United States Patent 9,328,346 (POLYCOMB-ASSOCIATED NON-CODING RNAS) - sequence listing, part 103

SEQ ID NO: 19728 - RNA, 2725 nt, Homo sapiens
uuuaggacacccccuaaauucuagcucagaccugagccuauggggagugggugucaugggcagagaagggggaucucuguccagccuguaacuagcuuacuugcuaaaaggacgagccgggacuuggggagaggaaagggagaauucagucucacggggccagaccgaauucuucuccagagggcaguugcugcuuuuggcugauuggguuuaccccgcugccugccuccccaucacguacuccccccgcaaccucgcucucucucuccuucucacacacacccucagcuccggaccucgccuaccggucagccccucuauucccagacagcuaccgcuacuccccuggcggguagggcggggugucggggauguaagguccgaggaagagggugggggauuccccugguggggguggacagacacgucagcccccgcagcagcguggaccgggggcgggagcgggggcggguggaggcuuaaauaggcggcucuggagccagagcccagugcgggcugagaaggcgguggcugcagcagcagcggcggcggaaacccuaaaguccgaguccggacuacgagugcguggccuccuaauccggauccuaguccugagcgugucugugugcgagugggugaguguccuggcggagcggggucggggcggcugcagauggaugcgccagguccggaggggucccgggugagggcgccgcgaccugggggcugggggagggcugcggcgggaccucggccggagcaucccgccugacuccggguugggcaggugcgccccgggucccgccucccucgcggcuuacacggccacucggguuccugauccccuagacggucccggacgcgaugacccugaacggcggcggcagcggagcgggcgggagccgcggugggggccaggagcgcgagcgccgucggggcagcacacccuggggccccgccccgccgcugcaccgccgcagcaugccgguggacgagcgcgaccugcaggcggcgcugaccccgggugcccugacggcggccgcggccgggacggggacccagggucccaggcuggacuggcccgaggacuccgaggacucgcucagcucagggggcagcgacucagacgagagcguuuacaaggugcugcugcugggggcgcccggcgugggcaagagcgcccuggcgcgcaucuucggcgguguggaggacgggccugaagcagaggcagcaggugaggggacccagcuguucaggggaggggcgaucccggggcuaggacuaggggcugagaccgguacucaaagccgcaaauaccguggaauuauaguuguuguuguuguuauuauuauuauuauuauuauuuuauuauuauuuugagacagaguuucgcucuuuuucccaggcuggagugcaguggccucgaucuaggcucacugcaaccuccgccuucagguuucaagggauucuccugccucagccuccagaguagcuaggauuacaggcgccugcuaccacgcccggcuaauauuuguguuuuuaguagaguugggguuucaccauguuggccaggcuggucuggaauuucugaccucgugauccgcccaccuuggcuucccaaagugcugggauuacaggcgugagccaccgcaccuggccaauacuguggaauucuauuggcgcuuucagaaucaugccucuaccuacccacuucauaaauggggaaaggaaaggagaagggacaccccccagccuuugguagggaagaaaugcccagaguagaaggccagggcauagauauggcuacucugugggaugggacuggacaucccucccugccuaucagggacaggucagaguuucuaaccagagggauuucuaagagaggagcccuagguggccaagguccccagggggggcauguggguggaggucaggcacaccaugcccuccagcccccacuucccugccuggcacugcuguugccacauaccagcaucugcaaguggaguggaggguaaggagggcucuggggaagaguuggaggguguggccagaacaggaaaccuggcagcagcggcuuugacaaccagcugguaaccugucuacuggccuucugccuagggcacaccuaugaucgcuccauuguaguggacggagaagaggcaucacucauggucuacgacauuugggagcagguagggugcaagcagagacccagggcaggggagggaggagugaguuggguuagaggucugggagugccaggcucgugucgggggcaugaggacuguugggcagauguguguuguguguucuccaggacgggggccgcugguugcccggccacugcauggccaugggggaugccuaugucauuguguacucagugacggacaagggcagcuucgagaaggccucagaacugcggguccagcugcggcgugcacggcaaacagaugaugugcccaucauccucgugggcaacaagagcgaccuggugcgcucucgugaggucucgguggauggugaguaggcggcagguugcagggggagggagagcccagcugggcccugauccaggcagucuuggcucagcuugagucccuggggaucaucagaggcuaaaaauguucagaaagaaaacuggcggggagggaaaugggagagagcuggugccugcucacagggcuccggaaggccccagagggcuggggaaagaacc

SEQ ID NO: 19729 - RNA, 2885 nt, Homo sapiens
gccuccagugggagacuggcauuguugugugaguucaggaggugaggaaagacuagguaggaccgugcacucauuugucccuuauguguggcuccaucccuggugcucagccacaccugggcccaggagagguugugggaagcauaauaucuguuuucagaugagcuauggcaaagugccugccagguucaugaauucaggcuguggcggccggagccccuccaccucccuguggggccuggccuugagagccucugcauacguccgcgucagccuaggggguuccaaauccagcagagugguaggauucccuaagucccugccaccacaccagaacacaccucugugcuacuaggaggaccagacauauccacugcucugggaccuguuggacaagagauggucaucuaccacccagccuuggcucgcucaaagggucaccauuacacggguuucaacugguuccagcaggguggaccgccaggagccaagcuuaacccccauccccugggauccuguggagacaggcaccuggugaucagggaagaaccacauacacggcaauaaucugggaaaccggcuccauucugggucugaguuaggagcuuggggcuguaguggggagcuaggagucccauuggaaggggccugcagcgacaggcuguggaugcgcacaggcuggcccaugcggcccgugcagcaggcgccacauaagccagaugucagcggccgagagcccgugcacuacaaccagcucacgguaaaagcaggggucgaaggugcucaaaugcggcgcggcugaaggcugggggaugccaaaggugcggaaggcagggugaggcucgggcgugagccgcaggcgcugcagacacaugcccagaaagacgucgucgauggggaagagcucgaccugcgcacaggcgccagccaggcggugcagcguggccccggaaagcacaaagccaccgccgcccgcguaggccggauaggcgggcaggccguacacggccucggggauguaguacuugcuagcccgcgugcggaugggccgcgcaugcacaauuacgucaccagcaagcaggucuugcgccgggucccgcggcgccaggaacuccaggagauuucccacguucacgaacacaucugcgucgcccuuaaaaacgaagcgcacgucggggcagaaagcugaggcccaggcuagaaaguggaucuccuugagcguuagguuaaaaaaggugucgucgaaggcccagagcaggauguccgcauacgcaaggcucucggcccgcagcagggcgcgccaguggguucgcgcgcccuccccaacuucgucggccccgcccgagccugcgccccugggcacgcccagcaagaacacgcggcgcaccagcgcccccugcacgcgacccuccgcgccccacgucuggcgcacggcuuggcgccgcucgaaguccucugccaccgacuugacagcaauaagcagguccgggcggccaccgggugcgccgucgccgcggcacuugugcggcugguuaaugagcaguggaaaccgccgcugguccuuggcgcgcaaauagcgggcgaagucaaagggucccguaggcgugggcggcgccgguguguccccuucguaggccggcggggcugcacccgcgucggguaacuggaacgcgcgggguccgggggugggccucggugccgcccucccucgcccucgcggcgcgcucgccgucggggccgcgccgucgcgcugcgcauagaguaagaggcccagggaggcgccaaggagcagcgugagcaaugcgucccugcguaggcgcagccuccuccucaucuccgcgcggccugcgcccucccuccccuguaagggucgcagucggcagcagggggcagcgagccccgcccuccccagcugagggggcgggaggccacgccccggggggggcuccagcgaccgacgguugagccccuugcguuguucuccuccucccggccgugucgcaccgccgggaccggcagccugaagggacaagaaguucacccauguagccaacucccccgcggccucagcuccggcccaggacugcgacccagggccgggcagggagacugggagccucggccccucccccgcccgccucccucgcgcugaggccgaaucccuuccacccugccauccccucaaugucgggcccuggggucccgacacucacgcucggcccucggaaguggcgcagccccggacgcccuggccuccggggcucagcgcaggguccgaggggccgccauggaccgggcccgagccaaaugcagcguuggcaggaagggggaccggugccgugccacgugacccuccagcugugcgcgcccagacuucuggagcucagcuccgccccggcgccaggagcacuccggccucagaguggggacuaaucccugagagggagccuccucacucucagucccucugggaagggcuggucugggugcucacaccccaaauucgccuuucuggggauugggaagaagcaucaacuccccugguuagcucccccaacuauccacuccccacucccgcgucucuggaguggggcggagccugggcugcuaggagccccugagcaggccgguuccaaaugcgcaugaaccuggccaccaucccgggcgggccucuccucagcagcccugauuccaucaggcagggugcauacgcugcccccgagacacauggcugucuucuuacuccugguucugccaugcuccccacccccaguaaacacacgcacgggacaaacaaggcagcccacccaauccucagggcaacucugccagcagcucucauucaugcccagauggggacacuggggggcucuucggggaguuaa

SEQ ID NO: 19730 - RNA, 2885 nt, Homo sapiens
uuaacuccccgaagagccccccaguguccccaucugggcaugaaugagagcugcuggcagaguugcccugaggauugggugggcugccuuguuugucccgugcguguguuuacuggggguggggagcauggcagaaccaggaguaagaagacagccaugugucucgggggcagcguaugcacccugccugauggaaucagggcugcugaggagaggcccgcccgggaugguggccagguucaugcgcauuuggaaccggccugcucaggggcuccuagcagcccaggcuccgccccacuccagagacgcgggaguggggaguggauaguugggggagcuaaccaggggaguugaugcuucuucccaauccccagaaaggcgaauuuggggugugagcacccagaccagcccuucccagagggacugagagugaggaggcucccucucagggauuaguccccacucugaggccggagugcuccuggcgccggggcggagcugagcuccagaagucugggcgcgcacagcuggagggucacguggcacggcaccggucccccuuccugccaacgcugcauuuggcucgggcccgguccauggcggccccucggacccugcgcugagccccggaggccagggcguccggggcugcgccacuuccgagggccgagcgugagugucgggaccccagggcccgacauugaggggauggcaggguggaagggauucggccucagcgcgagggaggcgggcgggggaggggccgaggcucccagucucccugcccggcccugggucgcaguccugggccggagcugaggccgcgggggaguuggcuacaugggugaacuucuugucccuucaggcugccggucccggcggugcgacacggccgggaggaggagaacaacgcaaggggcucaaccgucggucgcuggagccccccccggggcguggccucccgcccccucagcuggggagggcggggcucgcugcccccugcugccgacugcgacccuuacaggggagggagggcgcaggccgcgcggagaugaggaggaggcugcgccuacgcagggacgcauugcucacgcugcuccuuggcgccucccugggccucuuacucuaugcgcagcgcgacggcgcggccccgacggcgagcgcgccgcgagggcgagggagggcggcaccgaggcccacccccggaccccgcgcguuccaguuacccgacgcgggugcagccccgccggccuacgaaggggacacaccggcgccgcccacgccuacgggacccuuugacuucgcccgcuauuugcgcgccaaggaccagcggcgguuuccacugcucauuaaccagccgcacaagugccgcggcgacggcgcacccgguggccgcccggaccugcuuauugcugucaagucgguggcagaggacuucgagcggcgccaagccgugcgccagacguggggcgcggagggucgcgugcagggggcgcuggugcgccgcguguucuugcugggcgugcccaggggcgcaggcucgggcggggccgacgaaguuggggagggcgcgcgaacccacuggcgcgcccugcugcgggccgagagccuugcguaugcggacauccugcucugggccuucgacgacaccuuuuuuaaccuaacgcucaaggagauccacuuucuagccugggccucagcuuucugccccgacgugcgcuucguuuuuaagggcgacgcagauguguucgugaacgugggaaaucuccuggaguuccuggcgccgcgggacccggcgcaagaccugcuugcuggugacguaauugugcaugcgcggcccauccgcacgcgggcuagcaaguacuacauccccgaggccguguacggccugcccgccuauccggccuacgcgggcggcgguggcuuugugcuuuccggggccacgcugcaccgccuggcuggcgccugugcgcaggucgagcucuuccccaucgacgacgucuuucugggcaugugucugcagcgccugcggcucacgcccgagccucacccugccuuccgcaccuuuggcaucccccagccuucagccgcgccgcauuugagcaccuucgaccccugcuuuuaccgugagcugguuguagugcacgggcucucggccgcugacaucuggcuuauguggcgccugcugcacgggccgcaugggccagccugugcgcauccacagccugucgcugcaggccccuuccaaugggacuccuagcuccccacuacagccccaagcuccuaacucagacccagaauggagccgguuucccagauuauugccguguaugugguucuucccugaucaccaggugccugucuccacaggaucccaggggauggggguuaagcuuggcuccuggcgguccacccugcuggaaccaguugaaacccguguaauggugacccuuugagcgagccaaggcugggugguagaugaccaucucuuguccaacaggucccagagcaguggauaugucugguccuccuaguagcacagagguguguucuggugugguggcagggacuuagggaauccuaccacucugcuggauuuggaacccccuaggcugacgcggacguaugcagaggcucucaaggccaggccccacagggagguggaggggcuccggccgccacagccugaauucaugaaccuggcaggcacuuugccauagcucaucugaaaacagauauuaugcuucccacaaccucuccugggcccagguguggcugagcaccagggauggagccacacauaagggacaaaugagugcacgguccuaccuagucuuuccucaccuccugaacucacacaacaaugccagucucccacuggaggc

SEQ ID NO: 19731 - RNA, 3406 nt, Homo sapiens
agcguccagauacuagguuuuuaauagaggaaccccaggaggguggaggugcuuggggauccggugccuagcucccuugcuuaggcccggguccagggcuggcgcggggccgcugcaaucucugggaagcgggggcuucugggucgcgcucagcucugcaaugcaugcguucugugauccuggugaguugguauccuucucugaacuuccucugugacaggcagagaagaggggucgaugacaagauagauggaaagcaccuggaaauuggcaggcccugagugggcgcuggacguguggggccgcgggccgaacugcccccuccuggccucaucuccuggugcgccccggguggggagggaaagcugacuacaugcacguccccagccagcgcgcggccuccgcgguguggcuccuagugcccggggaagaacccucacccucccuauucccagcagcccuggccgccccgcccccgccgcagcugcugcacccacccccacccugcccggcccuuucugcaccgucaucuccugccccgccgaggcuugacccgugaguggggacgcccaaaacgggccagaccgggagccccacucccggcugugggagggaagggaaaccgagauugggcagaaucagcgccccaccacccgcugcggcgcucgggggucgggggggcgggguggguaggacugugggccccgcccugccgcaggacucucaagcucugggacuggguggagggagguaaggggcggggggggaaaauccgugcagucgcacaugcgcaaaggcucuucacugucccaagacccuggcuuccuggccaaagagcccgcgcagcgaggugggguugggggcugggacccagcuccgugccccgccaccuggcucucugggaagaaucggaccugucacccucgaaggacuggccgcuaaauaacuucgguauugagagcugugugagccucaaagggagggcccagaccagcuggagucucuacccccagacaggauaaagggcaggacuuggggucauaggaggaggcggcuaacaugaaaacaacuuagguuggagagaaggaggggccaauccaaucugcacccucccugugucugucccgaguaggugcugucccccucucccuuccuuugcccaccgauuggagggacacucuggaaaacucaguugaagaaagcggagagucugcguguacacagugcaaugaugucaguuaaugcacuagugagggcauguguuguucacgguacacagaagaaggaaccaccagcccuugggacacuuaggcauugguguagacaagggaacauuugaguccuggacgauggauagguccacggagcggagggaggagaaaaggauuccagucuuagcgaucagcaucagcaaaggcuccgaggugccagaggcauagugaguucuccgaucccuggcugguggagggaagcugggaagggccuggcuguccaggguggugggaggaggcuagaguagccagaccagauauuuuggguugucucugaugggcaguggggugugggggggagguagauagguauuuaggauggaauucugcuagacaggaaaauauaguucaguuccucauaguucaggcuggagcaaguaagauuccaguuuuaccacugaaucucugagccugucuccucaucuguaaaaugggaacagcaauccuagcccagaggguugucaaagucacugugcuaucgggccuggcagaaugggagugagaggggcucagagggacuguuacaggacaugaggugacgauggugggguggcaaggcaggagcugauggagacucacugagaaguggagaagcaagauucaucacauacgggacauaaagggagauggaggggcaggggguaguccuggucucggccugguggggaagggcuucaaugggaggaagccagggugugaagugacgggggagguauagugugacaccagaggguacugagaaagaccugggaggcaggauggcggcuaggacuaaauccucucucccagagaaggccgagccuccuagagccagagaaggaggcagaggagggacagcaaagggaagaagagaugggaggaugccgugugaacaaagccaaggcggggaggagaagaaguuauuaucagggugggggugggcugagggcaugguucaaggccugaugucuuugccuccuaaugccgggggucuugcuggcugggucaggccacucacaggaaugggccauaauccuugguugacaauaaauggacaaagcagcugggugcgguggcucaugccuguaaucccaacacuuugggaggccaagguggguggaucacgaggucaggaguucgagaccagccuagccaacauagugaaaccccgucucaacuaaaaacacaaaaaauuagcugagcguggugcgggcaccuguaaucucagcuacucgggaggcugaggcagaagaaucgcuugaacucaggaggcagagguugcagugaugagagaaugugccacugcacuccagccugggcaacagagugagacucugucaaaaaaaaaaaaaaaaaauggauaaagcagauugacucucccuaauagccgcuguugguagagauagucucucaagagccaggcauggugguucacauggugguucacaaagugcugguaaucccagcacuuuggaaggcugagaugggaggauugcuugaggccagcaguucgagaccagccugaucaauauagcaagaccaggacaggcgcgguggcucacgccuguaaucccagcacuuugggaggccaaggcagguggaucacgaggucaggaguucaagaccagccuggccaacauagugaaaccccgucuccacuaaaauaaauaaauacaaaaaauauauauagcaagaccccaccucuaaaaaaaaaaaaaaaaaaaaaggcugggcacgagaaucacuugagccugggaggcggagguugcagugagccaagauugcgccacugcacuccagcuugggcaacagcgagacuccaucucaaaaaaaaaaaaaaaaaagucucucaaaauagugcgauccauggaggaaaaucaguccaaguucggcaaguauuugucgguauccuguaugagcuaggccuuggguacuucaagaucaaacaacaaaugucuguagguaauucccaggucagcagggagccaggugggucagcagagagacagucacauuaggaguuagggcuucaguagggagacaggugggucucaggugaugucaagagaucuuggucagagcuaggccugaagaagauucugguaucucugcucaggaaucaggggaccaggaagggccaggagacuacauugggg

SEQ ID NO: 19732 - RNA, 3406 nt, Homo sapiens
ccccaauguagucuccuggcccuuccugguccccugauuccugagcagagauaccagaaucuucuucaggccuagcucugaccaagaucucuugacaucaccugagacccaccugucucccuacugaagcccuaacuccuaaugugacugucucucugcugacccaccuggcucccugcugaccugggaauuaccuacagacauuuguuguuugaucuugaaguacccaaggccuagcucauacaggauaccgacaaauacuugccgaacuuggacugauuuuccuccauggaucgcacuauuuugagagacuuuuuuuuuuuuuuuuuugagauggagucucgcuguugcccaagcuggagugcaguggcgcaaucuuggcucacugcaaccuccgccucccaggcucaagugauucucgugcccagccuuuuuuuuuuuuuuuuuuuuuagagguggggucuugcuauauauauuuuuuguauuuauuuauuuuaguggagacgggguuucacuauguuggccaggcuggucuugaacuccugaccucgugauccaccugccuuggccucccaaagugcugggauuacaggcgugagccaccgcgccuguccuggucuugcuauauugaucaggcuggucucgaacugcuggccucaagcaauccucccaucucagccuuccaaagugcugggauuaccagcacuuugugaaccaccaugugaaccaccaugccuggcucuugagagacuaucucuaccaacagcggcuauuagggagagucaaucugcuuuauccauuuuuuuuuuuuuuuuuugacagagucucacucuguugcccaggcuggagugcaguggcacauucucucaucacugcaaccucugccuccugaguucaagcgauucuucugccucagccucccgaguagcugagauuacaggugcccgcaccacgcucagcuaauuuuuuguguuuuuaguugagacgggguuucacuauguuggcuaggcuggucucgaacuccugaccucgugauccacccaccuuggccucccaaaguguugggauuacaggcaugagccaccgcacccagcugcuuuguccauuuauugucaaccaaggauuauggcccauuccugugaguggccugacccagccagcaagacccccggcauuaggaggcaaagacaucaggccuugaaccaugcccucagcccacccccacccugauaauaacuucuucuccuccccgccuuggcuuuguucacacggcauccucccaucucuucuucccuuugcugucccuccucugccuccuucucuggcucuaggaggcucggccuucucugggagagaggauuuaguccuagccgccauccugccucccaggucuuucucaguacccucuggugucacacuauaccucccccgucacuucacacccuggcuuccucccauugaagcccuuccccaccaggccgagaccaggacuacccccugccccuccaucucccuuuaugucccguaugugaugaaucuugcuucuccacuucucagugagucuccaucagcuccugccuugccaccccaccaucgucaccucauguccuguaacagucccucugagccccucucacucccauucugccaggcccgauagcacagugacuuugacaacccucugggcuaggauugcuguucccauuuuacagaugaggagacaggcucagagauucagugguaaaacuggaaucuuacuugcuccagccugaacuaugaggaacugaacuauauuuuccugucuagcagaauuccauccuaaauaccuaucuaccucccccccacaccccacugcccaucagagacaacccaaaauaucuggucuggcuacucuagccuccucccaccacccuggacagccaggcccuucccagcuucccuccaccagccagggaucggagaacucacuaugccucuggcaccucggagccuuugcugaugcugaucgcuaagacuggaauccuuuucuccucccuccgcuccguggaccuauccaucguccaggacucaaauguucccuugucuacaccaaugccuaagugucccaagggcuggugguuccuucuucuguguaccgugaacaacacaugcccucacuagugcauuaacugacaucauugcacuguguacacgcagacucuccgcuuucuucaacugaguuuuccagagugucccuccaaucggugggcaaaggaagggagagggggacagcaccuacucgggacagacacagggagggugcagauuggauuggccccuccuucucuccaaccuaaguuguuuucauguuagccgccuccuccuaugaccccaaguccugcccuuuauccugucuggggguagagacuccagcuggucugggcccucccuuugaggcucacacagcucucaauaccgaaguuauuuagcggccaguccuucgagggugacagguccgauucuucccagagagccagguggcggggcacggagcugggucccagcccccaaccccaccucgcugcgcgggcucuuuggccaggaagccagggucuugggacagugaagagccuuugcgcaugugcgacugcacggauuuuccccccccgccccuuaccucccuccacccagucccagagcuugagaguccugcggcagggcggggcccacaguccuacccaccccgcccccccgacccccgagcgccgcagcgggugguggggcgcugauucugcccaaucucgguuucccuucccucccacagccgggaguggggcucccggucuggcccguuuugggcguccccacucacgggucaagccucggcggggcaggagaugacggugcagaaagggccgggcagggugggggugggugcagcagcugcggcgggggcggggcggccagggcugcugggaauagggagggugaggguucuuccccgggcacuaggagccacaccgcggaggccgcgcgcuggcuggggacgugcauguagucagcuuucccuccccacccggggcgcaccaggagaugaggccaggagggggcaguucggcccgcggccccacacguccagcgcccacucagggccugccaauuuccaggugcuuuccaucuaucuugucaucgaccccucuucucugccugucacagaggaaguucagagaaggauaccaacucaccaggaucacagaacgcaugcauugcagagcugagcgcgacccagaagcccccgcuucccagagauugcagcggccccgcgccagcccuggacccgggccuaagcaagggagcuaggcaccggauccccaagcaccuccacccuccugggguuccucuauuaaaaaccuaguaucuggacgcu

SEQ ID NO: 19733 - RNA, 2540 nt, Homo sapiens
uuggcacaugcgaaggggucggugucuuccagguacugcacccucacggucaccacugauaccggcucuccguccccgcggucuuccccgcccgccauggcucugcggccggcucacgcagcgcgccuccgagucccggccccagugcagcuucuacucaaagcacacuguagcuccgcgguucgggcccggccggaccggacgcggcuggaggggcggggccagacggaggcggggccgaggaaggggguggagccaagauuaguccccgagugcgcgccaggagguaaccacugccggaggcggggccgccgcuagccacucacagggcccaaugggaaucccguuaguucacuggcuaggagggcgggaaaaaccgagcucgcgccccaccuucgagaacgcgcagaaggcggggaggcuuucuuuggucuggggauagugaggcugcguucucuuugagggguguuagggcagauggggcagaaguuucuuuagauaguggccggccaggucucucucaguugagggacaagauagcccucauuccuuccauuugaggggugagucccugugguuuccucauuuagggaaagcagugagagggggucccuucaauuuggagcaagaagugagaauaaauuccacccaguuugaaggaagaggugggaucaguucccuuuaguugugggaggaagagggaaggaugcccuucaguuuucugggaaaagauugggaggagucaguuugagggggcagauagaacacguuccccucaguuuuggagaaaaagugggaugggugccccucagccugaaugaaaaguggagacgguccuccucuguuuggggcgcuaugagccgaaugccccucagauuuggaaaaaguugggugcaucucgccuaguuugaagggaaucaguaggcuggguuuuccauagguuccugucagcuucaucaaagagaugagacaguucucuguagugugacugaaagggagggccaggugccccuugguuugggagaugaagaacagccucccucuucgccuggcacgagcugggccagucugggccuuaggguuucugggacguugggggcagcguuguccgucacugcuuuggggagcguccagugcgcgugcgcagcucagguccgggugggggccggcaggggguccugggcuuggcaacgugggcggagggcggccaagcacgguccccugcguuuugcacccggccgcgccuuggucccaggggggugcugcucgccgcacagcagcgcuggccgaggaggagccgugccccucccguccugaccgcgccccccgcagacccccgcccuucccgcugcgggcugccccaggggggccguggccgcgcaccgcucuggaucuggugggggcgguuuuggggagguuugggggcgcggacucgaaggaguagguuguggaacuugggggagagcugcacuggggaauuuccggagcugggacugauuuagggaggaaagaggagagaguccccgacuacgagaguccgaggcagggucucggagccuggaccuggcuuggggguaucggagccgggauuggggggagcgggccccacgugccugugacgcgggggcgcccgguagguggcggcggcgacgcggggccggcggccgugcggugccgggagggcggcugggcaggcggcaggaugcugcgcgccgcccugucccugcucgcgcugccccuggcgggggcggccgaagagcccacccagaagccagaguccccgggcgagccucccccaggcuuagagcucuuccgcuggcaguggcacgagguggaggcgcccuaccugguggcccuguggauccugguggccagucuggccaaaaucggugagugcgugugugcgugcgccaggccgaccgccagcggcggacccgcccccaacacccccaccuccucgguccucagauuggggcuggcuucuugcacggugcugggacuuagguuuggauuccacaaauccgggcucucgcccaguuccugcaucgcuucuugugggucccaggucccugucuucuccccugggagcucugaggauuugccuuucugaagggcugucccccgcucuccccaacuccaucuguaggcuccuuugcccucuccgcuccccucuuccccuugcaguaggcccucuucagucuggucucucccccaccaaucccuagccucccagaaaccucugucgcuggugaggauguguggggacauugaggggaggguguucucccaagaacacaggcauccugguucugaaaaagcagccuucccuggagaccauguccgaguguccauucccuugggaaacuacacugccacuuuuccuccagcucuccccugcuccccacuuaaagcugcugccuucuugugccuguguauggguacccccccaacccacguucagguccacauucuucucacuucaggguauaagaaacuuccguguaucggggccuuccugugugcugucuacccuagaugcu

SEQ ID NO: 19734 - RNA, 2540 nt, Homo sapiens
agcaucuaggguagacagcacacaggaaggccccgauacacggaaguuucuuauacccugaagugagaagaauguggaccugaacguggguuggggggguacccauacacaggcacaagaaggcagcagcuuuaaguggggagcaggggagagcuggaggaaaaguggcaguguaguuucccaagggaauggacacucggacauggucuccagggaaggcugcuuuuucagaaccaggaugccuguguucuugggagaacacccuccccucaauguccccacacauccucaccagcgacagagguuucugggaggcuagggauuggugggggagagaccagacugaagagggccuacugcaaggggaagaggggagcggagagggcaaaggagccuacagauggaguuggggagagcgggggacagcccuucagaaaggcaaauccucagagcucccaggggagaagacagggaccugggacccacaagaagcgaugcaggaacugggcgagagcccggauuuguggaauccaaaccuaagucccagcaccgugcaagaagccagccccaaucugaggaccgaggagguggggguguugggggcggguccgccgcuggcggucggccuggcgcacgcacacacgcacucaccgauuuuggccagacuggccaccaggauccacagggccaccagguagggcgccuccaccucgugccacugccagcggaagagcucuaagccugggggaggcucgcccggggacucuggcuucugggugggcucuucggccgcccccgccaggggcagcgcgagcagggacagggcggcgcgcagcauccugccgccugcccagccgcccucccggcaccgcacggccgccggccccgcgucgccgccgccaccuaccgggcgcccccgcgucacaggcacguggggcccgcuccccccaaucccggcuccgauacccccaagccagguccaggcuccgagacccugccucggacucucguagucggggacucucuccucuuuccucccuaaaucagucccagcuccggaaauuccccagugcagcucucccccaaguuccacaaccuacuccuucgaguccgcgcccccaaaccuccccaaaaccgcccccaccagauccagagcggugcgcggccacggccccccuggggcagcccgcagcgggaagggcgggggucugcggggggcgcggucaggacgggaggggcacggcuccuccucggccagcgcugcugugcggcgagcagcaccccccugggaccaaggcgcggccgggugcaaaacgcaggggaccgugcuuggccgcccuccgcccacguugccaagcccaggacccccugccggcccccacccggaccugagcugcgcacgcgcacuggacgcuccccaaagcagugacggacaacgcugcccccaacgucccagaaacccuaaggcccagacuggcccagcucgugccaggcgaagagggaggcuguucuucaucucccaaaccaaggggcaccuggcccucccuuucagucacacuacagagaacugucucaucucuuugaugaagcugacaggaaccuauggaaaacccagccuacugauucccuucaaacuaggcgagaugcacccaacuuuuuccaaaucugaggggcauucggcucauagcgccccaaacagaggaggaccgucuccacuuuucauucaggcugaggggcacccaucccacuuuuucuccaaaacugaggggaacguguucuaucugcccccucaaacugacuccucccaaucuuuucccagaaaacugaagggcauccuucccucuuccucccacaacuaaagggaacugaucccaccucuuccuucaaacuggguggaauuuauucucacuucuugcuccaaauugaagggacccccucucacugcuuucccuaaaugaggaaaccacagggacucaccccucaaauggaaggaaugagggcuaucuugucccucaacugagagagaccuggccggccacuaucuaaagaaacuucugccccaucugcccuaacaccccucaaagagaacgcagccucacuauccccagaccaaagaaagccuccccgccuucugcgcguucucgaagguggggcgcgagcucgguuuuucccgcccuccuagccagugaacuaacgggauucccauugggcccugugaguggcuagcggcggccccgccuccggcagugguuaccuccuggcgcgcacucggggacuaaucuuggcuccacccccuuccucggccccgccuccgucuggccccgccccuccagccgcguccgguccggccgggcccgaaccgcggagcuacagugugcuuugaguagaagcugcacuggggccgggacucggaggcgcgcugcgugagccggccgcagagccauggcgggcggggaagaccgcggggacggagagccgguaucaguggugaccgugagggugcaguaccuggaagacaccgaccccuucgcaugugccaa

SEQ ID NO: 19735 - RNA, 2654 nt, Homo sapiens
gugcggcgcguguacgggcgcgggcggcagcggcagcggcagcggagaccgggugagcaccggcugguuccucgcgguguuccugcaggcuuggcggccgcgguggugcgaucagcaaagggcaccgggaugccgguugugcguguccucaggugucccgaacaagcgugaguggcaugugcucaccugagcgcggcggcuuggcggccccgggcgugugggugggggcgcggcggagagcugaggccgggcacccgggcuggaccgacgggcccucucccaagcaccgcccgcagccaggcggcuccucgagcgcagcaacuuugggacuuuguuccggcuuuuuccaaaucgaaucuggucgagggggcggggcggggggggagcaccugcccugcggggggugccgggagagaagugaaggaaagccccgcccccgccccucccgcuccccgcccucucccccgcccccggggcucuucauaagcucggcccgagggcgagcagagaaagcgagugucccucucgcgccccaggccgguguacccccgcacuccgcgccccggccuagaagcucucucuccccgcuccccggcccggcccccgccccgccccgccccagcccgcugggccgccauggagcgcuggccuuggccgucgggcggcgccuggcugcucguggcugcccgcgcgcugcugcagcugcugcgcucagaccugcgucugggccgcccgcugcuggcggcgcuggcgcugcuggccgcgcucgacuggcugugccagcgccugcugcccccgccggccgcacucgccgugcuggccgccgccggcuggaucgcguugucccgccuggcgcgcccgcagcgccugccgguggccacucgcgcggugcucaucaccggugagugcgcgggucgcggagcgcggggacuccaggcucgagggcgggacuggacacucaacaggacugacuccccaugggcacagccaaggcgggcuccucagcgcaagagugggagaguucuccaccccugggugcagggagcgagccaaauagggagcgccgggcaccuccccaagcccggguucacuaccugccgcugcggggaguguuggagggaaagugagacagggagugggccgguucgagaaggaaacugacugguggcugagaagagggaaccuccuggaguuugagaguuuaugccauucccuuccccaagagagcagucucaggggacuucggaggccuugagaagggaggaucguuaccccuugaacucugccugacauccccaccuaagauacccaucucccauuccucgggccagagggaagagcuuagauggggaacuuccccaccccacccaucccccacuggcugggauccuuggaguucagaaaagcuagaggucaccgugaggggcagcuggacauucagcugucuuucugucuagccacccacugccaaacugcugaggcaguaguuuggagccuacacccagcaccccacccccaagcccuccugguccucugugcccaggaaggagcucuuagagagcugggcucaggugccucuggccgccuagcugagcuccuuugucuggagcagggaauaaaucugucaccagagggagggaaggggaaggggggggggggcuggaggcccgccggaaguggggagggggagaaaggccagggggcacugacuccauugcaucgugggaggagcagccuggucucucgccaauacccacggcuuuggacaggugcuccaggcuuuguccuugcgcugggccuuugcuggggcagccagcaaccuggcuucucagagaccucggucuaguaggggcccugugugaucagauggggcugggagaauuuuccggaggaggaaauccuugaguggggccuuggagcaugaguggagauaaguggaguaugaaagggaucucggaucagagaaaggaugugggacaaaggcuuaaggcaggaguacacacggucucuguaggggacagccagucuggguguggggguggggagaaggggauaugaggugguuuccuugggaggggccaugaaucagguaagaagccagacugcugaggcagaguaggggggaaggaggcacaagggccuugcacuccagcaaagaugguagagauggggaagcauucgggcuggacaggagagacccagguuccaggcgcagugugaagccucagcagaccccaguuucagagguuugaggaaggaaaaucaacagacaccccggguaugaaguaggggccagguugugggcucugccucuggggacagggcagaucccuuccugcuuuauuugugagccaccucaacaggacccaggccaucugcagguacuaguggccuagcuggguagucuuuccugaggucucaccucaggccuuugugcugcugcuguugcuucuggccuugagccugagagagaggugagaggaaggaugcuuucucuaacuugggcuccuccaaucucugguugcaaagcugggguugggggagagaggaccacccaaccugcccuguacaagcaucaguaagacuccaaguuucccagggcccgaacacuuggggguugucucucaacacccggcuggaagacaaguagguaa

SEQ ID NO: 19736 - RNA, 2654 nt, Homo sapiens
uuaccuacuugucuuccagccggguguugagagacaacccccaaguguucgggcccugggaaacuuggagucuuacugaugcuuguacagggcagguugggugguccucucucccccaaccccagcuuugcaaccagagauuggaggagcccaaguuagagaaagcauccuuccucucaccucucucucaggcucaaggccagaagcaacagcagcagcacaaaggccugaggugagaccucaggaaagacuacccagcuaggccacuaguaccugcagauggccuggguccuguugagguggcucacaaauaaagcaggaagggaucugcccuguccccagaggcagagcccacaaccuggccccuacuucauacccggggugucuguugauuuuccuuccucaaaccucugaaacuggggucugcugaggcuucacacugcgccuggaaccugggucucuccuguccagcccgaaugcuuccccaucucuaccaucuuugcuggagugcaaggcccuugugccuccuuccccccuacucugccucagcagucuggcuucuuaccugauucauggccccucccaaggaaaccaccucauauccccuucuccccacccccacacccagacuggcuguccccuacagagaccguguguacuccugccuuaagccuuugucccacauccuuucucugauccgagaucccuuucauacuccacuuaucuccacucaugcuccaaggccccacucaaggauuuccuccuccggaaaauucucccagccccaucugaucacacagggccccuacuagaccgaggucucugagaagccagguugcuggcugccccagcaaaggcccagcgcaaggacaaagccuggagcaccuguccaaagccguggguauuggcgagagaccaggcugcuccucccacgaugcaauggagucagugcccccuggccuuucucccccuccccacuuccggcgggccuccagccccccccccccuuccccuucccucccucuggugacagauuuauucccugcuccagacaaaggagcucagcuaggcggccagaggcaccugagcccagcucucuaagagcuccuuccugggcacagaggaccaggagggcuuggggguggggugcuggguguaggcuccaaacuacugccucagcaguuuggcaguggguggcuagacagaaagacagcugaauguccagcugccccucacggugaccucuagcuuuucugaacuccaaggaucccagccagugggggaugggugggguggggaaguuccccaucuaagcucuucccucuggcccgaggaaugggagauggguaucuuagguggggaugucaggcagaguucaagggguaacgauccucccuucucaaggccuccgaaguccccugagacugcucucuuggggaagggaauggcauaaacucucaaacuccaggagguucccucuucucagccaccagucaguuuccuucucgaaccggcccacucccugucucacuuucccuccaacacuccccgcagcggcagguagugaacccgggcuuggggaggugcccggcgcucccuauuuggcucgcucccugcacccagggguggagaacucucccacucuugcgcugaggagcccgccuuggcugugcccauggggagucaguccuguugaguguccagucccgcccucgagccuggaguccccgcgcuccgcgacccgcgcacucaccggugaugagcaccgcgcgaguggccaccggcaggcgcugcgggcgcgccaggcgggacaacgcgauccagccggcggcggccagcacggcgagugcggccggcgggggcagcaggcgcuggcacagccagucgagcgcggccagcagcgccagcgccgccagcagcgggcggcccagacgcaggucugagcgcagcagcugcagcagcgcgcgggcagccacgagcagccaggcgccgcccgacggccaaggccagcgcuccauggcggcccagcgggcuggggcggggcggggcgggggccgggccggggagcggggagagagagcuucuaggccggggcgcggagugcggggguacaccggccuggggcgcgagagggacacucgcuuucucugcucgcccucgggccgagcuuaugaagagccccgggggcgggggagagggcggggagcgggaggggcgggggcggggcuuuccuucacuucucucccggcaccccccgcagggcaggugcuccccccccgccccgcccccucgaccagauucgauuuggaaaaagccggaacaaagucccaaaguugcugcgcucgaggagccgccuggcugcgggcggugcuugggagagggcccgucgguccagcccgggugcccggccucagcucuccgccgcgcccccacccacacgcccggggccgccaagccgccgcgcucaggugagcacaugccacucacgcuuguucgggacaccugaggacacgcacaaccggcaucccggugcccuuugcugaucgcaccaccgcggccgccaagccugcaggaacaccgcgaggaaccagccggugcucacccggucuccgcugccgcugccgcugccgcccgcgcccguacacgcgccgcac

SEQ ID NO: 19737 - RNA, 2590 nt, Homo sapiens
cagcugggcaggcaggaagugaggguaggaggaaggaggcaggcugcaaagcugguucagccagauguucagcccuauccugccugggaauaagaggccacgccuguugagccuagcccuaugucccuuccccucaccccccaacccuguuccaguccacugucaccuccuccaggccaaaugagggcaaucacauauaaccgaagcccucaacacacacacuccaggaguuuggaguggggccagagcaaacaccuggagugggacaagcaggugggaaggggcggggcaaagcagguuaaaccugucuuugaccggguaccacccucagacaggugggggaggcccaggccugccugaggcccagaaggcucauggucaauggcagccccgccuccaggucugaccaaccgaggggcagagaaacuccaaggacagagcuccacacuuggacaucaggggcagcaugagcuuugacccacauccuauugaccggcuggcacugagcuguuugcucauagaggggguggcacuccugaggcugcccagcccucccccagccuccauccuugcuggagaaguauaaacacuaaucagugacccacgaacccucccugccaauucugugacacuuuacaacuuggggcugacagagcaaggcaacccagcucuccuccagcaaacuccccaagugaagggccgggagcccuucuggaacagacaaggaaucaucaucguggugccuccucaucaggaaccacaagaguuguuggaagaugaaagaacgugaguguauaaaaaggacuuacacuaauuacacucaagagucagacauagaaugagcgccguagugaagauaaggaaaagaaaacagcaauggaaaccaccucccacuucagcuagggcaggaggcaccccaggccuuugcacucagcaggcagauagucccccaggccaggccgggacagcgcccacgccuggccagccggccgggacaggccuagacgagcaguuuacaccuggcggcgucuaccucuagggccgacaccgcccuacgccuccgcuccagcagcucccaagcaggccgaagacgcgggccgcaaggacaggugaccuauaugggccccucgaccccuuucgcuuccggcugcggcucagggagaccugacccagcaggucucccaaaggcgucucggccucgcuccccgggcgggaacuggggauggaucccaaagccugcgucccgaucccuucgguaggaguagguuccugcaaugguugaaaaguaaggagcccaggggaauggcuggcacgcgcggaugaaaggggcacgcacacgcgagagucgcucaaaguuucaaacaagagcccaguccugccgccuggaccgguugguugcggcacgccaggccuagccuccggccgccaaucccgcccagaaauguccucacguccaggccaugccgccacccaccccggcgcucaccugcugcagcaccuuguccagcggcucugcccgcgccaggcugucggcgcucaggccgcucgccucgcggcacugcguacucagugcggccgccucggcacgaaccagcgauuugugcagcguccccaccugugagcggcgggggaaaccgaucagccgcgccccucgaccccggaagcucccuggggaccucaccgccucuuuuccacccuaccuggcggcuccgcggcucaaccacuugccaaacuaggaggauuaagucggucucguccgagcccaggucccgucccagcgcacccgccguagccccgaagaggacgaccagugauccgggccaggggcagggguccgcggcggggucggccgcggggucagggcccgggggagggggcggcggcggcggcggagucauggccgcagaggaagggggcucucggccagacacgcggaccgacgaggcgcacgcacgcaccgaccgaccgcagacgcggaucagcuugggcgggacaccguguaucgggggcggcaccugcggcccggcuggcucagugggcgcugccaagacccgcccguggcgccccgcggggcggggcggcuaccggcccacgcccucuccaggcgaguuaccugccggccccgccggccacgugaccggggcggcuccgggaaccuugggggagggccgccagaacucaacccaggacgcaagagcucacgcucccggccugggcgcacgcuuaggauccggauuccuacuuccagggcugguccugccugauuuugggggcuaacccauucuuccgcucuccccccacucuuccccaggggucgucaggccucugcaaaggagcgugcaagacagaggccuucuccaguauggaagucaccaggaggcagucuaggggcugugggggucaacacggcaggucugggguugauggaagucaaagggucaagggggcggugagaguugccggguaucacccuguagggggaucaccagaagucaccugggaaaggggagggcggcgggaacaucagcguuguuagagcugugggguggucaccagggaucacagggaagggcuuguccacgcagaugcu

SEQ ID NO: 19738 - RNA, 2590 nt, Homo sapiens
agcaucugcguggacaagcccuucccugugaucccuggugaccaccccacagcucuaacaacgcugauguucccgccgcccuccccuuucccaggugacuucuggugaucccccuacagggugauacccggcaacucucaccgcccccuugacccuuugacuuccaucaaccccagaccugccguguugacccccacagccccuagacugccuccuggugacuuccauacuggagaaggccucugucuugcacgcuccuuugcagaggccugacgaccccuggggaagaguggggggagagcggaagaauggguuagcccccaaaaucaggcaggaccagcccuggaaguaggaauccggauccuaagcgugcgcccaggccgggagcgugagcucuugcguccuggguugaguucuggcggcccucccccaagguucccggagccgccccggucacguggccggcggggccggcagguaacucgccuggagagggcgugggccgguagccgccccgccccgcggggcgccacgggcgggucuuggcagcgcccacugagccagccgggccgcaggugccgcccccgauacacggugucccgcccaagcugauccgcgucugcggucggucggugcgugcgugcgccucgucgguccgcgugucuggccgagagcccccuuccucugcggccaugacuccgccgccgccgccgcccccucccccgggcccugaccccgcggccgaccccgccgcggaccccugccccuggcccggaucacuggucguccucuucggggcuacggcgggugcgcugggacgggaccugggcucggacgagaccgacuuaauccuccuaguuuggcaagugguugagccgcggagccgccagguaggguggaaaagaggcggugagguccccagggagcuuccggggucgaggggcgcggcugaucgguuucccccgccgcucacagguggggacgcugcacaaaucgcugguucgugccgaggcggccgcacugaguacgcagugccgcgaggcgagcggccugagcgccgacagccuggcgcgggcagagccgcuggacaaggugcugcagcaggugagcgccgggguggguggcggcauggccuggacgugaggacauuucugggcgggauuggcggccggaggcuaggccuggcgugccgcaaccaaccgguccaggcggcaggacugggcucuuguuugaaacuuugagcgacucucgcgugugcgugccccuuucauccgcgcgugccagccauuccccugggcuccuuacuuuucaaccauugcaggaaccuacuccuaccgaagggaucgggacgcaggcuuugggauccauccccaguucccgcccggggagcgaggccgagacgccuuugggagaccugcugggucaggucucccugagccgcagccggaagcgaaaggggucgaggggcccauauaggucaccuguccuugcggcccgcgucuucggccugcuugggagcugcuggagcggaggcguagggcggugucggcccuagagguagacgccgccagguguaaacugcucgucuaggccugucccggccggcuggccaggcgugggcgcugucccggccuggccugggggacuaucugccugcugagugcaaaggccuggggugccuccugcccuagcugaagugggaggugguuuccauugcuguuuucuuuuccuuaucuucacuacggcgcucauucuaugucugacucuugaguguaauuaguguaaguccuuuuuauacacucacguucuuucaucuuccaacaacucuugugguuccugaugaggaggcaccacgaugaugauuccuugucuguuccagaagggcucccggcccuucacuuggggaguuugcuggaggagagcuggguugccuugcucugucagccccaaguuguaaagugucacagaauuggcagggaggguucgugggucacugauuaguguuuauacuucuccagcaaggauggaggcugggggagggcugggcagccucaggagugccacccccucuaugagcaaacagcucagugccagccggucaauaggaugugggucaaagcucaugcugccccugauguccaaguguggagcucuguccuuggaguuucucugccccucgguuggucagaccuggaggcggggcugccauugaccaugagccuucugggccucaggcaggccugggccucccccaccugucugagggugguacccggucaaagacagguuuaaccugcuuugccccgccccuucccaccugcuugucccacuccagguguuugcucuggccccacuccaaacuccuggaguguguguguugagggcuucgguuauaugugauugcccucauuuggccuggaggaggugacaguggacuggaacaggguuggggggugaggggaagggacauagggcuaggcucaacaggcguggccucuuauucccaggcaggauagggcugaacaucuggcugaaccagcuuugcagccugccuccuuccuccuacccucacuuccugccugcccagcug

SEQ ID NO: 19739 - RNA, 3020 nt, Homo sapiens
gaguaggugugccuggggucuuugcuugccugcggggacugaggugugaggucuguggcccagacugagcaauggugggcaggcaagucccugagccccuaaaacuugcgagaggagaaguuuauagacugcagcucaggugccuauaaauuuguugcagcuugggaagaagugauagaaauuauaucagguguauuuggaaaacagguaaacucuguuuuuugguuuuuuuuuuuuuuuuuuuuuuuuuuuuuuuuggagacggagucucgcucugcugcccaagcuggagugcaguggugcgauuucagcucacugcaaccuccaccugcgggguucaagcgauucuccugccucagccucccgaguagcugggauuacgggcauggugcccguaacgccgaaagugcugagauuacaggcuugagccacggcgcccggccacucauuuuuuaaaaacuaguuauuaauuauaauuucucuucaaguuuuccugagauguaaaaacucaucgccuucagcugguucuaaacuucuugucucugcuaacaacucuccccccuccucgaucucaccccaccccagugcaccccaacucacuucaucucacuuuacucgagucuagcacuaucuuuuagggaccugaaaacuacugucgauaaggucaguugggaauuuaggaggucauggaugucggaaauaaaggugugaaaaagaagaggaggaauuguuuuggcuuuaagacaccggaaccuccaagguuccuacaaaaccguuugcagcuuuugcaaaccgccuuaaagucaucagcgccccacugcggaauucaaagcuaagcugucacaauuguuaacaccuucuuugaccagccuuuuuacauuugacaauucucuucagcgccucuuuccugccagcaggaagguuuugcugccuuggcuuucgggagcccccuagacagcgaacugccccuucgcgugcagaagucggggaagagugcucucagcucgccuuccuugcagggugaguagguuuugcggguuagagagcggggcgugggggcggggagggagaguaacaauuuuggaagucccugcgugguaucuggaaaguuaacgacgcuucagguucuagguugagcccaaugaccgucuugccuuggcagcuggucccagggcgauugcagagccgcguggccuucggccccacucgggggacccagcuucggagagggcgcaggggcugcgagucuugcgagccggagccgcguccacccgggacuaggcguccccgccgagcgcuggcuuguggcgcucccugggaccgcgcggggucgggggugcgcccgcgggggcccucccacucuggucaacuuucccggccccagggccgggggaggcgccucuccuggcgggcacgcgccggguacuuaagggcggcucggcugggcaggcggcagucggagcgcgcggcggcgcggagcggagcgggaggaggggcauggagccgccgcgggccugcugagcuccggagcgcggcagccggcggcacggugagcgcgggccggccggcacccaggaggggagggccgcgcggggcugcgccgaggccggggcgcgccggguggcaggggugccucucgccgagccccccgcacccggccagcucccagcccugcgggcgccgcguccggcgcggggaggcggguugggggcggcggcagccccgggcuucccggcggccguuccugcagcccccuccccacugaccccuccucccuuucuuccugcauccucuccucuuccagccucgccucccuccuccccggcggcuccuguuuugugaaugaauuaggaggcggacgccggugcggggcuccaggcuggcugggguaccccucccccgcaccuucuacgaccucccggggguuugcaccuguccgggcaccaagguaccaggcgcccacguuccugcggguuagccgggccgcggcagcacguguccgggggagugggcuccccuccccuggccggccuggaggggcccggagggcggccgggcacaagaggaggagccccguugggcgcacaaguuuccaugccgcugcguguggcccugccgcggggcgcaccugucagcgggagagacgcugcacaccagcagccccucaaaguuucggaggcuugauggagaagcgugcguccuugacuggggguucuccuuccguaguccugggagccggacuugagagcgcccccaaccuugugcccuugaaagccgagugcgcguuaguuugccugggcugggcucccguggaugagcgaagggcaugaggaggcggcgguccaggcuguaggaucaccccacagccucugccggcuuggggugacacagccccccgccccaggucugggcaggagaaccucgaccacagccugcaccagcgccugauugcacgugggguaucuggcugagggacauuuugggggccucuauuuggggguggggguaguaaccuggguaaugccucuaauuccugcgggggaggggucccgcccagggaaggagagggccggcuacaccggggaugcgccuuugucuacaggcacacuuugccaagguagcugggguaccaggaagagcagggccugguccgacugggaucccuuggguuuuccguuccuucccgguugggucgugggaaagcggcacguggguguggccggcgccgccuuugccaagaggcgaggcucgagcggggaugagaagcguggcgagugcguucgcggcugcuuugaccuggugggcgccgccuccggcacugcaccgaggcggggcgccagcgcccagguugcugggcuggccuuggcgcccccuuccccuacccagagcgcaggcaggcaggggggucccgccgcgccccuucagcauguaagcuccggaggggaaugggggcgcuccuaggcugcggaugcaggccuggggacuccugggccgcaggcgcgagcaguaggguggcaaca

SEQ ID NO: 19740 - RNA, 3020 nt, Homo sapiens
uguugccacccuacugcucgcgccugcggcccaggaguccccaggccugcauccgcagccuaggagcgcccccauuccccuccggagcuuacaugcugaaggggcgcggcgggaccccccugccugccugcgcucuggguaggggaagggggcgccaaggccagcccagcaaccugggcgcuggcgccccgccucggugcagugccggaggcggcgcccaccaggucaaagcagccgcgaacgcacucgccacgcuucucauccccgcucgagccucgccucuuggcaaaggcggcgccggccacacccacgugccgcuuucccacgacccaaccgggaaggaacggaaaacccaagggaucccagucggaccaggcccugcucuuccugguaccccagcuaccuuggcaaagugugccuguagacaaaggcgcauccccgguguagccggcccucuccuucccugggcgggaccccucccccgcaggaauuagaggcauuacccagguuacuacccccacccccaaauagaggcccccaaaaugucccucagccagauaccccacgugcaaucaggcgcuggugcaggcuguggucgagguucuccugcccagaccuggggcggggggcugugucaccccaagccggcagaggcuguggggugauccuacagccuggaccgccgccuccucaugcccuucgcucauccacgggagcccagcccaggcaaacuaacgcgcacucggcuuucaagggcacaagguugggggcgcucucaaguccggcucccaggacuacggaaggagaacccccagucaaggacgcacgcuucuccaucaagccuccgaaacuuugaggggcugcuggugugcagcgucucucccgcugacaggugcgccccgcggcagggccacacgcagcggcauggaaacuugugcgcccaacggggcuccuccucuugugcccggccgcccuccgggccccuccaggccggccaggggaggggagcccacucccccggacacgugcugccgcggcccggcuaacccgcaggaacgugggcgccugguaccuuggugcccggacaggugcaaacccccgggaggucguagaaggugcgggggagggguaccccagccagccuggagccccgcaccggcguccgccuccuaauucauucacaaaacaggagccgccggggaggagggaggcgaggcuggaagaggagaggaugcaggaagaaagggaggaggggucaguggggagggggcugcaggaacggccgccgggaagcccggggcugccgccgcccccaacccgccuccccgcgccggacgcggcgcccgcagggcugggagcuggccgggugcggggggcucggcgagaggcaccccugccacccggcgcgccccggccucggcgcagccccgcgcggcccuccccuccugggugccggccggcccgcgcucaccgugccgccggcugccgcgcuccggagcucagcaggcccgcggcggcuccaugccccuccucccgcuccgcuccgcgccgccgcgcgcuccgacugccgccugcccagccgagccgcccuuaaguacccggcgcgugcccgccaggagaggcgccucccccggcccuggggccgggaaaguugaccagagugggagggcccccgcgggcgcacccccgaccccgcgcggucccagggagcgccacaagccagcgcucggcggggacgccuagucccggguggacgcggcuccggcucgcaagacucgcagccccugcgcccucuccgaagcugggucccccgaguggggccgaaggccacgcggcucugcaaucgcccugggaccagcugccaaggcaagacggucauugggcucaaccuagaaccugaagcgucguuaacuuuccagauaccacgcagggacuuccaaaauuguuacucucccuccccgcccccacgccccgcucucuaacccgcaaaaccuacucacccugcaaggaaggcgagcugagagcacucuuccccgacuucugcacgcgaaggggcaguucgcugucuagggggcucccgaaagccaaggcagcaaaaccuuccugcuggcaggaaagaggcgcugaagagaauugucaaauguaaaaaggcuggucaaagaagguguuaacaauugugacagcuuagcuuugaauuccgcaguggggcgcugaugacuuuaaggcgguuugcaaaagcugcaaacgguuuuguaggaaccuuggagguuccggugucuuaaagccaaaacaauuccuccucuucuuuuucacaccuuuauuuccgacauccaugaccuccuaaauucccaacugaccuuaucgacaguaguuuucaggucccuaaaagauagugcuagacucgaguaaagugagaugaagugaguuggggugcacugggguggggugagaucgaggaggggggagaguuguuagcagagacaagaaguuuagaaccagcugaaggcgaugaguuuuuacaucucaggaaaacuugaagagaaauuauaauuaauaacuaguuuuuaaaaaaugaguggccgggcgccguggcucaagccuguaaucucagcacuuucggcguuacgggcaccaugcccguaaucccagcuacucgggaggcugaggcaggagaaucgcuugaaccccgcagguggagguugcagugagcugaaaucgcaccacugcacuccagcuugggcagcagagcgagacuccgucuccaaaaaaaaaaaaaaaaaaaaaaaaaaaaaaaaccaaaaaacagaguuuaccuguuuuccaaauacaccugauauaauuucuaucacuucuucccaagcugcaacaaauuuauaggcaccugagcugcagucuauaaacuucuccucucgcaaguuuuaggggcucagggacuugccugcccaccauugcucagucugggccacagaccucacaccucaguccccgcaggcaagcaaagaccccaggcacaccuacuc

SEQ ID NO: 19741 - RNA, 2887 nt, Homo sapiens
gcagcccuagcauuuucugucccuucucuccuugcuuuaugcagcacauccugggcuuuguccaagauucaacagggggcugcauucuacuugccaggcucccacagucuuucuagaacaucaugucucucuuagguuugaaauuuuucaaacuuuuagcaugcacaggaggccccuguucaucucucuacacucacaaccucaugcucgcagacccagccauacugaacuacccccuuccccucaaaagaugacugcuuuuccaugccucuggguuacuacagaagcuauucuucuccuugggacaccuuuccucuuccuccucagucuuccuuuuuuuuuuuuuguuuugagauggagucucacucugucacccaggcuggagugcagugucgagaucucagcucacugcaaccuccgccucccagguucaagcaguccucccaccucagccucccgaguagcugagauuacaggcgugcgccaccgcgcucugcuaauuuuuuuguauguuuaguagagaugggguuucgcaguguuggccaggcuggucucgaacuccuuaccuccaaugaucugcccgcuucggccucccaaaguucugggauuacaggugugagccaccgcguccggcucggacagugguuuuuaaagaaaccuaaaaaugcagcucugaauucucccagguccugcaguugcaagugcaaugggcuuuagucagggaaacaacagcuguuucccugggcgaagcuuugacuguaucugggcgcacccuuuguuaugcuaguuaguuuuagauaauguaacauaaacucaggauaggagcucucccgcuguguggacauagcagggagacagacuggacucagccuccaagucccugggagaggggagccugacuccucccuagaggagaggccaggugucaaaaaccagaagcagucgucaccucggaccugucuccuguuggagcuggcaggggagauaucccaucugcucacaguucaccguguggggcacauuaucuggguauucaauggauggaaaaaacaccaggucccuaggaggcgguguggggaccagguccccucuugucuucccuuccccccccacccuccccuagcucacagagucuuccaguacacccugaaccuuucuccuuacaaggggccuaugggaauucugugcaaggcagagauggcaaaguuuuuucauuaggagggugcggucucaagcagccgugggauucgaaugacgcugccuagagagaccucacuggcaaaagggaaaacaaaccuguacccuucagugggagaauuuuacguagacuuuguucuuugguuaaaaauguagcgucucccaucugacuuuuuuuuuuuuuuuugagacggagucucgcuuugucgcccaggcuggagugcaguggugcgaucucggcucacugcaaccuccgccucccggguucaagcgauucucccuccucagccucccaaguagcugggauuacaggcaucugccaucacgccuggcuaaguuuuuguauuuuuaguaaagacgggguuucaccauguuggccaggcuggucucgaacuccuggccucaggugauccgcccgccucggccucccaaaguguugggauuacaggcaugagccaccgcgccggcccaccuguuucugaaggcaccuauuccugggagggguaacacauuaaacuauuaacucuucaucgggcuucccaagugggcggcccggccacaaggaaggggacuuuggagucgggaagggcuggcucuggaacacgggacaagggucugaaccccaaggcgcaguccugugaccaugcgggccgggccggggaggagccuggggugaaccccacccgccuggucuccucccaccccucccucucgggucccggggccucucuuucucuucuccagguccuccagcccagccacugcucacaggggugguuuuugcuuuguuaguuggguucaggccacgagaagggggaacccuaaaguuuuccuucccugccaggucgccucugagagcgcagaagggagaaacggcauuuguucauuuaaacgggcuccuaggacgagaacccggggacgccagggccucgcgggccggccugggccacagguguccccggcgcggaggucgcagcgccccggccccucucaccuuucgggucugcggcgcccggggucucccuuccucugcggcugcggcggcuccggggcuucccagggcgcgggcccaggaggcgcggcugcgucccaggucaguccccgggcuccgucccgcguccggcuuuggcgcgguuuuucccaaacuccguguucaccugcgcgagggcccgcgucccugugugugucccggcgggggccucgguccgggucucuuucccucucucucucccucucccggucccgguuccggucgcgguucccgucccucuccuggucucucuccgggucccgguccccgucccuucgccgguucccgucgcugcuucgcuuccugcgcggguccccgggucggucccgcggucgaucgugggugcggccuuggucugggugggggcgccgucccgggucccgcucucucggccgggcccggggcucgcgagcccccgacggaucuuccauggccggguuccguguccccgcccgggagcgaccugagggcaacaaccaacaaguuucuugggcagguggccaagcccgggggcggggcgggcacucaccugugcgcaugcgcgcuaguccgggagcucaccugagaacgggcgcccucagggggcggccugagcgcgucuggggcccgggcgggaggggugccugugugcugggugggggcuggggugcugcugcugga

SEQ ID NO: 19742 - RNA, 2887 nt, Homo sapiens
uccagcagcagcaccccagcccccacccagcacacaggcaccccucccgcccgggccccagacgcgcucaggccgcccccugagggcgcccguucucaggugagcucccggacuagcgcgcaugcgcacaggugagugcccgccccgcccccgggcuuggccaccugcccaagaaacuuguugguuguugcccucaggucgcucccgggcggggacacggaacccggccauggaagauccgucgggggcucgcgagccccgggcccggccgagagagcgggacccgggacggcgcccccacccagaccaaggccgcacccacgaucgaccgcgggaccgacccggggacccgcgcaggaagcgaagcagcgacgggaaccggcgaagggacggggaccgggacccggagagagaccaggagagggacgggaaccgcgaccggaaccgggaccgggagagggagagagagagggaaagagacccggaccgaggcccccgccgggacacacacagggacgcgggcccucgcgcaggugaacacggaguuugggaaaaaccgcgccaaagccggacgcgggacggagcccggggacugaccugggacgcagccgcgccuccugggcccgcgcccugggaagccccggagccgccgcagccgcagaggaagggagaccccgggcgccgcagacccgaaaggugagaggggccggggcgcugcgaccuccgcgccggggacaccuguggcccaggccggcccgcgaggcccuggcguccccggguucucguccuaggagcccguuuaaaugaacaaaugccguuucucccuucugcgcucucagaggcgaccuggcagggaaggaaaacuuuaggguucccccuucucguggccugaacccaacuaacaaagcaaaaaccaccccugugagcaguggcugggcuggaggaccuggagaagagaaagagaggccccgggacccgagagggaggggugggaggagaccaggcgggugggguucaccccaggcuccuccccggcccggcccgcauggucacaggacugcgccuugggguucagacccuugucccguguuccagagccagcccuucccgacuccaaaguccccuuccuuguggccgggccgcccacuugggaagcccgaugaagaguuaauaguuuaauguguuaccccucccaggaauaggugccuucagaaacaggugggccggcgcgguggcucaugccuguaaucccaacacuuugggaggccgaggcgggcggaucaccugaggccaggaguucgagaccagccuggccaacauggugaaaccccgucuuuacuaaaaauacaaaaacuuagccaggcgugauggcagaugccuguaaucccagcuacuugggaggcugaggagggagaaucgcuugaacccgggaggcggagguugcagugagccgagaucgcaccacugcacuccagccugggcgacaaagcgagacuccgucucaaaaaaaaaaaaaaaagucagaugggagacgcuacauuuuuaaccaaagaacaaagucuacguaaaauucucccacugaaggguacagguuuguuuucccuuuugccagugaggucucucuaggcagcgucauucgaaucccacggcugcuugagaccgcacccuccuaaugaaaaaacuuugccaucucugccuugcacagaauucccauaggccccuuguaaggagaaagguucaggguguacuggaagacucugugagcuaggggaggguggggggggaagggaagacaagaggggaccugguccccacaccgccuccuagggaccugguguuuuuuccauccauugaauacccagauaaugugccccacacggugaacugugagcagaugggauaucuccccugccagcuccaacaggagacagguccgaggugacgacugcuucugguuuuugacaccuggccucuccucuagggaggagucaggcuccccucucccagggacuuggaggcugaguccagucugucucccugcuauguccacacagcgggagagcuccuauccugaguuuauguuacauuaucuaaaacuaacuagcauaacaaagggugcgcccagauacagucaaagcuucgcccagggaaacagcuguuguuucccugacuaaagcccauugcacuugcaacugcaggaccugggagaauucagagcugcauuuuuagguuucuuuaaaaaccacuguccgagccggacgcgguggcucacaccuguaaucccagaacuuugggaggccgaagcgggcagaucauuggagguaaggaguucgagaccagccuggccaacacugcgaaaccccaucucuacuaaacauacaaaaaaauuagcagagcgcgguggcgcacgccuguaaucucagcuacucgggaggcugaggugggaggacugcuugaaccugggaggcggagguugcagugagcugagaucucgacacugcacuccagccugggugacagagugagacuccaucucaaaacaaaaaaaaaaaaaggaagacugaggaggaagaggaaaggugucccaaggagaagaauagcuucuguaguaacccagaggcauggaaaagcagucaucuuuugaggggaaggggguaguucaguauggcugggucugcgagcaugagguugugaguguagagagaugaacaggggccuccugugcaugcuaaaaguuugaaaaauuucaaaccuaagagagacaugauguucuagaaagacugugggagccuggcaaguagaaugcagcccccuguugaaucuuggacaaagcccaggaugugcugcauaaagcaaggagagaagggacagaaaaugcuagggcugc

SEQ ID NO: 19743 - RNA, 2473 nt, Homo sapiens
cggguggcaucggcaccacuuggagaaggagccaaggaacuuggaaggguccgaacuugaggaaggucugugccugcgaugaaacgucccaaggcgggcggcuccacgauaccccgcgcccugcugugugcgguguaugccacccauccagcccaugcaccgaccccaucccgccacuguacccacugccugucuuuagaagcgcgagaagccccccgccccagaccaaaggccagaagauaucguggagccccugcccgggggccgaggcccaaccgccagucccgcuccugcgugggcagggcgggccccgcccagcgccgccccccgacccucgguggcgcccgcgcccgucggccccgcucgccggaccagucuggcagcgcccgggcucggauuucaaagcccugguuucuggccgugaaugggccugcgcccgcgcggccguucccacagcccccucccgcgcggcccgcccuccuucccucccuccucgcgguccccccuccgccgcgcccacgugacgcccgauccucggcggcucggauuaccgccgccgucaguccccgcgccgaggcugcgccgcgagcugcccgcgccgcgccccccgcgccgcccgccagccccgcugcgacauggcccgcgccgcccgccggaggcccgcgaccccggagcgcggcgcggccggccgcugagcgcagccuggaggcgggaggcccggcccggccucggagcgagcgcccgcgcggccuggcccccucccuugcgcugcuccccgcgcuccgugcgccuagccgccgccgcggcccggcccagccagagcauggagacggcggagaaggagugcggcgcccugggcgggcucuuccaggccauagucaacgacaugaagguaaccggggcgcggcggggccgggcgcgcggcgacgggugcgggaccccccggggacgcguggcggcggguggccgagccucguguggccgcgcgccgcggugucuguguguccuugucugagcgcguccugccugcgucugcugggcgcccgugucuccgggugcccgucugggggugugggugcucgugugucgggguguccgugcggugcccgcgguggccccgugggguccugacccgagccugugcacacgcaggcucccugcgccccagaccgccaaaccaugaaugggguuuggauccaggaccgacucuagggcccuuuaacgaguccggggucuuaccggccuccgcccccuuccaccaccauguucccccacggccccggagcccagacaaugcugucaccgccaaagcaggaaaaaauaauaaagcggagaaccguuaacuccuuccccgccgaccuaggccucugcacccgaccgugagacugcgucccccagccccgccccacccccacagccccaggaagcuccaggacuccaaggucuccaggcugaaugucccugcaucccaaggauaggccuugaucaucaccuugggaggaggcgggaugaagguuggggucgguggagcaaccccaaggaagcgcuuuuccuaccccauuaccacccugggcucucagcuccgagcccuccuugucucccaggauugcuuaaggucaggcuggauccaaccacccauucauuccucaccccaccagguggggaaacugaggccuggaaauggcucaaggucacuaaggagacuauuggacccuuccccugaccucagcccccauuuuuccuccugggaaaauuaguggguuccucuccccaaaugaggccaggguuuggcagggcugcccuacgcugacuaggcagagagggcccagcuccagugauagggugggggccaggaaccaguauuccugcccuccugccgugcccccuuuccuuagccuaggaugaaggggcaggauuugggggcugggagaaggggaaagaacgaggcaccccacaggaucucccaagggcccccacccccacagcccagcgcagauucuccaagugcacaacacagaaucccaccaggccagggaugggggugacaccacccaguacagugcugcuaggacaggccccgugagggguggggguugcuggcagguuggaguucgaggcucccggugcugccaggacaacagccccagggacagcugccagaucucugcccccggaagaggccugaagccagccuggccugggacuacccaguuagcggcuuguagaugccccccacccccugccccucauggugcacucccccugggacccccaucucuugcaacuguacaucugggccccuccgcuggcccccagcaguccccaccuguccuguggacaucacagcccuggccccaggauccuguuaagggacugggcaacacagaccacccuccccuggccgaucccagagcuggcuccggaugggccuucccgcaccccaccacccaccaccacuggcagccucauagca

SEQ ID NO: 19744 - RNA, 2473 nt, Homo sapiens
ugcuaugaggcugccagugguggugggugguggggugcgggaaggcccauccggagccagcucugggaucggccaggggaggguggucuguguugcccagucccuuaacaggauccuggggccagggcugugauguccacaggacagguggggacugcugggggccagcggaggggcccagauguacaguugcaagagaugggggucccagggggagugcaccaugaggggcaggggguggggggcaucuacaagccgcuaacuggguagucccaggccaggcuggcuucaggccucuuccgggggcagagaucuggcagcugucccuggggcuguuguccuggcagcaccgggagccucgaacuccaaccugccagcaacccccaccccucacggggccuguccuagcagcacuguacuggguggugucacccccaucccuggccuggugggauucuguguugugcacuuggagaaucugcgcugggcugugggggugggggcccuugggagauccuguggggugccucguucuuuccccuucucccagcccccaaauccugccccuucauccuaggcuaaggaaagggggcacggcaggagggcaggaauacugguuccuggcccccacccuaucacuggagcugggcccucucugccuagucagcguagggcagcccugccaaacccuggccucauuuggggagaggaacccacuaauuuucccaggaggaaaaaugggggcugaggucaggggaaggguccaauagucuccuuagugaccuugagccauuuccaggccucaguuuccccaccugguggggugaggaaugaaugggugguuggauccagccugaccuuaagcaauccugggagacaaggagggcucggagcugagagcccagggugguaaugggguaggaaaagcgcuuccuugggguugcuccaccgaccccaaccuucaucccgccuccucccaaggugaugaucaaggccuauccuugggaugcagggacauucagccuggagaccuuggaguccuggagcuuccuggggcuguggggguggggcggggcugggggacgcagucucacggucgggugcagaggccuaggucggcggggaaggaguuaacgguucuccgcuuuauuauuuuuuccugcuuuggcggugacagcauugucugggcuccggggccgugggggaacauggugguggaagggggcggaggccgguaagaccccggacucguuaaagggcccuagagucgguccuggauccaaaccccauucaugguuuggcggucuggggcgcagggagccugcgugugcacaggcucgggucaggaccccacggggccaccgcgggcaccgcacggacaccccgacacacgagcacccacacccccagacgggcacccggagacacgggcgcccagcagacgcaggcaggacgcgcucagacaaggacacacagacaccgcggcgcgcggccacacgaggcucggccacccgccgccacgcguccccggggggucccgcacccgucgccgcgcgcccggccccgccgcgccccgguuaccuucaugucguugacuauggccuggaagagcccgcccagggcgccgcacuccuucuccgccgucuccaugcucuggcugggccgggccgcggcggcggcuaggcgcacggagcgcggggagcagcgcaagggagggggccaggccgcgcgggcgcucgcuccgaggccgggccgggccucccgccuccaggcugcgcucagcggccggccgcgccgcgcuccggggucgcgggccuccggcgggcggcgcgggccaugucgcagcggggcuggcgggcggcgcggggggcgcggcgcgggcagcucgcggcgcagccucggcgcggggacugacggcggcgguaauccgagccgccgaggaucgggcgucacgugggcgcggcggaggggggaccgcgaggagggagggaaggagggcgggccgcgcgggagggggcugugggaacggccgcgcgggcgcaggcccauucacggccagaaaccagggcuuugaaauccgagcccgggcgcugccagacugguccggcgagcggggccgacgggcgcgggcgccaccgagggucggggggcggcgcugggcggggcccgcccugcccacgcaggagcgggacuggcgguugggccucggcccccgggcaggggcuccacgauaucuucuggccuuuggucuggggcggggggcuucucgcgcuucuaaagacaggcaguggguacaguggcgggauggggucggugcaugggcuggauggguggcauacaccgcacacagcagggcgcgggguaucguggagccgcccgccuugggacguuucaucgcaggcacagaccuuccucaaguucggacccuuccaaguuccuuggcuccuucuccaaguggugccgaugccacccg

SEQ ID NO: 19745 - RNA, 3086 nt, Homo sapiens
ucuuaaagaacauauuagcuucuucccaugagaucaggaaaacgggacaucaauugucugggguucuuugcuccugacucccuuuggggcuggcacuauguugaucacguuuuacagauggggaaacugaggcugucgguuuuuaaguggucugccuaagguagcaguaaggguuggucugacuccagcgcagccucaacgagggcuucaaauuagggccaugaauuggcaauuccuggcggguaauugugaagaguauauuuauuuuuaauuuuuauuuauuuauuuuugagacggagugucucucggccacacccauccuagcucauugcugucucgaacucucgagcucagacgauccucccgucuaggcuucccaaagagcugggaugacaggcgugagcccgggcgcccggccgggaguguguuaaguauacggcaaacaccuggacugcggccggcucuccaggaaugccaugauauuggggaauucccuuugcaccuggccaaguggccucgggcagguagccuccccucggguugccucaguuucuucuuuggcacgcagaggcggggcuccaggccugggccgcuccauggcggggagggcgcggggacgcugcacucggggugcgcuccgagaggcggacccggcugggcgcgccuggggcggggcgaggcggggcgaggcugggcggugcggggggcggcccccgaggaucacguggcgcggcgccgcggccgaagcagaaguagcgagcgccggcggcggagggcgugagcggcgcugagugacccgagucgggacgcgggcugcgcgcgcgggaccccggagcccaaacccggggcaggcgggcagcugugcccgggcggcacggccaggugagcugcccggccgggagcgaggcaggcagggcgcccagggaccugcgccccgcggggaccggcucccagggcgcugcguccgagggggucugcguccuggcucagccggagcgggcagggacggggcgcacccucggggaccccggcccgccgugcccgggguccguuuggugacggcagggauccuggcccagccgcuggccacuuccucaccccgggccggcgccaccucuccgguccgugcgguggggcggccccagcuuugaauggggaccgggaggaaggucaggggucgugugggggcuggcguucaaaacuccucuuuucgagcggcucugcgugggguggcgccgucucucuugacggcccuugugcccagagcucgcggacgcucggagccacacuucccugucucacuucggugguugcggguggcgggugggagcgauaccgcgggaggcgcaguccuucccggagacuuuuggagagcuugcaggacacucgcgaugcccgcuccgcagcugucugcguaauuaugcgugugucugugcguguuguguuuuguuguguuuuggaaucccaaagagggcauuacccgcacagcgcaagaguucagguuaaagacgugccccguuuggacggggagcuccuggauuccagcaggacgguggggcggggcucucuugguacccuaaucuugaacuagggugagaaacuauggggggcggggugguaaaggggugacauggcgcgagggaaacagguggccuugcccgucggaacuuaauuugaauuucaguuccaucagugggacccugggcaaguugaagaaccuuuuugagucuguuucccccucuggauacuggagccacccaauuuuccagggcugugucgagaauuggggcuuauugcuguuccacgagguucgcugagaaucggggcgcauccauggagaguccuugggcaguuccugacucucugguucaagggcauucucuggggcaugggcccucguccuugacuacaguucugcggggaaguuuuacagaauuuugaagucuaugccagccucaagcaguuucucuugcaaaggugugugugcagucacguguauaccagcucagggacaaucgucauugugagccucacugauguuuaagucaccuaaugaugcagcugccuucccccaccagcgacuggaguaugggcaguuccucuggaaguggaaaagcacagaccccaugaauagcccuuuugcacucauuggguagagucaaugaaaagcugcuggugagaaaacuuuugaaaacauuucuuggucaggcacgguggcucacaccuguaaucccagcacuuugggaggccgagcugggcugaucacuugaggucaagcguuccagaccagccucaccaacauggugaaaccccaucucuacuaaaacuacaaaaauuaccugggcguggugguggccgccuguaaucccagcuacccaggaggcugaggcaggagaaucacuugaacccaggagguggagguugcagugaacccagaucaugccacugcacuccagccugggugacaagagagacuccaucucaagacaaacaaacaaacaaacaaacacacacaaacacuucuuaauuuagaaaacagcaagaacacaaagagaaaaauuugcccguuacaucaucaguuaauauaaauaaagucaaguuguauccucuacccucucccagccuccgauaaauaguaaccacucuccuggauuuaccagaagaucaccuuuauaaaaagggaauuguauuauacucauacaguugcaacuauugucugaagcuauuuuuuuauugaccucacaaaucuuuccagaucaaauugcuuaucuaucauccucauucuuucugauggcuacugagcguucuucagugcaugugcaccauuauuuauccaggaggccccccacauugaugagcaguuguuuucuguuuuuuuuucuuuuuuuguauuucuauugcaacuauugcuuccgugauuuucugucguacauauugcaucuuugugcaugucuuucuuuacauguacaauugcaggaucgaagcauaugcguguuuugcuuuuuaguagcugcucacagguugcccuaaaggagcagggguggaauuuacacucucacuugcaguggcugacaccauuccuuuga

SEQ ID NO: 19746 - RNA, 3086 nt, Homo sapiens
ucaaaggaauggugucagccacugcaagugagaguguaaauuccaccccugcuccuuuagggcaaccugugagcagcuacuaaaaagcaaaacacgcauaugcuucgauccugcaauuguacauguaaagaaagacaugcacaaagaugcaauauguacgacagaaaaucacggaagcaauaguugcaauagaaauacaaaaaaagaaaaaaaaacagaaaacaacugcucaucaauguggggggccuccuggauaaauaauggugcacaugcacugaagaacgcucaguagccaucagaaagaaugaggaugauagauaagcaauuugaucuggaaagauuugugaggucaauaaaaaaauagcuucagacaauaguugcaacuguaugaguauaauacaauucccuuuuuauaaaggugaucuucugguaaauccaggagagugguuacuauuuaucggaggcugggagaggguagaggauacaacuugacuuuauuuauauuaacugaugauguaacgggcaaauuuuucucuuuguguucuugcuguuuucuaaauuaagaaguguuuguguguguuuguuuguuuguuuguuugucuugagauggagucucucuugucacccaggcuggagugcaguggcaugaucuggguucacugcaaccuccaccuccuggguucaagugauucuccugccucagccuccuggguagcugggauuacaggcggccaccaccacgcccagguaauuuuuguaguuuuaguagagaugggguuucaccauguuggugaggcuggucuggaacgcuugaccucaagugaucagcccagcucggccucccaaagugcugggauuacaggugugagccaccgugccugaccaagaaauguuuucaaaaguuuucucaccagcagcuuuucauugacucuacccaaugagugcaaaagggcuauucauggggucugugcuuuuccacuuccagaggaacugcccauacuccagucgcuggugggggaaggcagcugcaucauuaggugacuuaaacaucagugaggcucacaaugacgauugucccugagcugguauacacgugacugcacacacaccuuugcaagagaaacugcuugaggcuggcauagacuucaaaauucuguaaaacuuccccgcagaacuguagucaaggacgagggcccaugccccagagaaugcccuugaaccagagagucaggaacugcccaaggacucuccauggaugcgccccgauucucagcgaaccucguggaacagcaauaagccccaauucucgacacagcccuggaaaauuggguggcuccaguauccagagggggaaacagacucaaaaagguucuucaacuugcccagggucccacugauggaacugaaauucaaauuaaguuccgacgggcaaggccaccuguuucccucgcgccaugucaccccuuuaccaccccgccccccauaguuucucacccuaguucaagauuaggguaccaagagagccccgccccaccguccugcuggaauccaggagcuccccguccaaacggggcacgucuuuaaccugaacucuugcgcugugcggguaaugcccucuuugggauuccaaaacacaacaaaacacaacacgcacagacacacgcauaauuacgcagacagcugcggagcgggcaucgcgaguguccugcaagcucuccaaaagucuccgggaaggacugcgccucccgcgguaucgcucccacccgccacccgcaaccaccgaagugagacagggaaguguggcuccgagcguccgcgagcucugggcacaagggccgucaagagagacggcgccaccccacgcagagccgcucgaaaagaggaguuuugaacgccagcccccacacgaccccugaccuuccucccgguccccauucaaagcuggggccgccccaccgcacggaccggagagguggcgccggcccggggugaggaaguggccagcggcugggccaggaucccugccgucaccaaacggaccccgggcacggcgggccgggguccccgagggugcgccccgucccugcccgcuccggcugagccaggacgcagacccccucggacgcagcgcccugggagccgguccccgcggggcgcaggucccugggcgcccugccugccucgcucccggccgggcagcucaccuggccgugccgcccgggcacagcugcccgccugccccggguuugggcuccggggucccgcgcgcgcagcccgcgucccgacucgggucacucagcgccgcucacgcccuccgccgccggcgcucgcuacuucugcuucggccgcggcgccgcgccacgugauccucgggggccgccccccgcaccgcccagccucgccccgccucgccccgccccaggcgcgcccagccggguccgccucucggagcgcaccccgagugcagcguccccgcgcccuccccgccauggagcggcccaggccuggagccccgccucugcgugccaaagaagaaacugaggcaacccgaggggaggcuaccugcccgaggccacuuggccaggugcaaagggaauuccccaauaucauggcauuccuggagagccggccgcaguccagguguuugccguauacuuaacacacucccggccgggcgcccgggcucacgccugucaucccagcucuuugggaagccuagacgggaggaucgucugagcucgagaguucgagacagcaaugagcuaggauggguguggccgagagacacuccgucucaaaaauaaauaaauaaaaauuaaaaauaaauauacucuucacaauuacccgccaggaauugccaauucauggcccuaauuugaagcccucguugaggcugcgcuggagucagaccaacccuuacugcuaccuuaggcagaccacuuaaaaaccgacagccucaguuuccccaucuguaaaacgugaucaacauagugccagccccaaagggagucaggagcaaagaaccccagacaauugaugucccguuuuccugaucucaugggaagaagcuaauauguucuuuaaga

SEQ ID NO: 19747 - RNA, 3765 nt, Homo sapiens
uuccagaagcaggucccaaauaaagccagugcccaccugcucucaugcgucugaggacucugugcucggagggagcugcguucccggaacccugcacugggcuggggggaagggaggaaaggggauugugggaggaguccuggggcaugugguccuggaugagguccauggcuggggccuugggguacaaaggauggugccccaagugugggggcaguugagcgggcagcuguacuagagucugggggugggaguggcgggugugugcaggcagugauguccaggagggcgcugcagccccgcccccuccgcagccugucccaggccucccuccucucuguucugccaugcggccuccuuucagucccuccugcuggccaggucucugccugccccaaggccuuugcacagagaguccccagcccaggacaguuucccgccuuucuuuaacuccuuuuccuugggaugucucagcauaagaaucacuuccucuaggaagccucuucugacacaaaccccuccacugccgucacagcaaauacuccuuucauggucuaaggugcuaccuuuucauagcagugcaguuuuuuuuucuuuuuuuugagacagagucucauuuugucacccaggcuggagugcuguggcgcuugguucacuacaaccucugcuucuggguugaaaugauucuccugucucagccucccaaguagcugggauuacaggugacugccaccucgcccagcuaguuauuguauuuuuaauagagacgggguuucaccauguuggccaggcuggucuugaacuccugaccucaagugauccgcccucuuuggcuccccaaaguguugguaucacaggcaugagccaccacacccuuccagcaguucaguuuuaauuguucauuuguuuguggaaucauuucaguguuuggcucugcccacuuggauguaagcuccaggagcucugggagaccaaguacaccaucuguuuugcccauugcuggaacuccgugguugggcaccugccuggcaccuaguggguucuccuuaauucaucuuuuaaauggauggguggauggauggaugggaggauggguggguggguggacagauggauagaugagaggaugguuggauggaugggaggaugguggguggguggauggauggauggauggaugggagggagggggguggguggguggguggauggaugggagggaggauggauggauggaugggagggagggaggauagauggauggauggaaggaugguggguggauggaugggaggguguguagguggguggauggauggauggaugagaggguagggggguggauagauggauagaugggaggguggguggguggauggacagacagaugggcgggcgggcagauggauggacggauggauggauggauggauggauggauggauggauggaugggaggguggauggauggauggauggaggguggauggauggaugccagggagggaggaugagugggugggugaauggauggauggaugggaggaugcuggguggguggauggauggauggaugaaugguugggaggguggguggauggauggacggacagucggccggccggauggauggaugggaggauggguggauggauguauagauggauugauggacggguaggcagguggauggauggauggauggauggacggacagguggguggguggauagauggauggguggauggaguaugaaggaaagauguucuggggugaagacugguucugggcguuuuguaaccaagggggcggccugagggggcgugcacgcccgcgggaguuaaggaugggcgcccgcgggcgugacggggccgcggggcgugggcgccgcuccccggggcuggagccggcagagggcgcuccgggcucgcuggacacccgcgcuucggccucugcugcgcgccgcgagugggaggggggacuuuagaagcggggagagcaggagacuuuuggggagcaggccccaggggcgccgccccgcccccaggccccacauaccccuccccuccggguagcccccucuguggcugcgcccgcgccccucgccccggcgggcaguccucaggccccgcgcccggccggcgggggugggggcggcggggagcgggcacguggcucgggguccggccggcccgccccccggcgccggccaguccccgcgguguccgcggccgcgggggcagcgggagagagggcggggcggcgcgggcagcgcggggagggggucgcgcgggggcgggccgcagcugggcgggggucggcgggcuuccgggcggcggcggcgggcgcggcgcgaugugcgagcgggcggcgcgccugugcagggccggcgcgcacaggcugcuccgggagccgccgcagcagggccgggcgcugggcgggcugcugcgcugggugggcgccaggaugggcgagccccgggagucgcuggcccccgccgcccccgcggaccccggcccagccucgccgcgcgggggcaccgccgucauccuggacgugaguacgcgccggccgggacccccgccguggccuccgcugggacccggagcccccuccgccccucgggcggaccccgacgccgcgacccgcgaggcccucccuacccgggcaggagacccccggccccuccgcgugccggagcgggagcccccagccccgccacguccaggccggucuccagcccaguccucucccuggaccgggagaccccccuccuccgccccuccaccggcgcuucucggagucccugccugcccacaguggggagccgugagcccccggacccggccacugucccccuaguuuuguccaagccaaacccccacccuuuaccccgcgggaccggagccccucgccgcguccagccgccuccuccucuccaucccggauccuguccggagcgauacuuuucugagaccccuaacaaccccuaccucuagcccaccucucuucgcccuagacccugagcccccguucaucucacgcucaaagacccuuugccccagcuacugccacuuuaaaagugaagcccccuccccaccuucugucuucucgucuccuuuccauugagccagagccaucgcccaucagcccugagcugguaccccucuggucuuccccaccccgcccccuuccauuccaaguccucuguucccuuccccacaccccucuacccuacagagagcuggguccucuucauggaccagacucaccccucaccccuccuaacuccccugggacccaaaucacccaucucugggaagcccaccucacccucccacccgccccacccgggagggaggaaucuucagggggcggcucggaggaggaggacuucucccagcagagagugcuaggaggagguggaggaggcuucuggggauguugacugcguguuucagcgaggguccugcugggguggggcugggggcugccucugccugugugguggauuucugggagaguggugggugugugugaaugugcacacgcguguaucgcggaucccugugagucgggggauucccucccuuccucucuccucuucccugcuccuggaacccuuggccggggucugggcugggagggccggccagagcagggggagcucuagagugccacacucgcaggcacacauucacacacucacgcacucgcuuacgcacgcacacacagccagagacacacccaugcagccaaaccau

SEQ ID NO: 19748 - RNA, 3765 nt, Homo sapiens
augguuuggcugcaugggugugucucuggcugugugugcgugcguaagcgagugcgugagugugugaaugugugccugcgaguguggcacucuagagcucccccugcucuggccggcccucccagcccagaccccggccaaggguuccaggagcagggaagaggagagaggaagggagggaaucccccgacucacagggauccgcgauacacgcgugugcacauucacacacacccaccacucucccagaaauccaccacacaggcagaggcagcccccagccccaccccagcaggacccucgcugaaacacgcagucaacauccccagaagccuccuccaccuccuccuagcacucucugcugggagaaguccuccuccuccgagccgcccccugaagauuccucccucccggguggggcgggugggagggugaggugggcuucccagagaugggugauuugggucccaggggaguuaggaggggugaggggugagucugguccaugaagaggacccagcucucuguaggguagagggguguggggaagggaacagaggacuuggaauggaagggggcgggguggggaagaccagagggguaccagcucagggcugaugggcgauggcucuggcucaauggaaaggagacgagaagacagaagguggggagggggcuucacuuuuaaaguggcaguagcuggggcaaagggucuuugagcgugagaugaacgggggcucagggucuagggcgaagagaggugggcuagagguagggguuguuaggggucucagaaaaguaucgcuccggacaggauccgggauggagaggaggaggcggcuggacgcggcgaggggcuccggucccgcgggguaaaggguggggguuuggcuuggacaaaacuagggggacaguggccggguccgggggcucacggcuccccacugugggcaggcagggacuccgagaagcgccgguggaggggcggaggaggggggucucccgguccagggagaggacugggcuggagaccggccuggacguggcggggcugggggcucccgcuccggcacgcggaggggccgggggucuccugcccggguagggagggccucgcgggucgcggcgucgggguccgcccgaggggcggagggggcuccgggucccagcggaggccacggcgggggucccggccggcgcguacucacguccaggaugacggcggugcccccgcgcggcgaggcugggccgggguccgcgggggcggcgggggccagcgacucccggggcucgcccauccuggcgcccacccagcgcagcagcccgcccagcgcccggcccugcugcggcggcucccggagcagccugugcgcgccggcccugcacaggcgcgccgcccgcucgcacaucgcgccgcgcccgccgccgccgcccggaagcccgccgacccccgcccagcugcggcccgcccccgcgcgacccccuccccgcgcugcccgcgccgccccgcccucucucccgcugcccccgcggccgcggacaccgcggggacuggccggcgccggggggcgggccggccggaccccgagccacgugcccgcuccccgccgcccccacccccgccggccgggcgcggggccugaggacugcccgccggggcgaggggcgcgggcgcagccacagagggggcuacccggaggggagggguauguggggccugggggcggggcggcgccccuggggccugcuccccaaaagucuccugcucuccccgcuucuaaaguccccccucccacucgcggcgcgcagcagaggccgaagcgcggguguccagcgagcccggagcgcccucugccggcuccagccccggggagcggcgcccacgccccgcggccccgucacgcccgcgggcgcccauccuuaacucccgcgggcgugcacgcccccucaggccgcccccuugguuacaaaacgcccagaaccagucuucaccccagaacaucuuuccuucauacuccauccacccauccaucuauccacccacccaccuguccguccauccauccauccauccauccaccugccuacccguccaucaauccaucuauacauccauccacccauccucccauccauccauccggccggccgacuguccguccauccauccacccacccucccaaccauucauccauccauccauccacccacccagcauccucccauccauccauccauucacccacccacucauccucccucccuggcauccauccauccacccuccauccauccauccauccacccucccauccauccauccauccauccauccauccauccauccauccguccauccaucugcccgcccgcccaucugucuguccauccacccacccacccucccaucuauccaucuauccaccccccuacccucucauccauccauccauccacccaccuacacacccucccauccauccacccaccauccuuccauccauccaucuauccucccucccucccauccauccauccauccucccucccauccauccacccacccacccaccccccucccucccauccauccauccauccauccacccacccaccauccucccauccauccaaccauccucucaucuauccaucuguccacccacccacccauccucccauccauccauccacccauccauuuaaaagaugaauuaaggagaacccacuaggugccaggcaggugcccaaccacggaguuccagcaaugggcaaaacagaugguguacuuggucucccagagcuccuggagcuuacauccaagugggcagagccaaacacugaaaugauuccacaaacaaaugaacaauuaaaacugaacugcuggaagggugugguggcucaugccugugauaccaacacuuuggggagccaaagagggcggaucacuugaggucaggaguucaagaccagccuggccaacauggugaaaccccgucucuauuaaaaauacaauaacuagcugggcgagguggcagucaccuguaaucccagcuacuugggaggcugagacaggagaaucauuucaacccagaagcagagguuguagugaaccaagcgccacagcacuccagccugggugacaaaaugagacucugucucaaaaaaaagaaaaaaaaacugcacugcuaugaaaagguagcaccuuagaccaugaaaggaguauuugcugugacggcaguggagggguuugugucagaagaggcuuccuagaggaagugauucuuaugcugagacaucccaaggaaaaggaguuaaagaaaggcgggaaacuguccugggcuggggacucucugugcaaaggccuuggggcaggcagagaccuggccagcaggagggacugaaaggaggccgcauggcagaacagagaggagggaggccugggacaggcugcggagggggcggggcugcagcgcccuccuggacaucacugccugcacacacccgccacucccacccccagacucuaguacagcugcccgcucaacugcccccacacuuggggcaccauccuuuguaccccaaggccccagccauggaccucauccaggaccacaugccccaggacuccucccacaauccccuuuccucccuuccccccagcccagugcaggguuccgggaacgcagcucccuccgagcacagaguccucagacgcaugagagcaggugggcacuggcuuuauuugggaccugcuucuggaa

SEQ ID NO: 19749 - RNA, 2677 nt, Homo sapiens
agcauugguguaucaagacuuuuugggaugucuuuaccuucacugccaauuuuugguauaggacuaaacgcacaaugaagcugagccuaaagagcagcaacauggaauuagaaaccuggauucucauccaagauccaacacucuucaccaucaugucuguauuuaugcaguaagaauuaaaauauucagaguaccccacuccuaggcagauacccaagauaauuagaaacuuuugcucacauaaaaacuccugcuugcauguucacaguggccuacucacaacugccagaaggcagaaacaaacaaaauguccaucaacaaaugaaugaauaagcaaaaugugguguuauccacacaaaggaguauuauucagccauaaaaaagcaugaaguacugauacauacuacaacauggauaaacuuugaaaacauuaugcuaaaggacagaaaccaaauacaaaaggccguauguuguauguuuccacuuguaugaaauguccagcauaagcaaauccauagagacagaagauaacuuagggcugcugagggacagggggagaaaagagguaugacuguuaaugggguugggguuucuuuuguaggugauuaaauguucuggaauuaguuacuggugaugguugcauagcauugugacuauagcaagaacuacugaguuauacacuguaaaauggcuaaaaugauaaauuuuaugucaugcguaagucauuucgauuuuugaaaaccuacuuuaaaaaaaaguagcaccaauauguucaacucuguugcccuagaauauuccagcagugauuaaaaccacaaacuuggccggguacaguggcucaugucuguaaccccagaacuuugggaggccaaggcgggcagaucacuugaggccaggaguucaaggcuacccugaccaacacagcgaaaccccgucucuacuaaaaaaaaaaaaaaaaaaauuagcugggugugguagaacgugccuguaaucccagcuacucggaaggcugaggcaggagaaucacuugggcccggggugcgggauggcgggcagagguagcaggagcugagaucgcaggcaccauugcacuacagcccgggcgacagagcgagauugucugaaucaaucaaucaaucaacacccucccccucccccucccucucccucucccucccucccucucucucucucucucucuccuguggcggucagaguaaaauugagagcucacuuuaugcaaaagacucugcuaagugcuuuauuccuauugucucacuuuauucucucauuaaucuuauaaagcgcagucagacucucccguuuauagauggggaaauugagucuuauagauguaaagucgcacacccaagaccccacaacucagaaaggggcuaccugcaauucagauggagguauagcaaggcgcagaguccuguccagggagcccacugugagaccccccgacugccucgcagucaccuguacacaucauguugggaucgccgaggggcgcugcagcgauccgguuucuggggcugcgucuggguggcacguucagaacggggaccugccugguucuucuucccagcccuuccccuccagcacccggcaaggcccagucaacacgagcaaacucggaaauccuggcugaacccacgaccgcugcauauuuccauuuuagaaaaacacggcaacaacaacucaaaccaaaucguucagaaaugagaauaaagaagcaccgacaaaggaggcgauugcuggggccgcucgggggaggagccgggugagaggcugcagggagggcagggcaugcgccggcgacaacgggguucgcgguuuggggggcaaggcccgggggaagagagagaacaggggugcagcgccgcggcggggggcgugaggauggagccgggggaaggggggcucugagaugugaaggggcggggcuggggcuuuuuggucugaaggaaggagucucacgggacggagggacgaagauuuccuggggucaggggcgccaaggggcuucggggccggaugcagcggagggggcccggggccuggggggcguggugagagcucagaggggucucgccaagcagccggcuggcgcugaggggaccgaggaggggucuggggcgaaaggaccgcgagagggcgcccagggcgcggggggcgcgguaccugcaggccggcaaagucuuccaaaccggucccgccagacccgcgcggccgccgcccccgucucggccgccggagcugcugccgcgccgcgcccucacgugacccgcguacgcgccgggggcggagccgucucagacccgcccccaccccccggcguccccagcgcgccgguccgucccgagugcgcgugcgcagcgguugccugggcgaccggggaagcguugggcuguaaagacuagggcgccagcggcuggcgaagaaggaaagaggguacucucuggcugggcuggggccguagcgacguccgccgcgaaccugggccccccaaagcugcggggcguucggugucgccgaaguaaacaugcacccugagcccucggagccugcgacagguggugcagcagagcuggauugcgcgcaggagcccggcguggaggagucugcgggugaccacgggagcgcaggccgagggggcugcaaggaaggugcc

SEQ ID NO: 19750 - RNA, 2677 nt, Homo sapiens
ggcaccuuccuugcagcccccucggccugcgcucccguggucacccgcagacuccuccacgccgggcuccugcgcgcaauccagcucugcugcaccaccugucgcaggcuccgagggcucagggugcauguuuacuucggcgacaccgaacgccccgcagcuuuggggggcccagguucgcggcggacgucgcuacggccccagcccagccagagaguacccucuuuccuucuucgccagccgcuggcgcccuagucuuuacagcccaacgcuuccccggucgcccaggcaaccgcugcgcacgcgcacucgggacggaccggcgcgcuggggacgccggggggugggggcgggucugagacggcuccgcccccggcgcguacgcgggucacgugagggcgcggcgcggcagcagcuccggcggccgagacgggggcggcggccgcgcgggucuggcgggaccgguuuggaagacuuugccggccugcagguaccgcgccccccgcgcccugggcgcccucucgcgguccuuucgccccagaccccuccucgguccccucagcgccagccggcugcuuggcgagaccccucugagcucucaccacgccccccaggccccgggcccccuccgcugcauccggccccgaagccccuuggcgccccugaccccaggaaaucuucgucccuccgucccgugagacuccuuccuucagaccaaaaagccccagccccgccccuucacaucucagagccccccuucccccggcuccauccucacgccccccgccgcggcgcugcaccccuguucucucucuucccccgggccuugccccccaaaccgcgaaccccguugucgccggcgcaugcccugcccucccugcagccucucacccggcuccucccccgagcggccccagcaaucgccuccuuugucggugcuucuuuauucucauuucugaacgauuugguuugaguuguuguugccguguuuuucuaaaauggaaauaugcagcggucguggguucagccaggauuuccgaguuugcucguguugacugggccuugccgggugcuggaggggaagggcugggaagaagaaccaggcagguccccguucugaacgugccacccagacgcagccccagaaaccggaucgcugcagcgccccucggcgaucccaacaugauguguacaggugacugcgaggcagucggggggucucacagugggcucccuggacaggacucugcgccuugcuauaccuccaucugaauugcagguagccccuuucugaguuguggggucuugggugugcgacuuuacaucuauaagacucaauuuccccaucuauaaacgggagagucugacugcgcuuuauaagauuaaugagagaauaaagugagacaauaggaauaaagcacuuagcagagucuuuugcauaaagugagcucucaauuuuacucugaccgccacaggagagagagagagagagagagggagggagggagagggagagggagggggagggggaggguguugauugauugauugauucagacaaucucgcucugucgcccgggcuguagugcaauggugccugcgaucucagcuccugcuaccucugcccgccaucccgcaccccgggcccaagugauucuccugccucagccuuccgaguagcugggauuacaggcacguucuaccacacccagcuaauuuuuuuuuuuuuuuuuuuaguagagacgggguuucgcuguguuggucaggguagccuugaacuccuggccucaagugaucugcccgccuuggccucccaaaguucugggguuacagacaugagccacuguacccggccaaguuugugguuuuaaucacugcuggaauauucuagggcaacagaguugaacauauuggugcuacuuuuuuuuaaaguagguuuucaaaaaucgaaaugacuuacgcaugacauaaaauuuaucauuuuagccauuuuacaguguauaacucaguaguucuugcuauagucacaaugcuaugcaaccaucaccaguaacuaauuccagaacauuuaaucaccuacaaaagaaaccccaaccccauuaacagucauaccucuuuucucccccugucccucagcagcccuaaguuaucuucugucucuauggauuugcuuaugcuggacauuucauacaaguggaaacauacaacauacggccuuuuguauuugguuucuguccuuuagcauaauguuuucaaaguuuauccauguuguaguauguaucaguacuucaugcuuuuuuauggcugaauaauacuccuuuguguggauaacaccacauuuugcuuauucauucauuuguugauggacauuuuguuuguuucugccuucuggcaguugugaguaggccacugugaacaugcaagcaggaguuuuuaugugagcaaaaguuucuaauuaucuuggguaucugccuaggagugggguacucugaauauuuuaauucuuacugcauaaauacagacaugauggugaagaguguuggaucuuggaugagaauccagguuucuaauuccauguugcugcucuuuaggcucagcuucauugugcguuuaguccuauaccaaaaauuggcagugaagguaaagacaucccaaaaagucuugauacaccaaugcu

SEQ ID NO: 19751 - RNA, 2884 nt, Homo sapiens
ggguccagcgcgcaccggggcugaaccgcgggcggagggcgcauuaacacuugcucgccagguugguggaggcggggcggauucugcuggcggccgcggggcggcgagagugggggcucuuuaagcgcccaccaacgcgggggcccgaggggggcagggacggagggagggaacuccgggagggucuuaggccgacccgcgagacgcagccgagcggagauggagugaaggcugccucgcccggaaucucggagccgagcgccgcgggcggcggggacucagggcugcucccggcuggggcgcacggccguaagaccuggagguggugccuccccccaaaaaauaccggcggggguagcuuccucacggccuucgcccgggcugcccucggccucagcucggcuccuuuccuugugggagggcgagaaagaaagagggaggagagaggugggggaggcgggaguuggagagagaggggcucugagccaaccgccggcggauccagcagcuccucggggagggcgggcgggagcgcgggggcgggcgcgccgcggcucgcucgggagaaguggccgccgaugacggcagaggugcagccagccccgcgcgcgcagcccccuccccuucgcccuccucccccccgucguccucuuccuccuccuccuccuccuccucccggcccguccgcggcgcagagcagcggcggcagcggcggcggcggcagcagccacccgaugucuucggcgcccgagaagcagcagccaccgcacggcggcggcggcggcggcggcgggggaggcggcgcggccauggaccccgcgucguccggcccguccaaggccaagaagaccaacgccggcauccggcgcccggagaagccgcccuauuccuacaucgcgcucaucgucauggccauccagaguucacccaccaagcgccugacgcugagcgagaucuaccaguuccugcagagccgcuuccccuucuuccggggcuccuaccagggcuggaagaacuccgugcgccacaaccucucgcucaacgagugcuucaucaagcuacccaagggccuugggcggcccggcaagggccacuacuggaccaucgacccggccagcgaguucauguucgaggagggcuccuuucggcggcggccgcgcggcuuccgaaggaaaugccaggcgcucaagcccauguacagcaugaugaacgggcucggcuucaaccaccucccggacaccuacggcuuccagggcucggccggcggccucucgugcccgcccaacagccuggcgcuggagggcggccugggcaugaugaacggccacuugccgggcaacguggacggcauggcccugcccagccacucggugccccaccugccuuccaacggcggccacucguacaugggcggcugcggcggcgcggcggccggcgaguacccgcaccacgacagcucggugcccgccuccccgcugcugcccaccggcgccgguggggucauggagccgcacgccgucuacucgggcucggcggcggccuggccgcccucggcguccgcggcgcucaacagcggcgccucuuauaucaagcagcagccccugucccccuguaaccccgcggccaacccccuguccggcagccucuccacgcacucccuggagcagccguaucugcaccagaacagccacaacgccccagccgagcugcaaggugaguggggaggccgagggcgcccugguccccgggaagucgagucugaguggcagcgggacccagcuggggcgagccccuccacuucuguggucggaaccccaaggcugaggggaggcaccagcuccccaaggugucucuuggccccaccucucccccuucgaagagugacuaccgcucuugacccuaguuugggccaaucuguuucucuuucuguucgaacuccagcugccagcugcuccaggccugaccagguaggcugguccugagccagaugucccagaccccagugcccuaaguccuuuugugucccuuaaguccccucacagcuuggaaagauccugggauggacccaaggcucccagcgcuggccagauggcugucccucccuggugguggcccucaggcugccuggagggcugccucugccuggggcugggcggaacggaagguguuaggcccaaagccgcugggccagcgcucagaggcucagccccggccuuucaggggaccagaccuggcagacccacagcugaguccaggggcauuuuguggugacugaggcaggagggugccguggccaggccccggagggucagagcugcagaccgggccaugggggcuccuuguuuuuuaggauccaaguuuucagguccccacacccccaacaccccugauaccccaauaccccgaacaugcagaagcaucugccaagggagaugcagcagccucgccuccugauucugccccaggccccccgcagccugcaggcccagcucuggaaaaagcuggagugagcuugccagggccaguccagggucagcugucagcagccccaggaggcaggagccaggccuggaggccuuaggcagccucucugcgggggacuccccggcuccggggccuguucucuggagaagcuucuucucaccccugcugcuggcccggcgcuggcccugcacuggccucuccuucaaccccgccggcagucguagccucugagguuggggguggugguggcugcccuggcggugacggccaugggcguuaggggcccuccacuuggucucccucaccacuuccccuauggcucuggaagcccugggccccugcacgguguccgaggcuggacaggcacgcagcaggcaggcaggcaggcaggcaggcaggc

SEQ ID NO: 19752 - RNA, 2884 nt, Homo sapiens
gccugccugccugccugccugccugccugcugcgugccuguccagccucggacaccgugcaggggcccagggcuuccagagccauaggggaaguggugagggagaccaaguggagggccccuaacgcccauggccgucaccgccagggcagccaccaccacccccaaccucagaggcuacgacugccggcgggguugaaggagaggccagugcagggccagcgccgggccagcagcaggggugagaagaagcuucuccagagaacaggccccggagccggggagucccccgcagagaggcugccuaaggccuccaggccuggcuccugccuccuggggcugcugacagcugacccuggacuggcccuggcaagcucacuccagcuuuuuccagagcugggccugcaggcugcggggggccuggggcagaaucaggaggcgaggcugcugcaucucccuuggcagaugcuucugcauguucgggguauugggguaucagggguguuggggguguggggaccugaaaacuuggauccuaaaaaacaaggagcccccauggcccggucugcagcucugacccuccggggccuggccacggcacccuccugccucagucaccacaaaaugccccuggacucagcugugggucugccaggucugguccccugaaaggccggggcugagccucugagcgcuggcccagcggcuuugggccuaacaccuuccguuccgcccagccccaggcagaggcagcccuccaggcagccugagggccaccaccagggagggacagccaucuggccagcgcugggagccuuggguccaucccaggaucuuuccaagcugugaggggacuuaagggacacaaaaggacuuagggcacuggggucugggacaucuggcucaggaccagccuaccuggucaggccuggagcagcuggcagcuggaguucgaacagaaagagaaacagauuggcccaaacuagggucaagagcgguagucacucuucgaagggggagagguggggccaagagacaccuuggggagcuggugccuccccucagccuugggguuccgaccacagaaguggaggggcucgccccagcugggucccgcugccacucagacucgacuucccggggaccagggcgcccucggccuccccacucaccuugcagcucggcuggggcguuguggcuguucuggugcagauacggcugcuccagggagugcguggagaggcugccggacaggggguuggccgcgggguuacagggggacaggggcugcugcuugauauaagaggcgccgcuguugagcgccgcggacgccgagggcggccaggccgccgccgagcccgaguagacggcgugcggcuccaugaccccaccggcgccggugggcagcagcggggaggcgggcaccgagcugucguggugcggguacucgccggccgccgcgccgccgcagccgcccauguacgaguggccgccguuggaaggcagguggggcaccgaguggcugggcagggccaugccguccacguugcccggcaaguggccguucaucaugcccaggccgcccuccagcgccaggcuguugggcgggcacgagaggccgccggccgagcccuggaagccguagguguccgggaggugguugaagccgagcccguucaucaugcuguacaugggcuugagcgccuggcauuuccuucggaagccgcgcggccgccgccgaaaggagcccuccucgaacaugaacucgcuggccgggucgaugguccaguaguggcccuugccgggccgcccaaggcccuuggguagcuugaugaagcacucguugagcgagagguuguggcgcacggaguucuuccagcccugguaggagccccggaagaaggggaagcggcucugcaggaacugguagaucucgcucagcgucaggcgcuuggugggugaacucuggauggccaugacgaugagcgcgauguaggaauagggcggcuucuccgggcgccggaugccggcguuggucuucuuggccuuggacgggccggacgacgcgggguccauggccgcgccgccucccccgccgccgccgccgccgccgccgugcgguggcugcugcuucucgggcgccgaagacaucggguggcugcugccgccgccgccgcugccgccgcugcucugcgccgcggacgggccgggaggaggaggaggaggaggaggaagaggacgacgggggggaggagggcgaaggggagggggcugcgcgcgcggggcuggcugcaccucugccgucaucggcggccacuucucccgagcgagccgcggcgcgcccgcccccgcgcucccgcccgcccuccccgaggagcugcuggauccgccggcgguuggcucagagccccucucucuccaacucccgccucccccaccucucuccucccucuuucuuucucgcccucccacaaggaaaggagccgagcugaggccgagggcagcccgggcgaaggccgugaggaagcuacccccgccgguauuuuuuggggggaggcaccaccuccaggucuuacggccgugcgccccagccgggagcagcccugaguccccgccgcccgcggcgcucggcuccgagauuccgggcgaggcagccuucacuccaucuccgcucggcugcgucucgcgggucggccuaagacccucccggaguucccucccuccgucccugccccccucgggcccccgcguuggugggcgcuuaaagagcccccacucucgccgccccgcggccgccagcagaauccgccccgccuccaccaaccuggcgagcaaguguuaaugcgcccuccgcccgcgguucagccccggugcgcgcuggaccc

SEQ ID NO: 19753 - RNA, 2371 nt, Homo sapiens
ggucuccccggggcgcgggcggggccgaaccaggaaggggcggggcaucgagcggggcggggacagugccuugaaggcccagacggacaggggcggggccgcagcgcuggggucggagccagcgccguaaagagcgaggcgggcgggggcgcggucgcggcucugggggcggagccagagcaacgaagagccgggcuggcgggggcguggccgcggcgcugggggcggagccggagaggugcagggcccggcaggaggcacggggcggggccggagcgccgggggcggggcgggaggugcggcggccgacgacgcucaggcccggccccgccccgugccuccagcccgccaggagcgcccucgcaguggccgccugcuccgccgcucgccgcccgcggguuccauugagaaaagccgagcggccgcggcggcggcggcgagugcgcgggagcggaggagccggcacccgcccgucgggcaguccgcgcgcccgcaacgcaggaccguggccucucgggccuccgcggcagcuccagcggcuccggggcugggcgcgcgggcugggggcgcgggccggggcggccgcggagaccgggggccgggggcaugagcggccccgcggccccgccgcgcccccgccgcccgccgccgcccgcccggggcuagaggcggccgccgggagggcgcgcggcgccggagacauguccaggcggaaacagagcaacccccggcagaucaagcgugagucaaacuuugcccgcgguccccuccgcgcgcccgacccccgccggagcccagccgccagcgccgcccccgcccguccccgcucugcccugggcgccggcgaccuucaccccgcgccgcgccccccgcgcugugccaagcgcgccguaaucuaaucuccgccggcggccugggcccccgcgucucggcuugggcaccgggggguucagcccaggagggggccgcccggaggccgggaggaggguguuugggggcgcggcccgggcagcucggccccucgcggccugccccucccccgcaucugcgagauggugcggcgauagggcggccccgaucugggcucagauaaaguuuaaaauauuacauucugcaagucccguccugauaagaucguucugucgggacgggcugaaauugugaucuuaucucgcgcgguugacucucccaggcuuuguaucuagaagcgaagagagagaccugggaggcagaggggacacccggggccgcggagaugccuggccaaguggcaggcaccggcccgcgcccacccccaccggugccgucgcagagccgcaggacaggggaggggguagcgcgcagcugccgcagccuaggcacuuggcuccagccccccagacacccccaccccgugcccuagcgcugaaguccugaacccaggccccgccagccuggugacaccuccuggacccugcaagugucccagccaaggcggcaugggcaacaaauggugcccucggaugcccgcgggcacccccuggcaucccaaugggcugcucugagucagagaagggccucccaggacgcagccccgggccggggucgccccugcacgccacuaaguuucucgcugguccggcucccugcccggucagaggcugcugccccgccgccacauugccagugcccccgcgaugagaacuaagcugucggggccacugucuggccugggccucugggcugugccaggagggagcaagagcacaggaagcuacccuccccacccuaugccaauaauaacuuugcgccucacaguuagggcccagacgcaggucuuccuccccggggcgccuccccggagccugacgggcaggucgucugagcccugccaggaggccacgacggaaacccgcccgcugcccagccguaggcgcccgggcacuaccuccuuuguccacacgaccacugccaccaggaccccuugugcggggccugugggagcuucccuacucaggaggucucccgaggcgggggucacaggcaugaaccgguucccguaacccaacucccucagcgcaaacgggaccuguuuuccgaaagucgccuucuaucgugucaacucaaguauuaaaagccacccacaggucccgauccgcgcuugugcucugguuucuuuuuccuuccuucccugagcgccuauguucgguucuggggugugugugugugugugugugugugugugugugugugugugguguuucacugugaugagaaaugcagauagcucggacagggagaucgcagguuggaaaccgaucuccagcgcugauaaggccgccagcgccagcgagagcccguagcccagcccagcggggcgggcagagcgcgc

SEQ ID NO: 19754 - RNA, 2371 nt, Homo sapiens
gcgcgcucugcccgccccgcugggcugggcuacgggcucucgcuggcgcuggcggccuuaucagcgcuggagaucgguuuccaaccugcgaucucccuguccgagcuaucugcauuucucaucacagugaaacaccacacacacacacacacacacacacacacacacacacacaccccagaaccgaacauaggcgcucagggaaggaaggaaaaagaaaccagagcacaagcgcggaucgggaccuguggguggcuuuuaauacuugaguugacacgauagaaggcgacuuucggaaaacaggucccguuugcgcugagggaguuggguuacgggaaccgguucaugccugugacccccgccucgggagaccuccugaguagggaagcucccacaggccccgcacaagggguccugguggcaguggucguguggacaaaggagguagugcccgggcgccuacggcugggcagcgggcggguuuccgucguggccuccuggcagggcucagacgaccugcccgucaggcuccggggaggcgccccggggaggaagaccugcgucugggcccuaacugugaggcgcaaaguuauuauuggcauaggguggggaggguagcuuccugugcucuugcucccuccuggcacagcccagaggcccaggccagacaguggccccgacagcuuaguucucaucgcgggggcacuggcaauguggcggcggggcagcagccucugaccgggcagggagccggaccagcgagaaacuuaguggcgugcaggggcgaccccggcccggggcugcguccugggaggcccuucucugacucagagcagcccauugggaugccagggggugcccgcgggcauccgagggcaccauuuguugcccaugccgccuuggcugggacacuugcaggguccaggaggugucaccaggcuggcggggccuggguucaggacuucagcgcuagggcacggggugggggugucuggggggcuggagccaagugccuaggcugcggcagcugcgcgcuacccccuccccuguccugcggcucugcgacggcaccggugggggugggcgcgggccggugccugccacuuggccaggcaucuccgcggccccggguguccccucugccucccaggucucucucuucgcuucuagauacaaagccugggagagucaaccgcgcgagauaagaucacaauuucagcccgucccgacagaacgaucuuaucaggacgggacuugcagaauguaauauuuuaaacuuuaucugagcccagaucggggccgcccuaucgccgcaccaucucgcagaugcgggggaggggcaggccgcgaggggccgagcugcccgggccgcgcccccaaacacccuccucccggccuccgggcggcccccuccugggcugaaccccccggugcccaagccgagacgcgggggcccaggccgccggcggagauuagauuacggcgcgcuuggcacagcgcggggggcgcggcgcggggugaaggucgccggcgcccagggcagagcggggacgggcgggggcggcgcuggcggcugggcuccggcgggggucgggcgcgcggaggggaccgcgggcaaaguuugacucacgcuugaucugccggggguugcucuguuuccgccuggacaugucuccggcgccgcgcgcccucccggcggccgccucuagccccgggcgggcggcggcgggcggcgggggcgcggcggggccgcggggccgcucaugcccccggcccccggucuccgcggccgccccggcccgcgcccccagcccgcgcgcccagccccggagccgcuggagcugccgcggaggcccgagaggccacgguccugcguugcgggcgcgcggacugcccgacgggcgggugccggcuccuccgcucccgcgcacucgccgccgccgccgcggccgcucggcuuuucucaauggaacccgcgggcggcgagcggcggagcaggcggccacugcgagggcgcuccuggcgggcuggaggcacggggcggggccgggccugagcgucgucggccgccgcaccucccgccccgcccccggcgcuccggccccgccccgugccuccugccgggcccugcaccucuccggcuccgcccccagcgccgcggccacgcccccgccagcccggcucuucguugcucuggcuccgcccccagagccgcgaccgcgcccccgcccgccucgcucuuuacggcgcuggcuccgaccccagcgcugcggccccgccccuguccgucugggccuucaaggcacuguccccgccccgcucgaugccccgccccuuccugguucggccccgcccgcgccccggggagacc

SEQ ID NO: 19755 - RNA, 3538 nt, Homo sapiens
acacccuucagcacgugcacguagcccccagagaaggucugcaagggagcggccaggucagugacugcccacccucccauaggccagacccuaggguacaguggguccgggaucuguuggcucaggccuuggcagcuucugaugcucagacccaaccccagagacuaggcuuagccagcuugggccaggcccaaacaugaugauuucuuuuuuuuuuuuuuuuuuuuuuuuuuuuugagacagagucuugcucugucauccaggcuggagugcaguggcuccaucucagcucacugcagccucugcgucccagguucaagcaaguuccccugccucagccucccggguagcugggacuacaggcgcccaccaccacacccggcuaauuuucauauuuuuaguagagacaggguuucaccauguuggccaugcuggucucaaacuccugaccucaagugauccgccugccuugagcucccaaagugcugggauuacaagcgugagccacugugcccggccuagaauuuuuuuuuuuuuuucuuuuuugagacagagucucgcucugucuggaguacaguggcacgaucucggcucacuacaaccuccuccucccggguucaagcgaucuuccugccucagccuccugaguagcugggauuacaggugcgcaccaccacgccccacuaauuuuuguauauuuaguagagacgggguuucaccauguugaccaggaaggucuugaucccuugaccucaugauccacccaccuuggccucccgaagugcugggauuacaggugugagccaccgcaccuggccgaauuucuuaaauuuaauggaaaaaacaaugaauacauuaaccuagcucacaaaucagaacaaaaugaagagccccuguacugagaaauuccacugucuucugucccaccgcucccuucaccccuggagauggccucaucuaauuaguuuugaauguacuugcccagguguuuguuuugcaaacccaaauacagauuucguuugcuccucguaugagguaguccccccuuuuuuuucaccucuuuguaaggucucuaaccaaagcuagacagguagccucuuaaacguguuguucugaacuuuguuuuuuuccacuacagucuugcagacaaggacagaagcuguaacguucauucccccugcuguguaguauuccaccaugggggugacacgucuguuuucagcgcucuccagaggcuguccaugcacugggcugacagccgugggacgguagaagggugagugcucuuuuuuuuuuuuuuuugagacggagucucacucugucaccaggauggagugcaguggcucgaucucugcucacuacaaccuccaccucccagguucaagugauucuccucccucagccuccugaguagcugggauuacaggcgcgugccaccacacccagcucauuuuuguauuuuuuaauagagacgggguuucaccauguugguuaggcuggugucaaucuccugaccucgugaucugcccaccucggccucccaaagagcugggauuacaggcgugagccaccgcgcccggccuggcugagugcuuucuagccuacacuuaggugaagaacuaaaggagcucaggacaaucacugcgagcgucuccugacucucaaauucccuaacuccgggacuccuagcaucuaaugccuggacacggcccacguguggagcgcccagugccugcagcacugagcucggggcuuugauucauuccucuggccccaugaacuggacuguucccgugucgcugucucaggaggaaaggggcugacagagauuagcuaauuuggccaaguccucgcggccaggaagcagcagaacuaaguccaaaccagggcuguccggcacugaagccgguuauucccccgccccgcccccugggaggccucaagggcgggccuguccguccucucucaugaaugaaaguccuggcgccuccgaccagcagguguccccggggagccgcggagagacugccgcugccauggcaaccggcggaggcguagcucgcccacgugcccagugacgucaucggcuuccuacucuuccgaauuagcucagagcucccggcggcccugcccccuccugccgccaggagcucaccuggagaggccaggccagcccugggcacagccucccgccccaggccguggaguucacuaggucugagcccagcccugagacuucacagggaugcacccaucugcaguccucccagccucggcggccuccucugcaaaugggauuggcccauaaccuggaggaauuaggaugaccaugggaacucaagucccuucugugcccccguccuaagauuuccauggcaacuggggccgcgaggccucuuagggaagacacugacgcaagcucucagggcaggaccccguaggcagcacccaagccugcccucgcccaccccauguucucagcccuaggagugggugcccccacacgcccacgaccccucagcgcucggagccuugaggagcccaccaggcacugaggacacuugaagccccucucucucgaaaggcguggucccccauggucggcggccccgcgacccgcaggccaggacgaggggcgcgcuccuccuggccuggcgccuaccuugaugguggugaacuccuuccuccagggcagcagguacaggugcaccgcggcgagcuccagaagcucgaaggcgcgagccaggccgcguagcgcgggcgccaggucggcgcggccccacagcccgucggugagcagagccagcgcgucguccugcagcgccccgugcaggucgaaguccuccaccaggaucugccagagcaccgcgcgcagcgagggguccccgcacacgcccgcgcggccccgucgcagcucgcgcuccaggcacuggcgguaguccucggacagcgagcugcugcccauccugcggcggacgggggucgggggggucagggaccuaaggccgcgcccagcccgccgcgcucuccccgaacccucacccagcguccccaggaccccucgagccuggagaccccgcccccagcggcugggcgcccccgguaucuucggcacccccuacgcuggagaccucggccccaucagcugcccgcccacccagcgauccaggccccuccaguugagcgcccccgcaccuccagccccucccuccagccuggguaccucggccuuccaggggcgcccccgguuaucgaccgcacccuucucuagagacgcgcuuccgcccgcugagcccucucccgaccagagccccuucgcccggcagauggagcugcggaucccgcgggugacggcgcuaccugucuguccccagcggucuccggccgccgcggaucaguucgggccuccccgcgcgccgcgcgcuuccgccgggagucggcuccgcccgggguccgcggccgugacgcugggggcggggcggggcuuggcgcaggccccgccuccgaauaauuuaggaggggcggggccuggugaaag

SEQ ID NO: 19756 - RNA, 3538 nt, Homo sapiens
cuuucaccaggccccgccccuccuaaauuauucggaggcggggccugcgccaagccccgccccgcccccagcgucacggccgcggaccccgggcggagccgacucccggcggaagcgcgcggcgcgcggggaggcccgaacugauccgcggcggccggagaccgcuggggacagacagguagcgccgucacccgcgggauccgcagcuccaucugccgggcgaaggggcucuggucgggagagggcucagcgggcggaagcgcgucucuagagaagggugcggucgauaaccgggggcgccccuggaaggccgagguacccaggcuggagggaggggcuggaggugcgggggcgcucaacuggaggggccuggaucgcugggugggcgggcagcugauggggccgaggucuccagcguagggggugccgaagauaccgggggcgcccagccgcugggggcggggucuccaggcucgagggguccuggggacgcugggugaggguucggggagagcgcggcgggcugggcgcggccuuaggucccugacccccccgacccccguccgccgcaggaugggcagcagcucgcuguccgaggacuaccgccagugccuggagcgcgagcugcgacggggccgcgcgggcgugugcggggaccccucgcugcgcgcggugcucuggcagauccugguggaggacuucgaccugcacggggcgcugcaggacgacgcgcuggcucugcucaccgacgggcuguggggccgcgccgaccuggcgcccgcgcuacgcggccuggcucgcgccuucgagcuucuggagcucgccgcggugcaccuguaccugcugcccuggaggaaggaguucaccaccaucaagguaggcgccaggccaggaggagcgcgccccucguccuggccugcgggucgcggggccgccgaccaugggggaccacgccuuucgagagagaggggcuucaaguguccucagugccuggugggcuccucaaggcuccgagcgcugaggggucgugggcgugugggggcacccacuccuagggcugagaacauggggugggcgagggcaggcuugggugcugccuacgggguccugcccugagagcuugcgucagugucuucccuaagaggccucgcggccccaguugccauggaaaucuuaggacgggggcacagaagggacuugaguucccauggucauccuaauuccuccagguuaugggccaaucccauuugcagaggaggccgccgaggcugggaggacugcagaugggugcaucccugugaagucucagggcugggcucagaccuagugaacuccacggccuggggcgggaggcugugcccagggcuggccuggccucuccaggugagcuccuggcggcaggagggggcagggccgccgggagcucugagcuaauucggaagaguaggaagccgaugacgucacugggcacgugggcgagcuacgccuccgccgguugccauggcagcggcagucucuccgcggcuccccggggacaccugcuggucggaggcgccaggacuuucauucaugagagaggacggacaggcccgcccuugaggccucccagggggcggggcgggggaauaaccggcuucagugccggacagcccugguuuggacuuaguucugcugcuuccuggccgcgaggacuuggccaaauuagcuaaucucugucagccccuuuccuccugagacagcgacacgggaacaguccaguucauggggccagaggaaugaaucaaagccccgagcucagugcugcaggcacugggcgcuccacacgugggccguguccaggcauuagaugcuaggagucccggaguuagggaauuugagagucaggagacgcucgcagugauuguccugagcuccuuuaguucuucaccuaaguguaggcuagaaagcacucagccaggccgggcgcgguggcucacgccuguaaucccagcucuuugggaggccgaggugggcagaucacgaggucaggagauugacaccagccuaaccaacauggugaaaccccgucucuauuaaaaaauacaaaaaugagcugggugugguggcacgcgccuguaaucccagcuacucaggaggcugagggaggagaaucacuugaaccugggagguggagguuguagugagcagagaucgagccacugcacuccauccuggugacagagugagacuccgucucaaaaaaaaaaaaaaaagagcacucacccuucuaccgucccacggcugucagcccagugcauggacagccucuggagagcgcugaaaacagacgugucacccccaugguggaauacuacacagcagggggaaugaacguuacagcuucuguccuugucugcaagacuguaguggaaaaaaacaaaguucagaacaacacguuuaagaggcuaccugucuagcuuugguuagagaccuuacaaagaggugaaaaaaaaggggggacuaccucauacgaggagcaaacgaaaucuguauuuggguuugcaaaacaaacaccugggcaaguacauucaaaacuaauuagaugaggccaucuccaggggugaagggagcggugggacagaagacaguggaauuucucaguacaggggcucuucauuuuguucugauuugugagcuagguuaauguauucauuguuuuuuccauuaaauuuaagaaauucggccaggugcgguggcucacaccuguaaucccagcacuucgggaggccaagguggguggaucaugaggucaagggaucaagaccuuccuggucaacauggugaaaccccgucucuacuaaauauacaaaaauuaguggggcgugguggugcgcaccuguaaucccagcuacucaggaggcugaggcaggaagaucgcuugaacccgggaggaggagguuguagugagccgagaucgugccacuguacuccagacagagcgagacucugucucaaaaaagaaaaaaaaaaaaaaauucuaggccgggcacaguggcucacgcuuguaaucccagcacuuugggagcucaaggcaggcggaucacuugaggucaggaguuugagaccagcauggccaacauggugaaacccugucucuacuaaaaauaugaaaauuagccgggugugguggugggcgccuguagucccagcuacccgggaggcugaggcaggggaacuugcuugaaccugggacgcagaggcugcagugagcugagauggagccacugcacuccagccuggaugacagagcaagacucugucucaaaaaaaaaaaaaaaaaaaaaaaaaaaaagaaaucaucauguuugggccuggcccaagcuggcuaagccuagucucugggguugggucugagcaucagaagcugccaaggccugagccaacagaucccggacccacuguacccuagggucuggccuaugggagggugggcagucacugaccuggccgcucccuugcagaccuucucugggggcuacgugcacgugcugaagggugu

SEQ ID NO: 19757 - RNA, 2312 nt, Homo sapiens
auuucugaauuauuuaucagugaaauaauaugucuagauuugguucaaaccacuaaugaagggagguuggugguagucuggagaggaggcugugggccugggggcugggaugucacacaugggccuuugucccgccguucucucuacuuuuguaagguuuucaaaaguaagugauaaguaaugacagagucaccaaugugugaucucaugagguuccacaaaguaggcaucacuggccacuuugcagacaaggaaacaggaguuggugucaagagcgugagcccucagaggacagggcccugucuucccacuaacuccccaccccaggcaggguacugcacagagcugcgaccuguagguaaauaccugugcacugauugagucaggugucugaagcccccagccagugacugaugggcucagaaacugaaccugcuuucucugccuuuuaagcugcugggaaguccuccuuuuuucccaaaggaggagggaaaacauauuaaccuccacucccaaaugccuugggcucccacagcccugcaggggaagcagaacugucuccacugacagaaauggaaauugaggcucacaggggccugacugcccacaguucacagcuggaaacagcucggagacccccaagcccucacucccaaccuccaggcuuccuauguccacaaagcugcuacugggaauacccaggagccugggacuaucaguguuaagaaagagcucuggucccucccacaaaugacaaaucaaaacccaaacccaccagcccuggggcauuugucccuauaccuuggacugcagauacacaggguggguggaccugcuccucccggggacagcccuucgggcuccagaggaugccacugugugcggcugggggacugagagguucccauguaguuccagagcggcaggcuggccugccugugcccucaggcaccugcuggcucccuggaaugggagcucuaggaaaccaggagguggugggcuuggcugggcagguggaggagucugcaguuugcauccaaguuccuaccuaggcaaauggaaccccgaaagcccuuuuggaaaagucucugaucgggaaggggggagguucugagagcuuucuucccguuaccgacuccaagguccugcaguagggccuccaccaucagggcagggagcgcuccacgcgcaccuacccuccccgaugagcgugcgccugggccacucccggaccagccacccuugcagcucuggaguccccggcaggccgcgcccgugcaugccccacauccccaagacccaucucagccccucgccccuggcaggaucccugcccgcgagucuacggcccucgccccccgggacucgcggcugggcgaacaaagcggacgcgcuugcaagcggccagcgucgcccucacgccccaccgacagggaccccaaacuccagccccggaaccccccucccccgcuccccgggucaccggcuggcuuggcugggagggggcucaggacgaaacuccgggccacccaccaaggagcgugccgggcacggcuucccgggccgggagcgcagagaacaagggggcggagacucgguccgugugcccccagccccgcgcggggaccgcgcccgggaggugccccuggcccgccggacgaccccgagcugccaaaggggucuucgcgacucccgggagcggcgaagggugagcccuggggggaggggcugcggcucgcugcggggaagcgcugcgcgggggucucgggggcuggggcugaacucaccuccggugccggcgcccuccgggggcuccaugcggccggugcggucugggaggggcacgggcgacggcggcgucgccuggcccgggcgccccaacagcugcggcagcgacucggccccggcuccgggcgcagcgcaucggggcagcaaccggggggccgcggcggcagggaggagcccgcggggcggggcggggcgcgcagcugcucccgggccccggcccccucccggcgcccccccagccgcaggacaggugcggccccgccccggcccgcgcgcgcccccugcuggccccuggcccagcggaccccucccccgccgacccuucccucgcgggccgcgccccgccgcggacaccaccgggaccuggcugcgcccucccgaccccggccgggcguccggggcuccugcgcacucacuuggcggccgcgcccgcuggcguccucuuguucucuuccagguacuugcguguggggcgccgacugugugcgggcgccccucggggcuggcgaggggcacaggagggg

SEQ ID NO: 19758 - RNA, 2312 nt, Homo sapiens
ccccuccugugccccucgccagccccgaggggcgcccgcacacagucggcgccccacacgcaaguaccuggaagagaacaagaggacgccagcgggcgcggccgccaagugagugcgcaggagccccggacgcccggccggggucgggagggcgcagccaggucccggugguguccgcggcggggcgcggcccgcgagggaagggucggcgggggagggguccgcugggccaggggccagcagggggcgcgcgcgggccggggcggggccgcaccuguccugcggcugggggggcgccgggagggggccggggcccgggagcagcugcgcgccccgccccgccccgcgggcuccucccugccgccgcggccccccgguugcugccccgaugcgcugcgcccggagccggggccgagucgcugccgcagcuguuggggcgcccgggccaggcgacgccgccgucgcccgugccccucccagaccgcaccggccgcauggagcccccggagggcgccggcaccggaggugaguucagccccagcccccgagacccccgcgcagcgcuuccccgcagcgagccgcagccccuccccccagggcucacccuucgccgcucccgggagucgcgaagaccccuuuggcagcucggggucguccggcgggccaggggcaccucccgggcgcgguccccgcgcggggcugggggcacacggaccgagucuccgcccccuuguucucugcgcucccggcccgggaagccgugcccggcacgcuccuugguggguggcccggaguuucguccugagcccccucccagccaagccagccggugacccggggagcgggggagggggguuccggggcuggaguuuggggucccugucgguggggcgugagggcgacgcuggccgcuugcaagcgcguccgcuuuguucgcccagccgcgagucccggggggcgagggccguagacucgcgggcagggauccugccaggggcgaggggcugagaugggucuuggggauguggggcaugcacgggcgcggccugccggggacuccagagcugcaaggguggcugguccgggaguggcccaggcgcacgcucaucggggaggguaggugcgcguggagcgcucccugcccugaugguggaggcccuacugcaggaccuuggagucgguaacgggaagaaagcucucagaaccuccccccuucccgaucagagacuuuuccaaaagggcuuucgggguuccauuugccuagguaggaacuuggaugcaaacugcagacuccuccaccugcccagccaagcccaccaccuccugguuuccuagagcucccauuccagggagccagcaggugccugagggcacaggcaggccagccugccgcucuggaacuacaugggaaccucucagucccccagccgcacacaguggcauccucuggagcccgaagggcuguccccgggaggagcagguccacccacccuguguaucugcaguccaagguauagggacaaaugccccagggcugguggguuuggguuuugauuugucauuugugggagggaccagagcucuuucuuaacacugauagucccaggcuccuggguauucccaguagcagcuuuguggacauaggaagccuggagguugggagugagggcuugggggucuccgagcuguuuccagcugugaacugugggcagucaggccccugugagccucaauuuccauuucugucaguggagacaguucugcuuccccugcagggcugugggagcccaaggcauuugggaguggagguuaauauguuuucccuccuccuuugggaaaaaaggaggacuucccagcagcuuaaaaggcagagaaagcagguucaguuucugagcccaucagucacuggcugggggcuucagacaccugacucaaucagugcacagguauuuaccuacaggucgcagcucugugcaguacccugccugggguggggaguuagugggaagacagggcccuguccucugagggcucacgcucuugacaccaacuccuguuuccuugucugcaaaguggccagugaugccuacuuuguggaaccucaugagaucacacauuggugacucugucauuacuuaucacuuacuuuugaaaaccuuacaaaaguagagagaacggcgggacaaaggcccaugugugacaucccagcccccaggcccacagccuccucuccagacuaccaccaaccucccuucauuagugguuugaaccaaaucuagacauauuauuucacugauaaauaauucagaaau

SEQ ID NO: 19759 - RNA, 2408 nt, Homo sapiens
ugcuaccuagggggugcuccaguagcuuccuugaaugaaccaaagagaaggggugaaggggggagucaguugccuaggagcuugcauggacuucuguguccuggaaccagcccggagcugcuggaagaugcuagaaguuggaauccuaucucauuucuaaacaucugcucccacucaucucuuuccagggucaucaguuauccccacuccucccccccgcccccacuuuguauaaaugagccccucacaucccuccaucuucuccaucacuguguggucacuucuuaaaucaugcgucuggaaggcgcccuccuguaccccauccuggaggcuuccugcacuuccccucuuguuucuuccagaaaugagucagagugaaagcaaacuuucugagguccugagaucccggagacaggcugugagggccgcuggccccgcccgcuccagcagcguguguguguaugucugugugugugugugugcgcgcgcgcgcgcgcgucaggggccaaugcuggaaaggaaacagcggacucgcugaggagaagaaaggagccgcccccuucgucgccagcccccuccccacuucccguccagcgcgcugcucccuuccccccgccucuggccucggggaaggagcaggaggcagcccaggcggagcgggaggagcuggcagcggggcgcaugccaggcggggguccucagggcgccccagccgccgccggcggcggcggcgugagccaccgcgcagguaggggagcugccacagaguccuagcacguccuggggggguccuggcaaggagggcgcgcucuggcccccaggaagucgcguaggucagggcgugccucuguuaacaaccccuuucgaggugagggaaacugaggcaggacgcgaggcgugcgagguugagagaagagcgagucuugggcugccagcccggcaccagcgccgagccgggccaggucccugacccaggacugugcagcgauccccgggacccgcaguuugcgaaacuguaggagucugacccgcgcccccgcugcguguccaggugaccgggaaagguugcagaggcgugcuugggguuuggauccguccccguccugggacaccugcgccgccugcacucucguugcggugcgccccagccugcgcccccucgggacaggggacgucccgcccgccuuaaccccaagacccagcuggaucucggguuccaccccuucggggaccuggagggaggaggcugggagcgggaccaggaacuggugccugugccuucccuaggggcugcucugaaaucagugucaccgcccacuuccuacuuggcuacaguaacggggauggcccaagccggagacugcucgguuuccaccgccuggagcgcgggucucgcugucaacucuuagugaugauuguggaugguuguuuuucaacaaugacaggacuucuaccuucucacucuuaaaaugugagguuuuccaaagacagugagauuuggaguuagggagugcugccuuguguucuugcugggugaggacagggcugggucagucgcuuaaccucucagagccucagucuccugaaauguaaaggagaacacucauagccuggccuccaugugucguuagguuuguuguaugggaaaucaauuugcaaaguguuaucaucaacuggacaaauuugaauuggacagcacuaggaccauaggaacugggguuuggagacagucugccugcaugucaauccuggacaugcaggagacuaugacaguaccugcuucauaggguuguuaugcgguuuaacugugaugguggaagugaagcaccucgcccaaugccugaaauacccagugcacucucaaaaaaccuuaguugcuauuuuuccuaggcaaaaucuaaauaauugggaguaaugugagaauaccaguuugauuugauuaaugcaggaauaguagggcauuuaaaaacacauguaguucuccugugcucggcaugguacaugaaguccucugagguucaguucugugccacagagcaaaaagaaccguggacaagauacccgcuuuucgggcucuuugacuuugagccuguuuucucaucuguuuacaaaaaagauaaaagaaaaauggggguaguaauuacugccuuuuguacugaucgcauugccugaggauuaaaugaggcaaaagaucugaaagcaccuuguggaguaugagucacuaugcacauauaagacaugauaguacuaggagggaaugguaacaucugcagguuuuuagaacuuacaaugugccagacauuuuauuaugaauuccuuugaugaaauccucccugcaucuuuaugggacugggauuacaguccucauuucccuaugacaaagcugagguucagggucacccugcuug

SEQ ID NO: 19760 - RNA, 2408 nt, Homo sapiens
caagcagggugacccugaaccucagcuuugucauagggaaaugaggacuguaaucccagucccauaaagaugcagggaggauuucaucaaaggaauucauaauaaaaugucuggcacauuguaaguucuaaaaaccugcagauguuaccauucccuccuaguacuaucaugucuuauaugugcauagugacucauacuccacaaggugcuuucagaucuuuugccucauuuaauccucaggcaaugcgaucaguacaaaaggcaguaauuacuacccccauuuuucuuuuaucuuuuuuguaaacagaugagaaaacaggcucaaagucaaagagcccgaaaagcggguaucuuguccacgguucuuuuugcucuguggcacagaacugaaccucagaggacuucauguaccaugccgagcacaggagaacuacauguguuuuuaaaugcccuacuauuccugcauuaaucaaaucaaacugguauucucacauuacucccaauuauuuagauuuugccuaggaaaaauagcaacuaagguuuuuugagagugcacuggguauuucaggcauugggcgaggugcuucacuuccaccaucacaguuaaaccgcauaacaacccuaugaagcagguacugucauagucuccugcauguccaggauugacaugcaggcagacugucuccaaaccccaguuccuaugguccuagugcuguccaauucaaauuuguccaguugaugauaacacuuugcaaauugauuucccauacaacaaaccuaacgacacauggaggccaggcuaugaguguucuccuuuacauuucaggagacugaggcucugagagguuaagcgacugacccagcccuguccucacccagcaagaacacaaggcagcacucccuaacuccaaaucucacugucuuuggaaaaccucacauuuuaagagugagaagguagaaguccugucauuguugaaaaacaaccauccacaaucaucacuaagaguugacagcgagacccgcgcuccaggcgguggaaaccgagcagucuccggcuugggccauccccguuacuguagccaaguaggaagugggcggugacacugauuucagagcagccccuagggaaggcacaggcaccaguuccuggucccgcucccagccuccucccuccagguccccgaagggguggaacccgagauccagcugggucuugggguuaaggcgggcgggacguccccugucccgagggggcgcaggcuggggcgcaccgcaacgagagugcaggcggcgcaggugucccaggacggggacggauccaaaccccaagcacgccucugcaaccuuucccggucaccuggacacgcagcgggggcgcgggucagacuccuacaguuucgcaaacugcgggucccggggaucgcugcacaguccugggucagggaccuggcccggcucggcgcuggugccgggcuggcagcccaagacucgcucuucucucaaccucgcacgccucgcguccugccucaguuucccucaccucgaaagggguuguuaacagaggcacgcccugaccuacgcgacuuccugggggccagagcgcgcccuccuugccaggacccccccaggacgugcuaggacucuguggcagcuccccuaccugcgcgguggcucacgccgccgccgccggcggcggcuggggcgcccugaggacccccgccuggcaugcgccccgcugccagcuccucccgcuccgccugggcugccuccugcuccuuccccgaggccagaggcggggggaagggagcagcgcgcuggacgggaaguggggagggggcuggcgacgaagggggcggcuccuuucuucuccucagcgaguccgcuguuuccuuuccagcauuggccccugacgcgcgcgcgcgcgcgcacacacacacacacagacauacacacacacgcugcuggagcgggcggggccagcggcccucacagccugucuccgggaucucaggaccucagaaaguuugcuuucacucugacucauuucuggaagaaacaagaggggaagugcaggaagccuccaggaugggguacaggagggcgccuuccagacgcaugauuuaagaagugaccacacagugauggagaagauggagggaugugaggggcucauuuauacaaagugggggcgggggggaggaguggggauaacugaugacccuggaaagagaugagugggagcagauguuuagaaaugagauaggauuccaacuucuagcaucuuccagcagcuccgggcugguuccaggacacagaaguccaugcaagcuccuaggcaacugacuccccccuucaccccuucucuuugguucauucaaggaagcuacuggagcacccccuagguagca

SEQ ID NO: 19761 - RNA, 2455 nt, Homo sapiens
cuugauacauuuauuauuuuaaaagauaauguagccaaaugucuuccucuguguuaaaucuuuacaaaacugaaaucuuaaaauggugacaaaaauucuacuucugauagaaucuauucauuuuuccaauuagauagggcauaauucuuaauuugcaaaacaaaacguaauaugcuuaugagguuccaucccaaagaaccugcuauugagaguagcauucagaauaacggguggaaaugccaacuccagaguuucagauccuaccgguaauugggguagggaggggcuuugggcggggccucccuagaggaggaggcguuguuagaaagcugucuggccaguccacagcugucacuaaucgggguaagccuuguuguauuugugcguguggguggcauucucaaugagaacuagcuucacuugucauuugagugaaaucuacaacccgaggcggcuagugcucccgcacuacugggaucugagaucuucggagaugacugucgcccgcaguacggagccagcagaaguccgacccuuccugggaaugggcuguaccgagagguccgacuagccccaggguuuuagugagggggcaguggaacucagcgagggacugagagcuucacagcaugcacgaguuugaugccagagaaaaagucgggagauaaaggagccgcgugucacuaaauugccgucgcagccgcagccacucaagugccggacuugugaguacucugcgucuccaguccucggacagaaguuggagaacucucuuggagaacuccccgaguuaggagacgagaucuccuaacaauuacuacuuuuucuugcgcuccccacuugccgcucgcugggacaaacgacagccacaguuccccugacgacaggauggaggccaagggcaggagcugaccagcgccgcccucccccgcccccgacccaggagguggagaucccuccgguccagccacauucaacacccacuuucuccucccucugccccuauauucccgaaacccccuccuccuucccuuuucccuccuccuggagacgggggaggagaaaaggggaguccagucgucaugacugagcugaaggcaaaggguccccgggcuccccacguggcgggcggcccgcccucccccgaggucggauccccacugcugugucgcccagccgcagguccguucccggggagccagaccucggacaccuugccugaaguuucggccauaccuaucucccuggacgggcuacucuucccucggcccugccagggacaggaccccuccgacgaaaagacgcaggaccagcagucgcugucggacguggagggcgcauauuccagagcugaagcuacaaggggugcuggaggcagcaguucuagucccccagaaaaggacagcggacugcuggacagugucuuggacacucuguuggcgcccucaggucccgggcagagccaacccagcccucccgccugcgaggucaccagcucuuggugccuguuuggccccgaacuucccgaagauccaccggcugcccccgccacccagcggguguuguccccgcucaugagccgguccgggugcaagguuggagacagcuccgggacggcagcugcccauaaagugcugccccggggccugucaccagcccggcagcugcugcucccggccucugagagcccucacugguccggggccccagugaagccgucuccgcaggccgcugcgguggagguugaggaggaggauggcucugaguccgaggagucugcggguccgcuucugaagggcaaaccucgggcucuggguggcgcggcggcuggaggaggagccgcggcugucccgccgggggcggcagcaggaggcgucgcccugguccccaaggaagauucccgcuucucagcgcccagggucgcccugguggagcaggacgcgccgauggcgcccgggcgcuccccgcuggccaccacggugauggauuucauccacgugccuauccugccucucaaucacgccuuauuggcagcccgcacucggcagcugcuggaagacgaaaguuacgacggcggggccggggcugccagcgccuuugccccgccgcggaguucacccugugccucguccaccccggucgcuguaggcgacuuccccgacugcgcguacccgcccgacgccgagcccaaggacgacgcguacccucucuauagcgacuuccagccgcccgcucuaaagauaaaggaggaggaggaaggcgcggaggccuccgcgcgcuccccgcguuccuaccuuguggccggugccaaccccgcagccuucccggauuucccguuggggccaccgcccccgcugccgccgcgagcgaccccauccagacccggggaagcggcggugacggccgcacccgccagugccucagucucgucugcguccuccucggggucgacccu

SEQ ID NO: 19762 - RNA, 2455 nt, Homo sapiens
agggucgaccccgaggaggacgcagacgagacugaggcacuggcgggugcggccgucaccgccgcuuccccgggucuggauggggucgcucgcggcggcagcgggggcgguggccccaacgggaaauccgggaaggcugcgggguuggcaccggccacaagguaggaacgcggggagcgcgcggaggccuccgcgccuuccuccuccuccuuuaucuuuagagcgggcggcuggaagucgcuauagagaggguacgcgucguccuugggcucggcgucgggcggguacgcgcagucggggaagucgccuacagcgaccgggguggacgaggcacagggugaacuccgcggcggggcaaaggcgcuggcagccccggccccgccgucguaacuuucgucuuccagcagcugccgagugcgggcugccaauaaggcgugauugagaggcaggauaggcacguggaugaaauccaucaccgugguggccagcggggagcgcccgggcgccaucggcgcguccugcuccaccagggcgacccugggcgcugagaagcgggaaucuuccuuggggaccagggcgacgccuccugcugccgcccccggcgggacagccgcggcuccuccuccagccgccgcgccacccagagcccgagguuugcccuucagaagcggacccgcagacuccucggacucagagccauccuccuccucaaccuccaccgcagcggccugcggagacggcuucacuggggccccggaccagugagggcucucagaggccgggagcagcagcugccgggcuggugacaggccccggggcagcacuuuaugggcagcugccgucccggagcugucuccaaccuugcacccggaccggcucaugagcggggacaacacccgcuggguggcgggggcagccgguggaucuucgggaaguucggggccaaacaggcaccaagagcuggugaccucgcaggcgggagggcuggguuggcucugcccgggaccugagggcgccaacagaguguccaagacacuguccagcaguccgcuguccuuuucugggggacuagaacugcugccuccagcaccccuuguagcuucagcucuggaauaugcgcccuccacguccgacagcgacugcugguccugcgucuuuucgucggagggguccugucccuggcagggccgagggaagaguagcccguccagggagauagguauggccgaaacuucaggcaagguguccgaggucuggcuccccgggaacggaccugcggcugggcgacacagcaguggggauccgaccucgggggagggcgggccgcccgccacguggggagcccggggacccuuugccuucagcucagucaugacgacuggacuccccuuuucuccucccccgucuccaggaggagggaaaagggaaggaggaggggguuucgggaauauaggggcagagggaggagaaaguggguguugaauguggcuggaccggagggaucuccaccuccugggucgggggcgggggagggcggcgcuggucagcuccugcccuuggccuccauccugucgucaggggaacuguggcugucguuugucccagcgagcggcaaguggggagcgcaagaaaaaguaguaauuguuaggagaucucgucuccuaacucggggaguucuccaagagaguucuccaacuucuguccgaggacuggagacgcagaguacucacaaguccggcacuugaguggcugcggcugcgacggcaauuuagugacacgcggcuccuuuaucucccgacuuuuucucuggcaucaaacucgugcaugcugugaagcucucagucccucgcugaguuccacugcccccucacuaaaacccuggggcuagucggaccucucgguacagcccauucccaggaagggucggacuucugcuggcuccguacugcgggcgacagucaucuccgaagaucucagaucccaguagugcgggagcacuagccgccucggguuguagauuucacucaaaugacaagugaagcuaguucucauugagaaugccacccacacgcacaaauacaacaaggcuuaccccgauuagugacagcuguggacuggccagacagcuuucuaacaacgccuccuccucuagggaggccccgcccaaagccccucccuaccccaauuaccgguaggaucugaaacucuggaguuggcauuuccacccguuauucugaaugcuacucucaauagcagguucuuugggauggaaccucauaagcauauuacguuuuguuuugcaaauuaagaauuaugcccuaucuaauuggaaaaaugaauagauucuaucagaaguagaauuuuugucaccauuuuaagauuucaguuuuguaaagauuuaacacagaggaagacauuuggcuacauuaucuuuuaaaauaauaaauguaucaag

SEQ ID NO: 19763 - RNA, 2287 nt, Homo sapiens
cuguccuuuccccauccagugccucccaaaucucucuuaguccccaaauguauccccgcccuaaggggcgcuggugggaggagcuaaaugugggggcggggcucggaguccagcuuauuaucauggcaucucagccagggcugggguagggguuugggaagggcaacccagcaucccccgaucccagagucgcggccggggaugacgcgagagagcguggucgcccccagaaggcccugggccaucaugccggccuccacguagaccccaggggucgcucacuccugccagcucgccuucaccaaggccaggagcuuagcgcacgcucgccucccgcccccccgccgccucugccgccgcccccuccuuggaaaccaaguuaccaacguuaaaccaauccccaagcgcaacucugccucccccacaccccacccgccgcgccgcgcggagccguccucuagcccagcuccucggcucgcgcucuccucgccuccugugcuuuccccgccgcggcgaugccagggccuucgccagggcugcgccgggcgcuacucggccucugggcugcucugggccuggggcucuucggccucucagguaagagccccgcucugguucgggguggacagggcgggggcggagucccuggaccugagaaacggccuccugucccucccagcucugcccucgccucgcucccacgccucugcccccaccucgagccugagucuucuccccuucccccuccuccccaacacacacccgagccccagcuuccugacuccucgauagccccuacccgcuucgagauccuagguguucuuccgcacccaacccuucgcccuggagacccagugucucuccuguccgcuccccggguaccuccuuacgcugugcugugcaccaugguccacggacuggcaucuuccccacucgcgguccgcgaagacuccaucucuccaacuacccugacucagaggcgcuguucccgcuccacccagagcccuggcaaccgggucccucagcuguucccgcgguuccuuccaugagcccagccuugcgucccggcuccguguucuucaccggguguaggguccuuccugauccuugacccagccucgucucuccuuugcccuugccgcaaacgcacucuccucguaucccggcauucugccaggacccugagaacugguucaucccccaucccccaucccggguccccuucucucagccuugcuguguucauccaagaacccaccuuuccucuccucuacgcccuccccccaugcuuucccgccgcuccaucggcgcuuuggagaccauggcucucugcuaccacgucccagagacacccucgagguuuagacucugggagugcgccuuuaaaccggaggccugggcaggacgcgggacgccuggguucuuucccuggcugcagccucuccuccuccuccccgcccucugagaacccuugacucgacauaggggcgcuaagaugucagggaguuggcuccccaggcucagcccgcguuucccugggcagcggucucgcaggagcccuucugggcggaccugcagccucgcguggcguucguggagcgcgggggcucgcuguggcugaauugcagcaccaacugcccucggccggagcgcgguggccuggagaccucgcugcgccgaaacgggacccagagggguuugcguugguuggcgcggcagcugguggacauucgcgagccggagacucagcccgucugcuucuuccgcugcgcgcggcgcacacuacaggcgcgugggcucauucgcacuuuccgugaguucuggguggccacgcgcguacuccacuacucucccucccucccaggccccgcccccugggucccaggguccuccccuucaggccccaccuucuguuccaagucccgguguucaaagagcugcggacucuucccccuugcagagcgaccagaucgcguagagcugaugccgcugccucccuggcagccggugggcgagaacuucacccugagcuguaggguccccggcgccgggccccgugcgagccucacgcugacccugcugcggggcgcccaggagcugauccgccgcagcuucgccggugaaccaccccgagcgcggggcgcggugcucacagccacgguacuggcucggagggaggaccauggagccaauuucucgugucgcgccgagcuggaccugcggccgcacggacugggacuguuugaaaacagcucggcccccagagagcuccgaaccuucugugagu

SEQ ID NO: 19764 - RNA, 2287 nt, Homo sapiens
acucacagaagguucggagcucucugggggccgagcuguuuucaaacagucccaguccgugcggccgcagguccagcucggcgcgacacgagaaauuggcuccaugguccucccuccgagccaguaccguggcugugagcaccgcgccccgcgcucggggugguucaccggcgaagcugcggcggaucagcuccugggcgccccgcagcagggucagcgugaggcucgcacggggcccggcgccggggacccuacagcucagggugaaguucucgcccaccggcugccagggaggcagcggcaucagcucuacgcgaucuggucgcucugcaagggggaagaguccgcagcucuuugaacaccgggacuuggaacagaagguggggccugaaggggaggacccugggacccagggggcggggccugggagggagggagaguaguggaguacgcgcguggccacccagaacucacggaaagugcgaaugagcccacgcgccuguagugugcgccgcgcgcagcggaagaagcagacgggcugagucuccggcucgcgaauguccaccagcugccgcgccaaccaacgcaaaccccucugggucccguuucggcgcagcgaggucuccaggccaccgcgcuccggccgagggcaguuggugcugcaauucagccacagcgagcccccgcgcuccacgaacgccacgcgaggcugcagguccgcccagaagggcuccugcgagaccgcugcccagggaaacgcgggcugagccuggggagccaacucccugacaucuuagcgccccuaugucgagucaaggguucucagagggcggggaggaggaggagaggcugcagccagggaaagaacccaggcgucccgcguccugcccaggccuccgguuuaaaggcgcacucccagagucuaaaccucgagggugucucugggacgugguagcagagagccauggucuccaaagcgccgauggagcggcgggaaagcauggggggagggcguagaggagaggaaagguggguucuuggaugaacacagcaaggcugagagaaggggacccgggaugggggaugggggaugaaccaguucucaggguccuggcagaaugccgggauacgaggagagugcguuugcggcaagggcaaaggagagacgaggcugggucaaggaucaggaaggacccuacacccggugaagaacacggagccgggacgcaaggcugggcucauggaaggaaccgcgggaacagcugagggacccgguugccagggcucuggguggagcgggaacagcgccucugagucaggguaguuggagagauggagucuucgcggaccgcgaguggggaagaugccaguccguggaccauggugcacagcacagcguaaggagguacccggggagcggacaggagagacacugggucuccagggcgaaggguugggugcggaagaacaccuaggaucucgaagcggguaggggcuaucgaggagucaggaagcuggggcucggguguguguuggggaggagggggaaggggagaagacucaggcucgaggugggggcagaggcgugggagcgaggcgagggcagagcugggagggacaggaggccguuucucagguccagggacuccgcccccgcccuguccaccccgaaccagagcggggcucuuaccugagaggccgaagagccccaggcccagagcagcccagaggccgaguagcgcccggcgcagcccuggcgaaggcccuggcaucgccgcggcggggaaagcacaggaggcgaggagagcgcgagccgaggagcugggcuagaggacggcuccgcgcggcgcggcggguggggugugggggaggcagaguugcgcuuggggauugguuuaacguugguaacuugguuuccaaggagggggcggcggcagaggcggcgggggggcgggaggcgagcgugcgcuaagcuccuggccuuggugaaggcgagcuggcaggagugagcgaccccuggggucuacguggaggccggcaugauggcccagggccuucugggggcgaccacgcucucucgcgucauccccggccgcgacucugggaucgggggaugcuggguugcccuucccaaaccccuaccccagcccuggcugagaugccaugauaauaagcuggacuccgagccccgcccccacauuuagcuccucccaccagcgccccuuagggcggggauacauuuggggacuaagagagauuugggaggcacuggauggggaaaggacag

SEQ ID NO: 19765 - RNA, 2844 nt, Homo sapiens
gccaccagccccacgggggcgucuaggagcacugcaggcauggggguuggucaggugggcgaggacugagacccucuccuccgaccacuccuccauucccagagcacuuaccuacuucauugauguggaugacacggugauaucgcggagcgccggaggcugcugugacgcgcaacucuaggggcacgaagcucgacgugucggcuguaggcagcgaacaccagaagcgcaccgcaccacgagccgugggagccuggugcaggcgacacagcuuccauggcucaucccuaugcgcccagggaagggagcagguugggaggggggaccggggaguuggcauugcccggccuguggggggcaguguguaugugugacacaaggucuagccuugugugugugugugacaagguguuccuucgucgcccaggcuggagugcaguggcgcgaucauggcucacugcagccucaaauucuggggcuuaagggauccucccaccucagcuucccaaguaguugagaccacaggcacgcgccacgccuggcuuuuuuuuuuuuuuuuuuugagacggaguuucgcucuuguugcccaggcuggagugcaauggcgcuaccucggcucaccgcaaccuccgccucccggguucaagcgauucuccugccucagccucccgaguagcugggaucacaggcaugcgccaccacgcccggcuaauuuuguauuuuuaguagagauagaguuucuccauguuggccaggcuggucucaaacucccgaccucaggugauccgcccgccucagccucccaaagugcugggauuacaggcgugagccaccgcgcccagucuaauuuuuuuuuaagagacggggaucucgcuguguugcccaggcuggucuugaacuccugggcucaagcgguucuuccgccucgaccuuccaaagaguugggauuacaggcaugagccacugcuggccuccuuuuggauacuaccucgagaaggcgucccagccccgacguaguaacgccuuacccucgauuuggaggcguuguuaucccagccugauguuuggggucgcguuccagcggugaucgcgggaguguucgcgccccggcccauagagggcgugccagcccuggacccgcagguuucccuccagugaccacgacuggaggcgccgucgggccucaaacagcaggggacauacgaggcuacgaccuccagggagcucugccccacccccucccuccgcccuuggaggcacccgccggaucggacucacucgagcugguaggagaagcuguaguugcccgggcccaccccagcgcucgccgcuuccucccagaaacacaccaaguccuccaaccgcucggugaagcacagaagcucuucgggcccccgggccgccagcaaggccgcuggggaggggcgacaaaggaagggcaugggggucugagcucuauccucgggagacagcccccuccucuucccucccgcagccugggcggacccgauaagaaaaaagccccgcccugccaucuucccaagcgggucccuuggagggguccgcagagguggugccccccuaauucccaggggcaaguuucucgccuuacugucccccgccgucaccacuggcgcacaccugcccacccagcggccagcugagcugggcgcggcguucaagaccucgagcucgggacugccagccccgccccagccuaggacacgcgcgcggcugggggugugugcggagaggcgggcccccuaucggccccggcaggcuccccgccaaccgauagcgccaaccgugccccccgccucccucccuccaccgggccgggcaagugaucuggcgcccucacacaaaccguguuuacaguagccuguggcuuggccccucuaacucggacccgggcuuuacccucccuccccuagggagggucggcuugguccccaccccccagggaccuuagcaccaagucagcccccuuaggauuuagcaugucccagacucccugaaaagguaaaacgggaauguuaagcccacucuagcucuugcccgggacgcgaucaggagucuuggauccuaacauaccccaccccgccccccacccauccaggacccagucuaaggguucagaugccagcuuggcccccaggacccggucaggaaguccagaaacaggcauggcccccaggaccuaggcugggaguucaggccccagcaugguccugcaggcuccagcguagggguccacacgcagcucauccuuaccuuugcucucgaacuugggguccgggagguuaggcgggggcgcccaggcggccccagcgagcaggagacaaagggagccgaccuggggccagagggacgccccgaggugguccaugauacagcccccgccacggggagcccagggcuccugccccuccgucccccgcccccggcacaguccacagcugggucagcagcugccuccgccggacgcagcugaccaggcccuucccgaccaggcgccucuaaguggcagauccccgagggggcggggccagcacucagccuggguagagauaagugccuggcgggaggaggcaggggcccuucccgagcccagaggccgcuugggggcaggggagggaguugggccgcaacagcucccguucuggcuucagacacacguuuuuuuuuucuuuguggcccuggacaggugacuuaccuuaccugagcuucagacuucucaucuguaaaaucuagccuggcacauagcgaacauuccaaaaaauguaccuacugauuuuaucgcagaaaucagcaucucuucccagccuggaaauaaauaaaaau

SEQ ID NO: 19766 - RNA, 2844 nt, Homo sapiens
auuuuuauuuauuuccaggcugggaagagaugcugauuucugcgauaaaaucaguagguacauuuuuuggaauguucgcuaugugccaggcuagauuuuacagaugagaagucugaagcucagguaagguaagucaccuguccagggccacaaagaaaaaaaaaacgugugucugaagccagaacgggagcuguugcggcccaacucccuccccugcccccaagcggccucugggcucgggaagggccccugccuccucccgccaggcacuuaucucuacccaggcugagugcuggccccgcccccucggggaucugccacuuagaggcgccuggucgggaagggccuggucagcugcguccggcggaggcagcugcugacccagcuguggacugugccgggggcgggggacggaggggcaggagcccugggcuccccguggcgggggcuguaucauggaccaccucggggcgucccucuggccccaggucggcucccuuugucuccugcucgcuggggccgccugggcgcccccgccuaaccucccggaccccaaguucgagagcaaagguaaggaugagcugcguguggaccccuacgcuggagccugcaggaccaugcuggggccugaacucccagccuagguccugggggccaugccuguuucuggacuuccugaccggguccugggggccaagcuggcaucugaacccuuagacuggguccuggauggguggggggcggggugggguauguuaggauccaagacuccugaucgcgucccgggcaagagcuagagugggcuuaacauucccguuuuaccuuuucagggagucugggacaugcuaaauccuaagggggcugacuuggugcuaaggucccugggggguggggaccaagccgacccucccuaggggagggaggguaaagcccggguccgaguuagaggggccaagccacaggcuacuguaaacacgguuugugugagggcgccagaucacuugcccggcccgguggagggagggaggcggggggcacgguuggcgcuaucgguuggcggggagccugccggggccgauagggggcccgccucuccgcacacacccccagccgcgcgcguguccuaggcuggggcggggcuggcagucccgagcucgaggucuugaacgccgcgcccagcucagcuggccgcugggugggcaggugugcgccaguggugacggcgggggacaguaaggcgagaaacuugccccugggaauuaggggggcaccaccucugcggaccccuccaagggacccgcuugggaagauggcagggcggggcuuuuuucuuaucggguccgcccaggcugcgggagggaagaggagggggcugucucccgaggauagagcucagacccccaugcccuuccuuugucgccccuccccagcggccuugcuggcggcccgggggcccgaagagcuucugugcuucaccgagcgguuggaggacuugguguguuucugggaggaagcggcgagcgcuggggugggcccgggcaacuacagcuucuccuaccagcucgagugaguccgauccggcgggugccuccaagggcggagggaggggguggggcagagcucccuggaggucguagccucguauguccccugcuguuugaggcccgacggcgccuccagucguggucacuggagggaaaccugcggguccagggcuggcacgcccucuaugggccggggcgcgaacacucccgcgaucaccgcuggaacgcgaccccaaacaucaggcugggauaacaacgccuccaaaucgaggguaaggcguuacuacgucggggcugggacgccuucucgagguaguauccaaaaggaggccagcaguggcucaugccuguaaucccaacucuuuggaaggucgaggcggaagaaccgcuugagcccaggaguucaagaccagccugggcaacacagcgagauccccgucucuuaaaaaaaaauuagacugggcgcgguggcucacgccuguaaucccagcacuuugggaggcugaggcgggcggaucaccugaggucgggaguuugagaccagccuggccaacauggagaaacucuaucucuacuaaaaauacaaaauuagccgggcgugguggcgcaugccugugaucccagcuacucgggaggcugaggcaggagaaucgcuugaacccgggaggcggagguugcggugagccgagguagcgccauugcacuccagccugggcaacaagagcgaaacuccgucucaaaaaaaaaaaaaaaaaaagccaggcguggcgcgugccuguggucucaacuacuugggaagcugaggugggaggaucccuuaagccccagaauuugaggcugcagugagccaugaucgcgccacugcacuccagccugggcgacgaaggaacaccuugucacacacacacacaaggcuagaccuugugucacacauacacacugccccccacaggccgggcaaugccaacuccccgguccccccucccaaccugcucccuucccugggcgcauagggaugagccauggaagcugugucgccugcaccaggcucccacggcucguggugcggugcgcuucugguguucgcugccuacagccgacacgucgagcuucgugccccuagaguugcgcgucacagcagccuccggcgcuccgcgauaucaccgugucauccacaucaaugaaguagguaagugcucugggaauggaggaguggucggaggagagggucucaguccucgcccaccugaccaacccccaugccugcagugcuccuagacgcccccguggggcugguggc

SEQ ID NO: 19767 - RNA, 4788 nt, Homo sapiens
acaggaaaggccuucucagaacacgacuggaucugaaaaccccucaccuguccacaccugaggcggcuccucuuccugcucucgcucagccuccuccaaaaaaucuuccagaagcuucucugcuuuuugagccucagcacucccuggggccgcccagcccagaaagguucggacacugcccagguccgaaugggcaggggggucucggaaauccugagggugguccugcagccaggagcccagcacugacaccacagcccuggccagagaggcagggucucagagcuggguccagagugggggacauagaauaugacuccugguaccuuuuuuuuuuuuuuuuuugagauagagucuuacugugucaccaaggcugcagugcaauggccugaucuugacucacugcaaccucagccucccgaguagcugggacuacaggcaugcgccaccacacccagcuaccuuuuuuuguuguuguuguauuuuuaguagagacaggguuucgccauauuggccaggauggucucuaacuccugaccuccagugauccaccugccucggccucccaaaguguugggauuacaggcaugagccaccacgccccaccugacucccagucucuuauuacccaaccugcaauuuucaaaaccccaguccgacugcuaaccuuugaccucuuggauuucccuccccgcacuccccuaucuggaugaaggacccaccucagguucuuguugaagcucagaucuuguaccgcugucuucuugaucucuacccugggaagaggccccccagcaggugaagaagggggaaccuagagggggcuuaggaagagggcucugggucugggagguguuuccagguuccacaccugaggagguggaggggggugcccaguugggguucuaggguggagaauacggagguuaugguucgcuacugacccgggaggugggggcgguggcauugguggcagcagaaagcccagcaggcaggcaguggguacaaagguccgguagguggccaggaaggcgggcaugaagcugggguccugcucacggucuccaaacaccaacucucccaccagccgcuccaggcgcgcugcccucagcacccucaccuugcugguucgauaguggaggaagguauuggcaauggggcugggagccugcaggaggggagagguggccaugagagagcaggagugguccucacagcaccccuucucuagucacauucaucacuagcaccacucuuuuuuuuuuuguuuuuuuuuuugagacagagucucacucuguugcccaggcuggagugcaguggcacgaucuugggucacuucaacuucugccuccuggguucaagcaauccuccuuccucagccuccaaguagcugaaacuacaggcgcacaccaccaagcccagcuaauuuuuguauuuuuguagagauaggguuucaccauguuggucagacuggucucgaacuccugaccucaaguaaucugccccccuuggccucccaaagucucccaaagggcuaggauuacaggcgugaaccaccgugcccagccccuagcaccacuuuuuuuuuuuuuuuuuuuugagacagaaucucacucugucaccuaggcuggaguucaguggcgugaucuuggcucacugcaaccuccgccuccuggguucaagcaauucucugccucagccucccaaguaucugggauuacaggcacccgccaccaagcccagcuaguuuuuucguauuuuuaguagagacgguguuucaccaucuuggccagguuggucuugaacuccugaccugaugauccacuugccucggccucccaaagugcugggauuacaggcgugagccaccucgccccgccuguagcaccauucuuucaugugauuccucugucucccggcuucuuggaguuauuguuuugguuuguuuuuuuuagaaacaggucuuguuuuguugcccaggcuggggugcaguggcacaaucauagcucacugcagccuccaaguccuagacucaagcggucccucugccccagccuccugaguagcugggaccacugcugggcaucaucacgcacagcuaguuuuuuaauuuuuauuuuuauuagagagaaucuugcuguguuguccaggcuggucuccaauuccuggccuucugccuuggucucucgaagcgcagggauuauaggugugugccccacucccugcccgcuugaaguuauuguuccuccccauccacaaauagcuccugcaacuugcccuggaaacccucccucucccaugcccuguccccuacucccucucccguccccucccccucccguccccucccccccacccccccgccccgccccacacacucuuuuccacccagggcuucccucagcccuccugucgcgcuucacuggcugccccauccgcccucaccuagccacuucuaaaccaaccccauuccaccuuccagccccggcccucuaaaccugccuuucccaacucugccguccaguucuguccuuaccaaguugucccuaggcuccucucgggaacugcgcggccaucgccuggccccaccccauucccuggaucuccccccacuuaccuggccgcccccaguccccuuucuaccuggucgccucaucuggucgccuccgagccccucccuuccuuccgcccacugcaccuggcggccugugcucggcucuccagcuccgcccucaacuggucgcuuccggccccgcgccacccaccaaacccccuccucaccuggcugcccccggggcccuccgccgggcuccugcgcugacugcgcugccgccgcagggagacacuguacaccgcgccguccucggucucuucaccccaguccugcagcggugccuggacgcacaggcggacucagggcaccaaaggggcacagguccuggggccucagccuccuuggccgcucggacucgggccgaguccuccugcugcauccccacgccccuucccggccagaagcugcgagacuagggcuggggucccaggcuaguccccuccucgcugcggguccccuccucccagguccugaggacaugggguggcauuuggggaugucccagggcccagucuaauagaaccugucucuagcucuuucugccgacugcgcucagagacucgcgcccccaucccuaagaggaaccagucgcuucacugggucaagggccgcgaguccccaggaggggacuccagggcaaguucagauugggagcagauaccguccgacgggcgggcgcuuggaguuucuggaccugcgggucaccagggaugcgggguccggggaucccuuguccccuuaccagggccagcucuuugccugcugugcgcuccauggccggcgcccgucccucucaguggcgccgcugagugaggcggaagggccggcggguggcggguggcgggcggcgggcaguggccgggcgcugaggccagaggggcggagcggccgagcugcuggggcggggcggggcagggcaggccggacccagccucugggugccuccagccggacccagcgccagcccaggagagguccuggcucuuccgcugggugccuaucaaucuguccccagaagaaaggacauaucuguccccaaggggucuuuuuuguauccccagaugugggggagcuccugugugggggcauguguguguccccagaccagaguccucuguccuccaguggaaggggcuagcuugaucaagugugggggcaucuuccacuuuuuauuauuauugcuauuauuuugagauggagucucguucugucacccaugcuggaguacaguggcuugaucuuaacucacugcaaccuccgccucccagauucaaaggauucuugugccucagccucccaaguagcuaggauuacaggugccgccaccaugcucagcuaauuuuuguauuuuuuguagaggcgggguuuugccauacuugccaggcuggucucaaacuccuggccucaagagauucgcccaccucagccucccaaaaugcugggauuacaggcaugaaccacggcgcccagccuuauuauuuuuuagagacagggucucacuccuguugccaaggcugcaguguaguggcuugaucuuggcucacugcaaucuccgccuccuggguucaauccauucuccugccucagucucccaaguagcugggacuacaggcauaugccaccaugcucagcuuuuuuuuuuuuuuuuuuuuuuuuuuuugguaaaaacugguuuucaccauguugcccaggcuagucuggaaccccugggcucaagcgacacacccagcucagccucccaaagugcugggaauauagguaugaaugagccacugcaccccgcccuuauuuuauuuauugagacagggucuggcucuguggcccaggcuggagugcaguagcacgaucauagcucacugcagccuggagcuccuggacucaagugauccucccaacucagccucccaaaauacugggauuacaggcauaaaaccacuacaucgggccaucucccauuuuuaagcuccaucugcgucacuagcugaugggagucaucaugacccagguuggaggaggcagucuguggcccuggguuuucagggacagccgucucuuggguggugcagggucaaaaacagaugaauacccagggucauggucgguaacauuuauugcgcaacucugaggccggggcggacccagcuggggagauuuacugugggaacgucuggccc

SEQ ID NO: 19768 - RNA, 4788 nt, Homo sapiens
gggccagacguucccacaguaaaucuccccagcuggguccgccccggccucagaguugcgcaauaaauguuaccgaccaugacccuggguauucaucuguuuuugacccugcaccacccaagagacggcugucccugaaaacccagggccacagacugccuccuccaaccugggucaugaugacucccaucagcuagugacgcagauggagcuuaaaaaugggagauggcccgauguagugguuuuaugccuguaaucccaguauuuugggaggcugaguugggaggaucacuugaguccaggagcuccaggcugcagugagcuaugaucgugcuacugcacuccagccugggccacagagccagacccugucucaauaaauaaaauaagggcggggugcaguggcucauucauaccuauauucccagcacuuugggaggcugagcugggugugucgcuugagcccagggguuccagacuagccugggcaacauggugaaaaccaguuuuuaccaaaaaaaaaaaaaaaaaaaaaaaaaaaagcugagcaugguggcauaugccuguagucccagcuacuugggagacugaggcaggagaauggauugaacccaggaggcggagauugcagugagccaagaucaagccacuacacugcagccuuggcaacaggagugagacccugucucuaaaaaauaauaaggcugggcgccgugguucaugccuguaaucccagcauuuugggaggcugaggugggcgaaucucuugaggccaggaguuugagaccagccuggcaaguauggcaaaaccccgccucuacaaaaaauacaaaaauuagcugagcaugguggcggcaccuguaauccuagcuacuugggaggcugaggcacaagaauccuuugaaucugggaggcggagguugcagugaguuaagaucaagccacuguacuccagcaugggugacagaacgagacuccaucucaaaauaauagcaauaauaauaaaaaguggaagaugcccccacacuugaucaagcuagccccuuccacuggaggacagaggacucuggucuggggacacacacaugcccccacacaggagcucccccacaucuggggauacaaaaaagaccccuuggggacagauauguccuuucuucuggggacagauugauaggcacccagcggaagagccaggaccucuccugggcuggcgcuggguccggcuggaggcacccagaggcuggguccggccugcccugccccgccccgccccagcagcucggccgcuccgccccucuggccucagcgcccggccacugcccgccgcccgccacccgccacccgccggcccuuccgccucacucagcggcgccacugagagggacgggcgccggccauggagcgcacagcaggcaaagagcuggcccugguaaggggacaagggauccccggaccccgcaucccuggugacccgcagguccagaaacuccaagcgcccgcccgucggacgguaucugcucccaaucugaacuugcccuggaguccccuccuggggacucgcggcccuugacccagugaagcgacugguuccucuuagggaugggggcgcgagucucugagcgcagucggcagaaagagcuagagacagguucuauuagacugggcccugggacauccccaaaugccaccccauguccucaggaccugggaggaggggacccgcagcgaggaggggacuagccugggaccccagcccuagucucgcagcuucuggccgggaaggggcguggggaugcagcaggaggacucggcccgaguccgagcggccaaggaggcugaggccccaggaccugugccccuuuggugcccugaguccgccugugcguccaggcaccgcugcaggacuggggugaagagaccgaggacggcgcgguguacagugucucccugcggcggcagcgcagucagcgcaggagcccggcggagggccccgggggcagccaggugaggaggggguuugguggguggcgcggggccggaagcgaccaguugagggcggagcuggagagccgagcacaggccgccaggugcagugggcggaaggaagggaggggcucggaggcgaccagaugaggcgaccagguagaaaggggacugggggcggccagguaaguggggggagauccagggaaugggguggggccaggcgauggccgcgcaguucccgagaggagccuagggacaacuugguaaggacagaacuggacggcagaguugggaaaggcagguuuagagggccggggcuggaagguggaaugggguugguuuagaaguggcuaggugagggcggauggggcagccagugaagcgcgacaggagggcugagggaagcccuggguggaaaagaguguguggggcggggcgggggggugggggggaggggacgggagggggaggggacgggagagggaguaggggacagggcaugggagagggaggguuuccagggcaaguugcaggagcuauuuguggauggggaggaacaauaacuucaagcgggcagggaguggggcacacaccuauaaucccugcgcuucgagagaccaaggcagaaggccaggaauuggagaccagccuggacaacacagcaagauucucucuaauaaaaauaaaaauuaaaaaacuagcugugcgugaugaugcccagcaguggucccagcuacucaggaggcuggggcagagggaccgcuugagucuaggacuuggaggcugcagugagcuaugauugugccacugcaccccagccugggcaacaaaacaagaccuguuucuaaaaaaaacaaaccaaaacaauaacuccaagaagccgggagacagaggaaucacaugaaagaauggugcuacaggcggggcgagguggcucacgccuguaaucccagcacuuugggaggccgaggcaaguggaucaucaggucaggaguucaagaccaaccuggccaagauggugaaacaccgucucuacuaaaaauacgaaaaaacuagcugggcuugguggcgggugccuguaaucccagauacuugggaggcugaggcagagaauugcuugaacccaggaggcggagguugcagugagccaagaucacgccacugaacuccagccuaggugacagagugagauucugucucaaaaaaaaaaaaaaaaaaaaguggugcuaggggcugggcacggugguucacgccuguaauccuagcccuuugggagacuuugggaggccaaggggggcagauuacuugaggucaggaguucgagaccagucugaccaacauggugaaacccuaucucuacaaaaauacaaaaauuagcugggcuugguggugugcgccuguaguuucagcuacuuggaggcugaggaaggaggauugcuugaacccaggaggcagaaguugaagugacccaagaucgugccacugcacuccagccugggcaacagagugagacucugucucaaaaaaaaaaacaaaaaaaaaaagaguggugcuagugaugaaugugacuagagaaggggugcugugaggaccacuccugcucucucauggccaccucuccccuccugcaggcucccagccccauugccaauaccuuccuccacuaucgaaccagcaaggugagggugcugagggcagcgcgccuggagcggcuggugggagaguugguguuuggagaccgugagcaggaccccagcuucaugcccgccuuccuggccaccuaccggaccuuuguacccacugccugccugcugggcuuucugcugccaccaaugccaccgcccccaccucccgggucaguagcgaaccauaaccuccguauucuccacccuagaaccccaacugggcaccccccuccaccuccucagguguggaaccuggaaacaccucccagacccagagcccucuuccuaagcccccucuagguucccccuucuucaccugcuggggggccucuucccaggguagagaucaagaagacagcgguacaagaucugagcuucaacaagaaccugagguggguccuucauccagauaggggagugcggggagggaaauccaagaggucaaagguuagcagucggacugggguuuugaaaauugcagguuggguaauaagagacugggagucagguggggcgugguggcucaugccuguaaucccaacacuuugggaggccgaggcagguggaucacuggaggucaggaguuagagaccauccuggccaauauggcgaaacccugucucuacuaaaaauacaacaacaacaaaaaaagguagcugggugugguggcgcaugccuguagucccagcuacucgggaggcugagguugcagugagucaagaucaggccauugcacugcagccuuggugacacaguaagacucuaucucaaaaaaaaaaaaaaaaaagguaccaggagucauauucuaugucccccacucuggacccagcucugagacccugccucucuggccagggcuguggugucagugcugggcuccuggcugcaggaccacccucaggauuuccgagaccccccugcccauucggaccugggcaguguccgaaccuuucugggcugggcggccccagggagugcugaggcucaaaaagcagagaagcuucuggaagauuuuuuggaggaggcugagcgagagcaggaagaggagccgccucagguguggacaggugagggguuuucagauccagucguguucugagaaggccuuuccugu

SEQ ID NO: 19769 - RNA, 2431 nt, Homo sapiens
gucucccacuuccccuuccccagcaauacuccccugucauccucaccucuccccuccccccagcucauuucccagaacccaccauccauuuaucuucucuacuuuauacaacacugcugggaggaagggcucuuccucaguggagcccaggaaccuccaugaggagcccauuucucccuucacaaccaaaaaauugcuuccuguagaauaacaagcagagggaaaaggcuggaaggagauauguuaucgggguguucuccagggggugggacuguaggugacugacauguuuguuuuucauacuuuucucuagguuuuacguuuucuauuaugagcagauuacuuuuauaaucaguaaauauuuagaggagagguuaaaccacagcucuucgaagaagacagggcuauguuugaauccugccuccacaguuaggagucaugcuuccuuggaaaaaucuaacuuucuaaaccucaguuggcacaucugugaaauaauaccuacuucacaggguuguugcuaugauuaaauauaaagugcuggcuacagggcaggcauucacaaacuggcaacuauuacuuaaacuaauaagaguuaaaaucgcaaccaccaccacuugccccuaaguguucucugccucuugguacccagacaugggaaagucucaccuauuauagaacugggcuauccuucccuuccaaagcccacuuuuuuuuucuuuacuaugccauaagguggcaaagucaguaaccucguguaucauuagcugguugacugaaugacugaaaauacaaggacuuuggaauagucuuucuccaagugcagaggcaaaaaauaaauaagcaaacaaauaaauuucauauacguaugaucacuguacucuuccagugaggcaggagccagggccuaugccaggcgcuuucauaccgagucaccuuuacagcaaaccccucgggcgcugggcacuugcaguacccagguuuccgcgugggcgcugacaaauugcagacacuuccuuuccucgccagcagggcucucucgcggucacuucacccagccccuuccgagcgagaaggccuugggggccgggacaaccccuccccagaaccacccugacuaggcucuuugcagccagcaucacuaccgagcuaaccaauauggaccagccugcgcugcacagggcgcuuaggcgaucguuggagggucaugaggaucagccuguccgcccaccgacggcggcgcagugggauggggaacggggugggggccgaaagacgggaggaaggagucgcugcagugucuccaggcgaugguugccagcgucucacuggggaggaaguuccuccugucauccaacccgcaguuccccucuugcagagcccugccgagcucccaguccagccuaggcugucuaacggaugggcgcucagacgcccccgcgaguugaggagcauuuuuccuagggcuuccaagucgggcgggcgccuuccaccauccaccacccacgucucggcaaggaccccuuuucuuucugcuccuaggucuuccgcauccacuuccaucccucucucgcccuccagggcuuucucaggcgccucucgcagcggaccccgccaagugccccucccccgggcccucuaacuuacggugcagcaguccaugcuggugucgggggguccucugcggggacgaaggcuggcgcagggcggggguggggucuguguggugccgggugggggcucuggggcagucggccgccagccgacccgcgccgaaacagcagcucugcucucggguccggucucccgcgcucggcuccgcucgcgaauguaaccugagccccgcggccgggaagccaaucaggagcagccuccggcagggugggcggggagaaguggagggagggccacgcccucucgcggcucucugcgccgcgcucccgcuccugccccagccccuccgccuacacgcuuguauccaagccuccuacacacuccauccucccgggcgcaauccccuggcuugcuaggcggcagacugccaggcagauguacgccggaguaggcagaaggaggcccccgacaccccgagcacaaacacccacaucugggcacagcaccuacucccgcucagagaaaaccacgcaccccucacccaucccuccauacuuccacaaccuagcaggagucccaaauauggcucccuuucacuucacucccccucaguccgcaaagaaaggcucccuaacgggcgguaaaaaggucucaucaucacuccugcuacagacggagaaaccuguugguacaaccuggcgaugggcaugcguccacacaaaagcucacaagccccacauguccacauaugauuuucccaggccuucuuccagcauacagacacugcagauacaaccugcaaaaauaacuacgcagcccu

SEQ ID NO: 19770 - RNA, 2431 nt, Homo sapiens
agggcugcguaguuauuuuugcagguuguaucugcagugucuguaugcuggaagaaggccugggaaaaucauauguggacauguggggcuugugagcuuuuguguggacgcaugcccaucgccagguuguaccaacagguuucuccgucuguagcaggagugaugaugagaccuuuuuaccgcccguuagggagccuuucuuugcggacugagggggagugaagugaaagggagccauauuugggacuccugcuagguuguggaaguauggagggaugggugaggggugcgugguuuucucugagcgggaguaggugcugugcccagauguggguguuugugcucggggugucgggggccuccuucugccuacuccggcguacaucugccuggcagucugccgccuagcaagccaggggauugcgcccgggaggauggaguguguaggaggcuuggauacaagcguguaggcggaggggcuggggcaggagcgggagcgcggcgcagagagccgcgagagggcguggcccucccuccacuucuccccgcccacccugccggaggcugcuccugauuggcuucccggccgcggggcucagguuacauucgcgagcggagccgagcgcgggagaccggacccgagagcagagcugcuguuucggcgcgggucggcuggcggccgacugccccagagcccccacccggcaccacacagaccccacccccgcccugcgccagccuucguccccgcagaggaccccccgacaccagcauggacugcugcaccguaaguuagagggcccgggggaggggcacuuggcgggguccgcugcgagaggcgccugagaaagcccuggagggcgagagagggauggaaguggaugcggaagaccuaggagcagaaagaaaagggguccuugccgagacgugggugguggaugguggaaggcgcccgcccgacuuggaagcccuaggaaaaaugcuccucaacucgcgggggcgucugagcgcccauccguuagacagccuaggcuggacugggagcucggcagggcucugcaagaggggaacugcggguuggaugacaggaggaacuuccuccccagugagacgcuggcaaccaucgccuggagacacugcagcgacuccuuccucccgucuuucggcccccaccccguuccccaucccacugcgccgccgucggugggcggacaggcugauccucaugacccuccaacgaucgccuaagcgcccugugcagcgcaggcugguccauauugguuagcucgguagugaugcuggcugcaaagagccuagucagggugguucuggggagggguugucccggcccccaaggccuucucgcucggaaggggcugggugaagugaccgcgagagagcccugcuggcgaggaaaggaagugucugcaauuugucagcgcccacgcggaaaccuggguacugcaagugcccagcgcccgagggguuugcuguaaaggugacucgguaugaaagcgccuggcauaggcccuggcuccugccucacuggaagaguacagugaucauacguauaugaaauuuauuuguuugcuuauuuauuuuuugccucugcacuuggagaaagacuauuccaaaguccuuguauuuucagucauucagucaaccagcuaaugauacacgagguuacugacuuugccaccuuauggcauaguaaagaaaaaaaaagugggcuuuggaagggaaggauagcccaguucuauaauaggugagacuuucccaugucuggguaccaagaggcagagaacacuuaggggcaagugguggugguugcgauuuuaacucuuauuaguuuaaguaauaguugccaguuugugaaugccugcccuguagccagcacuuuauauuuaaucauagcaacaacccugugaaguagguauuauuucacagaugugccaacugagguuuagaaaguuagauuuuuccaaggaagcaugacuccuaacuguggaggcaggauucaaacauagcccugucuucuucgaagagcugugguuuaaccucuccucuaaauauuuacugauuauaaaaguaaucugcucauaauagaaaacguaaaaccuagagaaaaguaugaaaaacaaacaugucagucaccuacagucccacccccuggagaacaccccgauaacauaucuccuuccagccuuuucccucugcuuguuauucuacaggaagcaauuuuuugguugugaagggagaaaugggcuccucauggagguuccugggcuccacugaggaagagcccuuccucccagcaguguuguauaaaguagagaagauaaauggaugguggguucugggaaaugagcuggggggaggggagaggugaggaugacaggggaguauugcuggggaaggggaagugggagac

SEQ ID NO: 19771 - RNA, 2513 nt, Homo sapiens
cugauggauccagccacuaacauagauuuuucaggaacagaacacacuugauaaaauucuccuaggguuuagguggggaggcagggugccuagcuuaggccugcggaguaaggaugggcuacaaagucuucccauuugugaacgcucacuaccccaccccccaucugccugcuuauguccaaugucagugccaacuccguggcccuggggcaaucagcggucaagccucaccccccaaccccacccaccucuagcggucaagccuaaccccucaccccugcuaacuauggcaaucuggcugggucccuaacugacuucccaaacuccgccaccucuccucuaaagcgcccugucucuacgagggaggaaagacaggcagcuucagcaaggguccccggggccccgggcucccccagcuaucuaaucggcuucaccccugcacucccccagggacagagccucacagggccucucuuuagcugggggaaggagacagaacgcuccuuuugaauaccuaagacuuacccacccucuuuuccuccagcuuuccugcugcugggucacuguuagucacucaccauccaggcccauuuccugauaaucccccagcccccugggugcaaggcccuucuuauucccuccaacacagacacacacacaccaagagcgggcuggucucuaacucccaaaccguaaucugggacacacacccacacacccacacccacccacccacccacccaccgggcuggucucuaacucccuaacccuaaucugggccaaaauagggggguuggcucgcuucucugccaggcagagugaagggcagcacuucucccagagggagggggccucagcuggggucucucuccaggauccuccugcugcaagcgccccagccuuccagaccaaagaggagacagggcuucucccggcuugagagggaccaggggcaaccagcucuccccagaaaagugaaacagagggagaggugacagagggacuccaaaaugucagggcugggaggccucgcagaccccucagugcccuguacaggggugagaagccaggcccauaggaggaaagaggcuugcuugcucuagaucacacagggagaacccacagugagagcccacagcgagaacacuucgccuaggacuuucccacuagagcacaggggaaugacuccaagaagggaguccagucguuaguaggaguucuggaggaggguuagcaccuggggggcucugggagcgcuggaggagggagugagaaagggaagcagagggguucuuuggagagaaugaaggggugggcccuggggagugggcaaagagguguagagaagagcccggcgugaccuugggccagcugcgucucccuccugggcccgucuuuccgucugcaggcaagagagcgccugggaucccggggggcucaggcuugaaggugccaccccggcgagugagggcgccucaccuucuugaagucggcggugaaggagacgagggugccgucgggcuugcgcagcucgaggcugaugcuguccgcgucgcuguccgccugcaggcucuccucggucaccuggccguccggcagccgcacgcggacccgcagcucggccggcgcacccguucccagcagcggcgcgagcagcggcagcagcagcagcagcgcagggcgcgccagggguaccccgggaaggcgcauccccgggggccgcugccguccgcggccccggcgcgccgcgugggggcggggagaggcgcaggcaaacuucgcccaaaguugggggcuaguucggggcgcccgggagccgcuccgccgggggccuuggccgcggggucgcccgcgagguggcgcggacgcacguggguagcgcucagcagggcgcccccggcggccccgaggcggagacggcgcugccccggcccggcuccgcggccccgggcuccagcgcugcgagccuguguuuugcacuuuucauucaaucccaccccccgucacuuccuucagaaaacagaaaccaccaggacccgccuuaaagagaccgcgcaccucgcggcccuuaaagggcccgcggcugcucuccgcacuucggcguuggccgggcagggggcggggagagggggcagcggcuccgcggcuuugugcgagcggccuccucgaccucccucccgcccggccgcgcggagucagcgacccaggcggagucagaaguuugcucucccggggcaaaucccuuccuuccagcaggggcaggacgggugacucuucccccgcccugcaccgccaccccccccccccgcuuuuuuuuuuuuggcuugcuuuugugccacguggaugaaauaaucgggcuuggauuuuuagggguuuuguuuggucuuucaguuucucugacagcgaauuucuaaaaagcuucugcaaaaucagaccucgcuuugcacucugccuuuucccugccccacacugggaggguggaucggggguucucgcccagcuuugccacggcc

SEQ ID NO: 19772 - RNA, 2513 nt, Homo sapiens
ggccguggcaaagcugggcgagaacccccgauccacccucccaguguggggcagggaaaaggcagagugcaaagcgaggucugauuuugcagaagcuuuuuagaaauucgcugucagagaaacugaaagaccaaacaaaaccccuaaaaauccaagcccgauuauuucauccacguggcacaaaagcaagccaaaaaaaaaaaagcgggggggggggguggcggugcagggcgggggaagagucacccguccugccccugcuggaaggaagggauuugccccgggagagcaaacuucugacuccgccugggucgcugacuccgcgcggccgggcgggagggaggucgaggaggccgcucgcacaaagccgcggagccgcugcccccucuccccgcccccugcccggccaacgccgaagugcggagagcagccgcgggcccuuuaagggccgcgaggugcgcggucucuuuaaggcggguccuggugguuucuguuuucugaaggaagugacggggggugggauugaaugaaaagugcaaaacacaggcucgcagcgcuggagcccggggccgcggagccgggccggggcagcgccgucuccgccucggggccgccgggggcgcccugcugagcgcuacccacgugcguccgcgccaccucgcgggcgaccccgcggccaaggcccccggcggagcggcucccgggcgccccgaacuagcccccaacuuugggcgaaguuugccugcgccucuccccgcccccacgcggcgcgccggggccgcggacggcagcggcccccggggaugcgccuucccgggguaccccuggcgcgcccugcgcugcugcugcugcugccgcugcucgcgccgcugcugggaacgggugcgccggccgagcugcggguccgcgugcggcugccggacggccaggugaccgaggagagccugcaggcggacagcgacgcggacagcaucagccucgagcugcgcaagcccgacggcacccucgucuccuucaccgccgacuucaagaaggugaggcgcccucacucgccgggguggcaccuucaagccugagccccccgggaucccaggcgcucucuugccugcagacggaaagacgggcccaggagggagacgcagcuggcccaaggucacgccgggcucuucucuacaccucuuugcccacuccccagggcccaccccuucauucucuccaaagaaccccucugcuucccuuucucacucccuccuccagcgcucccagagccccccaggugcuaacccuccuccagaacuccuacuaacgacuggacucccuucuuggagucauuccccugugcucuagugggaaaguccuaggcgaaguguucucgcugugggcucucacuguggguucucccugugugaucuagagcaagcaagccucuuuccuccuaugggccuggcuucucaccccuguacagggcacugaggggucugcgaggccucccagcccugacauuuuggagucccucugucaccucucccucuguuucacuuuucuggggagagcugguugccccuggucccucucaagccgggagaagcccugucuccucuuuggucuggaaggcuggggcgcuugcagcaggaggauccuggagagagaccccagcugaggcccccucccucugggagaagugcugcccuucacucugccuggcagagaagcgagccaaccccccuauuuuggcccagauuaggguuagggaguuagagaccagcccggugggugggugggugggugggugugggugugugggugugugucccagauuacgguuugggaguuagagaccagcccgcucuuggugugugugugucuguguuggagggaauaagaagggccuugcacccagggggcugggggauuaucaggaaaugggccuggauggugagugacuaacagugacccagcagcaggaaagcuggaggaaaagaggguggguaagucuuagguauucaaaaggagcguucugucuccuucccccagcuaaagagaggcccugugaggcucugucccugggggagugcaggggugaagccgauuagauagcugggggagcccggggccccggggacccuugcugaagcugccugucuuuccucccucguagagacagggcgcuuuagaggagagguggcggaguuugggaagucaguuagggacccagccagauugccauaguuagcaggggugagggguuaggcuugaccgcuagaggugggugggguuggggggugaggcuugaccgcugauugccccagggccacggaguuggcacugacauuggacauaagcaggcagauggggggugggguagugagcguucacaaaugggaagacuuuguagcccauccuuacuccgcaggccuaagcuaggcacccugccuccccaccuaaacccuaggagaauuuuaucaaguguguucuguuccugaaaaaucuauguuaguggcuggauccaucag

SEQ ID NO: 19773 - RNA, 2467 nt, Homo sapiens
ggacgcgcggcgccuccgacccguucuccucgcgcccggccgcgcagccagagccacccgggccgccgaccgccgagccccgcgcccgccgccugggccccgagccuucugcgccgcccgggugcgucccgccacccucggaggacggccggccauggacgccugcaaguuggagccgagcgggagggugugagcgggccggggccaggagcccgcgccgcgcaaccgggcagccgggcgcgccgggggugggucccucuccccagccccgcucugcguggaagaagagggcggggaccggcgccgggaggagagcggaggaggcgaaggggcaugacucgugcaacuugcggcgggcaucugccgagccucugagccggcggcggcccggggcccggacugcggccgcgcggaucccacccagcccaccccgccccggccgacggcugcagcugaccuggauccuucgagcgcccgccgaccgccagcgaucuucccucaucuuccgggcugguuucugcugcgcgaggagcgcugcccucgccgccccucucgccggacccccggcccccgauggcucggauggggcuugcgggcgccgcuggacgcugguggggacucgcucucggcuugaccgcauucuuccucccagguaagagcgcucaccucugcuguccccacccccauccaaugccuccccggggcugggagccggauggcgggcacgacuggauuguggggagugaaaggagccagaaaaguugggucacggcuuggguaaagggggugggagguggcacggcggagaaagagguugagaagccgaaccgccugcccugcagggaagcagucagaugcacgucucuauguagcaugaaagcacuuucuccgcucaguucuuuacaaaaaauaauaauauguaauagcguucuguuuauuuaauaaccagcucucugcucgggaagcaguuuggaaacacugcguguuacauaaaugcaaaauaaucaccguaaucaccgucuuggggugggagacaacagccccagggggagggcgucagucucggagcugcggguuuggaguauggcgggggggcuucgucucuuucggcggccccuuugccagacggcucaggacgcucgggcccccucccgccccacaccgccccacagcgggcgcggagagucggcugcugcggcagaggcggcuccucgcucaccugcgguuccuuuccuggagggugaggccggggcagccuccucccggccuggcgcgggaccgggcucccccucggaacucugcucccagcucugggggcucucccuggaggagacaccgcgggcuuccugccauccaaguagcugcaugacccacuuucccgagggugccccgcguguccuuccucgaggugcgggcugccggcagccgagggguuaaccucgcgcccgaccccgggguggcccugguggcccauucugacgggugggguggggacggaggcugggaccagcccaggcauauugugcuggggaaugaacuggaaaaugcguuuaggaggcaaauccgaccgaguccccucgccuggauuuaacccuuugugucccuggggaagcugccgagcucgccggcugacuggacaccaagcgugggucaagggguguggggaguuccuccagcucucuggguagaaaccagagacgaccugcagcucuagcaagaugggauuuuggggaggggggcggaucuugacuggagcacgugguccccgccuugggguggcagaauagggggucaguguacagagaccaucuccucguggggcaggaauauuagaucccgaguuccugcaaugugcuuugccgcagaauggccaggcaguuuguuaucgagggaacagucuggcugccuaguuccggggcuagggugcacuccuggaaggcagaagccuggccucauucccuucuaugccucuucugcugccagccagcucacuacgagggccccgccaaucucacuaagugguggaugucugggaagcaguuugugaaagccaguacuggggugccuccacccgugaagccuggggugcugcccugcucgaugugggggguggggaaaauccagggcucacaggugucacugcccacccugcccccagaggguggucuuggugagagugagaggucuucucacacuggauggccugggaagccagccagagauacagaaguucgggcucuaggacuugccuggccauggggauuugagcuuccaggaacccuucaauuacauauguccacauccggaacccagagaaacgagagcuucccagagcucugguugguccagcacacuagggguuaacguaauccugggauggacaaaggguggugggaaggguugggagaaggggaaggaacucacccuauucuccuuccuuuuguuauucucuuuccccagcuuugug

SEQ ID NO: 19774 - RNA, 2467 nt, Homo sapiens
cacaaagcuggggaaagagaauaacaaaaggaaggagaauagggugaguuccuuccccuucucccaacccuucccaccacccuuuguccaucccaggauuacguuaaccccuagugugcuggaccaaccagagcucugggaagcucucguuucucuggguuccggauguggacauauguaauugaaggguuccuggaagcucaaauccccauggccaggcaaguccuagagcccgaacuucuguaucucuggcuggcuucccaggccauccagugugagaagaccucucacucucaccaagaccacccucugggggcagggugggcagugacaccugugagcccuggauuuuccccaccccccacaucgagcagggcagcaccccaggcuucacggguggaggcaccccaguacuggcuuucacaaacugcuucccagacauccaccacuuagugagauuggcggggcccucguagugagcuggcuggcagcagaagaggcauagaagggaaugaggccaggcuucugccuuccaggagugcacccuagccccggaacuaggcagccagacuguucccucgauaacaaacugccuggccauucugcggcaaagcacauugcaggaacucgggaucuaauauuccugccccacgaggagauggucucuguacacugacccccuauucugccaccccaaggcggggaccacgugcuccagucaagauccgccccccuccccaaaaucccaucuugcuagagcugcaggucgucucugguuucuacccagagagcuggaggaacuccccacaccccuugacccacgcuugguguccagucagccggcgagcucggcagcuuccccagggacacaaaggguuaaauccaggcgaggggacucggucggauuugccuccuaaacgcauuuuccaguucauuccccagcacaauaugccugggcuggucccagccuccguccccaccccacccgucagaaugggccaccagggccaccccggggucgggcgcgagguuaaccccucggcugccggcagcccgcaccucgaggaaggacacgcggggcacccucgggaaagugggucaugcagcuacuuggauggcaggaagcccgcggugucuccuccagggagagcccccagagcugggagcagaguuccgagggggagcccggucccgcgccaggccgggaggaggcugccccggccucacccuccaggaaaggaaccgcaggugagcgaggagccgccucugccgcagcagccgacucuccgcgcccgcuguggggcgguguggggcgggagggggcccgagcguccugagccgucuggcaaaggggccgccgaaagagacgaagcccccccgccauacuccaaacccgcagcuccgagacugacgcccucccccuggggcuguugucucccaccccaagacggugauuacggugauuauuuugcauuuauguaacacgcaguguuuccaaacugcuucccgagcagagagcugguuauuaaauaaacagaacgcuauuacauauuauuauuuuuuguaaagaacugagcggagaaagugcuuucaugcuacauagagacgugcaucugacugcuucccugcagggcaggcgguucggcuucucaaccucuuucuccgccgugccaccucccacccccuuuacccaagccgugacccaacuuuucuggcuccuuucacuccccacaauccagucgugcccgccauccggcucccagccccggggaggcauuggauggggguggggacagcagaggugagcgcucuuaccugggaggaagaaugcggucaagccgagagcgaguccccaccagcguccagcggcgcccgcaagccccauccgagccaucgggggccggggguccggcgagaggggcggcgagggcagcgcuccucgcgcagcagaaaccagcccggaagaugagggaagaucgcuggcggucggcgggcgcucgaaggauccaggucagcugcagccgucggccggggcggggugggcugggugggauccgcgcggccgcaguccgggccccgggccgccgccggcucagaggcucggcagaugcccgccgcaaguugcacgagucaugccccuucgccuccuccgcucuccucccggcgccgguccccgcccucuucuuccacgcagagcggggcuggggagagggacccacccccggcgcgcccggcugcccgguugcgcggcgcgggcuccuggccccggcccgcucacacccucccgcucggcuccaacuugcaggcguccauggccggccguccuccgaggguggcgggacgcacccgggcggcgcagaaggcucggggcccaggcggcgggcgcggggcucggcggucggcggcccggguggcucuggcugcgcggccgggcgcgaggagaacgggucggaggcgccgcgcgucc

SEQ ID NO: 19775 - RNA, 2552 nt, Homo sapiens
cugccagcacugaggcugaggcagugucaggccggcggcagcggcaguggugcaaucguucugggaagcgauagaggccggccugaauucucuguggcaagggaggggagcccaagugggaggccccuuggggacaccgaggaccagguccgcuacugcuccucccccaggagguccccuaggggcuacauuggcuggcaggggcugagcagcggugagccuggcuggcuucgacccggggcgacuccgggcauccgggacagcuucuccucgcugccaccucggccagucagaccccgagacaccugucacuacccccucagccuucccaagccaggagccugggaguccggcucuggccuaccuccggcagcgcuccuaggcgcagcucccgggcuggcggcgccggggcccgcccccuagggcugcggcgcgcggggcgggggcugggggcugcgcggggcggggcgggcccgggcgcuccgggcccccucccccgccccccugacgucagcccccggcagccucgagcugcucacuuggcucucgcccuccggccgggaagcauggggcuucccaggcuggucugcgccuucuugcucgccgccugcugcugcuguccucgcgucgcgggugaguucgcucgcaggggggccgcgccccggcuaggggucugcgguggagcgugccagggagcagagccagcggcgcggcggggucggggcguugcgucugggaggacgagccuccucccuggguccccgauccccgggcgccuugcgcgcgagcaacucuucuuugcagccaguuugcagccgggauucuagaguaucccgggagcagcacucggaaggcggggaggaggcugcuucugggaacgagaagggguggagcucagccuuucggggugcugggggguggguggucccugaggugcucacucugggggcccgcaauugaagccgggcaggaggcgcagcuggggcgcauccucaaagccugaauuccgcgcccgccuguugcuggaaaaggcagcuuccuucgcuggagggggugcgccgacccaccccuucccccuucugccugggcaucacgccaggcuggaggugagcgagagcgggagguucggcggcucccgcccgagcugggcguuggcagggguugcggggcggugugggucgccucgcgccuccccgagugaugggaucauaggggacagagaugagggauggaggauucccauacuggaagcgcccgcuggcuuauuuuggggaccacauucaggugggaagugcgcccgggcaccucggagcguuucuccggauccgccugguagcagggcgcucucggguccacgcugcccuuguauggcccgcagcggugucgcguguuucucuuggcucccauuccgccgucccagccgcuguccggcuggggaaggggagggcuaggcaauacccagcucgcuggccucaugcccagugccaaccaugucccugggguauuccaggcuacugccucccaggcugacuuuauuucuggggaaagggcuaaaucgggcuccacaguugcagccgguccagcuccacccugcccugcucuucuagcucugggaggagucaggggucugaggcucuggguuggagaccccaccuuccaccugcccuccuuguccgagagccaagguaacaacccaggcaucccagagcccaggcagauggugucgagugacaucaccuccucacagggcuggcagcacgcuggcaccacugacgucacuccugcccacugccuggcccuugcccugaccccugggggagacucugaccucuccauccuuaccagcuaccuagggugggguccgcgggugugugcggaguguucauggaggugcugcugagggagcaugagaccggaacuuccgccagaguuagcccgcuggggagugagggcagggauuuuggagggcagaggauagagcaguggugucuuccccuggcgguggugacacaaaagggccugugugccccagccuggcacauucuuugcauucccacacucugagcucacccggagaggagggggccuggaaggaaaggggccuuccucuuggccccgagccuagguugccccuuucugccccucuaccagccucagcuggagcuguucggugcucagucucugcucaaucucugcuuggcuccaaggaccugggaucuccuggacggggagagggcuggcccagguggggcgcgggucgggguggggguagagcguucagaggacagggcccucugcagacccucugaguggcaggaaaaacagcugcagcagcgcugcgaggggaggggcggacagcagccggagcugacacagcugcgggggccccgccucccucccccaggugugcccggagaggcugagcagccugcgccugagcugguggagguggaagugggcagcacagcccuucugaagugcggccucucccagucccaaggcaaccucagccaugucgacugguuuucugugagugcuugggcuccugcaag

SEQ ID NO: 19776 - RNA, 2552 nt, Homo sapiens
cuugcaggagcccaagcacucacagaaaaccagucgacauggcugagguugccuugggacugggagaggccgcacuucagaagggcugugcugcccacuuccaccuccaccagcucaggcgcaggcugcucagccucuccgggcacaccugggggagggaggcggggcccccgcagcugugucagcuccggcugcuguccgccccuccccucgcagcgcugcugcagcuguuuuuccugccacucagagggucugcagagggcccuguccucugaacgcucuacccccaccccgacccgcgccccaccugggccagcccucuccccguccaggagaucccagguccuuggagccaagcagagauugagcagagacugagcaccgaacagcuccagcugaggcugguagaggggcagaaaggggcaaccuaggcucggggccaagaggaaggccccuuuccuuccaggcccccuccucuccgggugagcucagagugugggaaugcaaagaaugugccaggcuggggcacacaggcccuuuugugucaccaccgccaggggaagacaccacugcucuauccucugcccuccaaaaucccugcccucacuccccagcgggcuaacucuggcggaaguuccggucucaugcucccucagcagcaccuccaugaacacuccgcacacacccgcggaccccacccuagguagcugguaaggauggagaggucagagucucccccaggggucagggcaagggccaggcagugggcaggagugacgucaguggugccagcgugcugccagcccugugaggaggugaugucacucgacaccaucugccugggcucugggaugccuggguuguuaccuuggcucucggacaaggagggcagguggaagguggggucuccaacccagagccucagaccccugacuccucccagagcuagaagagcagggcaggguggagcuggaccggcugcaacuguggagcccgauuuagcccuuuccccagaaauaaagucagccugggaggcaguagccuggaauaccccagggacaugguuggcacugggcaugaggccagcgagcuggguauugccuagcccuccccuuccccagccggacagcggcugggacggcggaaugggagccaagagaaacacgcgacaccgcugcgggccauacaagggcagcguggacccgagagcgcccugcuaccaggcggauccggagaaacgcuccgaggugcccgggcgcacuucccaccugaaugugguccccaaaauaagccagcgggcgcuuccaguaugggaauccuccaucccucaucucuguccccuaugaucccaucacucggggaggcgcgaggcgacccacaccgccccgcaaccccugccaacgcccagcucgggcgggagccgccgaaccucccgcucucgcucaccuccagccuggcgugaugcccaggcagaagggggaaggggugggucggcgcacccccuccagcgaaggaagcugccuuuuccagcaacaggcgggcgcggaauucaggcuuugaggaugcgccccagcugcgccuccugcccggcuucaauugcgggcccccagagugagcaccucagggaccacccaccccccagcaccccgaaaggcugagcuccaccccuucucguucccagaagcagccuccuccccgccuuccgagugcugcucccgggauacucuagaaucccggcugcaaacuggcugcaaagaagaguugcucgcgcgcaaggcgcccggggaucggggacccagggaggaggcucguccucccagacgcaacgccccgaccccgccgcgccgcuggcucugcucccuggcacgcuccaccgcagaccccuagccggggcgcggccccccugcgagcgaacucacccgcgacgcgaggacagcagcagcaggcggcgagcaagaaggcgcagaccagccugggaagccccaugcuucccggccggagggcgagagccaagugagcagcucgaggcugccgggggcugacgucaggggggcgggggagggggcccggagcgcccgggcccgccccgccccgcgcagcccccagcccccgccccgcgcgccgcagcccuagggggcgggccccggcgccgccagcccgggagcugcgccuaggagcgcugccggagguaggccagagccggacucccaggcuccuggcuugggaaggcugaggggguagugacaggugucucggggucugacuggccgagguggcagcgaggagaagcugucccggaugcccggagucgccccgggucgaagccagccaggcucaccgcugcucagccccugccagccaauguagccccuaggggaccuccugggggaggagcaguagcggaccugguccucgguguccccaaggggccucccacuugggcuccccucccuugccacagagaauucaggccggccucuaucgcuucccagaacgauugcaccacugccgcugccgccggccugacacugccucagccucagugcuggcag

SEQ ID NO: 19777 - RNA, 2626 nt, Homo sapiens
aggcagauagcaggacgguauuagagagcagaaagcugcuuagaucucaaaagagcugcucccuaauucguccacaguaauggaagcaaccuaccgcagccccaccuggagagcagugcggacacagaauugaggaaggggcacagaauuggcuggcaacucuuccuugggucuugagauggaggaaacaaauccauaggguucauuugcuuggcaaaccaggggaagccaacuccuuugcucugguagcugucucauucaaaggcuaggccaaggaagauggggagauggaugcuugaaaccucaaucuccccacccucugcaagggaggccaauguccaguugagucagcuauccuggggaguugcuucugaccgagggacaagguacagggagaguuggaugaagagguggguucaagguguaaacugacagaugccaucuggcuuuuagccagccagcuggacagaguaaauagagcaauuucuuguggacauuucuguuuccggcaucuggggaacuaguaagguaaagccuccaaacucauaguggcuggaaauagagaacccucugagcaaggagcugauggacugugagagcaaggagagauugcugggucaggaugggagggagcuccagaaaagagagacuucuaccucccaccuuaucuccaucucaugaccacgcuuccugccccacuuccugggaggccagaugcccauggugcaaugggaggaaguaggcuggacugguuugugacugacccucaaggggcaguuccaagcucaucuacugguaggggcacugucaaucugcucuccaccugaacacuccccaacccccagugaaccacaggccagcauggaggagaaggauguguuugacuguagcagugaaauuacugucggguaggggggugauucaggcuccuuggggaucugccugaccacaccagggauuuggggcaugaaauguuaaaugggugugguggcaugagaagcaggcaaauuccuucugcaggugcaccugucucccaugccccaacacaaccagcacccaggcaaggcggaagugcccucaggcacagggauuagcguugcuaugagaacagcaacuugugcauggguuuggaaccagaguaccuugcccacagaaauggaagucuggggacccaguuggauuucuacaaccuccagccuuagcggcacccuuuucucugauccgggaggggaagagaagccauaggguuccccaguuuaugcccacccucgucuggccuccuagcacgagcagucagucccuccccuggaaggaaaggcugaagggaccacccaagcgcuugguccaacucaccccguuucugcaggccugcucguucagcgcucgcacccaagcccgcugccaguucucccggaaagacuugaaggcgaagagugacgccaggaggccccggacuccuggcuccucggcggcgccagcccgagucgcccgcagccgcagcagcgagcgccacacgcccagcucccgcagggaacccgcggguuccccggcuaaggcgggucccgggccccgguccccgcgggcccgcgccagccacaagccccgggcauauugcagcagccaggcgaacaccgugagcagcgaggcggcgaagaggaucagcaaggccgcccagcccacgucccgcugcccccagcccggauccaugcuccgcgcgggcuccgaucccggucccggcuggggcucacccgcugccccgggggagcauggcccgggcgggccgcggggaggaggugggcucccccggggcugggcgcgcggggucgggggcucuccgcggcugagugcccaggacuagugggugccacagggcgaggagaggagguccucgggggucgcgaugccggggucucugucuccgugguccgggucucuccuagcuuggucagcagucggacccguuagucgccggccagugcccgacuccucccaccgcgcgggccccgccggacccuggaggggacuggucugcagagacgcuggggcucgcgggccggcaccggcuccgggagggcugcgugcgcagagcugacacugacaacaccgccggcgccccgcccccacccgcccuuaaaggagccgcacccgcgccgggcggggccaggacagccuggcgcucccucgcuggaggagggcgggagggcuagcagcgagcggaggagguuccgggguugaaaauaggcgggaucuuugaucaccucgccccaucuugcaaucgcggugcucccacacucagcucaaggcaagaguaacuucacuuaccuaagaugcugccuuugcuuuccccuaugcuuguuagauuuccacaggucggacgccugugagguuaagaaggaggugaccccuguggaaaucaccgcccccuucucccaacacccccagacucagcgacuucuagcuucccauuuccugggggaagcuaggcccaggguaaggagacgcagagcgucccucccagauagaagugucuggcagagguccagcugaugucaacagagagaaagcagaaccugaagcugggagagguugagaguagaacaccgaauuugaauuccccccaccauca

SEQ ID NO: 19778 - RNA, 2626 nt, Homo sapiens
ugaugguggggggaauucaaauucgguguucuacucucaaccucucccagcuucagguucugcuuucucucuguugacaucagcuggaccucugccagacacuucuaucugggagggacgcucugcgucuccuuacccugggccuagcuucccccaggaaaugggaagcuagaagucgcugagucuggggguguugggagaagggggcggugauuuccacaggggucaccuccuucuuaaccucacaggcguccgaccuguggaaaucuaacaagcauaggggaaagcaaaggcagcaucuuagguaagugaaguuacucuugccuugagcugagugugggagcaccgcgauugcaagauggggcgaggugaucaaagaucccgccuauuuucaaccccggaaccuccuccgcucgcugcuagcccucccgcccuccuccagcgagggagcgccaggcuguccuggccccgcccggcgcgggugcggcuccuuuaagggcgggugggggcggggcgccggcgguguugucagugucagcucugcgcacgcagcccucccggagccggugccggcccgcgagccccagcgucucugcagaccaguccccuccaggguccggcggggcccgcgcggugggaggagucgggcacuggccggcgacuaacggguccgacugcugaccaagcuaggagagacccggaccacggagacagagaccccggcaucgcgacccccgaggaccuccucuccucgcccuguggcacccacuaguccugggcacucagccgcggagagcccccgaccccgcgcgcccagccccgggggagcccaccuccuccccgcggcccgcccgggccaugcucccccggggcagcgggugagccccagccgggaccgggaucggagcccgcgcggagcauggauccgggcugggggcagcgggacgugggcugggcggccuugcugauccucuucgccgccucgcugcucacgguguucgccuggcugcugcaauaugcccggggcuuguggcuggcgcgggcccgcggggaccggggcccgggacccgccuuagccggggaacccgcggguucccugcgggagcugggcguguggcgcucgcugcugcggcugcgggcgacucgggcuggcgccgccgaggagccaggaguccggggccuccuggcgucacucuucgccuucaagucuuuccgggagaacuggcagcgggcuugggugcgagcgcugaacgagcaggccugcagaaacggggugaguuggaccaagcgcuuggguggucccuucagccuuuccuuccaggggagggacugacugcucgugcuaggaggccagacgagggugggcauaaacuggggaacccuauggcuucucuuccccucccggaucagagaaaagggugccgcuaaggcuggagguuguagaaauccaacuggguccccagacuuccauuucugugggcaagguacucugguuccaaacccaugcacaaguugcuguucucauagcaacgcuaaucccugugccugagggcacuuccgccuugccugggugcugguuguguuggggcaugggagacaggugcaccugcagaaggaauuugccugcuucucaugccaccacacccauuuaacauuucaugccccaaaucccugguguggucaggcagauccccaaggagccugaaucaccccccuacccgacaguaauuucacugcuacagucaaacacauccuucuccuccaugcuggccugugguucacuggggguuggggaguguucagguggagagcagauugacagugccccuaccaguagaugagcuuggaacugccccuugagggucagucacaaaccaguccagccuacuuccucccauugcaccaugggcaucuggccucccaggaaguggggcaggaagcguggucaugagauggagauaaggugggagguagaagucucucuuuucuggagcucccucccauccugacccagcaaucucuccuugcucucacaguccaucagcuccuugcucagaggguucucuauuuccagccacuaugaguuuggaggcuuuaccuuacuaguuccccagaugccggaaacagaaauguccacaagaaauugcucuauuuacucuguccagcuggcuggcuaaaagccagauggcaucugucaguuuacaccuugaacccaccucuucauccaacucucccuguaccuugucccucggucagaagcaacuccccaggauagcugacucaacuggacauuggccucccuugcagaggguggggagauugagguuucaagcauccaucuccccaucuuccuuggccuagccuuugaaugagacagcuaccagagcaaaggaguuggcuuccccugguuugccaagcaaaugaacccuauggauuuguuuccuccaucucaagacccaaggaagaguugccagccaauucugugccccuuccucaauucuguguccgcacugcucuccagguggggcugcgguagguugcuuccauuacuguggacgaauuagggagcagcucuuuugagaucuaagcagcuuucugcucucuaauaccguccugcuaucugccu

SEQ ID NO: 19779 - RNA, 2346 nt, Homo sapiens
gucuccauuuuauuuccucggaaacugccgggcaggcgggggaccggccgcagggcgggguuucucuuggcggugagugagcgagaccguuaggcugaagcaccgggagacuguccuggcagcuccuggccgccacccgcgccgcaauaaaagccucucgcggcuucccgcccagccagcuucgcacugauuggucgccgugggagggacccgaguuggcuggaggcggcggccgagcgcugcucuugugccgcccgcggagggggcgcacugggugcucccuggcccgccccgugcgcuccccaaccgggggucggccguccagggcagguacaacgguaccuggagcugcgaccgcgacacacagccccuccgcccggcuuuccucgaucgcuucccagcacacgccccccgcccagaauguccgcccaacccacccagcucucugcggccccugcuuuucuuccuucccucccguccaucagagccaaagcgcaaauccuuggguggagguggggggaugacagcuggaggggagggugggcacgcacagaagaauuuuccagggaggccgggauggaaauagccaaaaugaaaugcaccucccugcacacugccgagguucucugggcggcggcgcaacccccgccacccgcggcagcaucacuacugucuuccucccagcucccuauuguucacacuuugccaggaucgggaaccucgcccaaagaaaggagacagggcgagguguuucgggcggcuaccugccauucuucucccgccccgugcaacacugggcacgcggcgcguguaaagacacacgcgcgcacacgcgcgcgcacacaccaggcagccccaaucacgcccuccucgcccuccgccccuccgcacuuccuccugucaaaacgcggcgcucgacccucccauccuucagugcucgcggccgaggguaggcuuugcaacuaaccagcaauuuggcaaaugaaaaacuaacgucaugucgacuggggugcaacaacggucacaccaacaacaacggccgugcgauucugcccauuuugccccauuuugcaaaccguuauucuucuggggcgggggaagcaaagcagcgauccugacuuuauuagacccaggaauauaacgaucuggggcggcugcccuagccuuauuguucacucuucccggagccggggcugacaagccacuucccccucggaauccgagcccgugcggcggcaccacccgagccgcgaccucccccgccccgccgcccgccuuuggggaaggagcgcugcccaucaccagcgcggccgcugaguccccaggagccggccggcucugcucccaccgccgcgggcgcacaaagugggaagggcggacgcgccggaggggcgccgggcgcuggcggcucggggaggcagccccgugcagcgcagcccuggagggagcgggguucggcugggcagcaagggcgacgcgcuccuuucacagcuaaacgaaaaugaccagccuuagcaguccacguaaaaccacccaaaauaauagcguuccuccuaggaguaggaggaagggguaauuagcaaaccagauugagaauuaaaaaaaaaaaaaauguaccugcaguucccaggaaaaacaaaguccaaaugaaauccuuaguuuggcagcauuguaaucugcuggcugggagggaugucuugccgcgguaaauucugugccccccccccugcagcgaguguggacggcggcugagcgacagaccuaggggcagacaauugccaggcugaguaugauuauuuuugcagaauuguuuccugccagcggcagccgagcugcguucacgcgcugaucggagaaugagugacagucccagccucagcacacucgcaacucggagauccuugcgcuggcccggguucguuuugauggaacugggaugggagcgaggagcggggggcgggggugagaaccucacuguguccuuccaccacgccggccacaaauagugccgaacaucaaggagguaagagagacagggaggcagaugcggaagccugcaaaacgcggccuggagcuuuugggggagccgggcucuuucacacgcagucucccugggagagcugggauuucuuuucacacuucuacccuacgccuucgcaggcgcuccugcuacccagccuuccuuaaucagcaguuugcauauuuugauaacuaguaaauaauaaaagcaaaauuuuagauuugguuagguaaaguugucaaaucccuccauuucgauucuaagauccuugcaacacaaggauagcccaggacuuuaagugcgggaaauuagaacuuuggagaggg

SEQ ID NO: 19780 - RNA, 2346 nt, Homo sapiens
cccucuccaaaguucuaauuucccgcacuuaaaguccugggcuauccuuguguugcaaggaucuuagaaucgaaauggagggauuugacaacuuuaccuaaccaaaucuaaaauuuugcuuuuauuauuuacuaguuaucaaaauaugcaaacugcugauuaaggaaggcuggguagcaggagcgccugcgaaggcguaggguagaagugugaaaagaaaucccagcucucccagggagacugcgugugaaagagcccggcucccccaaaagcuccaggccgcguuuugcaggcuuccgcaucugccucccugucucucuuaccuccuugauguucggcacuauuuguggccggcgugguggaaggacacagugagguucucacccccgccccccgcuccucgcucccaucccaguuccaucaaaacgaacccgggccagcgcaaggaucuccgaguugcgagugugcugaggcugggacugucacucauucuccgaucagcgcgugaacgcagcucggcugccgcuggcaggaaacaauucugcaaaaauaaucauacucagccuggcaauugucugccccuaggucugucgcucagccgccguccacacucgcugcaggggggggggcacagaauuuaccgcggcaagacaucccucccagccagcagauuacaaugcugccaaacuaaggauuucauuuggacuuuguuuuuccugggaacugcagguacauuuuuuuuuuuuuuaauucucaaucugguuugcuaauuaccccuuccuccuacuccuaggaggaacgcuauuauuuugggugguuuuacguggacugcuaaggcuggucauuuucguuuagcugugaaaggagcgcgucgcccuugcugcccagccgaaccccgcucccuccagggcugcgcugcacggggcugccuccccgagccgccagcgcccggcgccccuccggcgcguccgcccuucccacuuugugcgcccgcggcggugggagcagagccggccggcuccuggggacucagcggccgcgcuggugaugggcagcgcuccuuccccaaaggcgggcggcggggcgggggaggucgcggcucggguggugccgccgcacgggcucggauuccgagggggaaguggcuugucagccccggcuccgggaagagugaacaauaaggcuagggcagccgccccagaucguuauauuccugggucuaauaaagucaggaucgcugcuuugcuucccccgccccagaagaauaacgguuugcaaaauggggcaaaaugggcagaaucgcacggccguuguuguuggugugaccguuguugcaccccagucgacaugacguuaguuuuucauuugccaaauugcugguuaguugcaaagccuacccucggccgcgagcacugaaggaugggagggucgagcgccgcguuuugacaggaggaagugcggaggggcggagggcgaggagggcgugauuggggcugccuggugugugcgcgcgcgugugcgcgcgugugucuuuacacgcgccgcgugcccaguguugcacggggcgggagaagaauggcagguagccgcccgaaacaccucgcccugucuccuuucuuugggcgagguucccgauccuggcaaagugugaacaauagggagcugggaggaagacaguagugaugcugccgcggguggcggggguugcgccgccgcccagagaaccucggcagugugcagggaggugcauuucauuuuggcuauuuccaucccggccucccuggaaaauucuucugugcgugcccacccuccccuccagcugucauccccccaccuccacccaaggauuugcgcuuuggcucugauggacgggagggaaggaagaaaagcaggggccgcagagagcuggguggguugggcggacauucugggcggggggcgugugcugggaagcgaucgaggaaagccgggcggaggggcugugugucgcggucgcagcuccagguaccguuguaccugcccuggacggccgacccccgguuggggagcgcacggggcgggccagggagcacccagugcgcccccuccgcgggcggcacaagagcagcgcucggccgccgccuccagccaacucgggucccucccacggcgaccaaucagugcgaagcuggcugggcgggaagccgcgagaggcuuuuauugcggcgcggguggcggccaggagcugccaggacagucucccggugcuucagccuaacggucucgcucacucaccgccaagagaaaccccgcccugcggccggucccccgccugcccggcaguuuccgaggaaauaaaauggagac

SEQ ID NO: 19781 - RNA, 2725 nt, Homo sapiens
agcucacgagagcugucugcccuguucuucauggggcccaucugaccuuagugauguuugcugucagcuacgcagaggccuucugacacaaacugaccgugaauacaacagggauauuaaacacugggucaggcuggagagagaaaacaacagggugcagcagaauucuuuuccuucccuuucacccaaguaccagggauucugaagauucuccucccugcccccggcuucucuuccuuccucuuucucuaagccuccuuauccuccucccgcuucucccucaaccccuuaacuucaaccagaagaagagauagaggguugggcaggggagcacagagaauguuguucuuaggauuuugagagaguuaagcgucagggucaauguccccuucccgcuugcgcucucgaaauagauacacacaaaacaucuacuggaacuuuuaaaugaugagaggagauccacaagucaccugugaagcaaaaucucagcacuuuauagucacagaaacauacaggcaugcaaagggcucauguuuaugaauuauaucauaccuaggcaaagcagguggcacuugcacacacacaggaauccuuaaauacacgcaucuuggcauuuccuuuccgccagccuuggcccuucccacccacccaaaggugcgggccacagccacccucuguggggucugaugcagggugaagggcgucacuggguccuggcuacucccuggcugugagaagugggcaagcccuuuacucuaugggaaucucuguaaaaugaaaauaacugccuggccaggggcugugaggaugaaaggguauuaauaauauacgcagggcacuguccugcuugguucccgaaccucucuuuccuacacccacggcuggacugauggugccuucuguuacuugguccccaccgucaguacucuagugugacacugggaagagugggggcuuagccagggccgcggucuguacaggagggucccagcccgcaggucacgggucugcaggcccacagcuaaccuucagagcugcacaagcgccgggagcugugggcacgugaggagggcgagcggguccuaggugcguagacccguggguggggggcggagcggaccgguggaggugggcagagaccggcggcaagucgacccacggcuguggguggcuuccuccuguugcucaguaucagggagaggcgggggaggacauucauuuuuuuucuucccuaaguaagcauccaccuauugcuuuaauaacuaucgauugugaaaagccggcggggccucuuaaaggcgaagucgggaggcgcgcgccccugcgucuguguucggggaccaguccgcggggaccuucuggaccuucuccgccggcugcgcggcagcgauggacccugugcaugggcucuccuagcagccucgggaaccgcggccgcaagcugugguuugaccccugccccaaccacucgcgaggccuuuucuguucagagcccccagucacguucuuggacccagucaccugcgccgcagcgcagucccggcgccccagguucgaggacccggcccgcgcucggaaaguuauuucaaaaggcagauguguugcaacccucucugcagcaaacuacaguacgcggauucccgaacccuuccccgcccccacccagcccgggcgaccagagcccgccgcgggagacuggcagcaaggagagccaccccuaaaugcaccuucccucccucccgcgcgcccaagugcaaugggguugggggaagccccaaagcaaacucacgacgcggagcaauccccagucuuggccuggaaggggucgggcugcugaggaucggcuucccgauuucaugccccagccucccguccuccccagccccagcccacccgccugggccgucgcggccccuagguaccugcggcggucacgggcucgcccucgcucugcuccccggaauccgaauccaugcugcgggcugcuggcugggcguccacggccacccgcccgucugcggggcgcucgggcagccgcggcgcacucagggcggacagcggggcggcuggagcccgggcggcgcgggcggcgcgggcugggcggugcgcggcggcagcggccagggggcggcuccgcagaggcgagcgccgccgcgccccgcuccccgcgcccgccggccggugccugcgcgcgaggcgagcgcagggcggaggguggggcgcuccgggagacagccgggaggagggaggggaggcgcgagcgccgaggagcccgagcguccggcgcccggcgggcuccaggcugggguuaaauaucccgggggcggcgccgcgccucccuacccgcgcccugcgucggagcccuuggacuugccucgcgcggcgagguugugcuggucugcaaggccgagccccuucccuagggugaggccaaguuuguaaaauuacuaggugaaaaagagcuucaacucgcgcaggaaaggagagguuccgaguguuccgacuuaugggguugccaggguucgaguccaacuccuccgcucagagaccuuggacgagaccuguguuuguuuucucacuaggaagaugagggaaggggggcggggaauaagggaaggggagcggggaauaagggaagggagcggggaauaagggaagggggcgggguggggggagaugacaguuggacuguuguggaaaguaguaagacaaggcgugugcggga

SEQ ID NO: 19782 - RNA, 2725 nt, Homo sapiens
ucccgcacacgccuugucuuacuacuuuccacaacaguccaacugucaucuccccccaccccgcccccuucccuuauuccccgcucccuucccuuauuccccgcuccccuucccuuauuccccgccccccuucccucaucuuccuagugagaaaacaaacacaggucucguccaaggucucugagcggaggaguuggacucgaacccuggcaaccccauaagucggaacacucggaaccucuccuuuccugcgcgaguugaagcucuuuuucaccuaguaauuuuacaaacuuggccucacccuagggaaggggcucggccuugcagaccagcacaaccucgccgcgcgaggcaaguccaagggcuccgacgcagggcgcggguagggaggcgcggcgccgcccccgggauauuuaaccccagccuggagcccgccgggcgccggacgcucgggcuccucggcgcucgcgccuccccucccuccucccggcugucucccggagcgccccacccuccgcccugcgcucgccucgcgcgcaggcaccggccggcgggcgcggggagcggggcgcggcggcgcucgccucugcggagccgcccccuggccgcugccgccgcgcaccgcccagcccgcgccgcccgcgccgcccgggcuccagccgccccgcuguccgcccugagugcgccgcggcugcccgagcgccccgcagacgggcggguggccguggacgcccagccagcagcccgcagcauggauucggauuccggggagcagagcgagggcgagcccgugaccgccgcagguaccuaggggccgcgacggcccaggcgggugggcuggggcuggggaggacgggaggcuggggcaugaaaucgggaagccgauccucagcagcccgaccccuuccaggccaagacuggggauugcuccgcgucgugaguuugcuuuggggcuucccccaaccccauugcacuugggcgcgcgggagggagggaaggugcauuuagggguggcucuccuugcugccagucucccgcggcgggcucuggucgcccgggcugggugggggcggggaaggguucgggaauccgcguacuguaguuugcugcagagaggguugcaacacaucugccuuuugaaauaacuuuccgagcgcgggccggguccucgaaccuggggcgccgggacugcgcugcggcgcaggugacuggguccaagaacgugacugggggcucugaacagaaaaggccucgcgagugguuggggcaggggucaaaccacagcuugcggccgcgguucccgaggcugcuaggagagcccaugcacaggguccaucgcugccgcgcagccggcggagaagguccagaagguccccgcggacugguccccgaacacagacgcaggggcgcgcgccucccgacuucgccuuuaagaggccccgccggcuuuucacaaucgauaguuauuaaagcaauagguggaugcuuacuuagggaagaaaaaaaaugaauguccucccccgccucucccugauacugagcaacaggaggaagccacccacagccgugggucgacuugccgccggucucugcccaccuccaccgguccgcuccgccccccacccacgggucuacgcaccuaggacccgcucgcccuccucacgugcccacagcucccggcgcuugugcagcucugaagguuagcugugggccugcagacccgugaccugcgggcugggacccuccuguacagaccgcggcccuggcuaagcccccacucuucccagugucacacuagaguacugacgguggggaccaaguaacagaaggcaccaucaguccagccguggguguaggaaagagagguucgggaaccaagcaggacagugcccugcguauauuauuaauacccuuucauccucacagccccuggccaggcaguuauuuucauuuuacagagauucccauagaguaaagggcuugcccacuucucacagccagggaguagccaggacccagugacgcccuucacccugcaucagaccccacagaggguggcuguggcccgcaccuuugggugggugggaagggccaaggcuggcggaaaggaaaugccaagaugcguguauuuaaggauuccugugugugugcaagugccaccugcuuugccuagguaugauauaauucauaaacaugagcccuuugcaugccuguauguuucugugacuauaaagugcugagauuuugcuucacaggugacuuguggaucuccucucaucauuuaaaaguuccaguagauguuuuguguguaucuauuucgagagcgcaagcgggaaggggacauugacccugacgcuuaacucucucaaaauccuaagaacaacauucucugugcuccccugcccaacccucuaucucuucuucugguugaaguuaagggguugagggagaagcgggaggaggauaaggaggcuuagagaaagaggaaggaagagaagccgggggcagggaggagaaucuucagaaucccugguacuugggugaaagggaaggaaaagaauucugcugcacccuguuguuuucucucuccagccugacccaguguuuaauaucccuguuguauucacggucaguuugugucagaaggccucugcguagcugacagcaaacaucacuaaggucagaugggccccaugaagaacagggcagacagcucucgugagcu

SEQ ID NO: 19783 - RNA, 2959 nt, Homo sapiens
ucggcucucucguccugagaguggguuuaauuuuuuuuuuuuuaauuuauauaagaagggagcucuuaaaggagagccaucuccacccucagguauccaucacccagcuccagcgcgccugggaaaaccgccccgaaaguccaagaggaagcucagaguuguaacggccgcggagccagcucggcggugacgcaagguccaguccagauugccaggcccggggcaugagagaggauccuuguagguuucggaggugggggggcugcacuccauuguucacuccgggccaaucaggguuggcccacuuccucccagccaaucucccuucacccccagccuccaacccaacccaccccgcccaucagccccuggauccccaucaccucccccgcauccccggcaguucuggggaagcuucgugacgccacaggucccgcccccagcuccggcccggggcuagugcguguugacgucaugcugcgugcgggccggugcggaaucgcuccuucaacuccgcggggcaguaggaguuaguuagcaaagagccgaggccgggcgcgcgacccucguccuucugccccuggccgcacacuuugcgcacaucucuuuuucugcaugguggauauuauuuuucauuauccuuuucugggugcuaugggugaucauuccaagaguaaguauuucuguguguguguggggugggguguguguguaugcuuaauaugcaaaauuucuaaugcagaaaaauguuuaguggauucuacaaguggcuucuauuugucagaauaguuuaggagaggaaaaacgaaugcaugucuccugcaggacugcuuaucuuugggaauccuguuguuuuauuuuauaaguaaacacuauuucucaagccggcuaggaugacuucgggcugcgaaaucugcuucuguuuugcgcaaaggcaauuagguuugauuuagggauguggguuuuuuuuuuuuugguuguuguuuguuugccuuucgguuuuucaaagcuaggaagcuuucuuucgcuugcucugggauauuuaaacuaagaaaugucugagaggaugagcggggacugccgaaagacgaugugucuguguugggauaggaggcagccgcugugagugggagugugugagcggaaaugccaggacagcaccguuagguguugauauccaggcguccgcagugccuguguauuuacucucuucuuaguuucguguuugcguuuaguuucaagacacgucgacaaaacgacugucauuaaugaauguaauaacgaaauauuuggggugggggacagaagaaaccuucagcaauccacaagauacugguuuuucguuuccaaugcccuggaccuuuagagagcucaucaucuuuccuuauggucgcaagucuugaaagaaagagcaagagagcgagcggguuggguuggggcuggaguagccgaggccggccuggguccgggcagucaggccugacgcggccccgcgcccuuccccggcagagaagcccgggacggccaugugcgugggcugcgggagucagauccacgaccaguuuauccugcgggugucgcccgaccucgaguggcacgcggccugccucaagugugccgagugcagccaguaccuggacgagacgugcacgugcuucgugagagacgggaagaccuacugcaagcgggacuaugucaggugaggccggcgggaacgcgggcugggccaccgcgcgcaggggccggggccgggacuggggauggcggccugcccgcgcgccccggcccugcccagggagaaggccauccgcaucccgcacgggugccgcagcgcucccccgggcccgggaaugcccgcaggcgggucaccgcagucuccugguggccacaaaguguccugggcgcgcgccggagccguagcagccagggagaugagggcggccgcaggcccagcgcugacaccgccgcaccuugggcccgcaggcuguucggcaucaagugcgccaagugccaggugggcuucagcagcagcgaccuggugaugagggcgcgggacagcguguaccacaucgagugcuuccgcugcuccgugugcagccgccagcugcugccuggggacgaguucucgcugcgggagcacgagcugcucugccgcgccgaccacggccuccugcucgagcgcgccgcggccggcagcccgcgcagccccggcccgcuucccggcgcccgcggccugcaucugcccgguaagcgcgccggggccugugccggggugagcgggguguaugugcgugcguguguguagggguacgcuugugucccuaacgagaaguugucaguugugugugguuccgucugccgggauaguguuuuucuguaucagugcggaacugugugcugggaacaaggcuguguguauucucgugugcucgggagaaacugcguguguaugagugugugagcacggagaauugugcagaaucguguucuccaugaccaggaacaugcagggcacagugcuaggagcagaagaguggaugacaacagggaaucuuaagugguguccgucuuggggcuuguauuaggaauuucuuggaggaauauguguuauugucagaggguaagguuugcccagggguauguguguaaguaacacagcuccaaacugggagcugggcaggagcuuggucagccaggagccaagaacccaacaaagagggguuuuugccaucuuguuuugaggcccaguuugaugaacaauuuagccagguucuucugggggagggggaguaucaaugcauaguggacugucacuggaauauucuggguccuaaucagcagcugcccagagauggggucugaguguauaaugggcagguacggcugaacagaaacagaggugccuccaccccaggcaaggcaguuucccccagguagccauaggccugcagcacagauc

SEQ ID NO: 19784 - RNA, 2959 nt, Homo sapiens
gaucugugcugcaggccuauggcuaccugggggaaacugccuugccugggguggaggcaccucuguuucuguucagccguaccugcccauuauacacucagaccccaucucugggcagcugcugauuaggacccagaauauuccagugacaguccacuaugcauugauacucccccucccccagaagaaccuggcuaaauuguucaucaaacugggccucaaaacaagauggcaaaaaccccucuuuguuggguucuuggcuccuggcugaccaagcuccugcccagcucccaguuuggagcuguguuacuuacacacauaccccugggcaaaccuuacccucugacaauaacacauauuccuccaagaaauuccuaauacaagccccaagacggacaccacuuaagauucccuguugucauccacucuucugcuccuagcacugugcccugcauguuccuggucauggagaacacgauucugcacaauucuccgugcucacacacucauacacacgcaguuucucccgagcacacgagaauacacacagccuuguucccagcacacaguuccgcacugauacagaaaaacacuaucccggcagacggaaccacacacaacugacaacuucucguuagggacacaagcguaccccuacacacacgcacgcacauacaccccgcucaccccggcacaggccccggcgcgcuuaccgggcagaugcaggccgcgggcgccgggaagcgggccggggcugcgcgggcugccggccgcggcgcgcucgagcaggaggccguggucggcgcggcagagcagcucgugcucccgcagcgagaacucguccccaggcagcagcuggcggcugcacacggagcagcggaagcacucgaugugguacacgcugucccgcgcccucaucaccaggucgcugcugcugaagcccaccuggcacuuggcgcacuugaugccgaacagccugcgggcccaaggugcggcggugucagcgcugggccugcggccgcccucaucucccuggcugcuacggcuccggcgcgcgcccaggacacuuuguggccaccaggagacugcggugacccgccugcgggcauucccgggcccgggggagcgcugcggcacccgugcgggaugcggauggccuucucccugggcagggccggggcgcgcgggcaggccgccauccccagucccggccccggccccugcgcgcgguggcccagcccgcguucccgccggccucaccugacauagucccgcuugcaguaggucuucccgucucucacgaagcacgugcacgucucguccagguacuggcugcacucggcacacuugaggcaggccgcgugccacucgaggucgggcgacacccgcaggauaaacuggucguggaucugacucccgcagcccacgcacauggccgucccgggcuucucugccggggaagggcgcggggccgcgucaggccugacugcccggacccaggccggccucggcuacuccagccccaacccaacccgcucgcucucuugcucuuucuuucaagacuugcgaccauaaggaaagaugaugagcucucuaaagguccagggcauuggaaacgaaaaaccaguaucuuguggauugcugaagguuucuucugucccccaccccaaauauuucguuauuacauucauuaaugacagucguuuugucgacgugucuugaaacuaaacgcaaacacgaaacuaagaagagaguaaauacacaggcacugcggacgccuggauaucaacaccuaacggugcuguccuggcauuuccgcucacacacucccacucacagcggcugccuccuaucccaacacagacacaucgucuuucggcaguccccgcucauccucucagacauuucuuaguuuaaauaucccagagcaagcgaaagaaagcuuccuagcuuugaaaaaccgaaaggcaaacaaacaacaaccaaaaaaaaaaaaacccacaucccuaaaucaaaccuaauugccuuugcgcaaaacagaagcagauuucgcagcccgaagucauccuagccggcuugagaaauaguguuuacuuauaaaauaaaacaacaggauucccaaagauaagcaguccugcaggagacaugcauucguuuuuccucuccuaaacuauucugacaaauagaagccacuuguagaauccacuaaacauuuuucugcauuagaaauuuugcauauuaagcauacacacacaccccaccccacacacacacagaaauacuuacucuuggaaugaucacccauagcacccagaaaaggauaaugaaaaauaauauccaccaugcagaaaaagagaugugcgcaaagugugcggccaggggcagaaggacgagggucgcgcgcccggccucggcucuuugcuaacuaacuccuacugccccgcggaguugaaggagcgauuccgcaccggcccgcacgcagcaugacgucaacacgcacuagccccgggccggagcugggggcgggaccuguggcgucacgaagcuuccccagaacugccggggaugcgggggaggugauggggauccaggggcugaugggcgggguggguuggguuggaggcugggggugaagggagauuggcugggaggaagugggccaacccugauuggcccggagugaacaauggagugcagcccccccaccuccgaaaccuacaaggauccucucucaugccccgggccuggcaaucuggacuggaccuugcgucaccgccgagcuggcuccgcggccguuacaacucugagcuuccucuuggacuuucggggcgguuuucccaggcgcgcuggagcugggugauggauaccugaggguggagauggcucuccuuuaagagcucccuucuuauauaaauuaaaaaaaaaaaaauuaaacccacucucaggacgagagagccga

SEQ ID NO: 19785 - RNA, 2573 nt, Homo sapiens
cugacagcgccgaggcaagcggagccaagcgagccgggcggccuuuaagggagccagcgcccgcccgggcggccaguccggcggggggcggcggggcgggccgggggcggccggggcgcgggcggcgcggcgccgcggcgcuuggggagcgggcccaggccccgggagcccggcggggcagggcagggcgaggcggugaagggaggcccagccccgacccggcgccuguuugccccaccggcggcgacccggcgcccgggggcugcugaggcggggagccgagagcgaacggacgggagguagcggagccgagcggaggcugcgagccuagugcgccccggcccggcccggcccgccgcucgcccccuccccucccuuccccucgccgcgccuccuccccucgccucuucucgccuccucuccucuccuccgcccggcgcugcucccgccugcgcccgggccgccgaacccagcccggccggggcccccggcuucgcgcgcucucggcugggcccggcggggaccggguccccgcggcugacaucgccccuccucggggacccgguggauuccggaccuuucggaacgugaacugagccgugggagcggucucgcccagggccgaccgcggggcugggcugagcagacccucgcggccgcuccggacgccgcgggugccggggcacggacguucuggguccgggcugagcgcgucccgggcgcccggcggugccagcucacuccgggcgggguagggcagggcagaccccagcggaacacggacccggccgaucuggacuggacagagcgaaucccggacggugcagagcccggggaaugccgggcgugggcugaggggaucccggcgcccucccagcccuccgacuuuggcucacgcgcugggaccugcccggcgucuccucggccuccccgcgccccggucaccuguggccucggagccccaaaucugccggacccucgcucauucccgaccccgagccuggagaggcuugagaaagauuuuuccugcccccuucccuggagcgcggaggccccgcccccucccaccgcccagaugucuccggucacggcucggaggaccucccugaggcccggggccgaaggguccagagagagaagcccgcccuagggagccuugggggccccccaacuccgucuuggggcuuggcccccgacgcugcuuggagggaaggccggugcccccacccucggugaguccaggaguggggguucugagggaaggcggggcugggggagggaggguccgcugggaacgagggcacccugggggcgcuaggagggaggaugggugacuggagaggcccucuggugaaccagccugggcaggccuggcuggggggaagguggggggggagggcgggagcuacggccagggugccccguagcaggcugaggacuucugcuucuaaagcaggggcucccucccuuucccucuagaggaggggcugugcuguaaaccgucugccuccaccaccccuccccacaaagaaaaaaaaauccccagcgaggaagggugcaggcuggcgagaggagggaggcagcggcauugccggcuggugcugcagccugggagggcugacgccaggcucgcucucuccgcagggggcugcccucuuccaauccagcucccuccccagagcugcccauauccggagccccuuccacaucuggaagacccuggccaccaucccucugcaggugucaguugcauccagagaccucugccuuugcaacugccuaggaguugugaggggaucccugcugccuucccccaucccaagggcaucucuuacccuuagucccugcagagucaucccccugccucuguguucaagcucaggcagagaucagcucugcacacccacaggcacuucaagaccuggaggccacuccugggacccaaggucccucccccuccucuccuguguccucaccuugacccccucugcuagacucugucucccucugggugucccacucuccacccagaggcagaggaggcuggguggcagggggcaggggcugguugagggccgcccagggccagggugggcuggggggccguuaaaauguggagcucugcccagccgaggggggcuccguggaggcagacgcagugugugcccagcuggggggaguaugggcaggccugcggccacgugguaaacgaugaacauucggggcgccccggaccucgggcagcccagugacgaccccagcagugguggugagcgggagcggauucgacagcgcaugaagauggucaucgggcagcuugagggcauccuucgcgagcucaaggagguggccaaggagcugagggagguaagugaggggugaggagggaccagacagacccuaagccaaccuucuuggguuuggcacaaaaacguacucauaaauacguuggagugugcaaagcugcgugcacaugugucacucuacuggggaccuucuuucuccuugcucuccuuuccgcaaaucugcuuugcuaaaaaucucaucagaccccaaggcuggaggggccucgg

SEQ ID NO: 19786 - RNA, 2573 nt, Homo sapiens
ccgaggccccuccagccuuggggucugaugagauuuuuagcaaagcagauuugcggaaaggagagcaaggagaaagaagguccccaguagagugacacaugugcacgcagcuuugcacacuccaacguauuuaugaguacguuuuugugccaaacccaagaagguuggcuuagggucugucuggucccuccucaccccucacuuaccucccucagcuccuuggccaccuccuugagcucgcgaaggaugcccucaagcugcccgaugaccaucuucaugcgcugucgaauccgcucccgcucaccaccacugcuggggucgucacugggcugcccgagguccggggcgccccgaauguucaucguuuaccacguggccgcaggccugcccauacuccccccagcugggcacacacugcgucugccuccacggagccccccucggcugggcagagcuccacauuuuaacggccccccagcccacccuggcccugggcggcccucaaccagccccugcccccugccacccagccuccucugccucuggguggagagugggacacccagagggagacagagucuagcagagggggucaaggugaggacacaggagaggagggggagggaccuugggucccaggaguggccuccaggucuugaagugccugugggugugcagagcugaucucugccugagcuugaacacagaggcagggggaugacucugcagggacuaaggguaagagaugcccuugggaugggggaaggcagcagggauccccucacaacuccuaggcaguugcaaaggcagaggucucuggaugcaacugacaccugcagagggaugguggccagggucuuccagauguggaaggggcuccggauaugggcagcucuggggagggagcuggauuggaagagggcagcccccugcggagagagcgagccuggcgucagcccucccaggcugcagcaccagccggcaaugccgcugccucccuccucucgccagccugcacccuuccucgcuggggauuuuuuuuucuuuguggggaggggugguggaggcagacgguuuacagcacagccccuccucuagagggaaagggagggagccccugcuuuagaagcagaaguccucagccugcuacggggcacccuggccguagcucccgcccuccccccccaccuuccccccagccaggccugcccaggcugguucaccagagggccucuccagucacccauccucccuccuagcgcccccagggugcccucguucccagcggacccucccucccccagccccgccuucccucagaacccccacuccuggacucaccgagggugggggcaccggccuucccuccaagcagcgucgggggccaagccccaagacggaguuggggggcccccaaggcucccuagggcgggcuucucucucuggacccuucggccccgggccucagggagguccuccgagccgugaccggagacaucugggcggugggagggggcggggccuccgcgcuccagggaagggggcaggaaaaaucuuucucaagccucuccaggcucggggucgggaaugagcgaggguccggcagauuuggggcuccgaggccacaggugaccggggcgcggggaggccgaggagacgccgggcaggucccagcgcgugagccaaagucggagggcugggagggcgccgggauccccucagcccacgcccggcauuccccgggcucugcaccguccgggauucgcucuguccaguccagaucggccggguccguguuccgcuggggucugcccugcccuaccccgcccggagugagcuggcaccgccgggcgcccgggacgcgcucagcccggacccagaacguccgugccccggcacccgcggcguccggagcggccgcgagggucugcucagcccagccccgcggucggcccugggcgagaccgcucccacggcucaguucacguuccgaaagguccggaauccaccggguccccgaggaggggcgaugucagccgcggggacccgguccccgccgggcccagccgagagcgcgcgaagccgggggccccggccgggcuggguucggcggcccgggcgcaggcgggagcagcgccgggcggaggagaggagaggaggcgagaagaggcgaggggaggaggcgcggcgaggggaagggaggggagggggcgagcggcgggccgggccgggccggggcgcacuaggcucgcagccuccgcucggcuccgcuaccucccguccguucgcucucggcuccccgccucagcagcccccgggcgccgggucgccgccgguggggcaaacaggcgccgggucggggcugggccucccuucaccgccucgcccugcccugccccgccgggcucccggggccugggcccgcuccccaagcgccgcggcgccgcgccgcccgcgccccggccgcccccggcccgccccgccgccccccgccggacuggccgcccgggcgggcgcuggcucccuuaaaggccgcccggcucgcuuggcuccgcuugccucggcgcugucag

SEQ ID NO: 19787 - RNA, 2514 nt, Homo sapiens
uggcagcgccucguccgugccgucuucguccaggggcccgcgggacagagcgcucgggcagcgcuccuccgcgccgaggccacucucuuuggcuggcucggcaccguccaggggcucuggggcaccgcugccagcagcugccgcugccgccgccgcugccgccgccacggcugccgccacggccuuggcuuggcucugagcagcgggguaggacgguaccgggaggcugccugcugcuggccagaacaugggaaacgucggguacacaguggcggcggcggccgcugcagccacugccgcugcguccuuggcugccccggaggguugaugcccccagaacauggcgccgccgcccgggcccgccccugcccccgggggcaaguggcuggcucccgggccccccgcacccccgccuguccccgcgccgccgccgccgcucccagugccaggaccgcccuuuggcucgcccgcgccuaaaaccgggucguccuuuuuggggcauaggccgaaggccguagggaagccguaaggaugggggaaaaguggugggggcagcuuuugcaggagcccaaagccuuugcugggcaccgggaucaccggguagcuucguacgccggcgccgccaccgggcccuccugggcccgccgggccacuagcuccagucgccaggccaaguccgcgcugcgggugggguggagguggccccggaggcccggcagccucaucuucgccacagcgcaggcuuuuguggggcggcgggccuggggccaucucugcaccgcacccugggccaccgccgccaccgccgccagcaccacccuuccccugcccacccgacccgccauuggcaccgccuccgccgccuccuuguagggagaagguccgcuugcgcgugccgccauuaaacauggccuugacguccucccaagcauggcucaguucgucuguggccgacuugucacugaguuugaggugacgacgccaggaguugaaguuggcggcaucgggcugcguguacuuggcgucggguguucggugcgaguggaagaugaacuuguugggcgagaaguacaugcugcaguagccgcacuugaugcacuuggcacgagagcuguuguaacgcgcagggaugaagcuaccacgcgagccccacgcgcacucgugcaccacaucgaaggcgaaguucucgggcagcuugggugguuugugcucgcccaggaacgacuugcacaggcguucggccucucgcuuagugaucaugccgcagcggcgcgacgagaugggcauggccccggcccgacgcagaaucuccagcuguaccggcgugcacugcacgcacgugaugcccagggccacgcggcgguuguggaucucauuauagcuguaguucuugaggaggguguuggagaucugcgccaggcauaggcgcuccuggccgucgaugaccagcgacacaaugggcaccccguacagcgacgucucgcccaccugguuggguuugagagcgcuggagcccgaguacggcugcagcuccugcuuggaguugggcgaggaacugcccucgcgccccggccccagcugaguggugagagccuccaugccgccgcuccugcgaaauagagaaagcagagagcagaugagccauuuucagcgccgccgccgaggcucgggcccgcccagcagggcgcuccgaguugggcgcgcgggggauacuuggcaguggggaguccaaacucauucacccccuggacaggcgucuuuuguuacucagacccauguuggcgccguuaacaacagcccccggggcuugggggaggagaagggguaaaggagaccucaggaaugcccgggcugcaaggaacccaaucccguuuucggauugggaaggaagugaaacccagauacgcagagugacuugcccaaggccacacagcaaagccauugccaaauccuggcuuuuucagcgcccagauccgugcgccuucggcaacccucgcagccggugcugccggcccggguccugaagcccggacuucggggaucggccgccccucugcucagucgcgcaugcacgcgggcgggcgggggcagugcaaggagggguggggaggggggaggggcggucacugcccaucuccagacagcaggggguagaggggggugaagagaaggaggggggugaggagaaggaggagggaaccgugucugccagggaaggagagaggcggaggcuaccgcuguucgcggugcugaaccugacccucuccaaagcgcucggugcgcacccggaccuagcgcggcccccaccgcacccagcuuggugcccgagccggcuucaggggacaacauugccaguuuccacaaacccgagcuucuccucucacggcuggcgcccgcguucguugagcagaaagauuucggcuggauauauaaaccguuuucuuuccagcuauuagugagaccaggauccugcaguucuaaccacauuuucugcauuuuuagcuguauuccaga

SEQ ID NO: 19788 - RNA, 2514 nt, Homo sapiens
ucuggaauacagcuaaaaaugcagaaaaugugguuagaacugcaggauccuggucucacuaauagcuggaaagaaaacgguuuauauauccagccgaaaucuuucugcucaacgaacgcgggcgccagccgugagaggagaagcucggguuuguggaaacuggcaauguuguccccugaagccggcucgggcaccaagcugggugcggugggggccgcgcuagguccgggugcgcaccgagcgcuuuggagagggucagguucagcaccgcgaacagcgguagccuccgccucucuccuucccuggcagacacgguucccuccuccuucuccucaccccccuccuucucuucaccccccucuacccccugcugucuggagaugggcagugaccgccccuccccccuccccaccccuccuugcacugcccccgcccgcccgcgugcaugcgcgacugagcagaggggcggccgauccccgaaguccgggcuucaggacccgggccggcagcaccggcugcgaggguugccgaaggcgcacggaucugggcgcugaaaaagccaggauuuggcaauggcuuugcuguguggccuugggcaagucacucugcguaucuggguuucacuuccuucccaauccgaaaacgggauuggguuccuugcagcccgggcauuccugaggucuccuuuaccccuucuccucccccaagccccgggggcuguuguuaacggcgccaacaugggucugaguaacaaaagacgccuguccagggggugaaugaguuuggacuccccacugccaaguaucccccgcgcgcccaacucggagcgcccugcugggcgggcccgagccucggcggcggcgcugaaaauggcucaucugcucucugcuuucucuauuucgcaggagcggcggcauggaggcucucaccacucagcuggggccggggcgcgagggcaguuccucgcccaacuccaagcaggagcugcagccguacucgggcuccagcgcucucaaacccaaccaggugggcgagacgucgcuguacggggugcccauugugucgcuggucaucgacggccaggagcgccuaugccuggcgcagaucuccaacacccuccucaagaacuacagcuauaaugagauccacaaccgccgcguggcccugggcaucacgugcgugcagugcacgccgguacagcuggagauucugcgucgggccggggccaugcccaucucgucgcgccgcugcggcaugaucacuaagcgagaggccgaacgccugugcaagucguuccugggcgagcacaaaccacccaagcugcccgagaacuucgccuucgauguggugcacgagugcgcguggggcucgcgugguagcuucaucccugcgcguuacaacagcucucgugccaagugcaucaagugcggcuacugcagcauguacuucucgcccaacaaguucaucuuccacucgcaccgaacacccgacgccaaguacacgcagcccgaugccgccaacuucaacuccuggcgucgucaccucaaacucagugacaagucggccacagacgaacugagccaugcuugggaggacgucaaggccauguuuaauggcggcacgcgcaagcggaccuucucccuacaaggaggcggcggaggcggugccaauggcgggucgggugggcaggggaaggguggugcuggcggcgguggcggcgguggcccagggugcggugcagagauggccccaggcccgccgccccacaaaagccugcgcuguggcgaagaugaggcugccgggccuccggggccaccuccaccccacccgcagcgcggacuuggccuggcgacuggagcuaguggcccggcgggcccaggagggcccgguggcggcgccggcguacgaagcuacccggugaucccggugcccagcaaaggcuuugggcuccugcaaaagcugcccccaccacuuuucccccauccuuacggcuucccuacggccuucggccuaugccccaaaaaggacgacccgguuuuaggcgcgggcgagccaaagggcgguccuggcacugggagcggcggcggcggcgcggggacaggcgggggugcggggggcccgggagccagccacuugcccccgggggcaggggcgggcccgggcggcggcgccauguucugggggcaucaacccuccggggcagccaaggacgcagcggcaguggcugcagcggccgccgccgccacuguguacccgacguuucccauguucuggccagcagcaggcagccucccgguaccguccuaccccgcugcucagagccaagccaaggccguggcggcagccguggcggcggcagcggcggcggcagcggcagcugcuggcagcggugccccagagccccuggacggugccgagccagccaaagagaguggccucggcgcggaggagcgcugcccgagcgcucugucccgcgggccccuggacgaagacggcacggacgaggcgcugcca

SEQ ID NO: 19789 - RNA, 2476 nt, Homo sapiens
cauauggccacuagggggcagcaggggccaagcgcgggcuagggcuuugacuugccugcugucgccaggcaggaacucccucagggugcugaagagaagagaaacacuguaagcugccuggggaugccgggggagcgugaggaagggguggagacaccagagcccagaacugcaccucccaggggaccacugcuucuauuuguaacaagccccaguuccggagguggcggggguaaccaagucuguccaaaaaaaagccccuccacccaggucaagagagcuggugagggcggucaugcuggauccuggcagaugugaaaagaaagggcuugcccuccaacaccuuuccucaccugcucacugcugacagccccuggcccccgccaucggccccccuuacccccaguugcuagccuuggggucuguggggaagugccgaagucucaggaauuccaguaacuccuugggcaccuccugguucagguacaggaugcccuggagaggacagaggagaccugcaaucagacccagcuacuaauuugcauagcgcagugccagugaaaaugcagggcucuuuguuccaaaaaaagaauuucacgacaaugacagcagagcguugaaccaggcucagggcccuucugggcgcugggcgcugugugcacagguuguaccccaugacgcggcauagcuuugcuguugggggaaggacccucacccuacaugccaucaggagggcagcacaggaccucaccauggaggggacaggaccuggguuucauggagcugggacuaccuguguccguuaccucuuucaguccuuucaacaagccagagggggguguuuggaccuauauuagacucagaaaauugaugcuugagguggugaauaacauccccaaguuguggguucccucccugccaugcccccacaccucucugucugggccacaccccuggcacagaaggccggggggcaaccaacugugcucucgcauaccuggauguaagccuccaagcccugccggcgcuguuccaacccucugguccuccaguugggcaggcguuucgaggggaagucgggcacuuuguacagcuucuugaucuacuggagguuuaccgcgugcgaucacagcaucccgacugagcccucaagcccucuucgccccagccagaagcccucccgcgcccccgccuucgggcucuacugggacagacccuggugagugguggaccggccgagggcgaggaaggccccaacccacccacagaggcccgggggcugaccggcugcgcagggacugaggcaguaauggggguggcggaggcuggggcucgcccgcccgccucacagggccugggcgggggcuggacagaggcugggccggggccggugggaggucggcgccgccucacccgcuugugcagcgcguggaacucgcuguagcgccuuggcaccgugugucugcgcccgcugcacagcaccuccacucggaacaccuggcggcgcgggcgggcagcgggucugcgcgugaggccccgcgggaggacgccgcagcaccugcgccuggcgacgugcccacccucccgcucucaaaggcacaaagcggccuugcggcgccgcggcugcccggggacucuccgcucccgcacaccugggagaaccggcuggcggaccugccccucggagcccuggggucccucaagagcucgaaccaugguccgcgaggcuggcaaauccaagcggcccccaaacccucgacaagguuucccccgacgguccagcccgcagcgcucguucacccaggcccgggccccggguccccacugagcgcagcgcggggaaauccugcgggucccggcgccccuccccauccaggggccgcgcucaccauguggcuuuucuccgggcucugccugggccccucggccucgggccccaccgacgggaugugaacuuccagcauccgcgccccggccccagcugcuccgcgcgcucggcucggagcccuaacucucccggagcggacugaggaccccggggcggccggcuccgcccccucgguccgcaggccccaccccaggccccgcccccaggcgaccccgccccgggcguucccuugcgccgcggguccugagccuagaagauuaggcgggaccuggacgccgcccccgaagucuagugcgcccacagcgcggggcaguggagucaaccguuugucaaacauugacggagcacucacugaugccaggaacuggcgagcgaaaaugucacccaaccugaguuaagcgccuaccaaggacggccuguggcuccaggcgcggacggaggcggggcccgggccucagcgccgguccuggggccaaccagggaccugucuuggguuccucagucccuucccgagccuuucccuccuuucagccuggucccugaaauugugaucuggauuccccggcugaggccacaccugagcaaggc

SEQ ID NO: 19790 - RNA, 2476 nt, Homo sapiens
gccuugcucagguguggccucagccggggaauccagaucacaauuucagggaccaggcugaaaggagggaaaggcucgggaagggacugaggaacccaagacaggucccugguuggccccaggaccggcgcugaggcccgggccccgccuccguccgcgccuggagccacaggccguccuugguaggcgcuuaacucagguugggugacauuuucgcucgccaguuccuggcaucagugagugcuccgucaauguuugacaaacgguugacuccacugccccgcgcugugggcgcacuagacuucgggggcggcguccaggucccgccuaaucuucuaggcucaggacccgcggcgcaagggaacgcccggggcggggucgccugggggcggggccugggguggggccugcggaccgagggggcggagccggccgccccgggguccucaguccgcuccgggagaguuagggcuccgagccgagcgcgcggagcagcuggggccggggcgcggaugcuggaaguucacaucccgucgguggggcccgaggccgaggggcccaggcagagcccggagaaaagccacauggugagcgcggccccuggauggggaggggcgccgggacccgcaggauuuccccgcgcugcgcucaguggggacccggggcccgggccugggugaacgagcgcugcgggcuggaccgucgggggaaaccuugucgaggguuugggggccgcuuggauuugccagccucgcggaccaugguucgagcucuugagggaccccagggcuccgaggggcagguccgccagccgguucucccaggugugcgggagcggagaguccccgggcagccgcggcgccgcaaggccgcuuugugccuuugagagcgggagggugggcacgucgccaggcgcaggugcugcggcguccucccgcggggccucacgcgcagacccgcugcccgcccgcgccgccagguguuccgaguggaggugcugugcagcgggcgcagacacacggugccaaggcgcuacagcgaguuccacgcgcugcacaagcgggugaggcggcgccgaccucccaccggccccggcccagccucuguccagcccccgcccaggcccugugaggcgggcgggcgagccccagccuccgccacccccauuacugccucagucccugcgcagccggucagcccccgggccucuguggguggguuggggccuuccucgcccucggccgguccaccacucaccagggucugucccaguagagcccgaaggcgggggcgcgggagggcuucuggcuggggcgaagagggcuugagggcucagucgggaugcugugaucgcacgcgguaaaccuccaguagaucaagaagcuguacaaagugcccgacuuccccucgaaacgccugcccaacuggaggaccagaggguuggaacagcgccggcagggcuuggaggcuuacauccagguaugcgagagcacaguugguugccccccggccuucugugccagggguguggcccagacagagaggugugggggcauggcagggagggaacccacaacuuggggauguuauucaccaccucaagcaucaauuuucugagucuaauauagguccaaacaccccccucuggcuuguugaaaggacugaaagagguaacggacacagguagucccagcuccaugaaacccagguccuguccccuccauggugagguccugugcugcccuccugauggcauguagggugaggguccuucccccaacagcaaagcuaugccgcgucaugggguacaaccugugcacacagcgcccagcgcccagaagggcccugagccugguucaacgcucugcugucauugucgugaaauucuuuuuuuggaacaaagagcccugcauuuucacuggcacugcgcuaugcaaauuaguagcugggucugauugcaggucuccucuguccucuccagggcauccuguaccugaaccaggaggugcccaaggaguuacuggaauuccugagacuucggcacuuccccacagaccccaaggcuagcaacuggggguaaggggggccgauggcgggggccaggggcugucagcagugagcaggugaggaaagguguuggagggcaagcccuuucuuuucacaucugccaggauccagcaugaccgcccucaccagcucucuugaccuggguggaggggcuuuuuuuuggacagacuugguuacccccgccaccuccggaacuggggcuuguuacaaauagaagcagugguccccugggaggugcaguucugggcucuggugucuccaccccuuccucacgcucccccggcauccccaggcagcuuacaguguuucucuucucuucagcacccugagggaguuccugccuggcgacagcaggcaagucaaagcccuagcccgcgcuuggccccugcugcccccuaguggccauaug

SEQ ID NO: 19791 - RNA, 2477 nt, Homo sapiens
cuugaaacugcgcagaguucggggcuccgccgaucugggcggagggaagacgcgcuuuucucggcgaagagggggugacaggguuucccccgccggucaaauaggaggggguuucggggccucagggaggggaugguucggcucagguggccccggccuuccuugaugugggggcgaggacaacucccacgcgccucucggcccaucugcaaguuuguguuuggucuccuggguccaaaacaaaguucucuuggggcaaggcggguuggccgaaggugaaaugaacaaguuaggguggcggucccaggugggggccggcaggacugggagccagggaaggcgagugaggugguggggaggagaacgagagggggcgugggcuccugcgggucagugcaccgccaccgagugcaaggcggaggccgggcuggugagcguuucgcuggggguggcggggcugcuuuggcugguggcuguuugcgaggacguggggcugagcgagggcggcgaguucgagagcaagguggggaugggcgcuggcagcgcaggcagcgcgggcacggcggccggcgugggcuuaaugggcacggggauggcgggcagcguuuggcccgccgcguggcacagcggcuucaacggcacgccguaggcgcuguagucgccacucgccauggagauggggguggccgagucgaucaugccggcggagccauacacguguggccagccggugcccagcgagcugcccaugguagucaacugguuggggagcggguaggcagcgggcaccggcugcauggcggagaaggccagccccccaggcaucuuguauucccgcgcgaugauguucucgauggcgaaggggugcuugaagcccgagggcugcgccacgccgcccaaguuguaggcggcggcgggcaucuguggcaggugcgugcccgaggccgccagcgcgcugagccgcagcuuggccugcugcugcagguacugcgccgcgucggcuggcuugcugggcgccagguggucggacuuaagcaccuugaagcgcuugcggcgccgcaggaagcugccguucucgaacauguccccgcagcuugggugcagcgcccagaagcugcccuugccuggcugguccggccgccgcgggaucuugaugaagcagucguugaaggagagguuguggcgcagacuguucugccagcgcugcguguucucccuguaguaggggaagcgguccaugaugaacuuguagaucucgcucagcggcagcaucuucucgggagagcucuggauggccauagcggucagcgagauguacgaguagggcggcuucuggucgcuguacguguugcggccgggccgaggcaucuucuuccucgcccucuucuugcucuggguccgcgcgggccggcggacugcucggaucugggaaggggguggguaauagggaaagguagcauggaugcacagagacaccggcggggucagccagaccgaguaacagacuucgggggucggggguggggccugcggcgcucgaucagccagcgcccggacucuuucgccagcaacuuugcgggcuuagugggcgcgggaggggaagccggcgaacggcgcgaggauagccgggaaguaagucgguacuggggccagaauagggggcagggacggaacagagagcugcucaccuuaaaguugcuucaaguugcgcguccgcauccgggaggacgccgcugcgcgccgcuucucucucggcgcgcacucgacgcgcacuccgcgcgcagcguccggguccgguuggacucggcgcgaaccugggcucuugagcucagccccgcagcgucccgugccgcccgguccgcgacgcuccuggagcguccugcgggcggccgagcucggcugcggagucccggcgcggaugguggcagcgacguguuagggcuccggagggcgcugcugugggcuccgcgucuccgcugagcuagguggcugccuccauguccucccucgaaccaucugauaguuuuaagcggugacaggagcagaaaagaccccuguagcggcgcuucauuaaugugccacuucuuagcuaucauaugacaaucgccuugggaggaggaggaagaggagggggagcgggggcugcagagggaggggacugagcgagaagggagagcccggccagcucugguuucuuucacaccuauuuacauggacaccuuggccaauaggaaucacuuccagcucaagacugggcgagggggaagagccucggccacugggcaggcagcuggacgcgccggccggugugcgccgugugaagguaugaggaagcggccgccgcggaagagggagccaggcgaccacucacguucacagauggagcagccgcgcggaugauguuugacauggaaauugcuuggcugggguauucuguuuccucugcguuguauccgguuuguaucguuagguaacuu

SEQ ID NO: 19792 - RNA, 2477 nt, Homo sapiens
aaguuaccuaacgauacaaaccggauacaacgcagaggaaacagaauaccccagccaagcaauuuccaugucaaacaucauccgcgcggcugcuccaucugugaacgugaguggucgccuggcucccucuuccgcggcggccgcuuccucauaccuucacacggcgcacaccggccggcgcguccagcugccugcccaguggccgaggcucuucccccucgcccagucuugagcuggaagugauuccuauuggccaagguguccauguaaauaggugugaaagaaaccagagcuggccgggcucucccuucucgcucaguccccucccucugcagcccccgcucccccuccucuuccuccuccucccaaggcgauugucauaugauagcuaagaaguggcacauuaaugaagcgccgcuacaggggucuuuucugcuccugucaccgcuuaaaacuaucagaugguucgagggaggacauggaggcagccaccuagcucagcggagacgcggagcccacagcagcgcccuccggagcccuaacacgucgcugccaccauccgcgccgggacuccgcagccgagcucggccgcccgcaggacgcuccaggagcgucgcggaccgggcggcacgggacgcugcggggcugagcucaagagcccagguucgcgccgaguccaaccggacccggacgcugcgcgcggagugcgcgucgagugcgcgccgagagagaagcggcgcgcagcggcguccucccggaugcggacgcgcaacuugaagcaacuuuaaggugagcagcucucuguuccgucccugcccccuauucuggccccaguaccgacuuacuucccggcuauccucgcgccguucgccggcuuccccucccgcgcccacuaagcccgcaaaguugcuggcgaaagaguccgggcgcuggcugaucgagcgccgcaggccccacccccgacccccgaagucuguuacucggucuggcugaccccgccggugucucugugcauccaugcuaccuuucccuauuacccacccccuucccagauccgagcaguccgccggcccgcgcggacccagagcaagaagagggcgaggaagaagaugccucggcccggccgcaacacguacagcgaccagaagccgcccuacucguacaucucgcugaccgcuauggccauccagagcucucccgagaagaugcugccgcugagcgagaucuacaaguucaucauggaccgcuuccccuacuacagggagaacacgcagcgcuggcagaacagucugcgccacaaccucuccuucaacgacugcuucaucaagaucccgcggcggccggaccagccaggcaagggcagcuucugggcgcugcacccaagcugcggggacauguucgagaacggcagcuuccugcggcgccgcaagcgcuucaaggugcuuaaguccgaccaccuggcgcccagcaagccagccgacgcggcgcaguaccugcagcagcaggccaagcugcggcucagcgcgcuggcggccucgggcacgcaccugccacagaugcccgccgccgccuacaacuugggcggcguggcgcagcccucgggcuucaagcaccccuucgccaucgagaacaucaucgcgcgggaauacaagaugccuggggggcuggccuucuccgccaugcagccggugcccgcugccuacccgcuccccaaccaguugacuaccaugggcagcucgcugggcaccggcuggccacacguguauggcuccgccggcaugaucgacucggccacccccaucuccauggcgaguggcgacuacagcgccuacggcgugccguugaagccgcugugccacgcggcgggccaaacgcugcccgccauccccgugcccauuaagcccacgccggccgccgugcccgcgcugccugcgcugccagcgcccauccccaccuugcucucgaacucgccgcccucgcucagccccacguccucgcaaacagccaccagccaaagcagccccgccacccccagcgaaacgcucaccagcccggccuccgccuugcacucgguggcggugcacugacccgcaggagcccacgcccccucucguucuccuccccaccaccucacucgccuucccuggcucccaguccugccggcccccaccugggaccgccacccuaacuuguucauuucaccuucggccaacccgccuugccccaagagaacuuuguuuuggacccaggagaccaaacacaaacuugcagaugggccgagaggcgcgugggaguuguccucgcccccacaucaaggaaggccggggccaccugagccgaaccauccccucccugaggccccgaaacccccuccuauuugaccggcgggggaaacccugucacccccucuucgccgagaaaagcgcgucuucccuccgcccagaucggcggagccccgaacucugcgcaguuucaag

SEQ ID NO: 19793 - RNA, 2618 nt, Homo sapiens
ggagcgccgggcgcggggcggggcggccccuaggcgcgcgcugcccacccgggcugcaagagccgcgggcccgcgagccccggcuuggagcaagaggcgcgcgcgggccgugggggcugggccgaggcggagcgcgaggcggcggcgguggcgggaggcgccgcgggacgaggcagcggcccccgccccccgaagcccguccccgcgcggggcuggggagcucagggcggggaagccgcggggccgcgccacgucccucgcccgccccagagcggguuuuacaggcggcuccagucugggggcuuuugugucugcgacucgggagcggcgagagagcagaccuccuccucagagggcgcugugagugugccgccagggccgggccgcgagccuccugcuuccccugucagcggcuccugaggcggcggcgaagaagaaggagugggaggaggcggcggcggcggcggcgcacucgcccucagcacaugccggccccggguggggggccgcccccaggccgcgcucccggccaccgccgcugagccccgccggugcccgcacgccgccccgccgccccgccgccccgaggccucguccuccucccaaacuuugcaaagucggcccgcguccccaccgcccucggccgugccucggcuccgaggcuugccucgcagccgcagcggccccgcgaggaggaggagccgccgccgcagcaucaaagagaccgaauucccgcggccugggggggagucaugcuuugcggucuguaaugucagcagaacaggagaaggaucccauuucgcugaagagaguucgagguaaccgagaagggugccggauugggggaaccggggugagugaggugcgcggggccccgugcccggccgccgggaggccauggggcucuguccgggccuaaguccgcgcagcccgcgucccgccggcaccccggggccgaggcugcgauccgagcgcgcggcccgggcgcccgcuggcccccgagacauccgcgcggaucccucgccucccgacuuuguguucggaggcaguuggagccgcaagcagcauccuuucuuacccccuccucacccaccucuccucguucucaagacagcacaauaggcaccucaaagggugaaaaacagacacccccuggcagagaccucgaacggugcccacccccucaaaaaaaguaaguuggaguacacaagaguugaugcuguugaagaagggcuccugggcuuucacgucucuccuggcccccuucucgcccccccaccccggcaaaggcaacaaauauucaguuuauuuuccguagguuuaagaggagaagcuacaaauucagaaggcauuuucucuguugguuuauggauaagauauuaucuaaaaucaguguuaugcaugguugauuuucuucuuucuugcgcacugguuaggaauuuuccuuucguguuacuaucaucuaagaaaaaucagagggaaccaugugucaaacaaaagauacugcauauaaguucacaaaagucaaaugccacccggaaauugggggaugccuuuuagcucuuaauaagguuaagacugaaaguucuagaguuggaguaguacucacuguucauuaagcaaauauuuauugaacaucuacuaugugcuagacacuguucuuguuacugggauacagcagugaacaaagcagauagacaaucuucauccaguaggaguucacccucuugugggauaaacaaaugauaaacaguagauacagaaugucaaaucguaggugguaugguggacaacaaaacaggaauagaggagaggaaauauguguggggaugggaaguauggauuguauguaaggugaucaugaaagggcucaccugguagauaauguuugagcaaagaccuaaaggaaaugauagagccagggccauaugaauucacgugggaagagcagucucugaaaagcaacagcaaaugcaaagccccugugucuggaauaugcccagugugugcaaucaacagcaaagaagcuauuguaacugcagcaaagugagcaaggaaagaguccugugacaggggcuaaggaguaggaucaagaauuauuugauucuugaaaagugagcaaaggugauagauaucauuaagaguacauuuuuaaauuauagcauuuuaauaguaaaauuacagucguucaguagucuuaaugcugccggcuauaggaugauuguguauuagagggccuggugugccauuuaaaagacuuuggcuuuuacucugagaaaaggucugcagaguuuugagcauaagagugagugaucugacauuuuaaacagggcaucuuaagcugcugugcggagaauagacuguagagaaaaggcugaagcaggggagacuaguagggaggugauugcaauagucauccaaacaggguaaacaggguaaaaugcuuuauaaaucaguaaguaggaagguaaauuuccggcugacuuaagugauguagagaugaaggaccacagucauucauuuuuguuuuuguucaaugugacuagaaauuaaacauguauagaacuagcuugugacacacaauccaaaagacauccacucaagaguauuuugguaga

SEQ ID NO: 19794 - RNA, 2618 nt, Homo sapiens
ucuaccaaaauacucuugaguggaugucuuuuggauugugugucacaagcuaguucuauacauguuuaauuucuagucacauugaacaaaaacaaaaaugaaugacugugguccuucaucucuacaucacuuaagucagccggaaauuuaccuuccuacuuacugauuuauaaagcauuuuacccuguuuacccuguuuggaugacuauugcaaucaccucccuacuagucuccccugcuucagccuuuucucuacagucuauucuccgcacagcagcuuaagaugcccuguuuaaaaugucagaucacucacucuuaugcucaaaacucugcagaccuuuucucagaguaaaagccaaagucuuuuaaauggcacaccaggcccucuaauacacaaucauccuauagccggcagcauuaagacuacugaacgacuguaauuuuacuauuaaaaugcuauaauuuaaaaauguacucuuaaugauaucuaucaccuuugcucacuuuucaagaaucaaauaauucuugauccuacuccuuagccccugucacaggacucuuuccuugcucacuuugcugcaguuacaauagcuucuuugcuguugauugcacacacugggcauauuccagacacaggggcuuugcauuugcuguugcuuuucagagacugcucuucccacgugaauucauauggcccuggcucuaucauuuccuuuaggucuuugcucaaacauuaucuaccaggugagcccuuucaugaucaccuuacauacaauccauacuucccauccccacacauauuuccucuccucuauuccuguuuuguuguccaccauaccaccuacgauuugacauucuguaucuacuguuuaucauuuguuuaucccacaagagggugaacuccuacuggaugaagauugucuaucugcuuuguucacugcuguaucccaguaacaagaacagugucuagcacauaguagauguucaauaaauauuugcuuaaugaacagugaguacuacuccaacucuagaacuuucagucuuaaccuuauuaagagcuaaaaggcaucccccaauuuccggguggcauuugacuuuugugaacuuauaugcaguaucuuuuguuugacacaugguucccucugauuuuucuuagaugauaguaacacgaaaggaaaauuccuaaccagugcgcaagaaagaagaaaaucaaccaugcauaacacugauuuuagauaauaucuuauccauaaaccaacagagaaaaugccuucugaauuuguagcuucuccucuuaaaccuacggaaaauaaacugaauauuuguugccuuugccggggugggggggcgagaagggggccaggagagacgugaaagcccaggagcccuucuucaacagcaucaacucuuguguacuccaacuuacuuuuuuugagggggugggcaccguucgaggucucugccagggggugucuguuuuucacccuuugaggugccuauugugcugucuugagaacgaggagaggugggugaggaggggguaagaaaggaugcugcuugcggcuccaacugccuccgaacacaaagucgggaggcgagggauccgcgcggaugucucgggggccagcgggcgcccgggccgcgcgcucggaucgcagccucggccccggggugccggcgggacgcgggcugcgcggacuuaggcccggacagagccccauggccucccggcggccgggcacggggccccgcgcaccucacucaccccgguucccccaauccggcacccuucucgguuaccucgaacucucuucagcgaaaugggauccuucuccuguucugcugacauuacagaccgcaaagcaugacucccccccaggccgcgggaauucggucucuuugaugcugcggcggcggcuccuccuccucgcggggccgcugcggcugcgaggcaagccucggagccgaggcacggccgagggcgguggggacgcgggccgacuuugcaaaguuugggaggaggacgaggccucggggcggcggggcggcggggcggcgugcgggcaccggcggggcucagcggcgguggccgggagcgcggccugggggcggccccccacccggggccggcaugugcugagggcgagugcgccgccgccgccgccgccuccucccacuccuucuucuucgccgccgccucaggagccgcugacaggggaagcaggaggcucgcggcccggcccuggcggcacacucacagcgcccucugaggaggaggucugcucucucgccgcucccgagucgcagacacaaaagcccccagacuggagccgccuguaaaacccgcucuggggcgggcgagggacguggcgcggccccgcggcuuccccgcccugagcuccccagccccgcgcggggacgggcuucggggggcgggggccgcugccucgucccgcggcgccucccgccaccgccgccgccucgcgcuccgccucggcccagcccccacggcccgcgcgcgccucuugcuccaagccggggcucgcgggcccgcggcucuugcagcccgggugggcagcgcgcgccuaggggccgccccgccccgcgcccggcgcucc

SEQ ID NO: 19795 - RNA, 2680 nt, Homo sapiens
uuaaggaaaaauaguuuuucuguuuccauucauauacauuaaauaacuacccaggaaauacgccccgguuuugcgcgcgugugcgugcgugugugugugcgugugugugugugccguuucucuaaaauucugacucauagucuggaggacaaugauugacuuuuuuccacuucacauaguugcuaugaauuucuccucacaaggaugggccuguuuacucacccugggcaucguugguagagcgcuaguguaaacagccugaggaacccggugggccggggaagugggcgcgcucuguucuccgcggccagcugggacgccgggccagguggggccgccugcguuuagcaacugcuuucucacccccuggauuugcgauguuugccacagcagcgagaagcgccauuguaauggggaugggagggguggagccuccaaguccugucucaauuuagaucucucacucugcuguuaggcgcgcccauuucagauuacuaaacucgaauuaagagggaaaaaaaaucagggaggagguggcaagccacaccccacggugcccgcgaacuuccccggcagcggacuguagcccaggcagacgccgucgagaugcagggcccaccgcuccugaccgccgcccaccuccucugcgugugcaccgccgcgcuggccguggcucccggguaggaacgugggcgcgcggggggcgcgcgggcgcgcgggccugggccgcucugcggcucugggccagggcuucggggagguggcggcugcugugcagcagcgggugggaaaugcccucgcggcugcaguccccagccugguacuggccuggagguuugaccauauguagcuucagcguggcucuccaugggacaguuaacuuucuccacucaugaaguuguuuaagcgucuccccggccauaacaacuuucugaagagagucauuuuauuuuuaguccacauugccucugccuuuugcuucucaacuuuuugcucccagauugcgauucuucucucaaagacaugauauauuuuuucuaaccaagaugucucaaccuuagcauugccaaaguguggcggaggggacugauguauggguucaggggcagacauuauaggaagaaaacaacagcacccaauaauggcaagccccauucauuccuaaagauuucuguaguugagcccuaaccccuaguuauagcagagaaagugcugcuuuagugacuucuuuuaugauucgcuauaccuggaauuuucaccaguuguaguuuauuuucaaaugguauauuucaaucaaugguauugguuaaauaauuuuuuacccucguugggcagcuacucaaggauaaagguuugaauaagaaacaggcaaaaucuuaguuaaaaaauaacaacaacaacaagaaaauaaucacgcugggauaagguccucuguaaaggagaagcuuagagacuuuugcuuugccaauaacuccauuaugccccggugcaagccauuuacaucaugguuccuucugugcgguucgugguuuauaaaauggaaauaauaacacaggccuuccucuaguagugaugcaugaauuacugcauuaaaauugauuuaugggaauuauuguuguuucaguagcauuucaauucaguugccaaauagagcagugggcaauguuaacggaaacaacugcaauuggcgcaguauggagugccuaucgcacuaggaaaucugagggucacaaaagaaaggagaugugaggauaagaaacuuuguuuuucccuuguugggaacucuuuaggccucgguuucuggugacagccccagggaucaucaggcccggaggaaaugugacuauugggguggagcuucuggaacacugcccuucacaggugacugugaaggcggagcugcucaagacagcaucaaaccucacugucucuguccuggaagcagaaggagucuuugaaaaagguaagauaaacagcauaaagucuuacccuucugcaguaauaacuggaauauguuaauaaggucauguguuagguaguauagcagagaaaccccaaauuugcaguaucuuaccuaauauacuuuuaauucucacu[450 bp omitted]uuuguagcagaaccaaguuugguucuuguuucaaguuuggguucugacauggcccaagauuaaauugggccaaugaaugucuucuuuuucagugcuaagggaaaaauaauuuugggaggaagagguaaauacu

SEQ ID NO: 19796 - RNA, 2680 nt, Homo sapiens
aguauuuaccucuuccucccaaaauuauuuuucccuuagcacugaaaaagaagacauucauuggcccaauuuaaucuugggccaugucagaacccaaacuugaaacaagaaccaaacuugguucugcuacaaa[450 bp omitted]agugagaauuaaaaguauauuagguaagauacugcaaauuugggguuucucugcuauacuaccuaacacaugaccuuauuaacauauuccaguuauuacugcagaaggguaagacuuuaugcuguuuaucuuaccuuuuucaaagacuccuucugcuuccaggacagagacagugagguuugaugcugucuugagcagcuccgccuucacagucaccugugaagggcaguguuccagaagcuccaccccaauagucacauuuccuccgggccugaugaucccuggggcugucaccagaaaccgaggccuaaagaguucccaacaagggaaaaacaaaguuucuuauccucacaucuccuuucuuuugugacccucagauuuccuagugcgauaggcacuccauacugcgccaauugcaguuguuuccguuaacauugcccacugcucuauuuggcaacugaauugaaaugcuacugaaacaacaauaauucccauaaaucaauuuuaaugcaguaauucaugcaucacuacuagaggaaggccuguguuauuauuuccauuuuauaaaccacgaaccgcacagaaggaaccaugauguaaauggcuugcaccggggcauaauggaguuauuggcaaagcaaaagucucuaagcuucuccuuuacagaggaccuuaucccagcgugauuauuuucuuguuguuguuguuauuuuuuaacuaagauuuugccuguuucuuauucaaaccuuuauccuugaguagcugcccaacgaggguaaaaaauuauuuaaccaauaccauugauugaaauauaccauuugaaaauaaacuacaacuggugaaaauuccagguauagcgaaucauaaaagaagucacuaaagcagcacuuucucugcuauaacuagggguuagggcucaacuacagaaaucuuuaggaaugaauggggcuugccauuauugggugcuguuguuuucuuccuauaaugucugccccugaacccauacaucaguccccuccgccacacuuuggcaaugcuaagguugagacaucuugguuagaaaaaauauaucaugucuuugagagaagaaucgcaaucugggagcaaaaaguugagaagcaaaaggcagaggcaauguggacuaaaaauaaaaugacucucuucagaaaguuguuauggccggggagacgcuuaaacaacuucaugaguggagaaaguuaacugucccauggagagccacgcugaagcuacauauggucaaaccuccaggccaguaccaggcuggggacugcagccgcgagggcauuucccacccgcugcugcacagcagccgccaccuccccgaagcccuggcccagagccgcagagcggcccaggcccgcgcgcccgcgcgccccccgcgcgcccacguuccuacccgggagccacggccagcgcggcggugcacacgcagaggaggugggcggcggucaggagcggugggcccugcaucucgacggcgucugccugggcuacaguccgcugccggggaaguucgcgggcaccgugggguguggcuugccaccuccucccugauuuuuuuucccucuuaauucgaguuuaguaaucugaaaugggcgcgccuaacagcagagugagagaucuaaauugagacaggacuuggaggcuccaccccucccauccccauuacaauggcgcuucucgcugcuguggcaaacaucgcaaauccagggggugagaaagcaguugcuaaacgcaggcggccccaccuggcccggcgucccagcuggccgcggagaacagagcgcgcccacuuccccggcccaccggguuccucaggcuguuuacacuagcgcucuaccaacgaugcccagggugaguaaacaggcccauccuugugaggagaaauucauagcaacuaugugaaguggaaaaaagucaaucauuguccuccagacuaugagucagaauuuuagagaaacggcacacacacacacgcacacacacacgcacgcacacgcgcgcaaaaccggggcguauuuccuggguaguuauuuaauguauaugaauggaaacagaaaaacuauuuuuccuuaa

SEQ ID NO: 19797 - RNA, 2600 nt, Homo sapiens
aagcaugagggcagcuuuccucagccuguguguaaauugcauuuuaaaugucugaugagcaggcgugccaaauugccuggagcuccuuuuuaugaagccaagauuaaaauuuuggcacugcccuaaguaucuaaggggucuagcaauuucuuucuuccuaauuaacaacuguuugacauuucuaacccucuucuacaucagugaaaagcaagaggugagacuggcccauuguuccaaucaucuugccuuaacuuugguauaauaauuuccaacucaguuggcagucgugcucgcgagaaguuaaaggcgaacaaucgacccaccgaaaagcugugcgcagauuuuuuuuuaacagcugaacucaacgaaaaccugagugguaacacuuuugcugggucucgaucgccaccugucgcuuucccgacuuagcugcaagaaugaaucaucucgcgccgggauaucggaacgccagccagccaagcaucccgucaauauauguuuuaaaaaagaaaaugcuuucucuccuuuuuagccaaaacauucauuugaaugcuuagcaacacuucauugagcauucucagacauaaauaucugaaagcggccgccccuacguggcagcgaggacucccucacuucacccucaugaauaaaaaugaguccacuggggugggagugggggcuaaguggacucguccccuucugccaacucgcccccucccaauucccugcuggaagaacccaauuccuuaacucccgcguccaguuaaaaagaaaaucacacacacacacacacaccgcgugcgcgucgccuaccuccucucccacccaccacgaccuuggcauuagccaaaggagagcuuagcguuuauuuccuuuccugcccuauccuuccccagcauucacuagaagacuacagaguccggaucgagagucucccuggcccagagucccagggagcccugaacuggucacugaagggcucccgaggucgcccgcuuggggguaccuguuccgcucgcugaacgaguccggcgacccacgcuuucugauccccacaagucuaggaucugagugggaaaccgccgcggagaucucacagaccccgaauagggccuccaccaaugcaccgggagggagucggagaggggacuuucucccggagcugggaaaaguccgccaagaaugaguacccuagugcugccuaacccaccaucucggaugcucugaaagguaggggaggaaggagccagaacacuccacuaggaaucuguuacgagaugccacacacacccgugcagccucgacgagcugcagagcacucagcgggcccuccaaagaauuccgcaccgugcgucaccaaaauaccuucccagcgcccccgccgcacgccugcccuccccgacaaagccacagccgcgagauaaccagggcccugcugccccagaacccggcgcgcccuccauugaaaucgacagcaucuacagaugaaacuccucuagaaacggaaacacugaacgggaugcuuugcgugcacaaaaccuugcucagcucuuaagaaaagcaacauuccccucucccucaaaaaccccaaagaaucaccaaaucccaguauacaaggcaacgcucuagcccaccuacacuauuacaaguccaaacuguccucgcccaggauucuucaccgcuccgggcaaggugcaagcuagacgccguuucccgaguugucucugggaaugauggggguaggggaaaggggacagaaaccaggcugaccugaggcggcggcaacagggagagguagcggcggcgacagcggcuucccggcgucggagaagcuggugcucgguguggcccccacacgccccggcgauaggcgcugcacuccaggagcaccuggcggccgccgaggcgugggcagcugcggggaaguccaggaggaggaggagaaucccaggaggagaggcgggcgcggcaggaagacuggagauggccugagccugcagcugccggcgcgcggacgcgucuggggcgguucgccuuagccaaguggaaagagacuccgcgccgcgggcuacuuaauagagggcuguucccagcucucaguuuacucgguuacgaaacgccugagaagguggacggcugccacggggugauguaugcuccuccggcggugaaggaggucuacuuuugggaacgugugcauacuucgagcauuccuucggcgugagguggcgaucgccguaguagcagugccccgcuggggggcggggagaagggagggagcguagagggggacagccgcagccggguucccugccaagggaagccgcguacuccgccacuuggggcggacugggauuucuuuaaugaagcucggguuucccuaucccugagauuucuuuaaugaauuuuucuacauuaagaacaauggggaggggaccgacucccauuuucggaaaugcaaggaugcguaacccauucacccccgcuccugcggaucuccauccuucaucugauaucaccaccuccaucuuccucccccucuguccugggugcacuuaaaaccgauuuacaggauuuccauuaacuaacugucuguacac

SEQ ID NO: 19798 - RNA, 2600 nt, Homo sapiens
guguacagacaguuaguuaauggaaauccuguaaaucgguuuuaagugcacccaggacagagggggaggaagauggagguggugauaucagaugaaggauggagauccgcaggagcgggggugaauggguuacgcauccuugcauuuccgaaaaugggagucgguccccuccccauuguucuuaauguagaaaaauucauuaaagaaaucucagggauagggaaacccgagcuucauuaaagaaaucccaguccgccccaaguggcggaguacgcggcuucccuuggcagggaacccggcugcggcugucccccucuacgcucccucccuucuccccgccccccagcggggcacugcuacuacggcgaucgccaccucacgccgaaggaaugcucgaaguaugcacacguucccaaaaguagaccuccuucaccgccggaggagcauacaucaccccguggcagccguccaccuucucaggcguuucguaaccgaguaaacugagagcugggaacagcccucuauuaaguagcccgcggcgcggagucucuuuccacuuggcuaaggcgaaccgccccagacgcguccgcgcgccggcagcugcaggcucaggccaucuccagucuuccugccgcgcccgccucuccuccugggauucuccuccuccuccuggacuuccccgcagcugcccacgccucggcggccgccaggugcuccuggagugcagcgccuaucgccggggcgugugggggccacaccgagcaccagcuucuccgacgccgggaagccgcugucgccgccgcuaccucucccuguugccgccgccucaggucagccugguuucuguccccuuuccccuacccccaucauucccagagacaacucgggaaacggcgucuagcuugcaccuugcccggagcggugaagaauccugggcgaggacaguuuggacuuguaauaguguaggugggcuagagcguugccuuguauacugggauuuggugauucuuugggguuuuugagggagaggggaauguugcuuuucuuaagagcugagcaagguuuugugcacgcaaagcaucccguucaguguuuccguuucuagaggaguuucaucuguagaugcugucgauuucaauggagggcgcgccggguucuggggcagcagggcccugguuaucucgcggcuguggcuuugucggggagggcaggcgugcggcgggggcgcugggaagguauuuuggugacgcacggugcggaauucuuuggagggcccgcugagugcucugcagcucgucgaggcugcacggguguguguggcaucucguaacagauuccuaguggaguguucuggcuccuuccuccccuaccuuucagagcauccgagaugguggguuaggcagcacuaggguacucauucuuggcggacuuuucccagcuccgggagaaaguccccucuccgacucccucccggugcauugguggaggcccuauucggggucugugagaucuccgcggcgguuucccacucagauccuagacuuguggggaucagaaagcgugggucgccggacucguucagcgagcggaacagguacccccaagcgggcgaccucgggagcccuucagugaccaguucagggcucccugggacucugggccagggagacucucgauccggacucuguagucuucuagugaaugcuggggaaggauagggcaggaaaggaaauaaacgcuaagcucuccuuuggcuaaugccaaggucguggugggugggagaggagguaggcgacgcgcacgcggugugugugugugugugugauuuucuuuuuaacuggacgcgggaguuaaggaauuggguucuuccagcagggaauugggagggggcgaguuggcagaaggggacgaguccacuuagcccccacucccaccccaguggacucauuuuuauucaugagggugaagugagggaguccucgcugccacguaggggcggccgcuuucagauauuuaugucugagaaugcucaaugaaguguugcuaagcauucaaaugaauguuuuggcuaaaaaggagagaaagcauuuucuuuuuuaaaacauauauugacgggaugcuuggcuggcuggcguuccgauaucccggcgcgagaugauucauucuugcagcuaagucgggaaagcgacagguggcgaucgagacccagcaaaaguguuaccacucagguuuucguugaguucagcuguuaaaaaaaaaucugcgcacagcuuuucggugggucgauuguucgccuuuaacuucucgcgagcacgacugccaacugaguuggaaauuauuauaccaaaguuaaggcaagaugauuggaacaaugggccagucucaccucuugcuuuucacugauguagaagaggguuagaaaugucaaacaguuguuaauuaggaagaaagaaauugcuagaccccuuagauacuuagggcagugccaaaauuuuaaucuuggcuucauaaaaaggagcuccaggcaauuuggcacgccugcucaucagacauuuaaaaugcaauuuacacacaggcugaggaaagcugcccucaugcuu

SEQ ID NO: 19799 - RNA, 2509 nt, Homo sapiens
aaauaaagcagucugcagacuucggcacuagcacacauaaugguuuguuuguuagaguuguggcuugacaaucgcuaaacaggaauuacaaaauuguaaaucugcagaaaacaaacaaucauagguguugauucucaguuuaacacuccucaucucccauucccacccacccacccccauauaguuucaaguauaauaaaaauagagaucucagcaucagaauuuugcuguuaacucuucaagguuucucugcgccauccaagccacacauaggguuugaagcaccaaauccacaaguuucuccaaccaaguuuaaauagacaaaaagugaagacugaaugaugccaaaguaacuguucuuaaauuaagcuguaacacaaaguucuccccccaaaaacacagggcauuaagcgucuaguucaaguacugccaggcuguauguagaucugucucagacaggcuucagacaacaauuacaaguacacugcuucuagugggcauuauccacgauaccaaagcagggcagggauucccuuccauuaucaauuuuuaaaaguugcaacccccuuugggauuggcugccgcagggucagugcugagcccggggcuugaggggaggaagugagccuccuccugggcagggaagcucuacauuuaguuucaacacuucuccuuucagagcucucucucaggacuauucuggcuucucaggauccauugcccuugcccaggagagagagccucgcugggacccagaaaccgcgaaagaagauucgaccuaccuguggaaccagacacaacuugguccccaaaggucgcuuaggcgaccccacugcaaacggcaagucaacuugugcacuuaaaacguaucaguuuauggaaugcuuguuuaaaguccucauuggacaugguauagauuaugggguugaugagggaguugagauagcccagccaugugaagaagucaaagauggcuagguggaaccagcaggcaucuuugcagauaggcaucacuagggagaugaugaagaaggguagccaacacacaauaaaggcucccaaaaugaucccuagggucuugguggcuuugcgcucccuagcggccaugaguuucuucuuuuccagcagggcgucggagacucgcacuuugacuugguucacauacacaggagauccggauucgcugggcacgucgggaacccgcgaguuaauagaggugaccgaggacguggacccgggggagucgguuaucagcugggcucgggucaagcgcuugccgguccuguugggcgucuguuucaaaauccgggagcgggcuucuacguagaugcggccauagagggcgaugaggagcaggguggggaaguagaaagcacccaccguggaguagaccguguagaggauguggucgguguucaccacgcauuccgacaccuccucuucggccuuagccugacgccagaagaagggcggcagcgagauagagauggagaagacccacaccagcgcgaucaugaccgccgcccucuugggaguccuuuuagcugaguacuccacggcguccgugauggcccaguagcgguccagggcgaugacacagaggugcaggauggaggcagugcaacaagugauguccgacgacagccagaagucacagaccaccuggcccaguguccagcggccggugacaguguacauggugcugaugggcaucaccaggauggacacaagcaggucggugaccgccagagaggcgaucagguaguuagccggggugugcaguuuccggguccgguacacuguggcaaucacaaaggcauuggagagcgugguggccaaggugaugagcgccaauagcauaaccagcaguacuuuccaggguagggagauggaguccugguaaauguaguccuuggcgcugcaguuuugggagggagcagaggauaaguuggcuugaggaacccaggucucggagcccgcgggcggcgguggagcgcacugagcacccgguuccuccauggcucuccucgccccagcuccggagcgcagcucuugggcauggagcggacgaaggagagggcggaaggaccguggcgaucgcagguuuguccccaguugauaguuccgugaguuccucaauuauuccuccgcccagguucacagcugaaacuagaggucaugggugcggcagccaaggcaggcgggcgccuccccugcacuuccagagcgccuagcuaagccgccgcgucugugguuguuccucuccacaccgggucuuagaccuggguugcuaagagcuggcccaccgagcccugcuccgcuccagcucccuggaggcgucuagugcaggagggugaaguacugcuugaggagaaggcuuugaccaaaugggaucucuuaccccaguugcuugaggcugagcgucuccuaaccuggacgcuuuuggaucugcagacuuugcccacaggaguuuccuagguguagagaccaaagcuugcaggccagcgag

SEQ ID NO: 19800 - RNA, 2509 nt, Homo sapiens
cucgcuggccugcaagcuuuggucucuacaccuaggaaacuccugugggcaaagucugcagauccaaaagcguccagguuaggagacgcucagccucaagcaacugggguaagagaucccauuuggucaaagccuucuccucaagcaguacuucacccuccugcacuagacgccuccagggagcuggagcggagcagggcucggugggccagcucuuagcaacccaggucuaagacccgguguggagaggaacaaccacagacgcggcggcuuagcuaggcgcucuggaagugcaggggaggcgcccgccugccuuggcugccgcacccaugaccucuaguuucagcugugaaccugggcggaggaauaauugaggaacucacggaacuaucaacuggggacaaaccugcgaucgccacgguccuuccgcccucuccuucguccgcuccaugcccaagagcugcgcuccggagcuggggcgaggagagccauggaggaaccgggugcucagugcgcuccaccgccgcccgcgggcuccgagaccuggguuccucaagccaacuuauccucugcucccucccaaaacugcagcgccaaggacuacauuuaccaggacuccaucucccuacccuggaaaguacugcugguuaugcuauuggcgcucaucaccuuggccaccacgcucuccaaugccuuugugauugccacaguguaccggacccggaaacugcacaccccggcuaacuaccugaucgccucucuggcggucaccgaccugcuuguguccauccuggugaugcccaucagcaccauguacacugucaccggccgcuggacacugggccagguggucugugacuucuggcugucgucggacaucacuuguugcacugccuccauccugcaccucugugucaucgcccuggaccgcuacugggccaucacggacgccguggaguacucagcuaaaaggacucccaagagggcggcggucaugaucgcgcuggugugggucuucuccaucucuaucucgcugccgcccuucuucuggcgucaggcuaaggccgaagaggaggugucggaaugcguggugaacaccgaccacauccucuacacggucuacuccacggugggugcuuucuacuuccccacccugcuccucaucgcccucuauggccgcaucuacguagaagcccgcucccggauuuugaaacagacgcccaacaggaccggcaagcgcuugacccgagcccagcugauaaccgacucccccggguccacguccucggucaccucuauuaacucgcggguucccgacgugcccagcgaauccggaucuccuguguaugugaaccaagucaaagugcgagucuccgacgcccugcuggaaaagaagaaacucauggccgcuagggagcgcaaagccaccaagacccuagggaucauuuugggagccuuuauuguguguuggcuacccuucuucaucaucucccuagugaugccuaucugcaaagaugccugcugguuccaccuagccaucuuugacuucuucacauggcugggcuaucucaacucccucaucaaccccauaaucuauaccauguccaaugaggacuuuaaacaagcauuccauaaacugauacguuuuaagugcacaaguugacuugccguuugcaguggggucgccuaagcgaccuuuggggaccaaguugugucugguuccacagguaggucgaaucuucuuucgcgguuucugggucccagcgaggcucucucuccugggcaagggcaauggauccugagaagccagaauaguccugagagagagcucugaaaggagaaguguugaaacuaaauguagagcuucccugcccaggaggaggcucacuuccuccccucaagccccgggcucagcacugacccugcggcagccaaucccaaaggggguugcaacuuuuaaaaauugauaauggaagggaaucccugcccugcuuugguaucguggauaaugcccacuagaagcaguguacuuguaauuguugucugaagccugucugagacagaucuacauacagccuggcaguacuugaacuagacgcuuaaugcccuguguuuuuggggggagaacuuuguguuacagcuuaauuuaagaacaguuacuuuggcaucauucagucuucacuuuuugucuauuuaaacuugguuggagaaacuuguggauuuggugcuucaaacccuauguguggcuuggauggcgcagagaaaccuugaagaguuaacagcaaaauucugaugcugagaucucuauuuuuauuauacuugaaacuauaugggggugggugggugggaaugggagaugaggaguguuaaacugagaaucaacaccuaugauuguuuguuuucugcagauuuacaauuuuguaauuccuguuuagcgauugucaagccacaacucuaacaaacaaaccauuaugugugcuagugccgaagucugcagacugcuuuauuu

SEQ ID NO: 19801 - RNA, 2593 nt, Homo sapiens
agagcaacgauagggcuuucagaacccaaaaccugucugguauaauaacagauccuuccgguaaccaaccauucaauuugucccucuccccaaccccauccucuccaucaccaucugccagaugcccccugggacaaucgacuuugaaaccaaacuucucucccaggucagcuccugcaauccccacuccucauccuuggagcuuucuccacagaagugacuugacacaccgcgcuacaucuggggaggggggcggguccgcuuuccgggagacucaagucuuugcuauuugccuuuuguuucugggaugccuuuggcugccuuucucuuccaucugcuuuuaauuuugguaagagaaaagcuaaugaaucaggaaugaaucuccucuccacuaaucuuuuuuuuuucuuucucucucucucucucuuaaaguuggcgcgcucucuucacaaguuccaucacuacccaagaagugagggggcgggggggacaggcgggaaggcauuaauuacaccuaaaucugaaguuugcggccucaaguaccacuuugauggggagagcuucugaagcuuccauacaaccugccgugccuuugcugcugccgcaguagauuuucagcucauuucuuucugcugcugcuucgcgcugcucugucaugccuaaaucuaucucgucacugccaaaggugccugaaucagggugaauuccacgagauucaccagcgguuuugcuccaguccaagguaaauacaguaugcaaaaugaggaaccacccaaggaugucggggaggggggagagaaagggauucccucaccuuuuccggcacauuccucguuaauuuccaccaggaggaggcgcgcagcccagcuccccuagucucucuucuuaaaucccccuaccuacggcugccgagguuggccgcgcgucgggaaucuccccgacaguccuggcccucccccgccccccggguugguuuuucccagcugcggagguugggagguugggccaggggcuggggugcgaagagagucggcgcccgcaacgcggagccgggaagucgucgcuacucugguggaacucagaguugguucuggaggcggcggacgcggaggugagcagugggagcccgcggccugggagagacccgggaggcgucguuggggccccuccccauccucggguggagaguaggguugguucggguugccacuguaccccgagucccacugcugcuuuguucccagacucuccccuccucuuuggagaugacuugaaccccuuugagauccgaggggcuggcggggcgcgggcuggggggcgacaguuguagcuccacuuccugcuaaugcgagaagguacaaaaagagaucaaaaaguccuguaaccugaaacuucccucgcauccuaaccgggaccugguggagaggucugggcgggggcggagacacccggaggccgaccuuccgccgaggcggugcaggaaggaacgggagagggagaaguuugguagggaaggaauuggggauuaagcgguaaguuagacgcgggagacgagucuccucgggaaaggcggagggcgggaggccggucggguuuauuuagugugggccagggaagaaggaagacuuugcggucugggugucggaugcgcgucccccuccggaguaaaagugaccggagggguuggggaggcgaggccggggcgggcuuuuggaaggaggucucugggacagacuggagacgacuagacucgaaaaggccgguuuuugcacuccggaagccgcggcagccaccgcuguucacgccucucuccugcuugucccaggucccucagaggauccagcgaggggcgccaacaagaggcgaagagguggcaccagggcggcggcaggaagaggagcgggagcaggagcgcggagcggagcgucccgacccgccgugcguacuuucuggagggaaggggcgggggaaucggccccugagggaagcgcccgguggcgaggggguuagccaaguuccggcugcggcgccacucccucgguuccacgagaggaaaguuuuuuuuuuccagacgcuuccgccggcucgcgcccuccgggcccagccucccgagccuucggagcgggcgccgucccagcccagcuccggggaaacgcgagccgcgaugccuggggggugcucccggggccccgccgccggggacgggcgucugcggcuggcgcgacuagcgcugguacuccugggcugggucuccucgucuucucccaccuccucggcauccuccuucuccuccucggcgccguuccuggcuuccgccguguccgcccagcccccgcugccggaccagugccccgcgcugugcgagugcuccgaggcagcgcgcacagucaagugcguuaaccgcaaucugaccgaggugcccacggaccugcccgccuacgugcgcaaccucuuccuuaccggcaaccagcuggccgugcucccugccggcgccuucgcccgccggccgccgcuggcggagcuggccgcgcucaaccucagcggcagccgccuggacgaggugcgcgcgggcgccuucgagcaucugcccagc

SEQ ID NO: 19802 - RNA, 2593 nt, Homo sapiens
gcugggcagaugcucgaaggcgcccgcgcgcaccucguccaggcggcugccgcugagguugagcgcggccagcuccgccagcggcggccggcgggcgaaggcgccggcagggagcacggccagcugguugccgguaaggaagagguugcgcacguaggcgggcagguccgugggcaccucggucagauugcgguuaacgcacuugacugugcgcgcugccucggagcacucgcacagcgcggggcacugguccggcagcgggggcugggcggacacggcggaagccaggaacggcgccgaggaggagaaggaggaugccgaggaggugggagaagacgaggagacccagcccaggaguaccagcgcuagucgcgccagccgcagacgcccguccccggcggcggggccccgggagcaccccccaggcaucgcggcucgcguuuccccggagcugggcugggacggcgcccgcuccgaaggcucgggaggcugggcccggagggcgcgagccggcggaagcgucuggaaaaaaaaaacuuuccucucguggaaccgagggaguggcgccgcagccggaacuuggcuaacccccucgccaccgggcgcuucccucaggggccgauucccccgccccuucccuccagaaaguacgcacggcgggucgggacgcuccgcuccgcgcuccugcucccgcuccucuuccugccgccgcccuggugccaccucuucgccucuuguuggcgccccucgcuggauccucugagggaccugggacaagcaggagagaggcgugaacagcgguggcugccgcggcuuccggagugcaaaaaccggccuuuucgagucuagucgucuccagucugucccagagaccuccuuccaaaagcccgccccggccucgccuccccaaccccuccggucacuuuuacuccggagggggacgcgcauccgacacccagaccgcaaagucuuccuucuucccuggcccacacuaaauaaacccgaccggccucccgcccuccgccuuucccgaggagacucgucucccgcgucuaacuuaccgcuuaauccccaauuccuucccuaccaaacuucucccucucccguuccuuccugcaccgccucggcggaaggucggccuccgggugucuccgcccccgcccagaccucuccaccaggucccgguuaggaugcgagggaaguuucagguuacaggacuuuuugaucucuuuuuguaccuucucgcauuagcaggaaguggagcuacaacugucgccccccagcccgcgccccgccagccccucggaucucaaagggguucaagucaucuccaaagaggaggggagagucugggaacaaagcagcagugggacucgggguacaguggcaacccgaaccaacccuacucuccacccgaggauggggaggggccccaacgacgccucccgggucucucccaggccgcgggcucccacugcucaccuccgcguccgccgccuccagaaccaacucugaguuccaccagaguagcgacgacuucccggcuccgcguugcgggcgccgacucucuucgcaccccagccccuggcccaaccucccaaccuccgcagcugggaaaaaccaacccggggggcgggggagggccaggacugucggggagauucccgacgcgcggccaaccucggcagccguagguagggggauuuaagaagagagacuaggggagcugggcugcgcgccuccuccugguggaaauuaacgaggaaugugccggaaaaggugagggaaucccuuucucuccccccuccccgacauccuugggugguuccucauuuugcauacuguauuuaccuuggacuggagcaaaaccgcuggugaaucucguggaauucacccugauucaggcaccuuuggcagugacgagauagauuuaggcaugacagagcagcgcgaagcagcagcagaaagaaaugagcugaaaaucuacugcggcagcagcaaaggcacggcagguuguauggaagcuucagaagcucuccccaucaaagugguacuugaggccgcaaacuucagauuuagguguaauuaaugccuucccgccugucccccccgcccccucacuucuuggguagugauggaacuugugaagagagcgcgccaacuuuaagagagagagagagagaaagaaaaaaaaaagauuaguggagaggagauucauuccugauucauuagcuuuucucuuaccaaaauuaaaagcagauggaagagaaaggcagccaaaggcaucccagaaacaaaaggcaaauagcaaagacuugagucucccggaaagcggacccgccccccuccccagauguagcgcggugugucaagucacuucuguggagaaagcuccaaggaugaggaguggggauugcaggagcugaccugggagagaaguuugguuucaaagucgauugucccagggggcaucuggcagauggugauggagaggaugggguuggggagagggacaaauugaaugguugguuaccggaaggaucuguuauuauaccagacagguuuuggguucugaaagcccuaucguugcucu

SEQ ID NO: 19803 - RNA, 2517 nt, Homo sapiens
agggucuugcugaggucuuugaccuccucagggcuguugacccgcucauagcccaggacggccaugggcugguagcaaaacuccuccaccuguuugaucugcuggaaggugagggcgguccgccaggcauuggcggccugcguggcauugcgugcagauaccacgaaaggcuuggaggaggagcccgagccacuggucauguucagggcaaacugcuccauuucggggcucaccaacagucccacaaaaucguacacucuccguagugucuugacggggucucccaccagguccucguaccgcaccaccagguaguggcccugcagccagucagggggcugcagggcugucugcagcgucuuagccauacuauugcagaugaccuccauagcgcccagagcgugguagucugcggggccgcccacgcccuccuucuuggcgccaagcuuguggcccgcggccuccaagaagggcaugcggugagcucgcgggucucggcugcgcaccaccuguaggcucucacggaugaggccguggcgcgagcggauccgugaacucgccaccgcgcggggaucacgcaccaaguggaugaccuugagguccagggccgggucucgcagcaguggcgccaagaccgccacgucgaagacgcgcacacccuuuaugacuagugugcgguacuugcggcacuccuccucgaaacgcgccaggcgcuguggcgggcacuucuugcacacgcggucguccaccaaccccacgaccuccuugcgguaggcggggcagaguggugacgagcacaccaccuuguugguggcugcgccgaagaugcccagcguggugagguugcgccccccgcugcccgcggggcuauacaacuggaagacagagaggucgcagcgguaaagagcgcucagcaugucccgcgcugcccccugcagggaaacggcgucccccggauacaguuuuugccauacaugccacacuggcucguagagaaagaacaccucgggauucugguugaauagcucgccgaagaacgacgagccagagcgccacguggugaacacguacaccagcugccgcuuguccccgacgcccccggugccccgagugccauugccuggaggggccgcaacccccgccaucccugccgcggcugcaggagccgccccgacggcggcagcgggagggcgguaaggagugcggagguccaaacgggcaugagcacggggcggcccggccggaggcggcccugggcgcccccagcugccuccggcugcccccgcugcggcacccagcggcccaucgggguugcacugcugcagcggcuccuugugccacuuguaguccaggagguugagcauagugagcaccagcagcagugcauagcccgcgcacaacaccagcgccuuccuacggaacaccuucauuccgagaggggacgcgggccagcggcguccugggcgccggggccacugcgggagcagggcacgcggcgcggcugcaggcgcagccuggagcagccgagggagcgcgcccgggggcagagcucgcugcgggcugcggcucaucacaggcacaauccgggccggcggcgcggcggaggcagcccugcagcccgggaaggggacgcagcgggcuggcugcuggcgccgggacucgggccgcgacuccgaggcgggcgcggcggcugguccccagcgcccaaggcuggcucucccauggcagcggcuccggguaggaccugcgaggggaagcggagugagcggaugcgccccaaucucccucccagccuccuccuccuaaguaacgcccacccucgguucugcccgguuccuccgcucaccuggagccgagggcgcgcccgggagcggccccggaucaccgcccggcggacuguccggcugucacucguuccucgauuucgcucccucucgcuuccgcuggggguccccgcaccuucgaggggucuggggagucggccgacuuaucccugggcaguuuccgggcagcgggcgcccugcggcucgggaagaaaaacuuucacgcggcccagagccccgcuccgcgcuccgccgaacccggcgccucccggcuccagcgacgucuccuccgcuuucucgggaccgcagcuuccugucucgcucaggggaacgaagccggcugggggcgauggcugggggcggcuuauaugggacucagcucccggcauagcggcgcagccccucucgcuuucggccuccgugcggcgaauuuucccaccucucuggcagcgguggauggggcacagcgcgaccccgcagcggcggcggcggcugcuuccaucaccgggaggaugcccgggcggacagcgcaggcaacccccgccgcuccgcagccuccgacuggaccaaaggaccccgaacacacagcucuaggcaaggaaacccaggugugcagcacugcccgacccgacccaacccgcccccgguaccagcgcuucuggccaacgagguauuuaagcaaagaaagaccccg

SEQ ID NO: 19804 - RNA, 2517 nt, Homo sapiens
cggggucuuucuuugcuuaaauaccucguuggccagaagcgcugguaccgggggcggguugggucgggucgggcagugcugcacaccuggguuuccuugccuagagcuguguguucgggguccuuugguccagucggaggcugcggagcggcggggguugccugcgcuguccgcccgggcauccucccggugauggaagcagccgccgccgccgcugcggggucgcgcugugccccauccaccgcugccagagaggugggaaaauucgccgcacggaggccgaaagcgagaggggcugcgccgcuaugccgggagcugagucccauauaagccgcccccagccaucgcccccagccggcuucguuccccugagcgagacaggaagcugcggucccgagaaagcggaggagacgucgcuggagccgggaggcgccggguucggcggagcgcggagcggggcucugggccgcgugaaaguuuuucuucccgagccgcagggcgcccgcugcccggaaacugcccagggauaagucggccgacuccccagaccccucgaaggugcggggacccccagcggaagcgagagggagcgaaaucgaggaacgagugacagccggacaguccgccgggcggugauccggggccgcucccgggcgcgcccucggcuccaggugagcggaggaaccgggcagaaccgagggugggcguuacuuaggaggaggaggcugggagggagauuggggcgcauccgcucacuccgcuuccccucgcagguccuacccggagccgcugccaugggagagccagccuugggcgcuggggaccagccgccgcgcccgccucggagucgcggcccgagucccggcgccagcagccagcccgcugcguccccuucccgggcugcagggcugccuccgccgcgccgccggcccggauugugccugugaugagccgcagcccgcagcgagcucugcccccgggcgcgcucccucggcugcuccaggcugcgccugcagccgcgccgcgugcccugcucccgcaguggccccggcgcccaggacgccgcuggcccgcguccccucucggaaugaagguguuccguaggaaggcgcugguguugugcgcgggcuaugcacugcugcuggugcucacuaugcucaaccuccuggacuacaaguggcacaaggagccgcugcagcagugcaaccccgaugggccgcugggugccgcagcgggggcagccggaggcagcugggggcgcccagggccgccuccggccgggccgccccgugcucaugcccguuuggaccuccgcacuccuuaccgcccucccgcugccgccgucggggcggcuccugcagccgcggcagggauggcggggguugcggccccuccaggcaauggcacucggggcaccgggggcgucggggacaagcggcagcugguguacguguucaccacguggcgcucuggcucgucguucuucggcgagcuauucaaccagaaucccgagguguucuuucucuacgagccaguguggcauguauggcaaaaacuguauccgggggacgccguuucccugcagggggcagcgcgggacaugcugagcgcucuuuaccgcugcgaccucucugucuuccaguuguauagccccgcgggcagcggggggcgcaaccucaccacgcugggcaucuucggcgcagccaccaacaagguggugugcucgucaccacucugccccgccuaccgcaaggaggucgugggguugguggacgaccgcgugugcaagaagugcccgccacagcgccuggcgcguuucgaggaggagugccgcaaguaccgcacacuagucauaaagggugugcgcgucuucgacguggcggucuuggcgccacugcugcgagacccggcccuggaccucaaggucauccacuuggugcgugauccccgcgcgguggcgaguucacggauccgcucgcgccacggccucauccgugagagccuacagguggugcgcagccgagacccgcgagcucaccgcaugcccuucuuggaggccgcgggccacaagcuuggcgccaagaaggagggcgugggcggccccgcagacuaccacgcucugggcgcuauggaggucaucugcaauaguauggcuaagacgcugcagacagcccugcagcccccugacuggcugcagggccacuaccugguggugcgguacgaggaccuggugggagaccccgucaagacacuacggagaguguacgauuuugugggacuguuggugagccccgaaauggagcaguuugcccugaacaugaccaguggcucgggcuccuccuccaagccuuucgugguaucugcacgcaaugccacgcaggccgccaaugccuggcggaccgcccucaccuuccagcagaucaaacagguggaggaguuuugcuaccagcccauggccguccugggcuaugagcgggucaacagcccugaggaggucaaagaccucagcaagacccu

SEQ ID NO: 19805 - RNA, 2564 nt, Homo sapiens
cgcggcuccccaguguccuccagaacgcccgcguggcugucggguuucgaaccccagggccgacucuaguacucggcgcgcgcgccgccgcgucgccgaccagccugcggcccccgcaucaaucauuaacggggcggcccgggcugcggcggcccgaggagggggaugguacggaacucgagacaggggacaacucuaucccccgaagcggccgcgaaacccuagccugggaggcccccgcccuuccucggugcgcccgucccucccuccgcgccucggcucgcacauccccaccucccgcuccgggggcggcggcggcggaggcacccgcaccgcgcgaugcccagucaccgcugccgcgcugccgccgcagucagccgcgccgccgccgcugccgcagcgcgggcggccgcgcgccgguagcaggggcuuggcgaggaagccgcugagccucgcgcgcuccgcgcuccuggcggucgcagcgcugccuauuaauugauucucuuauugauuuauuuaauuuuuaggagcggcugcucggaggcacgggucuucuccuaaaccugcagcgacgcccccggcgugggcacaaaggcuccgacggcggccggcgggggcugcccagcgcccgggagccggcgccagaggucgccugcgcgcgcccuagccgagccccgggcaccaugccgcggcgccugcagccccggggcgcgggcacaaaaggcccuccggccccggccccggcagcuucgggggccgcccggaacucccacucugccgccucccgggaccccccagcgucugccaagccgcugcugcgcugggacgaggugcccgacgacuucguggagugcuucauccugucgggcuaccggcgucugccgugcacggcccaggagugccuagccucggugcugaagccuaccaacgagacgcucaacuucuggacgcacuucaucccgcugcugcuguuccugagcaaguucugccgucuguucuuccugagcggcggcgacgugcccuuccaccacccguggcugcuaccguuguggugcuacgcgucgggagugcugcugaccuucgccaugagcugcacggcgcacguguucagcugccugucgcugcgucugcgcgccgccuucuucuaccuggacuacgcguccaucagcuacuacggcuucggcagcacgguggccuacuacuacuaccuguugccaggccucagcuugcuggaugccagagucaugacuccauacuugcagcagcgccugggcuggcacguggacugcacgcgccuuaucgccgccuaccgcgcccuggugcugccuguggccuucgugcuggcgguggcuugcacuguggccugcugcaagagccguaccgacugguguaccuacccguucgcgcugcgcaccuucgucuucgucaugccgcucagcauggccugccccauuaugcucgagagcuggcucuucgaccugcguggggagaaccccacacucuucgugcacuucuaccgccgcuacuucuggcuggugguggccgccuucuucaacgugagcaagauccccgagcgcauccagccgggucuuuucgacauuaucggccacagccaccagcucuuccacaucuucaccuuccucagcaucuacgaccagguguacuacguagaagagggccugcgccaguuccuccaggcgccgccugccgcacccacuuucucggguacugugggcuacaugcugcugcugguggucugccuggggcugguaaucaggaaguuccuaaacagcuccgaauucugcaguaaaaagugagccuccgccuuggaggagacuacugguucgcccaucuguuuggaguuucuguuguugcuauuguugguuuguuuucaaauuucauuguguuuucuucuuugcucaaggaaggugcugcaaaaccauagggaaaaaguucacugcuacaaagggaucccaacccacuggaggcuuugaaguagggagguuggcagggguggucaagcgggagggagauagucacuuguucuugccccuggaaaaaauucaggugaugucuuugacauccagggauuucucaaaggcagugaguaaaaucccaaauaaagccccaaagaguuugcuuuuccaaucaucugugccauugguaauaaggaguagccccugugaggucagguacacaguaaagaggguaaauagaauccuugggaacuucuguuucagucugaggaaugcuuggauuugucaaaagaauggagcuuuguaggaaacaggcacaaagacgcaaacccagggcuuaaccugcuagaaaaugcauggaaugugaacacaaguuaauuauuucaaaauguuuuucagauguuauuuaaauaguaauauauacauugauuuuucauaauuuaucaaagccugugguacgcacugaauuuucuuugucacauaguuuugaauuucacagccuucugcauugcauacacuugaacuggacaucaggggaagcugcuugagaguucucaauuacuuucuuaaacaguguuuucugaaggc

SEQ ID NO: 19806 - RNA, 2564 nt, Homo sapiens
gccuucagaaaacacuguuuaagaaaguaauugagaacucucaagcagcuuccccugauguccaguucaaguguaugcaaugcagaaggcugugaaauucaaaacuaugugacaaagaaaauucagugcguaccacaggcuuugauaaauuaugaaaaaucaauguauauauuacuauuuaaauaacaucugaaaaacauuuugaaauaauuaacuuguguucacauuccaugcauuuucuagcagguuaagcccuggguuugcgucuuugugccuguuuccuacaaagcuccauucuuuugacaaauccaagcauuccucagacugaaacagaaguucccaaggauucuauuuacccucuuuacuguguaccugaccucacaggggcuacuccuuauuaccaauggcacagaugauuggaaaagcaaacucuuuggggcuuuauuugggauuuuacucacugccuuugagaaaucccuggaugucaaagacaucaccugaauuuuuuccaggggcaagaacaagugacuaucucccucccgcuugaccaccccugccaaccucccuacuucaaagccuccaguggguugggaucccuuuguagcagugaacuuuuucccuaugguuuugcagcaccuuccuugagcaaagaagaaaacacaaugaaauuugaaaacaaaccaacaauagcaacaacagaaacuccaaacagaugggcgaaccaguagucuccuccaaggcggaggcucacuuuuuacugcagaauucggagcuguuuaggaacuuccugauuaccagccccaggcagaccaccagcagcagcauguagcccacaguacccgagaaagugggugcggcaggcggcgccuggaggaacuggcgcaggcccucuucuacguaguacaccuggucguagaugcugaggaaggugaagauguggaagagcugguggcuguggccgauaaugucgaaaagacccggcuggaugcgcucggggaucuugcucacguugaagaaggcggccaccaccagccagaaguagcggcgguagaagugcacgaagagugugggguucuccccacgcaggucgaagagccagcucucgagcauaauggggcaggccaugcugagcggcaugacgaagacgaaggugcgcagcgcgaacggguagguacaccagucgguacggcucuugcagcaggccacagugcaagccaccgccagcacgaaggccacaggcagcaccagggcgcgguaggcggcgauaaggcgcgugcaguccacgugccagcccaggcgcugcugcaaguauggagucaugacucuggcauccagcaagcugaggccuggcaacagguaguaguaguaggccaccgugcugccgaagccguaguagcugauggacgcguaguccagguagaagaaggcggcgcgcagacgcagcgacaggcagcugaacacgugcgccgugcagcucauggcgaaggucagcagcacucccgacgcguagcaccacaacgguagcagccacgggugguggaagggcacgucgccgccgcucaggaagaacagacggcagaacuugcucaggaacagcagcagcgggaugaagugcguccagaaguugagcgucucguugguaggcuucagcaccgaggcuaggcacuccugggccgugcacggcagacgccgguagcccgacaggaugaagcacuccacgaagucgucgggcaccucgucccagcgcagcagcggcuuggcagacgcuggggggucccgggaggcggcagagugggaguuccgggcggcccccgaagcugccggggccggggccggagggccuuuugugcccgcgccccggggcugcaggcgccgcggcauggugcccggggcucggcuagggcgcgcgcaggcgaccucuggcgccggcucccgggcgcugggcagcccccgccggccgccgucggagccuuugugcccacgccgggggcgucgcugcagguuuaggagaagacccgugccuccgagcagccgcuccuaaaaauuaaauaaaucaauaagagaaucaauuaauaggcagcgcugcgaccgccaggagcgcggagcgcgcgaggcucagcggcuuccucgccaagccccugcuaccggcgcgcggccgcccgcgcugcggcagcggcggcggcgcggcugacugcggcggcagcgcggcagcggugacugggcaucgcgcggugcgggugccuccgccgccgccgcccccggagcgggagguggggaugugcgagccgaggcgcggagggagggacgggcgcaccgaggaagggcgggggccucccaggcuaggguuucgcggccgcuucgggggauagaguuguccccugucucgaguuccguaccaucccccuccucgggccgccgcagcccgggccgccccguuaaugauugaugcgggggccgcaggcuggucggcgacgcggcggcgcgcgcgccgaguacuagagucggcccugggguucgaaacccgacagccacgcgggcguucuggaggacacuggggagccgcg

SEQ ID NO: 19807 - RNA, 2687 nt, Homo sapiens
uccacuuugagucacaggcuuaauccagggccuggaccaacugacccguguuuuuacgccugucuccuguaaucccccuaacuaaucugugaucuguuaucaaaauaugaggaaucagaaauggacuuggcugcugucuugauacagcucuaacauggccuuccccauauuauagaacacacaugaaaucucuuuacaaaacuauacauacugcacuuccuucccccacucccucccacaaacaggggcuaagaauauacuuugugcuuagugcugggugggauguuuaagucauaggcuuuaaccuccaagagcuuacacaaccugccaacuuccuggucgggaaguugggaggugcuaaaauacucaggauacuauauacaauggggauacuaacagcacaaacaacaguaguaagugcuauaggguucagaagagggagagcuacuucaugcuaaggcaaucaaggaaggcuuccaaaaagaggucacaccugagcuacaccuugcagcaugagcaggacuucaauacggaaagagggaggcaaacaggcauuuugggcaaagggcccaggugacugagggaaggaaggagggcguuuucaggaccagcaaauuguuagguggggcuucagugaaagggcacuuuuugaaaggaauuuaugagguacuaggaagcuuaguaagagaaacaacuaauuuucugcuuaagccagacuucaugguauaaguagaagagaaaaaggaaguuuaauaauggagguaaagaagaguaucugcagggagugguaaaaagaccccagaaaaugagaaaaccuggaucccaggccuagcuuugccaaugaggggcuuggguggccacagcaagucaucuaaccucgcuggucucaguuuucucauuuguaaacugaagcagcugaacuggcugaccucaaaggucucuacagccaaaacuagaccagcuguauauuauuucugccauuaaaacauuuaucaugggaggaaugaaggggggcaggauaccuguauucccuuuccauauagguuucucuuccugaacuuaaaauuuccucuuccuaaacuuacuaccucucucucuauauauauauaugccuccacauuacacauuaacacuuuacuauagaauuucauuacauaauucaacuuaaaggaaagcugauuacaaagguggugggggguguaaaaguacuugcuucaaguucagugugugcccccuguccugaaauuuugcuucuggcucacagguucuucaagaaauuuaugcagcacagcugaagccucauacaaguguauccaacaccguggcuggagggaaagauaucacgguauaagccauaaaaugugacauaguaaguaaguaaaggaggaaaagugagaauucuguuacucaucuaaacgaccgcuuccuuuuaauaguaccaaaugaagaccgaaauacaguaauaauugaaaaguuagggagaaaucuuaaauuuuuuuaagucuccacuugaaaaugcagcugaaacacggaaaguuuuuuggcagugaaauucgcugaaaacugacauuuuuaugccgcauccagaggucccuaugcuccaggaaagguaccaaaaacagcacggaugggauuucacuacagcccuauugauccuaugcaccaaaaggccaaaggcaaauaaaccagucccagaauuaaaacaaaacaggcugguucagaaagccucaccggcagccacccaaaguugaaagaagaaaacuuaaugaaauaccuuauuucauugcauagaaucacaauucaguuaacaggcuuauuguuuaagcaguguaaauacgcgauuuaacaccugcgggcacugccugccgggacugggcagaagcgugcccagaggacggcgggcgccacacugcacagccaggagacgagacgcgagcgaggggacccggagauacugcccccgagccgccgcgcgcccccaaaggaguaacgcuucgcuuuccaucugucuguccagccuuccuuuugggcccuauccccacccccgcguaccugccgccaccgcuguccugccuucgagagggcagcucccacuggagauccaaguaccugcagguccacucugcggcuaccucuccgcgcccgcguagccgcugcgcucgcgccacugcgcaugcucggccggcacccgggcccgcaaacucugaauccacuugccgcguuuugccugcggcucccaggggagggaaagggaagcccagaaccuggguuuaggcuaagggugaaagaggaguugcaggcgcugggagcguggauggggagagguggacgggcgcugcggcaacguuaucucuaccgcccacaguuacccaagucuaaagaugaccaccuacacccugggaaugaguuuagcacagcaguucucaaacuugagcguggaucagaaucaccuggagagcuuuuuaaaucacagaucccaaacccggaaacugaguuuccgauucaguuaggucuggagcguagcgcgacaguucccauuucuaacauguucucagcgaaaacuggugcuacuagucuggguaccacacuuugggaccugcuggucaaaaggaaagguauacguuauuaaaggaagacuuguuucucuccccuacucuuuuuuuuuccguuuguuucacggauugcuu

SEQ ID NO: 19808 - RNA, 2687 nt, Homo sapiens
aagcaauccgugaaacaaacggaaaaaaaaagaguaggggagagaaacaagucuuccuuuaauaacguauaccuuuccuuuugaccagcaggucccaaagugugguacccagacuaguagcaccaguuuucgcugagaacauguuagaaaugggaacugucgcgcuacgcuccagaccuaacugaaucggaaacucaguuuccggguuugggaucugugauuuaaaaagcucuccaggugauucugauccacgcucaaguuugagaacugcugugcuaaacucauucccaggguguagguggucaucuuuagacuuggguaacugugggcgguagagauaacguugccgcagcgcccguccaccucuccccauccacgcucccagcgccugcaacuccucuuucacccuuagccuaaacccagguucugggcuucccuuucccuccccugggagccgcaggcaaaacgcggcaaguggauucagaguuugcgggcccgggugccggccgagcaugcgcaguggcgcgagcgcagcggcuacgcgggcgcggagagguagccgcagaguggaccugcagguacuuggaucuccagugggagcugcccucucgaaggcaggacagcgguggcggcagguacgcggggguggggauagggcccaaaaggaaggcuggacagacagauggaaagcgaagcguuacuccuuugggggcgcgcggcggcucgggggcaguaucuccggguccccucgcucgcgucucgucuccuggcugugcaguguggcgcccgccguccucugggcacgcuucugcccagucccggcaggcagugcccgcagguguuaaaucgcguauuuacacugcuuaaacaauaagccuguuaacugaauugugauucuaugcaaugaaauaagguauuucauuaaguuuucuucuuucaacuuuggguggcugccggugaggcuuucugaaccagccuguuuuguuuuaauucugggacugguuuauuugccuuuggccuuuuggugcauaggaucaauagggcuguagugaaaucccauccgugcuguuuuugguaccuuuccuggagcauagggaccucuggaugcggcauaaaaaugucaguuuucagcgaauuucacugccaaaaaacuuuccguguuucagcugcauuuucaaguggagacuuaaaaaaauuuaagauuucucccuaacuuuucaauuauuacuguauuucggucuucauuugguacuauuaaaaggaagcggucguuuagaugaguaacagaauucucacuuuuccuccuuuacuuacuuacuaugucacauuuuauggcuuauaccgugauaucuuucccuccagccacgguguuggauacacuuguaugaggcuucagcugugcugcauaaauuucuugaagaaccugugagccagaagcaaaauuucaggacagggggcacacacugaacuugaagcaaguacuuuuacaccccccaccaccuuuguaaucagcuuuccuuuaaguugaauuauguaaugaaauucuauaguaaaguguuaauguguaauguggaggcauauauauauauagagagagagguaguaaguuuaggaagaggaaauuuuaaguucaggaagagaaaccuauauggaaagggaauacagguauccugccccccuucauuccucccaugauaaauguuuuaauggcagaaauaauauacagcuggucuaguuuuggcuguagagaccuuugaggucagccaguucagcugcuucaguuuacaaaugagaaaacugagaccagcgagguuagaugacuugcuguggccacccaagccccucauuggcaaagcuaggccugggauccagguuuucucauuuucuggggucuuuuuaccacucccugcagauacucuucuuuaccuccauuauuaaacuuccuuuuucucuucuacuuauaccaugaagucuggcuuaagcagaaaauuaguuguuucucuuacuaagcuuccuaguaccucauaaauuccuuucaaaaagugcccuuucacugaagccccaccuaacaauuugcugguccugaaaacgcccuccuuccuucccucagucaccugggcccuuugcccaaaaugccuguuugccucccucuuuccguauugaaguccugcucaugcugcaagguguagcucaggugugaccucuuuuuggaagccuuccuugauugccuuagcaugaaguagcucucccucuucugaacccuauagcacuuacuacuguuguuugugcuguuaguauccccauuguauauaguauccugaguauuuuagcaccucccaacuucccgaccaggaaguuggcagguuguguaagcucuuggagguuaaagccuaugacuuaaacaucccacccagcacuaagcacaaaguauauucuuagccccuguuugugggagggagugggggaaggaagugcaguauguauaguuuuguaaagagauuucauguguguucuauaauauggggaaggccauguuagagcuguaucaagacagcagccaaguccauuucugauuccucauauuuugauaacagaucacagauuaguuagggggauuacaggagacaggcguaaaaacacgggucaguugguccaggcccuggauuaagccugugacucaaagugga

SEQ ID NO: 19809 - RNA, 2305 nt, Homo sapiens
uuugccuguuucaggcuggcucggcugcuccacacagcagaggguucugggagaugggaccagacccugggccaugcucugcaaccaccuccccaaggaaauaaguaaagaauuggccugccaucuuuacagcacuguagacccccugguguaguggaaagagcaugagacagcgugcaggaaggccuuagauucauuccaaauaauuuucaggacuaaauucaccucuugguccuaaagacagaaaaugucagccauggagcuuugaagggcaccaccuccuugaagagcggagguauuucacugaggagaauggaauuagaggcgcacgccagacuuuaagcacccacauuccauugcagccuccagcugaaaaaauuaauugccugcccuuuaugccauuugucuucugcaugugaacugccuccucagaguagggugggaggagagaacgcgccaagcagcguggagcagguccaaccacgcugaccucuuacagcuggguuuaacuccugcaguuacacagggcccugcgccucugucucagcagcaucagaaccgucuccuucagugcaugugaccagaaccgccaugcccagggcuguagggauugcccgaguaucagcaccucuuaguggagggguguguggguguguguguguguauguguuuuauccuuuucuggguuuuaccuuauuuuacuuuggguuuuauggugcccuuuccagacccacacagucaacaccuggucaggcaaaaaccaaguauacccagcauugggcgacaucgaacaacagaccucacgggguuuagcacgccuggcagugccagugccccucccccauccccucaggggcagcgggaaguccuucuaguacaguaaucucaagcuuagucccaucagggccaccugucaccaacagguguccagacauuggggaagguagacaccuuaaggugugauuaagaucccaagcccguccagauacccccuacauuguucuugcuguugggugcuggccucuuccauugacccuguagcugucacucugaaccgaacuggcagggcccaggcuggcccuggacagagucccaguguggcucuggacaaccaggaaccagacugugaccuucgcagugcagagaacauggaggggcuucugguggagcugagagggcacaguucaccucuuaacaguuuuacaaguccaugaaaaaguaugagugugcgcagguccuucaaggucaaggacacgagcaacccuccaccucccauuaaaucugaaaacuuggcaaccuccaauuccacuaucaaaagaaacggccgugucuucccuugggguggccgggccaggcuggauuagcgacgcagacggggagaaaggagccggagaggaagcuccgcgaucccggcgcggcccagcaaaagcacacuggcacgccgagccagaaaucgcccgcggaugccucuucccccagcucaucacaaaccagauccagucgacagcacaauccaaacagaagagggaaucagaauguacauguuuuguuugccguggcaggagaacuguugagcagaggaaaaaaacaagcugagcuuagcgcuaucagcuguuuccuggggcucucuccuuccuuccuccgaggggggccuggccgcuuuguucucguucccagcugcuccucugcgccuuuaagcaguggccuuugcagaccucggaggaaugcggcccugggaccccaggggacuuagcucgaggcuccgcccgccccgcaugcucggccccaggccgcagaaucaggagcgccgcagugucgcgcggaggccgcuccugccccuggcuucucagggcucgcuuucugccgccacuuccugggcggggagggcgcaucccaucagaggcggcuuccugcucucccugacaccccuggaaggacacccauuucacagagcccacacagggagcccaaaagaggggucgucacaauaacacuuuuugcaggcauagagucuggggugaaauggcucccacacuggcguugguuugcuguaguucagaucccagcucuaccaguuauaagccggucacccacagccgcuuacucaaccccucugagccucaacaguucuugccuuaugggacugugacgaagauuaaaacgauaaaacagauugggugucgacccaaaaccuggcgcacagcaggccugcuaccacaguauguauuagcggcuguuguuaccaugccuggguucugguugucucaggcaggacagcuacacaagacuccaucagacugaaagg

SEQ ID NO: 19810 - RNA, 2305 nt, Homo sapiens
ccuuucagucugauggagucuuguguagcuguccugccugagacaaccagaacccaggcaugguaacaacagccgcuaauacauacugugguagcaggccugcugugcgccagguuuugggucgacacccaaucuguuuuaucguuuuaaucuucgucacagucccauaaggcaagaacuguugaggcucagagggguugaguaagcggcugugggugaccggcuuauaacugguagagcugggaucugaacuacagcaaaccaacgccagugugggagccauuucaccccagacucuaugccugcaaaaaguguuauugugacgaccccucuuuugggcucccugugugggcucugugaaauggguguccuuccaggggugucagggagagcaggaagccgccucugaugggaugcgcccuccccgcccaggaaguggcggcagaaagcgagcccugagaagccaggggcaggagcggccuccgcgcgacacugcggcgcuccugauucugcggccuggggccgagcaugcggggcgggcggagccucgagcuaaguccccuggggucccagggccgcauuccuccgaggucugcaaaggccacugcuuaaaggcgcagaggagcagcugggaacgagaacaaagcggccaggccccccucggaggaaggaaggagagagccccaggaaacagcugauagcgcuaagcucagcuuguuuuuuuccucugcucaacaguucuccugccacggcaaacaaaacauguacauucugauucccucuucuguuuggauugugcugucgacuggaucugguuugugaugagcugggggaagaggcauccgcgggcgauuucuggcucggcgugccagugugcuuuugcugggccgcgccgggaucgcggagcuuccucuccggcuccuuucuccccgucugcgucgcuaauccagccuggcccggccaccccaagggaagacacggccguuucuuuugauaguggaauuggagguugccaaguuuucagauuuaaugggagguggaggguugcucguguccuugaccuugaaggaccugcgcacacucauacuuuuucauggacuuguaaaacuguuaagaggugaacugugcccucucagcuccaccagaagccccuccauguucucugcacugcgaaggucacagucugguuccugguuguccagagccacacugggacucuguccagggccagccugggcccugccaguucgguucagagugacagcuacagggucaauggaagaggccagcacccaacagcaagaacaauguaggggguaucuggacgggcuugggaucuuaaucacaccuuaaggugucuaccuuccccaaugucuggacaccuguuggugacagguggcccugaugggacuaagcuugagauuacuguacuagaaggacuucccgcugccccugaggggaugggggaggggcacuggcacugccaggcgugcuaaaccccgugaggucuguuguucgaugucgcccaaugcuggguauacuugguuuuugccugaccagguguugacugugugggucuggaaagggcaccauaaaacccaaaguaaaauaagguaaaacccagaaaaggauaaaacacauacacacacacacacccacacaccccuccacuaagaggugcugauacucgggcaaucccuacagcccugggcauggcgguucuggucacaugcacugaaggagacgguucugaugcugcugagacagaggcgcagggcccuguguaacugcaggaguuaaacccagcuguaagaggucagcgugguuggaccugcuccacgcugcuuggcgcguucucuccucccacccuacucugaggaggcaguucacaugcagaagacaaauggcauaaagggcaggcaauuaauuuuuucagcuggaggcugcaauggaaugugggugcuuaaagucuggcgugcgccucuaauuccauucuccucagugaaauaccuccgcucuucaaggagguggugcccuucaaagcuccauggcugacauuuucugucuuuaggaccaagaggugaauuuaguccugaaaauuauuuggaaugaaucuaaggccuuccugcacgcugucucaugcucuuuccacuacaccagggggucuacagugcuguaaagauggcaggccaauucuuuacuuauuuccuuggggaggugguugcagagcauggcccagggucuggucccaucucccagaacccucugcuguguggagcagccgagccagccugaaacaggcaaa

SEQ ID NO: 19811 - RNA, 2350 nt, Homo sapiens
uguuuugguaucauuucuauuuuauuucgcauguaugaaucgugucuuugcccauuugaucuuuuguuuguugaccucaggaaucucuuacauauuuaaagagaugagccuguugugauaggagugguauaugucauaugugacaguuugucauauaucuuuugacuguuucuggugauuucuuuuccuugcagauuuuauuuuuauaucauuaaauauaucuuuaaaauaaacgagaaauacaaacuggagagauauuuggguagaagguccaguaaguugaauuuuguuugugauuugccaaagguggcuuaaauucuuuucauuaccauuuuuaaaaauggaauaaauuagaggguaugugucucagaggaauaugcccuuggguaaaggauguuuauaucaugcuuuuacacauuuuacgucuuccagacuuaagcucaucaaauugcgcggguggggggcagggggccagaaagggggugggaggauagagggcucagagucugagagaaaggaacuccuaucuucaucccccaaccccccaaggaggagaguggggcgcagaagaggaaaccaagcggggggagguuagagaacuugcccaaggucacaccgcgagcuggugguggagacagauucgaacccaagccugacuccagaacugagaacucuccaccuucucgcgacagcgguacagaaaagugcccuccucuccuuccugccggcagccgucugcgcuuggccaugggccggcgggagcagccacucccccgguucucccgccagucagaggucgggggcucggcguccccuucuggcuuggagccccuggcgcguacagagcgaccagggcggacacauuugccgcgcucaagucucugacccccucccuccuucccagagcccugcgccuaggguuuccugagcucccaacccccucccuucccgagcauagacaaguuuguauucaagcaaggccaggacuggucccugagucgcucucgggccaggcgaccagccucacugccccagagucaggaauaaacgguaacaacagccaccggugccuauugcgugacccgugcuuuacuuccaccucuccgaauaccccggacgaacagacccccaggaauuauuguccccauuacacggacgacggaacugcugcagcuucggaaaguuggauaacaagcuugggcucgcaaagcuaauaauaauacuagcuaacauaugauugaguguuuccugugugcccagcacaugucuaccuacgaacaccaucccauagaucuuuccaauaccccuauaaaaugugcacaauuaucauucccauccuacggaugaggaaacagguuuggcgcccuguccaaggucacucagccagugagugacggauccuggauccaaaccaaagcgggugaaucggauggcaguuuuuugugcguuguccgcuacgcagagaagcaaagggcuuagaacccaugauaccaaaggccgggccccaaacgccccagggcugcgcgcaaaucaaccaucucgaacugccacaaccugcagagaggaauucucagggacugggacgucaggagcgccagcugugucgagugcuggcccgcacaaaguccgugcagccggaucucggcucccggcccccgcgcgccccucaccaggagcuggagaguacuuaccauaaaagagagggcaagcgccuguucgggaagaauccccagcgcuggcagguccuggacucccuggagaggggucugcugccgccgccgcccacucaggggcgcccgagugacccgcaaaugccggcucucuccgcacggccaggggcgcguccucacggcugaugcccggcagcagcgcccccucugcgcugcaggauggccuggaguuaggagcguucuuggcgaaguuggcgcucaggcgccgggggucgggccuggaguggggaagcgccuuacugaagcgauccugggggcgcuccaaggcccgcgcucuagccgcuuggaagcuuggcgccugacccggagggcgacgagucccgcgcucagggcgcacgggccgcgccucggccgcuggcccccggcgcgccgggcgucuuccccagcgcccugagcgcacgcagcgguagcagcagcuggggcccgggcccgggaugugguguguucaucgcccuccccuggggcugggugcuuuugugcgcggggcgcgccggccgccacggccagcucuggaugcugcagccgccgccgccucccccuccuccgccgccgccgcccgcuccccgccuucccggccggcccggaggcugcagcugaaagccgaucuggcugagcucauc

SEQ ID NO: 19812 - RNA, 2350 nt, Homo sapiens
gaugagcucagccagaucggcuuucagcugcagccuccgggccggccgggaaggcggggagcgggcggcggcggcggaggagggggaggcggcggcggcugcagcauccagagcuggccguggcggccggcgcgccccgcgcacaaaagcacccagccccaggggagggcgaugaacacaccacaucccgggcccgggccccagcugcugcuaccgcugcgugcgcucagggcgcuggggaagacgcccggcgcgccgggggccagcggccgaggcgcggcccgugcgcccugagcgcgggacucgucgcccuccgggucaggcgccaagcuuccaagcggcuagagcgcgggccuuggagcgcccccaggaucgcuucaguaaggcgcuuccccacuccaggcccgacccccggcgccugagcgccaacuucgccaagaacgcuccuaacuccaggccauccugcagcgcagagggggcgcugcugccgggcaucagccgugaggacgcgccccuggccgugcggagagagccggcauuugcgggucacucgggcgccccugagugggcggcggcggcagcagaccccucuccagggaguccaggaccugccagcgcuggggauucuucccgaacaggcgcuugcccucucuuuuaugguaaguacucuccagcuccuggugaggggcgcgcgggggccgggagccgagauccggcugcacggacuuugugcgggccagcacucgacacagcuggcgcuccugacgucccagucccugagaauuccucucugcagguuguggcaguucgagaugguugauuugcgcgcagcccuggggcguuuggggcccggccuuugguaucauggguucuaagcccuuugcuucucugcguagcggacaacgcacaaaaaacugccauccgauucacccgcuuugguuuggauccaggauccgucacucacuggcugagugaccuuggacagggcgccaaaccuguuuccucauccguaggaugggaaugauaauugugcacauuuuauagggguauuggaaagaucuaugggaugguguucguagguagacaugugcugggcacacaggaaacacucaaucauauguuagcuaguauuauuauuagcuuugcgagcccaagcuuguuauccaacuuuccgaagcugcagcaguuccgucguccguguaauggggacaauaauuccugggggucuguucguccgggguauucggagagguggaaguaaagcacgggucacgcaauaggcaccgguggcuguuguuaccguuuauuccugacucuggggcagugaggcuggucgccuggcccgagagcgacucagggaccaguccuggccuugcuugaauacaaacuugucuaugcucgggaagggaggggguugggagcucaggaaacccuaggcgcagggcucugggaaggagggagggggucagagacuugagcgcggcaaauguguccgcccuggucgcucuguacgcgccaggggcuccaagccagaaggggacgccgagcccccgaccucugacuggcgggagaaccgggggaguggcugcucccgccggcccauggccaagcgcagacggcugccggcaggaaggagaggagggcacuuuucuguaccgcugucgcgagaagguggagaguucucaguucuggagucaggcuuggguucgaaucugucuccaccaccagcucgcggugugaccuugggcaaguucucuaaccuccccccgcuugguuuccucuucugcgccccacucuccuccuugggggguugggggaugaagauaggaguuccuuucucucagacucugagcccucuauccucccacccccuuucuggcccccugccccccacccgcgcaauuugaugagcuuaagucuggaagacguaaaauguguaaaagcaugauauaaacauccuuuacccaagggcauauuccucugagacacauacccucuaauuuauuccauuuuuaaaaaugguaaugaaaagaauuuaagccaccuuuggcaaaucacaaacaaaauucaacuuacuggaccuucuacccaaauaucucuccaguuuguauuucucguuuauuuuaaagauauauuuaaugauauaaaaauaaaaucugcaaggaaaagaaaucaccagaaacagucaaaagauauaugacaaacugucacauaugacauauaccacuccuaucacaacaggcucaucucuuuaaauauguaagagauuccugaggucaacaaacaaaagaucaaaugggcaaagacacgauucauacaugcgaaauaaaauagaaaugauaccaaaaca

SEQ ID NO: 19813 - RNA, 2537 nt, Homo sapiens
gugacuuggagaugaacucgcccgugcgcggcuggccgccccgcuauaggggcgaaggcgccugacgcaagcggaacucgguggagcccauacgaaucagaacagagcgaggcuccuggcgcacuagggacuccaggaggcagcuccgccagagacgcgggucgugcuucgggaaaccggggggcggggggaggggaagagcgcagaaaagaaaacccaccaaggcggggacuggccugagcggggaggggcggcgaggccggagccccucucuguugggcggacuccccauggccagaggcugagcuccacucccgccggccgcucccuaggggaaggggaaggagaggggagagcagcgacaggccuccagcaagcaagcgcgggcggcauccgcagucuccagaaguuugagacuuggccguaagcggacucgugcgccccaacucuuugccgcgccagcgccuggagcggagagcagaggcggcccggccgcggcgcgccggcuuugucaugauggccagcuaccccgagcccgaggacgcggcgggggcccugcuggccccagagaccggucgcacagucaaggagccagaagggccgccgccgagcccaggcaagggcgguggggguggcggcgggacagccccggagaagccggacccggcgcagaagcccccguacucguacguggcgcucaucgccauggcgauccgcgagagcgcggagaagaggcucacgcuguccggcaucuaccaguacaucaucgcgaaguucccguucuacgagaagaauaagaagggcuggcaaaauagcauccgccacaaccucagccucaacgagugcuucaucaaggugccgcgcgagggcggcggcgagcgcaagggcaacuacuggacgcuggacccggccugcgaagacauguucgagaagggcaacuaccggcgccgccgccgcaugaagaggcccuuccggccgccgcccgcgcacuuccagcccggcaaggggcucuucggggccggaggcgccgcaggcgggugcggcguggcgggcgccggggccgacggcuacggcuaccuggcgccccccaaguaccugcagucuggcuuccucaacaacucguggccgcuaccgcagccucccucacccaugcccuaugccuccugccagauggcggcagccgcagcggcugcagcagcugcggcugcagccgcgggccccgguagcccuggcgcggccgcuguggucaaggggcuggcgggcccggccgccucguacgggccguacacacgcgugcagagcauggcgcugccccccggcguagugaacucguacaauggccugggaggcccgccggccgcacccccgccuccgccgcacccccacccgcauccgcacgcacaccaucugcacgcggccgccgcaccgccgccugccccaccgcaccacggggccgccgcgccgccgccgggccagcucagcccugccagcccagccaccgccgcgcccccggcgcccgcgcccaccagugcgccgggccugcaguucgcuugugcccggcagcccgagcucgccaugaugcauugcucuuacugggaccacgacagcaagaccggcgcgcugcauucgcgccucgaucucugagagcccaccgcaugccggugcagacggaugcgaggaugcagggacgcgcgacgccggccccggucgcagccgacgacgccgccgccagccugaccucacacccucugggcccgccucuggagccagcgcccagggucccucugugcuuuuucgcuuuccuaagcuccugucgcuccucuuuguccccucaguuuauguccuccugugcucaccucccugaccucugugaccuugcacuccccuggccugaagcugccucucugcgcgcuuucuacugggcucgucucuuuccggagccccagcgucuccugcccaaauucaccgcggaaagggcccggggcggaggugcgaccgggcgucggcagcgcagaccucuuggccuucucucacaggucggugcgcucgcucuccgcguuccccgcccgacugccgugcaguccauggcuagacgcgccggacaggacugauggcgggaccgcgcugcccgagaaagggacggaccaauacguguguuugcuccgcgaacccucuugaagcuguucagaagccgcuugccgcggggcccacuaggcggggcggggguugggacccagcgggagccggggcagccuggcuccacggccuguacucgguuuacaccgcgggcgggcgcggagggaggcugcguuuccuccgcuaucagucccgucgcuucgggcaccuccgggccccggcggcuggcuaauguuuuguuugaaagaucgguggaacuuuuuaagagaguauuuaaaaaaaaaaaaaggaaaaaaaauucaccgggcaaccggggaaguauuguggccuuggaguuugcuaaauccaaauaugaaaaucaaaagcuuuaguauuccucaucuucucuucuggaagauuug

SEQ ID NO: 19814 - RNA, 2537 nt, Homo sapiens
caaaucuuccagaagagaagaugaggaauacuaaagcuuuugauuuucauauuuggauuuagcaaacuccaaggccacaauacuuccccgguugcccggugaauuuuuuuuccuuuuuuuuuuuuuaaauacucucuuaaaaaguuccaccgaucuuucaaacaaaacauuagccagccgccggggcccggaggugcccgaagcgacgggacugauagcggaggaaacgcagccucccuccgcgcccgcccgcgguguaaaccgaguacaggccguggagccaggcugccccggcucccgcugggucccaacccccgccccgccuagugggccccgcggcaagcggcuucugaacagcuucaagaggguucgcggagcaaacacacguauugguccgucccuuucucgggcagcgcggucccgccaucaguccuguccggcgcgucuagccauggacugcacggcagucgggcggggaacgcggagagcgagcgcaccgaccugugagagaaggccaagaggucugcgcugccgacgcccggucgcaccuccgccccgggcccuuuccgcggugaauuugggcaggagacgcuggggcuccggaaagagacgagcccaguagaaagcgcgcagagaggcagcuucaggccaggggagugcaaggucacagaggucagggaggugagcacaggaggacauaaacugaggggacaaagaggagcgacaggagcuuaggaaagcgaaaaagcacagagggacccugggcgcuggcuccagaggcgggcccagagggugugaggucaggcuggcggcggcgucgucggcugcgaccggggccggcgucgcgcgucccugcauccucgcauccgucugcaccggcaugcggugggcucucagagaucgaggcgcgaaugcagcgcgccggucuugcugucguggucccaguaagagcaaugcaucauggcgagcucgggcugccgggcacaagcgaacugcaggcccggcgcacuggugggcgcgggcgccgggggcgcggcgguggcugggcuggcagggcugagcuggcccggcggcggcgcggcggccccguggugcgguggggcaggcggcggugcggcggccgcgugcagauggugugcgugcggaugcgggugggggugcggcggaggcgggggugcggccggcgggccucccaggccauuguacgaguucacuacgccggggggcagcgccaugcucugcacgcguguguacggcccguacgaggcggccgggcccgccagccccuugaccacagcggccgcgccagggcuaccggggcccgcggcugcagccgcagcugcugcagccgcugcggcugccgccaucuggcaggaggcauagggcaugggugagggaggcugcgguagcggccacgaguuguugaggaagccagacugcagguacuuggggggcgccagguagccguagccgucggccccggcgcccgccacgccgcacccgccugcggcgccuccggccccgaagagccccuugccgggcuggaagugcgcgggcggcggccggaagggccucuucaugcggcggcggcgccgguaguugcccuucucgaacaugucuucgcaggccggguccagcguccaguaguugcccuugcgcucgccgccgcccucgcgcggcaccuugaugaagcacucguugaggcugagguuguggcggaugcuauuuugccagcccuucuuauucuucucguagaacgggaacuucgcgaugauguacugguagaugccggacagcgugagccucuucuccgcgcucucgcggaucgccauggcgaugagcgccacguacgaguacgggggcuucugcgccggguccggcuucuccggggcugucccgccgccacccccaccgcccuugccugggcucggcggcggcccuucuggcuccuugacugugcgaccggucucuggggccagcagggcccccgccgcguccucgggcucgggguagcuggccaucaugacaaagccggcgcgccgcggccgggccgccucugcucuccgcuccaggcgcuggcgcggcaaagaguuggggcgcacgaguccgcuuacggccaagucucaaacuucuggagacugcggaugccgcccgcgcuugcuugcuggaggccugucgcugcucuccccucuccuuccccuuccccuagggagcggccggcgggaguggagcucagccucuggccauggggaguccgcccaacagagaggggcuccggccucgccgccccuccccgcucaggccaguccccgccuugguggguuuucuuuucugcgcucuuccccuccccccgccccccgguuucccgaagcacgacccgcgucucuggcggagcugccuccuggagucccuagugcgccaggagccucgcucuguucugauucguaugggcuccaccgaguuccgcuugcgucaggcgccuucgccccuauagcggggcggccagccgcgcacgggcgaguucaucuccaagucac

SEQ ID NO: 19815 - RNA, 3099 nt, Homo sapiens
gacucugagguccagucagcaaggccagaucccauccuaagacccuuauggcccugggagagcagggcauaacacaccuuccucugacaccaucuugucgcugauagcucaggagaagcacauggaagaauggucccggccgggcgcgguggcuuacgccuguaaucccaacaguuugggaggcugaggcgggcggaucaccugaggucaggaguuugagaccagccuggccaacacugugaauccugucucuacuaaaaauacaaaauuagccgggugugguggugcgcgccuguaaucccagcuauucaggagguugagacaggaggagguugaggcuggagaaucgcuugaaccugggaggcggaguuugcagugagccgagaucgcgccacugcaauccagcuugggccacagagcaagacuccuucucaaaaaaaaaaaaggacaguccuuucccacaaaggguggcgccccauaacaucucuuguaagugccccacaucuccccucuggucuuccacacaauccuggucucuguucuccacauggugggcccccaggccaccucugggcaccagccacugaggguguugcuacuaagugcaaacuaguuccaccgcaagcaaagagcccaguguccugccccccuucucgcugcgaaccagucgguaguggggggaugggaugggacggcucagacuggcucaccucucuccaggccacaccaugcacauccacccacaggccgcugagaaaaaggcgccaagacgccaggugaagguacaggagccaggccuccaagggccggaagagucggaugggcggagggccugggcuaggccaagccuuccucgcggccccgcccccacggcccgacuccgcccgcccagcccggcgcccucgggucggcugagcgcuaagcgccaguguacagcggcggcuggggcggcaggugaggcggcuggggcguugcugucgugcguccgcaggcgucaggugcucagacccgagggccgggaagggauuuggguuucacaggaaccuggggcggggguccgcuaucuuggggcugucgggaccgcugcuuaaauuuggcccaguccagaccucgagucgggcccccagccaggcccacgcccagguccaggcccaggccgguagggauccucuagggucccagcucgccucgauggagcuccucccgccgcugccucaguccuuccuguugcugcugcuguugccugccaagcccgcggcgggcgaggacuggcagugcccgcgcacccccuacgcggccucucgcgacuuugacgugaaguacguggugcccagcuucuccgccggaggccugguacaggccauggugaccuacgagggcgacagaaaugagagugcuguguuuguagccauacgcaaucgccugcaugugcuugggccugaccugaagucuguccagagccuggccacgggcccugcuggagacccuggcugccagacgugugcagccuguggcccaggaccccacggcccucccggugacacagacacaaaggugcuggugcuggaucccgcgcugccugcgcuggucaguuguggcuccagccugcagggccgcugcuuccugcaugaccuagagccccaagggacagccgugcaucuggcagcgccagccugccucuucucagcccaccauaaccggcccgaugacugccccgacuguguggccagcccauugggcacccguguaacugugguugagcaaggccaggccuccuauuucuacguggcauccucacuggacgcagccguggcugccagcuucagcccacgcucagugucuaucaggcgucucaaggcugacgccucgggauucgcaccgggcuuuguggcguugucagugcugcccaagcaucuugucuccuacaguauugaauacgugcacagcuuccacacgggagccuucguauacuuccugacuguacagccggccagcgugacagaugauccuagugcccugcacacacgccuggcacggcuuagcgccacugagccagaguugggugacuaucgggagcugguccucgacugcagauuugcuccaaaacgcaggcgccggggggccccagaaggcggacagcccuacccugugcugcggguggcccacuccgcuccagugggugcccaacuugccacugagcugagcaucgccgagggccaggaaguacuauuuggggucuuugugacuggcaaggauggugguccuggcgugggccccaacucugucgucugugccuuccccauugaccugcuggacacacuaauugaugaggguguggagcgcuguugugaauccccaguccauccaggccuccggcgaggccucgacuucuuccagucgcccaguuuuugccccaacccgguaagcugaaagaaggggcccuuacuugugagcugcaugcacauggcugaacacaggcugcuucccuuccaucacugaggggaucugggggcgcggugggggggcaggcggaaagaagcauucucucucacccaguuccuaagugcugggguggugugagaaaccagccagacaaaggcuacacuggaggcuuagcucccaggcuggcccuuguggcugccucaucuugcucuuuccccuaccugcccaucauggccucugguuuuuuagguaguuucccuggcuaugugaggauaggguuacauaaccgugucucuguuagcauagcuccugaaugcuggguagaaugaugggcauucccuccuacuuguccaccacccauauccucagggacacacgcagaaaaauagcacuccccccuccccucccccacccccgccaccaccaccaccaccacgcacaaauacacagggagaugcucacagauucacagacucacagcugcuugccaacaguuucacuuucccuuguuuugcucugcuuuccaaagggggugggacgggaguugucagagaaucuccccuuccuccacacccccuccccccacccacccccauccuucugccagccaccacguuccagggagccuccugggccuuggaaguugggagcuuguua

SEQ ID NO: 19816 - RNA, 3099 nt, Homo sapiens
uaacaagcucccaacuuccaaggcccaggaggcucccuggaacgugguggcuggcagaaggauggggguggguggggggaggggguguggaggaaggggagauucucugacaacucccgucccacccccuuuggaaagcagagcaaaacaagggaaagugaaacuguuggcaagcagcugugagucugugaaucugugagcaucucccuguguauuugugcgugguggugguggugguggcgggggugggggaggggaggggggagugcuauuuuucugcgugugucccugaggauaugggugguggacaaguaggagggaaugcccaucauucuacccagcauucaggagcuaugcuaacagagacacgguuauguaacccuauccucacauagccagggaaacuaccuaaaaaaccagaggccaugaugggcagguaggggaaagagcaagaugaggcagccacaagggccagccugggagcuaagccuccaguguagccuuugucuggcugguuucucacaccaccccagcacuuaggaacugggugagagagaaugcuucuuuccgccugcccccccaccgcgcccccagauccccucagugauggaagggaagcagccuguguucagccaugugcaugcagcucacaaguaagggccccuucuuucagcuuaccggguuggggcaaaaacugggcgacuggaagaagucgaggccucgccggaggccuggauggacuggggauucacaacagcgcuccacacccucaucaauuaguguguccagcaggucaauggggaaggcacagacgacagaguuggggcccacgccaggaccaccauccuugccagucacaaagaccccaaauaguacuuccuggcccucggcgaugcucagcucaguggcaaguugggcacccacuggagcggagugggccacccgcagcacaggguagggcuguccgccuucuggggccccccggcgccugcguuuuggagcaaaucugcagucgaggaccagcucccgauagucacccaacucuggcucaguggcgcuaagccgugccaggcgugugugcagggcacuaggaucaucugucacgcuggccggcuguacagucaggaaguauacgaaggcucccguguggaagcugugcacguauucaauacuguaggagacaagaugcuugggcagcacugacaacgccacaaagcccggugcgaaucccgaggcgucagccuugagacgccugauagacacugagcgugggcugaagcuggcagccacggcugcguccagugaggaugccacguagaaauaggaggccuggccuugcucaaccacaguuacacgggugcccaaugggcuggccacacagucggggcagucaucgggccgguuauggugggcugagaagaggcaggcuggcgcugccagaugcacggcugucccuuggggcucuaggucaugcaggaagcagcggcccugcaggcuggagccacaacugaccagcgcaggcagcgcgggauccagcaccagcaccuuugugucugugucaccgggagggccgugggguccugggccacaggcugcacacgucuggcagccagggucuccagcagggcccguggccaggcucuggacagacuucaggucaggcccaagcacaugcaggcgauugcguauggcuacaaacacagcacucucauuucugucgcccucguaggucaccauggccuguaccaggccuccggcggagaagcugggcaccacguacuucacgucaaagucgcgagaggccgcguagggggugcgcgggcacugccaguccucgcccgccgcgggcuuggcaggcaacagcagcagcaacaggaaggacugaggcagcggcgggaggagcuccaucgaggcgagcugggacccuagaggaucccuaccggccugggccuggaccugggcgugggccuggcugggggcccgacucgaggucuggacugggccaaauuuaagcagcggucccgacagccccaagauagcggacccccgccccagguuccugugaaacccaaaucccuucccggcccucgggucugagcaccugacgccugcggacgcacgacagcaacgccccagccgccucaccugccgccccagccgccgcuguacacuggcgcuuagcgcucagccgacccgagggcgccgggcugggcgggcggagucgggccgugggggcggggccgcgaggaaggcuuggccuagcccaggcccuccgcccauccgacucuuccggcccuuggaggccuggcuccuguaccuucaccuggcgucuuggcgccuuuuucucagcggccuguggguggaugugcaugguguggccuggagagaggugagccagucugagccgucccaucccauccccccacuaccgacugguucgcagcgagaaggggggcaggacacugggcucuuugcuugcgguggaacuaguuugcacuuaguagcaacacccucaguggcuggugcccagagguggccugggggcccaccauguggagaacagagaccaggauuguguggaagaccagaggggagauguggggcacuuacaagagauguuauggggcgccacccuuugugggaaaggacuguccuuuuuuuuuuuugagaaggagucuugcucuguggcccaagcuggauugcaguggcgcgaucucggcucacugcaaacuccgccucccagguucaagcgauucuccagccucaaccuccuccugucucaaccuccugaauagcugggauuacaggcgcgcaccaccacacccggcuaauuuuguauuuuuaguagagacaggauucacaguguuggccaggcuggucucaaacuccugaccucaggugauccgcccgccucagccucccaaacuguugggauuacaggcguaagccaccgcgcccggccgggaccauucuuccaugugcuucuccugagcuaucagcgacaagauggugucagaggaagguguguuaugcccugcucucccagggccauaagggucuuaggaugggaucuggccuugcugacuggaccucagaguc

SEQ ID NO: 19817 - RNA, 2523 nt, Homo sapiens
uaggucccagaaccccaagacucuuggaaggaaggaagggacaggaggaggaagccucuaugcauuguaucccugcuggggucucugggacaguggggcccugguggucacugugcccuuugccccugugucccaaugaguagcccaaggcacuggcaguacauacaagauugggggacaggaugugccccccagcucccagccuugucuuugaggaacaagcagcuuuaucagaggcugcaggggcccugcucuggguuuccucaggaagcaccacccccucaucccccacucucacaacuggcccaugugauggaucgucuguuucccugugcgggccccauagccccauuuccugugcuggccccggccuggacggggagggggcugagacucugggcccagaucccaccucccccccaccccccacccccuggcuccuguuuccugcuaguccagcucuuccccuaggaaaggcugcugguaacugggauggggguuggggggagguaagaagucucugacuccuccucuaccucaucccaguuccaucaccugaaguggaccucuugggaccgucugaagguaccagcugggcagccugagaggacccuggagucgcugcuggcucaucuucaggugugcccuguugcuaccccaacccccaggcucagcccagcccggcccagcuggugucugaccuuucuccucuaggagcagcacggguugagggugaggauccugcugcacggcucagcccugcucuaugcggccggauggucaccugaaaagcaggcccagcaccugccccucaggugagcccacuuggggcuuuagacaggccccaccagucccuggaggcuggggcuagggaccacacugccuuuugucuucccagccccauucugggccccucacaccuucccaagcauucuuuccccaaauggagccagcaaacaggcuggagguggggugagggccgagagccugaggaggagucuucaggagcugccuauuuggccagccccaugggcuccccacaugcugcacagccccccuuucacagcccacucccaagggacccauagcuuccugccuccugcuugccucaucagcugcuccuaaaauaguuucagauguuuccugucuugagcagcuccugcuccuggcuugggcuccugacggccugccagcacccucucuaguccaugccaggcugccuucugcuugccauggcucaccucuccaaucuccccuaaacccaccccuaccagggugacagaacugguucagcagcugacaggccaggcaccugcuccugggcagcggguguuggugcuagagcugagcugugagggugacgacgaggacacugccuucccaccucugcacuaugagcugugacaaggcagccacccugucaccuagcucaauggagccccggaucccaagcccugcauuguaagcccacaguaggcacucaauaaaugcuuguuaaaggaaggcauugcagagaggauggacgauagaaaacagugcacuaaugcacacgggugugacaugggcaugacagggaccuucacacagagaaaaaaagcucuucagaagauuugucucccugggcagugccucacagggcuggggcugccucuuagugccucagggguauggagccaggacagucuagaaaaaaggcuuuuauugucccaggcuggagggcagggucagagguagcugacaucauugcagaugaugggcuggcggcuacgacagcucaugagagcugcaaagcgugagacauccgcaggcaguucagguucugggcgaggugggcaugacagccgcuuuccugccauagcuguccgccgagcccuggccagccggcgccgaagcugcucagagaggccaagcaggaacugagggggccgagcacgggcacggugcccaccuccgucacccccuucacucccugucucaggcagcuccauccaguugugcaccaagucagcaaagcaauuguccccuaguaccaggggcuggcgacugcgaccccuguucaguagggcugcuguccaguccucugcuuccagucccugccagugcuccaggcaggcgucugggguggacuugggccguggaugguggacaggugguacacuggcuacaggggcccugcugggcauggggaggccacugacugagaggcacugccuacgaaggggcugugcugagggugcugggcgcugggauacaggcaguucuuccucucgccaugugcugccugacaccuccgagaagccagagucccaguccagggcaugcucccuggggccucccaaggcugcaucccugucuucugucaccacugcuuccuccuccuccucuuccuccuccuccacacagcagacugaguccucuuccaaggcacccgaggcccuaagcugguggcugggcugcacaucugggccaguuugggagguuggcugcaggggaccaggcauugagggugagccugugucccga

SEQ ID NO: 19818 - RNA, 2523 nt, Homo sapiens
ucgggacacaggcucacccucaaugccugguccccugcagccaaccucccaaacuggcccagaugugcagcccagccaccagcuuagggccucgggugccuuggaagaggacucagucugcuguguggaggaggaggaagaggaggaggaggaagcaguggugacagaagacagggaugcagccuugggaggccccagggagcaugcccuggacugggacucuggcuucucggaggugucaggcagcacauggcgagaggaagaacugccuguaucccagcgcccagcacccucagcacagccccuucguaggcagugccucucagucaguggccuccccaugcccagcagggccccuguagccaguguaccaccuguccaccauccacggcccaaguccaccccagacgccugccuggagcacuggcagggacuggaagcagaggacuggacagcagcccuacugaacaggggucgcagucgccagccccugguacuaggggacaauugcuuugcugacuuggugcacaacuggauggagcugccugagacagggagugaagggggugacggaggugggcaccgugcccgugcucggcccccucaguuccugcuuggccucucugagcagcuucggcgccggcuggccagggcucggcggacagcuauggcaggaaagcggcugucaugcccaccucgcccagaaccugaacugccugcggaugucucacgcuuugcagcucucaugagcugucguagccgccagcccaucaucugcaaugaugucagcuaccucugacccugcccuccagccugggacaauaaaagccuuuuuucuagacuguccuggcuccauaccccugaggcacuaagaggcagccccagcccugugaggcacugcccagggagacaaaucuucugaagagcuuuuuuucucugugugaaggucccugucaugcccaugucacacccgugugcauuagugcacuguuuucuaucguccauccucucugcaaugccuuccuuuaacaagcauuuauugagugccuacugugggcuuacaaugcagggcuugggauccggggcuccauugagcuaggugacaggguggcugccuugucacagcucauagugcagaggugggaaggcaguguccucgucgucacccucacagcucagcucuagcaccaacacccgcugcccaggagcaggugccuggccugucagcugcugaaccaguucugucacccugguagggguggguuuaggggagauuggagaggugagccauggcaagcagaaggcagccuggcauggacuagagagggugcuggcaggccgucaggagcccaagccaggagcaggagcugcucaagacaggaaacaucugaaacuauuuuaggagcagcugaugaggcaagcaggaggcaggaagcuaugggucccuugggagugggcugugaaaggggggcugugcagcauguggggagcccauggggcuggccaaauaggcagcuccugaagacuccuccucaggcucucggcccucaccccaccuccagccuguuugcuggcuccauuuggggaaagaaugcuugggaaggugugaggggcccagaauggggcugggaagacaaaaggcaguguggucccuagccccagccuccagggacugguggggccugucuaaagccccaagugggcucaccugaggggcaggugcugggccugcuuuucaggugaccauccggccgcauagagcagggcugagccgugcagcaggauccucacccucaacccgugcugcuccuagaggagaaaggucagacaccagcugggccgggcugggcugagccuggggguugggguagcaacagggcacaccugaagaugagccagcagcgacuccaggguccucucaggcugcccagcugguaccuucagacggucccaagagguccacuucaggugauggaacugggaugagguagaggaggagucagagacuucuuaccuccccccaacccccaucccaguuaccagcagccuuuccuaggggaagagcuggacuagcaggaaacaggagccaggggguggggggugggggggaggugggaucugggcccagagucucagcccccuccccguccaggccggggccagcacaggaaauggggcuauggggcccgcacagggaaacagacgauccaucacaugggccaguugugagagugggggaugaggggguggugcuuccugaggaaacccagagcagggccccugcagccucugauaaagcugcuuguuccucaaagacaaggcugggagcuggggggcacauccugucccccaaucuuguauguacugccagugccuugggcuacucauugggacacaggggcaaagggcacagugaccaccagggccccacugucccagagaccccagcagggauacaaugcauagaggcuuccuccuccugucccuuccuuccuuccaagagucuugggguucugggaccua

SEQ ID NO: 19819 - RNA, 2431 nt, Homo sapiens
gugcuagagcugagcugugagggugacgacgaggacacugccuucccaccucugcacuaugagcugugacaaggcagccacccugucaccuagcucaauggagccccggaucccaagcccugcauuguaagcccacaguaggcacucaauaaaugcuuguuaaaggaaggcauugcagagaggauggacgauagaaaacagugcacuaaugcacacgggugugacaugggcaugacagggaccuucacacagagaaaaaaagcucuucagaagauuugucucccugggcagugccucacagggcuggggcugccucuuagugccucagggguauggagccaggacagucuagaaaaaaggcuuuuauugucccaggcuggagggcagggucagagguagcugacaucauugcagaugaugggcuggcggcuacgacagcucaugagagcugcaaagcgugagacauccgcaggcaguucagguucugggcgaggugggcaugacagccgcuuuccugccauagcuguccgccgagcccuggccagccggcgccgaagcugcucagagaggccaagcaggaacugagggggccgagcacgggcacggugcccaccuccgucacccccuucacucccugucucaggcagcuccauccaguugugcaccaagucagcaaagcaauuguccccuaguaccaggggcuggcgacugcgaccccuguucaguagggcugcuguccaguccucugcuuccagucccugccagugcuccaggcaggcgucugggguggacuugggccguggaugguggacaggugguacacuggcuacaggggcccugcugggcauggggaggccacugacugagaggcacugccuacgaaggggcugugcugagggugcugggcgcugggauacaggcaguucuuccucucgccaugugcugccugacaccuccgagaagccagagucccaguccagggcaugcucccuggggccucccaaggcugcaucccugucuucugucaccacugcuuccuccuccuccucuuccuccuccuccacacagcagacugaguccucuuccaaggcacccgaggcccuaagcugguggcugggcugcacaucugggccaguuugggagguuggcugcaggggaccaggcauugagggugagccugugucccgaccacacaacugaggggaagagagggcagaagucggagagguaucacuugucaccaggccagcccagagaacagaggguccaggaagguuagauaggccugcuggccugggcagcaggguguuagugagcacagggcaggcauaggggugcuggcacucgaagcuggugugguucucauccaccgaccugguggcagucuggcaggcugcagcaugcagggccgggcaagucggcacccgccaccagggcgggcgggcaggcaggcaggguugcgggccugaacggggaaguagguccugcccaggacuggaggggcaucccgugccuauugggggauucagcucccaaagcccaaagcgucuuucacagaaagagcgcuugcuaggugagggguagagaagggaggcauaggccagccugaaguagggggcguucacagcagcgccagcaccucguuagucccuugccgccccaugccccgcccccaaagaagucccccuuccacucucuccucccgcgccguuccagcagcacggccagcuggaugcuguuaucugaugcucagcucaguucccaaccguccgaaacccgacgcgggccaucugagccauaugcgccacgccgcccccaccccgccucggaccggcacgcuggagccaccccgcacccgucuguuguuccggccgggcggcagccuggcaucccgcacgcguccucacuaaccacacccgcucccgagccucaccaguucccagcggagcuggcuaaggaagcugucaagccgagcgcugugcauguccaugccagggcccccaccgaaccuacuagcuccucuuggaaccccggcggagccgcgcggagagggcugggagggccggccagcggcgcccucagccuccgccugccugcgcgacuccucgcucuccguagcucccgccgccgccgccccgacaucuggcagccgcgccccgccccggccccgcggccaaagggggcggggcuaaagcccggcgucccucccgacuccgccgcgguucugggugggaagggcggggucauaacuggaagccggacggggccgguacggggaccccccgagcccccagacuguugaguggacccugcguuugcugcgugacgcaggacaggucgccuccgugcgggggccucauccuccccguuuguucaauggugaaauagcggucccucucacggggcgccgugcugcguccgcacauaggca

SEQ ID NO: 19820 - RNA, 2431 nt, Homo sapiens
ugccuaugugcggacgcagcacggcgccccgugagagggaccgcuauuucaccauugaacaaacggggaggaugaggcccccgcacggaggcgaccuguccugcgucacgcagcaaacgcaggguccacucaacagucugggggcucgggggguccccguaccggccccguccggcuuccaguuaugaccccgcccuucccacccagaaccgcggcggagucgggagggacgccgggcuuuagccccgcccccuuuggccgcggggccggggcggggcgcggcugccagaugucggggcggcggcggcgggagcuacggagagcgaggagucgcgcaggcaggcggaggcugagggcgccgcuggccggcccucccagcccucuccgcgcggcuccgccgggguuccaagaggagcuaguagguucggugggggcccuggcauggacaugcacagcgcucggcuugacagcuuccuuagccagcuccgcugggaacuggugaggcucgggagcgggugugguuagugaggacgcgugcgggaugccaggcugccgcccggccggaacaacagacgggugcgggguggcuccagcgugccgguccgaggcggggugggggcggcguggcgcauauggcucagauggcccgcgucggguuucggacgguugggaacugagcugagcaucagauaacagcauccagcuggccgugcugcuggaacggcgcgggaggagagaguggaagggggacuucuuugggggcggggcauggggcggcaagggacuaacgaggugcuggcgcugcugugaacgcccccuacuucaggcuggccuaugccucccuucucuaccccucaccuagcaagcgcucuuucugugaaagacgcuuugggcuuugggagcugaaucccccaauaggcacgggaugccccuccaguccugggcaggaccuacuuccccguucaggcccgcaacccugccugccugcccgcccgcccugguggcgggugccgacuugcccggcccugcaugcugcagccugccagacugccaccaggucgguggaugagaaccacaccagcuucgagugccagcaccccuaugccugcccugugcucacuaacacccugcugcccaggccagcaggccuaucuaaccuuccuggacccucuguucucugggcuggccuggugacaagugauaccucuccgacuucugcccucucuuccccucaguuguguggucgggacacaggcucacccucaaugccugguccccugcagccaaccucccaaacuggcccagaugugcagcccagccaccagcuuagggccucgggugccuuggaagaggacucagucugcuguguggaggaggaggaagaggaggaggaggaagcaguggugacagaagacagggaugcagccuugggaggccccagggagcaugcccuggacugggacucuggcuucucggaggugucaggcagcacauggcgagaggaagaacugccuguaucccagcgcccagcacccucagcacagccccuucguaggcagugccucucagucaguggccuccccaugcccagcagggccccuguagccaguguaccaccuguccaccauccacggcccaaguccaccccagacgccugccuggagcacuggcagggacuggaagcagaggacuggacagcagcccuacugaacaggggucgcagucgccagccccugguacuaggggacaauugcuuugcugacuuggugcacaacuggauggagcugccugagacagggagugaagggggugacggaggugggcaccgugcccgugcucggcccccucaguuccugcuuggccucucugagcagcuucggcgccggcuggccagggcucggcggacagcuauggcaggaaagcggcugucaugcccaccucgcccagaaccugaacugccugcggaugucucacgcuuugcagcucucaugagcugucguagccgccagcccaucaucugcaaugaugucagcuaccucugacccugcccuccagccugggacaauaaaagccuuuuuucuagacuguccuggcuccauaccccugaggcacuaagaggcagccccagcccugugaggcacugcccagggagacaaaucuucugaagagcuuuuuuucucugugugaaggucccugucaugcccaugucacacccgugugcauuagugcacuguuuucuaucguccauccucucugcaaugccuuccuuuaacaagcauuuauugagugccuacugugggcuuacaaugcagggcuugggauccggggcuccauugagcuaggugacaggguggcugccuugucacagcucauagugcagaggugggaaggcaguguccucgucgucacccucacagcucagcucuagcac

SEQ ID NO: 19821 - RNA, 2226 nt, Homo sapiens
uaugagccuugcccacagccagguaagagauugugugacuacuaaauccaucaggaguccgugguucgccucacccacagcaguucaugggucugccugcagcagaauguacagaugaaguacaaaugaaacacuaaaaaggcauaugagcaauagacaucagccuccuuccggucccucugagcugcccaggucuuuccagaauuucauaugauuggcucugcaacaucugauaaacuacaagcagagcagccuguuugguuaucagaagagaaaugacaaauuccccauacagggaacucucaauaacaagguguuuuuccauucagcuacagaagcuuucccuuggaaggagaacacuaaagccugggugagccucccucaagcuaaaacccaaacagcaacucaacaugcagcaaaauggacaguguuugcagugcuaagagcugugugcuauccaacugcauuacuauuauagcuaguauaaaauggacaaaucccaccucuaaaaaggaugcucacaggcugaccugucugccgcagguuucaagcuacuaacagccuuucauuacuguuaguugucuaagaaaugacuucugaggaaauaaacacacaagaggcacagucgggcagccaaagaauaaaaaauuaugcguccucaguuuaugugcuuccacacagaaaagccagggcaacauauaucagcagacccacauggagcuggaagcaccucccucccacccccuggggguuuugcuacuccccaagccuauuuggugcaaagauaaugccuuccauuuuaucgugucaucucuuaguaguuuuccugaguuuucagucuacugacuuauuauauauuggcauucccuuacagccuucauugccacuugacuguuuuugcaggaccuggguuggcauacauuuaaaacaaacugguuucacaguauuuaaucagauauguucuguuuaaagcauucuguguggguuucagcuuuuccacugguuugaucuaaaucauaagguaacgagaacauaucuggugcuggaugacucaauagcauuuuugcuucaccccaaaauguuucccuaaaccuuggugaaagcacaugauccuauuaguauuguugggccuaaauaagcaccucuugguguccagugggcaauuuuccuuucccccaaaggugauuacagccacuaaaugcccaaggaaagcccaagaccaaguucaugguucaacuauuuucaucucucuguuccucgcagugacacuuaucuucccugacagccacucccauugugcuguuuucucggcccagcacaauggacacaugcagacaccagcagacagggaggacguuuuccaucccauugcucuccugugcggagggaccagguuaagguuacauaagccccuccugagcagucaggcccgagcguuggggagaagcgaauuugggguucgugacggagucacggucugcaggccccgacugacccugcgcucgucauccugccacgccaaggcggggcagcuggaaaggaagggccgcuucccgcgaccacccaguucacgccaauccggcaggguucagagugcggccggacgucgaaccucgcuguccacacuagaucgcgggauccugggcccgggucccggccucaggcugcagcucaccgccccccgggcgccgagacacgcgcuuaccugcccgggccagggccgggaccggggccggggccggggccagggaccggugguaccgcggucgaccgcgcugcucccgccgcggggagcuguccgccaccggccggugcugaaggcggcuuuccugcgccggggccggggccggggcccgggccggggccggcgccgccgggcggcagcggcccgucgccagcgccgcccuccaggcugaccucguugcccauggcgggcaggcgggcgggcggggucggggucgcgcugcgcccgggccggcggcucccgggcggugcucacacucucggcgccgccgcugccgccgccaucucccagcucggcucgcgccgccgccugccgcugcgcaugcgcgucucgcgcccccuucccugcacacgccccccuuccccugugcgcgcucccgccagccucggggucgcugggaaacagccgccggcgcccgcgcaugcgcuguccagggccgacgcgguuguaucaugcugagaaggagccgggcgggggccggc

SEQ ID NO: 19822 - RNA, 2226 nt, Homo sapiens
gccggcccccgcccggcuccuucucagcaugauacaaccgcgucggcccuggacagcgcaugcgcgggcgccggcggcuguuucccagcgaccccgaggcuggcgggagcgcgcacaggggaaggggggcgugugcagggaagggggcgcgagacgcgcaugcgcagcggcaggcggcggcgcgagccgagcugggagauggcggcggcagcggcggcgccgagagugugagcaccgcccgggagccgccggcccgggcgcagcgcgaccccgaccccgcccgcccgccugcccgccaugggcaacgaggucagccuggagggcggcgcuggcgacgggccgcugccgcccggcggcgccggccccggcccgggccccggccccggccccggcgcaggaaagccgccuucagcaccggccgguggcggacagcuccccgcggcgggagcagcgcggucgaccgcgguaccaccggucccuggccccggccccggccccggucccggcccuggcccgggcagguaagcgcgugucucggcgcccggggggcggugagcugcagccugaggccgggacccgggcccaggaucccgcgaucuaguguggacagcgagguucgacguccggccgcacucugaacccugccggauuggcgugaacuggguggucgcgggaagcggcccuuccuuuccagcugccccgccuuggcguggcaggaugacgagcgcagggucagucggggccugcagaccgugacuccgucacgaaccccaaauucgcuucuccccaacgcucgggccugacugcucaggaggggcuuauguaaccuuaaccuggucccuccgcacaggagagcaaugggauggaaaacguccucccugucugcuggugucugcauguguccauugugcugggccgagaaaacagcacaaugggaguggcugucagggaagauaagugucacugcgaggaacagagagaugaaaauaguugaaccaugaacuuggucuugggcuuuccuugggcauuuaguggcuguaaucaccuuugggggaaaggaaaauugcccacuggacaccaagaggugcuuauuuaggcccaacaauacuaauaggaucaugugcuuucaccaagguuuagggaaacauuuuggggugaagcaaaaaugcuauugagucauccagcaccagauauguucucguuaccuuaugauuuagaucaaaccaguggaaaagcugaaacccacacagaaugcuuuaaacagaacauaucugauuaaauacugugaaaccaguuuguuuuaaauguaugccaacccagguccugcaaaaacagucaaguggcaaugaaggcuguaagggaaugccaauauauaauaagucaguagacugaaaacucaggaaaacuacuaagagaugacacgauaaaauggaaggcauuaucuuugcaccaaauaggcuuggggaguagcaaaacccccagggggugggagggaggugcuuccagcuccaugugggucugcugauauauguugcccuggcuuuucuguguggaagcacauaaacugaggacgcauaauuuuuuauucuuuggcugcccgacugugccucuuguguguuuauuuccucagaagucauuucuuagacaacuaacaguaaugaaaggcuguuaguagcuugaaaccugcggcagacaggucagccugugagcauccuuuuuagaggugggauuuguccauuuuauacuagcuauaauaguaaugcaguuggauagcacacagcucuuagcacugcaaacacuguccauuuugcugcauguugaguugcuguuuggguuuuagcuugagggaggcucacccaggcuuuaguguucuccuuccaagggaaagcuucuguagcugaauggaaaaacaccuuguuauugagaguucccuguauggggaauuugucauuucucuucugauaaccaaacaggcugcucugcuuguaguuuaucagauguugcagagccaaucauaugaaauucuggaaagaccugggcagcucagagggaccggaaggaggcugaugucuauugcucauaugccuuuuuaguguuucauuuguacuucaucuguacauucugcugcaggcagacccaugaacugcugugggugaggcgaaccacggacuccugauggauuuaguagucacacaaucucuuaccuggcugugggcaaggcucaua

SEQ ID NO: 19823 - RNA, 2562 nt, Homo sapiens
aaucugcuccagccaucucauuccuccagcggagggcugagaugacuaaugcgccaaggguggacaccgcuauggagaccccaaacuuugucccccuaaauuccggcgaaauuacagacaccaggauugauuaucacagcgggacgcagucucaaaaaaaaaaaaaaaaaaaaaaaaaaaaaaaggaaaagaaagucacaggcgacuugauccaauuaguaaaugccuaauugaauuagugucaccuccaccagccaauaggagggucuccgggcugugaggccgggaagccccucccuggccgcaaauauauaaagcagcuagugacagcccauaaguuuccaaguggucaacuugaccgaugcuuuggcaauugaaaaagggcagaaaggcgcgggcuaguggguggauggggacaaagaucuaagucaccuucuuccagcgugugagccugggaggaggguggggguccugaggagcaagagguacgaggaaggaaaaggagagggcuucuggguuaguuuccaccuccugcuuuccaacucacggcgcuuuccuuccggaaaggacgcuggauucagggcgcgccaguacgcgcaguagcggcccgcgagucggcagguggguagccccggcgcgggaggaaggggaaguuaccuuccccucggaagagggcgcuggcucccccauccugccuuuauaauaaggccaccggaggagaggaagcagccagcugccgucugcgcuuugcaaagcaugcaguuaggggagcagcucuuggugagcucagugaaccugccuggcgcgcacuucuacccgcuggagagugcgcgaggcggcagcggcgggagcgcuggccaccuccccagcgcggcccccucuccucagaaguuggacuuagacaaagcguccaagaaguuuuccggcagucucuccugcgaggcggugagcggggagcccgcagccgccagcgcaggggcccccgcggccaugcuuagugacaccgacgccggggacgcauuugccagcgcugcggcaguggccaagccggggcccccggacggccgcaagggcucccccugcggggaggaggagcugcccuccgccgcugcagccgccgccgccgccgccgccgcggcugcggccacugcgcgcuacuccauggacagccugagcuccgagcgguacuaccuccagucccccgguccucaggggucggagcuggcugcgcccugcucacucuucccguaccaggcggcggcuggggcgccccacggaccuguguacccggcuccuaacggggcgcgcuaccccuacggcuccaugcugccccccggcggcuuccccgcggcugugugcccacccgggagggcgcaguucggcccaggagccggugcgggcaguggcgcgggcgguagcagcggcgggggcggcggcccgggcaccuaucaguacagccagggggcuccgcucuacgggccguacccuggagccgcagcggcgggaucuugcggaggacuggggggccuggggguuccagguucuggcuuccgugcccacgucuaccugugcaaccggccucuguggcucaaauuccaccgccaccaaacugagaugaucauuacgaaacagggcaggugagcgcagcguggaggggccccuggguucggggauaaagggugacgugugguccuggggaagguccgggaugagggagcugaacccaguuguuccgcgcggugcuuagaguguuucaccgcgcgcaauaaaucuccguagacaccgcaucuccaaugcggugucccucugugucagugccccggcggcucuugcagggugccaauguuacggcuguacaccgcuuuucccucccaucauccucaccugaacagaccuggaggaggcggaaauggaaauuagggcauguccacaagcuggauucguuagauccuccugcucggcgguaugcuugugcaugccugcaugccggcaaggagccacggauagggaaggcucaagagcuggccaccugagcgcaguagaugggcucccgcaguuuuaggcgccagggucuccacggggcgucuccgggaggugggcaugaaggcuagagcgccggccucggaagcucggucggaguaggugguuagaucugcccuggagccagaccuggcucggguucggugcgcgagaaaguucugauauacauccaacugcuaacacuggcuacuucuggggaaagggaggggugggugcugagagaggggcacucaaaggggacuuuuagccuaaaguuuuaauauauauuuuuaacaagaauaaccuaauauuguucucugguacuuuucaaaauggugcauuuaaaaauuaguaguuuuuaacauucuaggagaaaaauuuuaagagcgucugaaagggccgagaauaugagccuucggaagcacgcgcgaauuuggaauauaccgauguuggggcaagcuuuuuuuuuuuuuuuuuuuuuuuuuuuuuuuuuuuuuuuugaaaagacggaaagguuccaagaguugccaacucaaaaauauu

SEQ ID NO: 19824 - RNA, 2562 nt, Homo sapiens
aauauuuuugaguuggcaacucuuggaaccuuuccgucuuuucaaaaaaaaaaaaaaaaaaaaaaaaaaaaaaaaaaaaaaaagcuugccccaacaucgguauauuccaaauucgcgcgugcuuccgaaggcucauauucucggcccuuucagacgcucuuaaaauuuuucuccuagaauguuaaaaacuacuaauuuuuaaaugcaccauuuugaaaaguaccagagaacaauauuagguuauucuuguuaaaaauauauauuaaaacuuuaggcuaaaaguccccuuugagugccccucucucagcacccaccccucccuuuccccagaaguagccaguguuagcaguuggauguauaucagaacuuucucgcgcaccgaacccgagccaggucuggcuccagggcagaucuaaccaccuacuccgaccgagcuuccgaggccggcgcucuagccuucaugcccaccucccggagacgccccguggagacccuggcgccuaaaacugcgggagcccaucuacugcgcucagguggccagcucuugagccuucccuauccguggcuccuugccggcaugcaggcaugcacaagcauaccgccgagcaggaggaucuaacgaauccagcuuguggacaugcccuaauuuccauuuccgccuccuccaggucuguucaggugaggaugaugggagggaaaagcgguguacagccguaacauuggcacccugcaagagccgccggggcacugacacagagggacaccgcauuggagaugcggugucuacggagauuuauugcgcgcggugaaacacucuaagcaccgcgcggaacaacuggguucagcucccucaucccggaccuuccccaggaccacacgucacccuuuauccccgaacccaggggccccuccacgcugcgcucaccugcccuguuucguaaugaucaucucaguuugguggcgguggaauuugagccacagaggccgguugcacagguagacgugggcacggaagccagaaccuggaacccccaggccccccaguccuccgcaagaucccgccgcugcggcuccaggguacggcccguagagcggagcccccuggcuguacugauaggugcccgggccgccgcccccgccgcugcuaccgcccgcgccacugcccgcaccggcuccugggccgaacugcgcccucccgggugggcacacagccgcggggaagccgccggggggcagcauggagccguagggguagcgcgccccguuaggagccggguacacagguccguggggcgccccagccgccgccugguacgggaagagugagcagggcgcagccagcuccgaccccugaggaccgggggacuggagguaguaccgcucggagcucaggcuguccauggaguagcgcgcaguggccgcagccgcggcggcggcggcggcggcggcugcagcggcggagggcagcuccuccuccccgcagggggagcccuugcggccguccgggggccccggcuuggccacugccgcagcgcuggcaaaugcguccccggcgucggugucacuaagcauggccgcgggggccccugcgcuggcggcugcgggcuccccgcucaccgccucgcaggagagacugccggaaaacuucuuggacgcuuugucuaaguccaacuucugaggagagggggccgcgcuggggagguggccagcgcucccgccgcugccgccucgcgcacucuccagcggguagaagugcgcgccaggcagguucacugagcucaccaagagcugcuccccuaacugcaugcuuugcaaagcgcagacggcagcuggcugcuuccucuccuccgguggccuuauuauaaaggcaggaugggggagccagcgcccucuuccgaggggaagguaacuuccccuuccucccgcgccggggcuacccaccugccgacucgcgggccgcuacugcgcguacuggcgcgcccugaauccagcguccuuuccggaaggaaagcgccgugaguuggaaagcaggagguggaaacuaacccagaagcccucuccuuuuccuuccucguaccucuugcuccucaggacccccacccuccucccaggcucacacgcuggaagaaggugacuuagaucuuuguccccauccacccacuagcccgcgccuuucugcccuuuuucaauugccaaagcaucggucaaguugaccacuuggaaacuuaugggcugucacuagcugcuuuauauauuugcggccagggaggggcuucccggccucacagcccggagacccuccuauuggcugguggaggugacacuaauucaauuaggcauuuacuaauuggaucaagucgccugugacuuucuuuuccuuuuuuuuuuuuuuuuuuuuuuuuuuuuuuugagacugcgucccgcugugauaaucaauccuggugucuguaauuucgccggaauuuagggggacaaaguuuggggucuccauagcgguguccacccuuggcgcauuagucaucucagcccuccgcuggaggaaugagauggcuggagcagauu

SEQ ID NO: 19825 - RNA, 2611 nt, Homo sapiens
uccccaggccaacagaaggagucccucugggcuccuuccagagaguguggagcccuaggccagagagugugguccugcagcacauccagugcuggggcacccacacugugaaacggaugcagacucuccaaugcaaguguagacaaccuggaacagcacagggcacagugaucacccccucccaccaacaauucuccuugacagguucuuauuuccccaucugguuugcaguguggacagaaggcaguugagguaauuuugggugaugagcuagaaguggcagggccuucagggaaaacagcuuggggucacaguguucaugucaacccuucaggaaaggcuggacugaguuaggcauuugggaggcuggucucaaauggggugggccagggcagccaagccuaugccacaggacugggagguccugacugagccuccaugugucuuccuccauggaaaagauaucaaggcugccucaggagagaaacuggacaaaggcacagacacugaggaugaagccuguuccaacaggagccaaggaaugacgcugugucagagagaaagcagagauguccacuguguccucucagcugcccagccucccuucuugcuagucuggcaggcgcacgaaagacaccucuggccugaagaaagaagagggagcacuggaaggggcagggacuccaugacucaucuagacaagguggcuuuaaggagccuaggcuauugguguaaaagcaacagcucugggcacagagcaaggucucucugggccaggaggaccaggucugugccaacugcagaacacgagauagacuggaggcuggcugaugggaacaucucuaagucccucuaaauuccagggggacucuaguggaaggcuagaggacucugcccuucucuuucccaucuauuauguccaugaacaguuuagauggaugggugguggccacuaaagccuccaaccccaaggguacuaaaaaagagagggauauacaguaaagcagugauugguaugaaaggagcaggguuugcugagauggcaagugaccugggagggcaggagggcaagcccccaccaagagugagugagugccuguccuggagcaaagaggcgcccaaaguuacccuccccaaccucccgccucccagaaggccuccagaucugccuucgggagcccaggcuccccucgcugcuggagggacagcgaaagggcaaagagcuggcucauauuggaggaaacaaagcuccgcuggacaaaggauggagcaggcagcuccggcugagaccuggcccugucccccgaggagggucgcagaugaggggaucgugcugcuucuuucagccugagcaucgcugacuauucugcgcugggcaguuaaggcugcacggcccgaccacgguuaaccuugcacaccuccucuccccacccgcuuagccccugcuccgccacacccgcgcggccugacgcgguccaggcacgcccaggcuuuggggagccucuggggcggcccggauggggcaaggagaauuuuggucguucuuggaugcuguuuccuuccuucgccgccccuccgugcgagcgggaucguggagcccagacuuucaugaccaggacaaggggguccgcgaggcggagggaagucuuuagacccguaccgcccgcccacccaccccccgggcuagaucucggacaagccuggaaacgcccagggucgugcccggcagucccacccagggagccgcgggcugagauuuucccaguccggagaaggggcagagaggcgggcccggggugguguggaggcggccgaaggagcugggggcucccuguccagggcccggaacagcuuuccagggguccaccccugcagggucucccgcucgcgcgggccaggcacucaccgugcagggucaggaagucccggcccgaguccaugcccgacgggcggcgcggcgggaggggcaccgcgggacucacuugaguagcgacagcaccggcggccugggguccgagcggagugcggugcagggaccugaauggaccgcggugggaggaggccggggguggucccgggacaccgccccgcccccgcugcccugcgcccccgcccccugagcccgccaacccucgucucuccccgcccccuucuggggacgcgagagggagggcagagcugggggcccggaggacuggccaacccuggcccgggccagcgggcgcgccccgaccagaaauagccagauuccuccagcuuccuccgccgccgccacccacgggccgcgggcccugucauuaccgcgggcggccgggccccacgcccuguugugggcgccucgcuggggucggggugaugcuggaaagaauccggcgucaucccggggaagggaucguguaagguccgacgcccagccgggcugcugcgcuagggagacgcggcguccaggcuuccagccgcagcucccagcguucgcauucccuucugcgaaaugggugcacggacacgauuagaaggucuucagagagcaauaccuggaccuugucgggaggaggguccccuucccucucgcugggagguuucuaaccccaagagugccuuugguggagug

SEQ ID NO: 19826 - RNA, 2611 nt, Homo sapiens
cacuccaccaaaggcacucuugggguuagaaaccucccagcgagagggaaggggacccuccucccgacaagguccagguauugcucucugaagaccuucuaaucguguccgugcacccauuucgcagaagggaaugcgaacgcugggagcugcggcuggaagccuggacgccgcgucucccuagcgcagcagcccggcugggcgucggaccuuacacgaucccuuccccgggaugacgccggauucuuuccagcaucaccccgaccccagcgaggcgcccacaacagggcguggggcccggccgcccgcgguaaugacagggcccgcggcccguggguggcggcggcggaggaagcuggaggaaucuggcuauuucuggucggggcgcgcccgcuggcccgggccaggguuggccaguccuccgggcccccagcucugcccucccucucgcguccccagaagggggcggggagagacgaggguuggcgggcucagggggcgggggcgcagggcagcgggggcggggcggugucccgggaccacccccggccuccucccaccgcgguccauucaggucccugcaccgcacuccgcucggaccccaggccgccggugcugucgcuacucaagugagucccgcggugccccucccgccgcgccgcccgucgggcauggacucgggccgggacuuccugacccugcacggugagugccuggcccgcgcgagcgggagacccugcagggguggaccccuggaaagcuguuccgggcccuggacagggagcccccagcuccuucggccgccuccacaccaccccgggcccgccucucugccccuucuccggacugggaaaaucucagcccgcggcucccugggugggacugccgggcacgacccugggcguuuccaggcuuguccgagaucuagcccggggggugggugggcgggcgguacgggucuaaagacuucccuccgccucgcggacccccuuguccuggucaugaaagucugggcuccacgaucccgcucgcacggaggggcggcgaaggaaggaaacagcauccaagaacgaccaaaauucuccuugccccauccgggccgccccagaggcuccccaaagccugggcgugccuggaccgcgucaggccgcgcggguguggcggagcaggggcuaagcggguggggagaggaggugugcaagguuaaccguggucgggccgugcagccuuaacugcccagcgcagaauagucagcgaugcucaggcugaaagaagcagcacgauccccucaucugcgacccuccucgggggacagggccaggucucagccggagcugccugcuccauccuuuguccagcggagcuuuguuuccuccaauaugagccagcucuuugcccuuucgcugucccuccagcagcgaggggagccugggcucccgaaggcagaucuggaggccuucugggaggcgggagguuggggaggguaacuuugggcgccucuuugcuccaggacaggcacucacucacucuuggugggggcuugcccuccugcccucccaggucacuugccaucucagcaaacccugcuccuuucauaccaaucacugcuuuacuguauaucccucucuuuuuuaguacccuugggguuggaggcuuuaguggccaccacccauccaucuaaacuguucauggacauaauagaugggaaagagaagggcagaguccucuagccuuccacuagagucccccuggaauuuagagggacuuagagauguucccaucagccagccuccagucuaucucguguucugcaguuggcacagaccugguccuccuggcccagagagaccuugcucugugcccagagcuguugcuuuuacaccaauagccuaggcuccuuaaagccaccuugucuagaugagucauggagucccugccccuuccagugcucccucuucuuucuucaggccagaggugucuuucgugcgccugccagacuagcaagaagggaggcugggcagcugagaggacacaguggacaucucugcuuucucucugacacagcgucauuccuuggcuccuguuggaacaggcuucauccucagugucugugccuuuguccaguuucucuccugaggcagccuugauaucuuuuccauggaggaagacacauggaggcucagucaggaccucccaguccuguggcauaggcuuggcugcccuggcccaccccauuugagaccagccucccaaaugccuaacucaguccagccuuuccugaaggguugacaugaacacugugaccccaagcuguuuucccugaaggcccugccacuucuagcucaucacccaaaauuaccucaacugccuucuguccacacugcaaaccagauggggaaauaagaaccugucaaggagaauuguuggugggagggggugaucacugugcccugugcuguuccagguugucuacacuugcauuggagagucugcauccguuucacagugugggugccccagcacuggaugugcugcaggaccacacucucuggccuagggcuccacacucucuggaaggagcccagagggacuccuucuguuggccugggga

SEQ ID NO: 19827 - RNA, 2656 nt, Homo sapiens
ccacucggcuagugagcugcugaaucaccuuauuccuggagaaagacuuugaugcugagaaaacugacuugcucagcucuugcuacaacugugaccaucucugcaacaguaaaguaaaaacaaauaccucucuuguuggguaauaauuuguaagucauugcaaggagaacacaaaacugcugcugauucuuuccuucuguuacauacuuugguggaaauggacacauugucacugcuuuuuuaaacuguuguagccagaucucaggcauucucagcauugaccccuuccugcuagaggauuuccaaggguugguaucuggguggcuccaagguccuuugcguuuucaguagaggguauucacuguaucuaggaacccuuuccuaggcuucaauaauuaucuuuuaauggcuugguaaaaugguguugaacuuaaucagcaacacugcuaaaaauuaguucaaagaaagcuuuucaagaagguuccccuuacuuauaaauuaaguccuccauaccccuucucagauugcuacaaaggaccgccagaaaucauguugcuuguuuccuaccgagagaggucauccccaucaggcuagcgcuagagaagagggucagcaucgggagccugggaacaagggcagaagugagggauggggaggcagcauucuuaccuuuccgggccugcuggauguaucuugccagcagggcgcccaggugcgcucgggacucgccauccguucucugcgauacccucagcugccuacggggcgccuccucugcccgcugcagcccggagcccgcgggaucugcgggaggcaccggcugcgucagggcgccagccgccaguaccgccaucagcacgcacaggcacacgccgcuguucauggcuguagcgagcaaaggaggagggcgcguuaacugaaaggcugggcaacagagcuccugcggcgggccgggcacccagaagcgggcuuaggacaaacacaggugcuccagacccgccaggccgccgcaagcacgagggcucgccaagcgcugaccccagccgagugccauggcgcgcgcccccgggcgcaccuggcuggucuuugggaacuccucacccagcgccaaggggcagagacccuguuuucugccguguugagcagaaggaauguuuuugcuuuccuaaaguuugaggaaguguuugcagagugccucucuucuaaccgaaagaagaaaaauaaaaccccacgagauuaaaaauagugugaaaaaaauauccuaaagggaagacuccgugggagaaaugagaacccuggggaaagcacuuuuccagauagcuaacaagcuuucaauauggaaauacaguaaaugaugaaaaagagaagcacaguuuaaaauguaggagcaauaaauaaagccguauuuauaaaguuuuucucaaaguguacgugggaaauggcaauaagccacuacgcagaacauaggcagguuuuaaaaucagaaauaugugcccagcgcucaggcuucgaaagccccgugcauuuuagaucgcuaguggauaaaacacccucaaguuucuauccguaaagccucgaaauuuucugcaguauuuagaaaaugaauuuaaaucuuaaaacccucuaauauuuuauuagaaaagauugcaaagucccccgcaccgcuguguaacagcuagcaaacucaaucugcaugcgaaucuuagcgaauggguaguucaucccuuaaugaugcuggcguaugaaaggcucuaaagcagcucuacccacccagaccucacuuuuagacccagagccguuauuucugacuucaagaaaugucuuucgagcucucggagggaagacacagaaaauagaaaagcauaauggaaaugggcacaaagcugaagacagcauccuucaaagacacacgacacuuggaucccccgcugacgaaccgagggaccuaccuuuuggauuaggacgcagcuggcuuggcguuuccaaccggagcagcccggcagcugagccaaguucagggaggaccagcgggcggcugucucuuaaauagccccacccggcggcgucggccagucauguauuuacccaacgcugacgcagacuggcaguaacacgugcucagagggcggccacuggggcgacaaccgguugaaguggcuccugggagagagggggagguggucuagugggguggaguuaaucccucccacgcgcggugccggguguccgcccccucuggguccgagaagcuuccgcccaacccuuuccaggugccgcuccccugcgcauuccagagcaguacucuccaaggugggaaaccuaggaguuuggagucuccuccgggauggagaagcugccgcuagcuuaguucgcuuuggggaccggaggggcuagaaaggaaacugggggcgggggugggggguggacacugggcaggacugagcaucagcaaggcgugauucugaaagggagggggcgucggcccccuaccccggagcguccgaggcgcuggucuucauaccugugucggcucuuucgaaggagagaggaggagucggggucuucacuuucuucucagccgcauuaaaagcccucgcaguucuccagguuuccgagggccaguguucugggucagugaaagggcucuggccacagc

SEQ ID NO: 19828 - RNA, 2656 nt, Homo sapiens
gcuguggccagagcccuuucacugacccagaacacuggcccucggaaaccuggagaacugcgagggcuuuuaaugcggcugagaagaaagugaagaccccgacuccuccucucuccuucgaaagagccgacacagguaugaagaccagcgccucggacgcuccgggguagggggccgacgcccccucccuuucagaaucacgccuugcugaugcucaguccugcccaguguccaccccccacccccgcccccaguuuccuuucuagccccuccgguccccaaagcgaacuaagcuagcggcagcuucuccaucccggaggagacuccaaacuccuagguuucccaccuuggagaguacugcucuggaaugcgcaggggagcggcaccuggaaaggguugggcggaagcuucucggacccagagggggcggacacccggcaccgcgcgugggagggauuaacuccaccccacuagaccaccucccccucucucccaggagccacuucaaccgguugucgccccaguggccgcccucugagcacguguuacugccagucugcgucagcguuggguaaauacaugacuggccgacgccgccggguggggcuauuuaagagacagccgcccgcugguccucccugaacuuggcucagcugccgggcugcuccgguuggaaacgccaagccagcugcguccuaauccaaaagguaggucccucgguucgucagcgggggauccaagugucgugugucuuugaaggaugcugucuucagcuuugugcccauuuccauuaugcuuuucuauuuucugugucuucccuccgagagcucgaaagacauuucuugaagucagaaauaacggcucugggucuaaaagugaggucuggguggguagagcugcuuuagagccuuucauacgccagcaucauuaagggaugaacuacccauucgcuaagauucgcaugcagauugaguuugcuagcuguuacacagcggugcgggggacuuugcaaucuuuucuaauaaaauauuagaggguuuuaagauuuaaauucauuuucuaaauacugcagaaaauuucgaggcuuuacggauagaaacuugaggguguuuuauccacuagcgaucuaaaaugcacggggcuuucgaagccugagcgcugggcacauauuucugauuuuaaaaccugccuauguucugcguaguggcuuauugccauuucccacguacacuuugagaaaaacuuuauaaauacggcuuuauuuauugcuccuacauuuuaaacugugcuucucuuuuucaucauuuacuguauuuccauauugaaagcuuguuagcuaucuggaaaagugcuuuccccaggguucucauuucucccacggagucuucccuuuaggauauuuuuuucacacuauuuuuaaucucgugggguuuuauuuuucuucuuucgguuagaagagaggcacucugcaaacacuuccucaaacuuuaggaaagcaaaaacauuccuucugcucaacacggcagaaaacagggucucugccccuuggcgcugggugaggaguucccaaagaccagccaggugcgcccgggggcgcgcgccauggcacucggcuggggucagcgcuuggcgagcccucgugcuugcggcggccuggcgggucuggagcaccuguguuuguccuaagcccgcuucugggugcccggcccgccgcaggagcucuguugcccagccuuucaguuaacgcgcccuccuccuuugcucgcuacagccaugaacagcggcgugugccugugcgugcugauggcgguacuggcggcuggcgcccugacgcagccggugccucccgcagaucccgcgggcuccgggcugcagcgggcagaggaggcgccccguaggcagcugaggguaucgcagagaacggauggcgagucccgagcgcaccugggcgcccugcuggcaagauacauccagcaggcccggaaagguaagaaugcugccuccccaucccucacuucugcccuuguucccaggcucccgaugcugacccucuucucuagcgcuagccugauggggaugaccucucucgguaggaaacaagcaacaugauuucuggcgguccuuuguagcaaucugagaagggguauggaggacuuaauuuauaaguaaggggaaccuucuugaaaagcuuucuuugaacuaauuuuuagcaguguugcugauuaaguucaacaccauuuuaccaagccauuaaaagauaauuauugaagccuaggaaaggguuccuagauacagugaauacccucuacugaaaacgcaaaggaccuuggagccacccagauaccaacccuuggaaauccucuagcaggaaggggucaaugcugagaaugccugagaucuggcuacaacaguuuaaaaaagcagugacaauguguccauuuccaccaaaguauguaacagaaggaaagaaucagcagcaguuuuguguucuccuugcaaugacuuacaaauuauuacccaacaagagagguauuuguuuuuacuuuacuguugcagagauggucacaguuguagcaagagcugagcaagucaguuuucucagcaucaaagucuuucuccaggaauaaggugauucagcagcucacuagccgagugg

SEQ ID NO: 19829 - RNA, 2903 nt, Homo sapiens
aaggaggagggacagaaagaggaaaagcucuucccauuuuaaaggugaggcaacggggguggugucuuaugucuguaaucucagcuacgagggaggcugaggcagaagaauggcuugaucccaggaguucaaguccaggcuggacaacauagugagacccugccucuuaaaauaaaggcagggcaacagggccgccaaaaagugaacaccauguccaacuucugaccagaaaacccaagcacccuguauccagggguagcuggagugagacauauuccgggggggaagauggaggcaccaggacagaaguucccagaaagcaugaaggaagggagacccuggaagagaggcuccagugcuuucccgucucuggacugagggucagagcuuaggccaccuucuccccuaggggcaucuccugaccaaagaauccagagucaagaccucuccgugcuccauuuagaaaugaggcagccaggcccucaucuuucagaagggcccagacaccccacccccgucccauaagcccccggggcugagucaagucuuucucugggagggggccucugcccagcuguccccugugcgucaugugcaggaggccaggcggcucgccuuacagggacccggccaccucuauauauagccccucgaagacagcugcucagucuaagcaaaccccagcaggaaagcagggguacagagaggagcccccuuggcaccgccaccgcacccuaggccacccaccauggcgcugggcuuggagcaggcggaggagcagcgguuguaccagcagacgcuccugcaagacgggcucaaagacaugcuggaccauggcaaguuccucgacuguguggugcgggcgggcgagcgcgaguucccgugccaucgccuggugcuggccgccugcagccccuacuuccgggcgcgcuuucuagccgagccggagcgcgcgggcgagcugcaccuggaggagguguccccggacgugguggcccaggugcugcacuaccuguacacaucagagaucgcgcuggaugaggcgagcgugcaggauuuguucgccgcggcacaccgcuuccagaucccuuccaucuucaccaucugcguguccuuccugcagaagcgccugugccucuccaacugcuuggccgucuuccgucucggccuccugcucgacugcgcgcgucucgccguggcugcccgcgacuucaucugcgcucacuucacgcugguggcgcgcgacgcugacuuccucggacucucggccgacgagcucaucgccaucaucuccagcgacggccuuaacguggagaaggaggaggcaguguucgaggcggugaugcggugggcggguagcggcgacgccgaggcgcaggcugagcgccagcgcgcgcugcccaccgucuucgagagcgugcgcugccgcuugcugccgcgcgccuuucuggaaagccgcguggagcgccacccucucgugcgugcccagcccgaguugcugcgcaaggugcagauggugaaggaugcacacgagggccgcaucaccacgcugcggaagaaaaagaaggggaaggauggagccggggccaaggaggcugauaagggcacaagcaaagccaaagcagaggaggaugaggaggccgaacguauccuuccugggauccucaaugacacccugcgcuucggcauguuccugcaggaucucaucuucaugaucagugaggagggcgcuguggccuacgauccagcagccaacgagugcuacugugcuucccucuccaaccagguccccaagaaccacgucagccugguuaccaaggagaaccaggucuucguggcuggaggccucuucuacaacgaagacaacaaagaggaccccaugagcgcauacuuccugcaggugccugaccagccuugggagccgccagcuaaugcugggcucuaggcacuguggacagucuuggggcccagaaggggcuugugucuacacaagugaaugccacugggucuagggugagauguagacuggggagguugacugauagccaccuacuugaagguugaagacagucaauaggcagcugccaaaaagcagcauaacuuugguaucuuaauuucaggggugugguagccccaaguuggcauauguuggaggcccuggcccugcacagggguugggguggggcacaguaaggagcagcaaggucggugugaggauccugggcagggccucugcgugaaggccaggcccggagcucacagcagugucccagacaaaggaacaauccuguaugguccucccauuguacagaugaggaaacugaggcccaggagguaucagcagaguggagugccaggucugaguuggggugugacugugagaucucaaagggcagagacaguuuccuggagacuggccauauaaguuugagccuugccaguggggugggauuuggagaugugaaggggaagauggcaguguuuccggccaaggaacgguaagcaagggauagaacuggggcugagccuggugaguggugugcucagggaggccugaucagcaagaggggugacaggcgcuuggugccaggguuaagcucacaggccuuacgguugcacugggggaugagggcagcuucaccagcuacuagcucagcagugugggcacauuguuuauucucucugggccucuguuuguaacuggggauauucuccuuccugcaugauaagguuguuggaagguuaaaugaugcuuauaaagugcucaucagcaaggugcucagcccucagaaaacuuuccaaaaagaugaaccccuaguauuaauaucuuaauuauaaagcuguggagguggacaaggcuguggacuguagauuuuacagggcgaaaaggcagggccguauuu

SEQ ID NO: 19830 - RNA, 2903 nt, Homo sapiens
aaauacggcccugccuuuucgcccuguaaaaucuacaguccacagccuuguccaccuccacagcuuuauaauuaagauauuaauacuagggguucaucuuuuuggaaaguuuucugagggcugagcaccuugcugaugagcacuuuauaagcaucauuuaaccuuccaacaaccuuaucaugcaggaaggagaauauccccaguuacaaacagaggcccagagagaauaaacaaugugcccacacugcugagcuaguagcuggugaagcugcccucaucccccagugcaaccguaaggccugugagcuuaacccuggcaccaagcgccugucaccccucuugcugaucaggccucccugagcacaccacucaccaggcucagccccaguucuaucccuugcuuaccguuccuuggccggaaacacugccaucuuccccuucacaucuccaaaucccaccccacuggcaaggcucaaacuuauauggccagucuccaggaaacugucucugcccuuugagaucucacagucacaccccaacucagaccuggcacuccacucugcugauaccuccugggccucaguuuccucaucuguacaaugggaggaccauacaggauuguuccuuugucugggacacugcugugagcuccgggccuggccuucacgcagaggcccugcccaggauccucacaccgaccuugcugcuccuuacugugccccaccccaaccccugugcagggccagggccuccaacauaugccaacuuggggcuaccacaccccugaaauuaagauaccaaaguuaugcugcuuuuuggcagcugccuauugacugucuucaaccuucaaguagguggcuaucagucaaccuccccagucuacaucucacccuagacccaguggcauucacuuguguagacacaagccccuucugggccccaagacuguccacagugccuagagcccagcauuagcuggcggcucccaaggcuggucaggcaccugcaggaaguaugcgcucaugggguccucuuuguugucuucguuguagaagaggccuccagccacgaagaccugguucuccuugguaaccaggcugacgugguucuuggggaccugguuggagagggaagcacaguagcacucguuggcugcuggaucguaggccacagcgcccuccucacugaucaugaagaugagauccugcaggaacaugccgaagcgcagggugucauugaggaucccaggaaggauacguucggccuccucauccuccucugcuuuggcuuugcuugugcccuuaucagccuccuuggccccggcuccauccuuccccuucuuuuucuuccgcagcguggugaugcggcccucgugugcauccuucaccaucugcaccuugcgcagcaacucgggcugggcacgcacgagaggguggcgcuccacgcggcuuuccagaaaggcgcgcggcagcaagcggcagcgcacgcucucgaagacggugggcagcgcgcgcuggcgcucagccugcgccucggcgucgccgcuacccgcccaccgcaucaccgccucgaacacugccuccuccuucuccacguuaaggccgucgcuggagaugauggcgaugagcucgucggccgagaguccgaggaagucagcgucgcgcgccaccagcgugaagugagcgcagaugaagucgcgggcagccacggcgagacgcgcgcagucgagcaggaggccgagacggaagacggccaagcaguuggagaggcacaggcgcuucugcaggaaggacacgcagauggugaagauggaagggaucuggaagcggugugccgcggcgaacaaauccugcacgcucgccucauccagcgcgaucucugauguguacagguagugcagcaccugggccaccacguccggggacaccuccuccaggugcagcucgcccgcgcgcuccggcucggcuagaaagcgcgcccggaaguaggggcugcaggcggccagcaccaggcgauggcacgggaacucgcgcucgcccgcccgcaccacacagucgaggaacuugccaugguccagcaugucuuugagcccgucuugcaggagcgucugcugguacaaccgcugcuccuccgccugcuccaagcccagcgccaugguggguggccuagggugcgguggcggugccaagggggcuccucucuguaccccugcuuuccugcugggguuugcuuagacugagcagcugucuucgaggggcuauauauagagguggccgggucccuguaaggcgagccgccuggccuccugcacaugacgcacaggggacagcugggcagaggcccccucccagagaaagacuugacucagccccgggggcuuaugggacggggguggggugucugggcccuucugaaagaugagggccuggcugccucauuucuaaauggagcacggagaggucuugacucuggauucuuuggucaggagaugccccuaggggagaagguggccuaagcucugacccucaguccagagacgggaaagcacuggagccucucuuccagggucucccuuccuucaugcuuucugggaacuucuguccuggugccuccaucuucccccccggaauaugucucacuccagcuaccccuggauacagggugcuuggguuuucuggucagaaguuggacaugguguucacuuuuuggcggcccuguugcccugccuuuauuuuaagaggcagggucucacuauguuguccagccuggacuugaacuccugggaucaagccauucuucugccucagccucccucguagcugagauuacagacauaagacaccacccccguugccucaccuuuaaaaugggaagagcuuuuccucuuucugucccuccuccuu

SEQ ID NO: 19831 - RNA, 2696 nt, Homo sapiens
gagcaaaaaguuaaaucauauaaaacuguguuugccaccgugacaggugggggguggaugggaacugagggucaguguggugagaugcaagacaaucgccaucagggcaaauaauacuguuuccaucuaucucucacagccagguaaaggagacagaaguagcccuucucuaacuuuuccgagauucccuugcucagguuuuaggguaacgucuugcaauucugggauucccuuucccaaaucaaauaaagaaaaagcuacauacacaucucuggaggaaaaugucuguauuaaaagccaaaaaaccacauaaguacaagaagaaacgcccaccaggccacgucacuggauagaucaacuuggaaaagguucauaaaguucauuuucagcgguaacaauauaucgguguuaaauccuucccaugcccuccccccaauuuuaaauaaauuaaaaaaccacaaauuucaaauacaacuauguucagauacaaagagcuucucuuacuacagcaauagcaauuuaaucuuuuuguuuuguauuuuuuuuacuaaaacuuucauuuaaaacaguuauuaaauauauaaaacaaauacacaggauuuggucauuuucugccaugaaucuagggcacgugggugcggggaaggagucgggcagggggaugcaauagaggggaaagggccccauuucccuccucuccgucuucggagcugcgaucccacccucaguccaagggcuuaaacaucugcuuuucggaacuggaagcgcagcacaaaccuugcuuuucaaaggcgcuggggucucucggcggccccaucucgggaagaggaacuaacgauaacuacagcacgaagcacaccggccgagucuccggcgggaaaggcacccgcgcgcgcggacacaggacggacacagggaggagcggagcgggucacuuggucgccacccccgaagugacggccgcggcggcggcggcagcggcggcggcggcggcggcugcgguggucccugcgggcacugcggcggggguggcugcgguggugcuggcggugguccggcgcuguuccaugccguugggcaggaagccggcgaugaugggcaccggccagaugagggcggccacgcuccacaccacgaugaccagggucaugaagcaggccaccagcguggacucaaugggcuuacgguucagccgccagcccggcucgcccugcagcuccuccaggcugaagucuaggcagcagaaaugcagcggcucgcccugcagccacagcggcccgggcggcucggccgcgggguaggcuggcagcgcggugggcgccccggcgguggcggcggcggcgcugggggcggcggcgggccggaggcggccggugcggcgaccgcgcacccagccgcagcccacgcagaggcgcagguccugcugcgcgccgcccgccgccagccccaggugcucgaugagcagcggcggcccgacgcgguggaaggcggcggcgaagaaagcgcggccgugcgcguugguggagaagagcaguaggucgcacuggaagccccgcgggcggccccagcgcacgagcagcgagcucagcaucugccgcugcacgcugauguugcacggcgccgccgccgccgccgccuccuccgggcccgggcgcucggggggcccgggggccgccgaggccagcagccgcggggcgaugggcucguccgcggaggacgcguugacugaagcauuggagggcaccccgaggaggccgggcgcguccgcggccccgccgcggacgggcggcagcgggcaggcggcggccaggagcgcggcgagcaggggcagcauggccugcggcgggcgccuacgcgcgcgaggccggcggcgguugcauggcgagcgggcgacgggccggcgagcucacggugggaccgcgggagccggcggccgggcgcagugcgggcgcgccgggcgccugccaagcccgcaggggcggcgcggaggcggugacggcggcuggcucggcgcggggaucccuccagacccgguugcguuugggguuccccgccgcccccggcgccggggcccuugggcugccgcgcugcucugcggggccgggugcuaucccagagcaggauuccccggcucggcuccgccucccgcgugccccgccccgccccgcccuccgcucgccaggcucggggacucaggggagggcgggguuccacgcgccggggcugggagaggaaucgccggggcggggcugggugcgggggcgcggcggagagcggaucgcccggggugcgugcgggcgggcggggaagccugcggacgcgcccgggcgcccccgcgcuccgggugaaucgcguucucagagggaggcuccagggcccggagaccauccuuuugucaggccugaggggagcuucgcugucucgccuuagugcuaccgaaccuccuuuguuuuacagaaggggaaacugaggucgagagaggggaaagggccucgcuaggccaacucaugagccagaaacaaguccgcgccacuagcucuuucugccuuuuuacggugucucuuaccucaaaucuguagaguuuggcugcuuuuuaauggcuccaacacagcagacucacuugggauucuccucgcagcaagcgaggaaaauuccaagaacucuguggaguuucgaguggagagugacuggcuggg

SEQ ID NO: 19832 - RNA, 2696 nt, Homo sapiens
cccagccagucacucuccacucgaaacuccacagaguucuuggaauuuuccucgcuugcugcgaggagaaucccaagugagucugcuguguuggagccauuaaaaagcagccaaacucuacagauuugagguaagagacaccguaaaaaggcagaaagagcuaguggcgcggacuuguuucuggcucaugaguuggccuagcgaggcccuuuccccucucucgaccucaguuuccccuucuguaaaacaaaggagguucgguagcacuaaggcgagacagcgaagcuccccucaggccugacaaaaggauggucuccgggcccuggagccucccucugagaacgcgauucacccggagcgcgggggcgcccgggcgcguccgcaggcuuccccgcccgcccgcacgcaccccgggcgauccgcucuccgccgcgcccccgcacccagccccgccccggcgauuccucucccagccccggcgcguggaaccccgcccuccccugaguccccgagccuggcgagcggagggcggggcggggcggggcacgcgggaggcggagccgagccggggaauccugcucugggauagcacccggccccgcagagcagcgcggcagcccaagggccccggcgccgggggcggcggggaaccccaaacgcaaccgggucuggagggauccccgcgccgagccagccgccgucaccgccuccgcgccgccccugcgggcuuggcaggcgcccggcgcgcccgcacugcgcccggccgccggcucccgcggucccaccgugagcucgccggcccgucgcccgcucgccaugcaaccgccgccggccucgcgcgcguaggcgcccgccgcaggccaugcugccccugcucgccgcgcuccuggccgccgccugcccgcugccgcccguccgcggcggggccgcggacgcgcccggccuccucggggugcccuccaaugcuucagucaacgcguccuccgcggacgagcccaucgccccgcggcugcuggccucggcggcccccgggccccccgagcgcccgggcccggaggaggcggcggcggcggcggcgccgugcaacaucagcgugcagcggcagaugcugagcucgcugcucgugcgcuggggccgcccgcggggcuuccagugcgaccuacugcucuucuccaccaacgcgcacggccgcgcuuucuucgccgccgccuuccaccgcgucgggccgccgcugcucaucgagcaccuggggcuggcggcgggcggcgcgcagcaggaccugcgccucugcgugggcugcggcugggugcgcggucgccgcaccggccgccuccggcccgccgccgcccccagcgccgccgccgccaccgccggggcgcccaccgcgcugccagccuaccccgcggccgagccgcccgggccgcuguggcugcagggcgagccgcugcauuucugcugccuagacuucagccuggaggagcugcagggcgagccgggcuggcggcugaaccguaagcccauugaguccacgcugguggccugcuucaugacccuggucaucgugguguggagcguggccgcccucaucuggccggugcccaucaucgccggcuuccugcccaacggcauggaacagcgccggaccaccgccagcaccaccgcagccacccccgccgcagugcccgcagggaccaccgcagccgccgccgccgccgccgcugccgccgccgccgcggccgucacuucggggguggcgaccaagugacccgcuccgcuccucccuguguccguccuguguccgcgcgcgcgggugccuuucccgccggagacucggccggugugcuucgugcuguaguuaucguuaguuccucuucccgagauggggccgccgagagaccccagcgccuuugaaaagcaagguuugugcugcgcuuccaguuccgaaaagcagauguuuaagcccuuggacugagggugggaucgcagcuccgaagacggagaggagggaaauggggcccuuuccccucuauugcaucccccugcccgacuccuuccccgcacccacgugcccuagauucauggcagaaaaugaccaaauccuguguauuuguuuuauauauuuaauaacuguuuuaaaugaaaguuuuaguaaaaaaaauacaaaacaaaaagauuaaauugcuauugcuguaguaagagaagcucuuuguaucugaacauaguuguauuugaaauuugugguuuuuuaauuuauuuaaaauuggggggagggcaugggaaggauuuaacaccgauauauuguuaccgcugaaaaugaacuuuaugaaccuuuuccaaguugaucuauccagugacguggccuggugggcguuucuucuuguacuuaugugguuuuuuggcuuuuaauacagacauuuuccuccagagauguguauguagcuuuuucuuuauuugauuugggaaagggaaucccagaauugcaagacguuacccuaaaaccugagcaagggaaucucggaaaaguuagagaagggcuacuucugucuccuuuaccuggcugugagagauagauggaaacaguauuauuugcccugauggcgauugucuugcaucucaccacacugacccucaguucccauccaccccccaccugucacgguggcaaacacaguuuuauaugauuuaacuuuuugcuc

SEQ ID NO: 19833 - RNA, 2721 nt, Homo sapiens
gagcuggacuggagaaacaacacauuuuuacaaccccauuagucauacagucaagcuucauuauauuauaaucauuuaucaguagucaguaacgaguaugcuguuuucuugugcaaugaggguguuuaagaaaacgugucuucacaacaggccaugaaaugugucaaauacagaacacccgacauuagugguaaagccugugaguucaucugguugucaucucuguugaagagcacaacaguugaaugaacacaaaccuagcuuuagcuuagaagccacauucuuaauuauuaaccccuucaugcuuccacccuuuccaaacuccacucccuuaagaggaggucacuucauuuagaauuaauaacuguuauucaagaugcucaugagagaucauuuuggcuucagucguuuugcugcaguuuauucuacauauuucucccuaaaucaaauguauacacgucccugagacuuguguaugaccuuagucccuggaccuugggaagucacgaugucguggaggagaggggagcugggagccugaagcugacagaucccgggaucccgcaggccccccgcagggcucccgcccuuccaccgaggcacccgucgagguugccccagaugcucauucugcgcccaucaaugggaguaacugagcuuagagaggaaaaacuacggcuucaacaaagcacaacgugugcagcucugauaaugcagggcggaauuauggagacaccgucggggcuggcuggaaagcggaaagcguuccaucucaggauuuucacggggaauuucaagaaccaagggggccucugagauccccagaaccucuccuuuccacgaggcagcuuccuuccuucccugcucguucuccacaaaaaucagggcugcccggaucccagcagugagcgcugcucucuuuggcugcuguauccccaaccgcugcugaggcgcagcuggagugagccccuccgagccccgcuuugcgcagcugcagcuggagcccagaggcgcccggagcucggagaaaagcacugugcuccgcgggacccaacccuccccacggccaccaagggggcccgcagauccccgggcaccggcagccgaacccagacaggggcgucccaaccgcugagcccgacgccagagggcaccgcgggggagagaaggcgccgcgccucgcuccuggcacuugguccccgggagucagggacaugcgcgccccggagcuggagcccgggaaaauuacugcgcgggcacagaggagcuagagagguccccgacccucccagccccgcgcccagguaccucgcagccguagagcugacccagcugcuccacgauccauuccuccagcaccagccgcuuccgaagcuccuuacgaucguauuucacugucacuuuucccugcuggugucgccgcugcuguugcugcugaaccugcccugcagcggccgccguggccacgggcgccgaguccucccgggaggagccugagccgcugcuggagccggggcugccaccggcgccaccccgggggcuuuggaagaaaacccgugcgccgccgccgcuggccccgccggccgucucgcugcugcccgucgccaccgacauguccccgcgcgcccgagccucagugcggcccggaggaggggcgggcggagcgcgcccggcgccgcuaccaccuccggcccggcagccgcaugcgaagggcuccccggcaccugcucugcgccgcgcgcgcccagccgcccggcugcucugggagggcgggaggagccgcggcgagagggaggagggcggggaggacgacggggcggggaccgcagccuuaaagaagccgccgaggacccucucgguccagcccccagaggcgggaucuggcgccugcggcagagagggcccggggcgugggagucuccgcggggcgggaaaugugugcgccuagacacgggaggucgccgauguguagacuccggaaggacgggcguggggcggggugccaggggaugcuccugcgcggguguccguggccucuagucucggagacagggacucacgcuucucccgcaaucccggagcgcaggaaacgcgccgccucucggggccuccaccuggcgcggccccgggcaggacccgcagcgaaggggacacaggaaaggaccgcgccgcaggcucccccaggagguuuuccuagccccaccgucuccucuguuggcuggguagcguccccuccccuccagccccgccccacggcuccaaacacacauuccuauucaugccacgauggaugccacuuccucucuggauugugagaaacaucgaagaggcgauguuugugcaauaaggcagucacggcgcuugagaaauuauuuccagaccaauguuuucuuuccuuacuaagcgucugcuuaaucaugggcacagcauucggauaucuucguauccaaagggcagaaagcgugacggcgcucaggcaaggcgucugggggcauccagacaguaaacauuucucuaagagggucggcgacaggguccugguuucacauuucuaguguugcgucccgugcacugccagcuuucucuccaucccauuccaaacagccccuuccacccaggagggcaacagcacugccugacucuacugcaaaacaucacagccuaguaguuacacaugaaggagcuucucagaaggguuaggacaauaagguggggagggaa

SEQ ID NO: 19834 - RNA, 2721 nt, Homo sapiens
uucccuccccaccuuauuguccuaacccuucugagaagcuccuucauguguaacuacuaggcugugauguuuugcaguagagucaggcagugcuguugcccuccuggguggaaggggcuguuuggaaugggauggagagaaagcuggcagugcacgggacgcaacacuagaaaugugaaaccaggacccugucgccgacccucuuagagaaauguuuacugucuggaugcccccagacgccuugccugagcgccgucacgcuuucugcccuuuggauacgaagauauccgaaugcugugcccaugauuaagcagacgcuuaguaaggaaagaaaacauuggucuggaaauaauuucucaagcgccgugacugccuuauugcacaaacaucgccucuucgauguuucucacaauccagagaggaaguggcauccaucguggcaugaauaggaauguguguuuggagccguggggcggggcuggaggggaggggacgcuacccagccaacagaggagacgguggggcuaggaaaaccuccugggggagccugcggcgcgguccuuuccuguguccccuucgcugcggguccugcccggggccgcgccagguggaggccccgagaggcggcgcguuuccugcgcuccgggauugcgggagaagcgugagucccugucuccgagacuagaggccacggacacccgcgcaggagcauccccuggcaccccgccccacgcccguccuuccggagucuacacaucggcgaccucccgugucuaggcgcacacauuucccgccccgcggagacucccacgccccgggcccucucugccgcaggcgccagaucccgccucugggggcuggaccgagaggguccucggcggcuucuuuaaggcugcgguccccgccccgucguccuccccgcccuccucccucucgccgcggcuccucccgcccucccagagcagccgggcggcugggcgcgcgcggcgcagagcaggugccggggagcccuucgcaugcggcugccgggccggaggugguagcggcgccgggcgcgcuccgcccgccccuccuccgggccgcacugaggcucgggcgcgcggggacaugucgguggcgacgggcagcagcgagacggccggcggggccagcggcggcggcgcacggguuuucuuccaaagcccccgggguggcgccgguggcagccccggcuccagcagcggcucaggcuccucccgggaggacucggcgcccguggccacggcggccgcugcagggcagguucagcagcaacagcagcggcgacaccagcagggaaaagugacagugaaauacgaucguaaggagcuucggaagcggcuggugcuggaggaauggaucguggagcagcugggucagcucuacggcugcgagguaccugggcgcggggcugggagggucggggaccucucuagcuccucugugcccgcgcaguaauuuucccgggcuccagcuccggggcgcgcaugucccugacucccggggaccaagugccaggagcgaggcgcggcgccuucucucccccgcggugcccucuggcgucgggcucagcgguugggacgccccugucuggguucggcugccggugcccggggaucugcgggcccccuugguggccguggggaggguugggucccgcggagcacagugcuuuucuccgagcuccgggcgccucugggcuccagcugcagcugcgcaaagcggggcucggaggggcucacuccagcugcgccucagcagcgguuggggauacagcagccaaagagagcagcgcucacugcugggauccgggcagcccugauuuuuguggagaacgagcagggaaggaaggaagcugccucguggaaaggagagguucuggggaucucagaggcccccuugguucuugaaauuccccgugaaaauccugagauggaacgcuuuccgcuuuccagccagccccgacggugucuccauaauuccgcccugcauuaucagagcugcacacguugugcuuuguugaagccguaguuuuuccucucuaagcucaguuacucccauugaugggcgcagaaugagcaucuggggcaaccucgacgggugccucgguggaagggcgggagcccugcggggggccugcgggaucccgggaucugucagcuucaggcucccagcuccccucuccuccacgacaucgugacuucccaagguccagggacuaaggucauacacaagucucagggacguguauacauuugauuuagggagaaauauguagaauaaacugcagcaaaacgacugaagccaaaaugaucucucaugagcaucuugaauaacaguuauuaauucuaaaugaagugaccuccucuuaagggaguggaguuuggaaaggguggaagcaugaagggguuaauaauuaagaauguggcuucuaagcuaaagcuagguuuguguucauucaacuguugugcucuucaacagagaugacaaccagaugaacucacaggcuuuaccacuaaugucggguguucuguauuugacacauuucauggccuguugugaagacacguuuucuuaaacacccucauugcacaagaaaacagcauacucguuacugacuacugauaaaugauuauaauauaaugaagcuugacuguaugacuaaugggguuguaaaaauguguuguuucuccaguccagcuc

SEQ ID NO: 19835 - RNA, 2461 nt, Homo sapiens
uccguuccugaugugugauuugguuagagaaauugggaaggggggugggguggaagaaaguuaaaaaaaaaaucaggaaggcguaagcuggagcggugagugugucaaucagaggguuuugugccugggggcuccuagcgguucggagcagaggugucccagggcggccccacaaugaauaugaauaggaauccuugcuaaaugggacagcaaagcgcaccgcccugaaugauggcacgucauccuaaccagcccaggauagauaggagggcuccuuuugucucuuuucuccgccgcagcucuauaaaagccccucuuuuucagcgugagguuaguucaagcacacaccaacuagcuguccaggaagcagccuaaccagagagaggggcgugggagggagagaggcggggaaaagcagcgucuccgcuuuucuucucacgucuugccgcggagaaguggguuccugggcagugcagauuuuuuuuuuuuaauucaagauuuucuuuaauuucccgccuaaagccuccccacgguagggccgcauccccuguaauaaaaugaauucugauucgagcucugucuccagcagagcuucaucuccggacauggaugagauguaccugagggaccaccaccaccgccaccaccaccaccaggagagccgucucaacucggucucguccacgcagggcgauaugaugcagaagaugcccggggaaagccucucgcgggcuggcgccaaggccgcgggagagagcagcaaguacaaaaucaagaagcagcugucggagcaggaccuacagcaguugaggcugaagaucaacggacgcgaacgcaagcggaugcacgaccugaaccuagccauggacgggcugcgcgaagucaugcccuacgcgcaugggccgucggugcgcaagcucuccaagaucgccacacuccugcucgccagaaacuacauccucaugcucaccagcucccuggaggagaugaagaggcugguuggcgagaucuaugggggccaccacucggccuuucacugcgggaccgugggccacucggccggccaccccgcgcacgcggccaacuccgugcacccggugcaccccaucuugggcggcgcgcucucaucuggcaacgccucgucaccgcuguccgccgccucacuucccgccaucggcaccauccggccuccccacucgcuacucaaggcgcccuccacgccgcccgcgcugcagcugggcagcggcuuccagcacugggcuggucugcccugccccugcaccaucugccagaugccgccgccgccgcaccuguccgcucucuccacagccaacauggcccggcugucggccgaguccaaggacuugcucaagugagcagcgggcgggcccggcugccaaggaggagggagagcggcgggaggggccgcggugccgggccgggagggaagagggaggcugcacgcucggcccacgggagggcaggcuccggggcccgcagccucccacgcugucugagagaucucagacuccacuugacccccggagggaaaggaccaaaaucaaaccgcaauuucuaggugguagcaaagggggacucgaaccagaugucguguguuuugcaugcaugcuucuuuuccccaugccgcgccaguauuuuucacugccauaugcucuugucaaaacugcauuuguuguauaaagaugggaucgguguaguuaaaaacuugcgaagggacuuuugaguuggcuuucucugacucuguguucucgcuuuggaaaaagacggccaucccuuuugugcaaaacaaauguaaauauuuucuugagauggaugcgauuaugauugucucuguccuugccacaguuuuucuagagacaauggagagagaaagagagagagagcgcgagagagaucaagacccaaguuuugaaucucaaccgagguccagggcaugacaccuccuauguggguuuuccuuucgacgcaguguaggucaaaagaaugcaugcacgcuucuaaaugaaucuugucugaauaugucgugcaggcuguggugccguuuuccuuguaacaaggauuuauuagugaauuaucccaaguacuccauauaucugucugugguuguaugaaaugaaaaaaggggcagagugcaaagacccacacucacgcacacgcgcuucuucucccacccccacccccuucaaacuuuauucggaaccuuccuuugcuguucuggggccgcuauuguaaaagccugggcucccucuaguagcuugcgccacccccccucgcucaguuauucugcaugcgggguuggcucucucuauuaucagcuuugaaaacuuauccugguuuugggaggggugccguuuuuauuuuccugaacauuugcuugaaauauuuuguuagggccucaaagacgauaccugucuuuauuuuuuauauauucuugauaacu

SEQ ID NO: 19836 - RNA, 2461 nt, Homo sapiens
aguuaucaagaauauauaaaaaauaaagacagguaucgucuuugaggcccuaacaaaauauuucaagcaaauguucaggaaaauaaaaacggcaccccucccaaaaccaggauaaguuuucaaagcugauaauagagagagccaaccccgcaugcagaauaacugagcgaggggggguggcgcaagcuacuagagggagcccaggcuuuuacaauagcggccccagaacagcaaaggaagguuccgaauaaaguuugaagggggugggggugggagaagaagcgcgugugcgugagugugggucuuugcacucugccccuuuuuucauuucauacaaccacagacagauauauggaguacuugggauaauucacuaauaaauccuuguuacaaggaaaacggcaccacagccugcacgacauauucagacaagauucauuuagaagcgugcaugcauucuuuugaccuacacugcgucgaaaggaaaacccacauaggaggugucaugcccuggaccucgguugagauucaaaacuugggucuugaucucucucgcgcucucucucucuuucucucuccauugucucuagaaaaacuguggcaaggacagagacaaucauaaucgcauccaucucaagaaaauauuuacauuuguuuugcacaaaagggauggccgucuuuuuccaaagcgagaacacagagucagagaaagccaacucaaaagucccuucgcaaguuuuuaacuacaccgaucccaucuuuauacaacaaaugcaguuuugacaagagcauauggcagugaaaaauacuggcgcggcauggggaaaagaagcaugcaugcaaaacacacgacaucugguucgagucccccuuugcuaccaccuagaaauugcgguuugauuuugguccuuucccuccgggggucaaguggagucugagaucucucagacagcgugggaggcugcgggccccggagccugcccucccgugggccgagcgugcagccucccucuucccucccggcccggcaccgcggccccucccgccgcucucccuccuccuuggcagccgggcccgcccgcugcucacuugagcaaguccuuggacucggccgacagccgggccauguuggcuguggagagagcggacaggugcggcggcggcggcaucuggcagauggugcaggggcagggcagaccagcccagugcuggaagccgcugcccagcugcagcgcgggcggcguggagggcgccuugaguagcgaguggggaggccggauggugccgauggcgggaagugaggcggcggacagcggugacgaggcguugccagaugagagcgcgccgcccaagauggggugcaccgggugcacggaguuggccgcgugcgcgggguggccggccgaguggcccacggucccgcagugaaaggccgagugguggcccccauagaucucgccaaccagccucuucaucuccuccagggagcuggugagcaugaggauguaguuucuggcgagcaggaguguggcgaucuuggagagcuugcgcaccgacggcccaugcgcguagggcaugacuucgcgcagcccguccauggcuagguucaggucgugcauccgcuugcguucgcguccguugaucuucagccucaacugcuguagguccugcuccgacagcugcuucuugauuuuguacuugcugcucucucccgcggccuuggcgccagcccgcgagaggcuuuccccgggcaucuucugcaucauaucgcccugcguggacgagaccgaguugagacggcucuccuggugguggugguggcgguggugguggucccucagguacaucucauccauguccggagaugaagcucugcuggagacagagcucgaaucagaauucauuuuauuacaggggaugcggcccuaccguggggaggcuuuaggcgggaaauuaaagaaaaucuugaauuaaaaaaaaaaaaucugcacugcccaggaacccacuucuccgcggcaagacgugagaagaaaagcggagacgcugcuuuuccccgccucucucccucccacgccccucucucugguuaggcugcuuccuggacagcuaguuggugugugcuugaacuaaccucacgcugaaaaagaggggcuuuuauagagcugcggcggagaaaagagacaaaaggagcccuccuaucuauccugggcugguuaggaugacgugccaucauucagggcggugcgcuuugcugucccauuuagcaaggauuccuauucauauucauuguggggccgcccugggacaccucugcuccgaaccgcuaggagcccccaggcacaaaacccucugauugacacacucaccgcuccagcuuacgccuuccugauuuuuuuuuuaacuuucuuccaccccaccccccuucccaauuucucuaaccaaaucacacaucaggaacgga

SEQ ID NO: 19837 - RNA, 2204 nt, Homo sapiens
gugcaacagucuaucccccagaaaaaacccgagaaaccuugcucaagaaagugggcacccugacccucugccuucagagaucaucuaccuuugguuccugcccuggaaucccuuuuccacccacuuuccugcaaacuagcgggggccacauaaaauaucuauguaaauauagauaagacauccgguaccuugacuacauaaauaagaguggugaggaagcgucacaaaagcugaauauucuucuggagcccuuggaggggcuccaaacugagaggggagggaagaccgcagggaaaggcggaccucagugucugaaaagccagcuuagagugggagggccugggaguagaagguaaaaagggaguggugagaaugaaugugagaaggaagccaggacagcgcaguccccagucccgaacggccagggagaggagguggccuagcgcuggcggggcucaccccaauccgucugccuuuugaugccguacuguaagcuccguccaucuguagguucuugagccagaaccucugcgggaaggagaaaaagugaaagagggagagggagagggagagagagggggagaaggggagagagagagagggagagagaggcuggaacucucccuuacucucgcacuuucccuuuauuuccuaagcugcugguugcgcagccaccucgggauacugcacacggagaggagggaaaauaagcgaggcaccgccgcaccacgcgggagaccuacggagacccacagcgcccgagcccuggaagagcacuacuggaugucagcggagaaauggcuuugagcucagccuggcgcucgguucugccucuguggcuccucuggagcgcugccugcucccgcgccgcguccggggacgacaacgcuuuuccuuuugacauugaagggagcucagcgguuggcaggcaagacccgccugagacgagcgaaccccgcguggcucugggacgccugccgccugcggccgagguacagugucccugccauugccacccugcuggggcaccugcgcccccgcgggcugugccacacucguccuucucucucucuccgccucuuuccucuccccagugccuugagaguuucaccugggcuaggucaguucggaaacuugaaauaaagaguuuuccuuuguaaguugcauuuggauguugagaguugaaaguugaggcuucggaaugugucugcucaaaggggugagagugcauguguuggugcucugaguucauccgcuagacucucaccggggacugcagcagcacaucggugacuucugccacuugcgugucccaguagucauuuugucaagccacggcacuuaacgugugugcccugucacuggcuuccugcuccucugugcuguuaggacagugggaacacuacugcaggaucuuuuugucucauauuagacaagaagucuucugcagcagggaaggugagggggugagugagaguggcuggucaugaaaggagcuguuagacaacugcugagaggguaucuuaaguagaaacgagccauuguauuccagaaacaagauguuuccauuaaaaucaagccucaggauaugcuauugauaauauguuuauucaaagagcugcuguuugaauaccuuacaauagcuuuuaaguuggaaacaaaaccagaauguagaggucugguaaaggagaaugaauccagaacaagugauuuaagaaccccugaacugaaacagacaacagcaugcccauugcaugggacaugcuaagagggaggaaaauaaagucaccuaaguucaugggaaaggaaggagcaauugaccuagcaaaacaaacaccacacucuauagcuaugguuacagcaacuguacaacuaaaacaguuauguggauugacaccauuucuaacaucacugaugcauggauuauugcuaugaauucuguuaauuguuaguacaauuauaguuauuaauuauugaugauuaaaaauaaggugcaugaacaugguccuucuucagaguaagcccuacccacauugccccaaaaaagagaguggacagggucagaauaugccaaccucucacugugguauaaaauguagccuccaugaaaaagagggagcauggcuucuggucaacuucauacccagaaacuuggggagaagccagaccaggagggacuucaugcaaugggaaggcuuugcuuc

SEQ ID NO: 19838 - RNA, 2204 nt, Homo sapiens
gaagcaaagccuucccauugcaugaagucccuccuggucuggcuucuccccaaguuucuggguaugaaguugaccagaagccaugcucccucuuuuucauggaggcuacauuuuauaccacagugagagguuggcauauucugacccuguccacucucuuuuuuggggcaauguggguagggcuuacucugaagaaggaccauguucaugcaccuuauuuuuaaucaucaauaauuaauaacuauaauuguacuaacaauuaacagaauucauagcaauaauccaugcaucagugauguuagaaauggugucaauccacauaacuguuuuaguuguacaguugcuguaaccauagcuauagagugugguguuuguuuugcuaggucaauugcuccuuccuuucccaugaacuuaggugacuuuauuuuccucccucuuagcaugucccaugcaaugggcaugcuguugucuguuucaguucagggguucuuaaaucacuuguucuggauucauucuccuuuaccagaccucuacauucugguuuuguuuccaacuuaaaagcuauuguaagguauucaaacagcagcucuuugaauaaacauauuaucaauagcauauccugaggcuugauuuuaauggaaacaucuuguuucuggaauacaauggcucguuucuacuuaagauacccucucagcaguugucuaacagcuccuuucaugaccagccacucucacucacccccucaccuucccugcugcagaagacuucuugucuaauaugagacaaaaagauccugcaguaguguucccacuguccuaacagcacagaggagcaggaagccagugacagggcacacacguuaagugccguggcuugacaaaaugacuacugggacacgcaaguggcagaagucaccgaugugcugcugcaguccccggugagagucuagcggaugaacucagagcaccaacacaugcacucucaccccuuugagcagacacauuccgaagccucaacuuucaacucucaacauccaaaugcaacuuacaaaggaaaacucuuuauuucaaguuuccgaacugaccuagcccaggugaaacucucaaggcacuggggagaggaaagaggcggagagagagagaaggacgaguguggcacagcccgcgggggcgcaggugccccagcaggguggcaauggcagggacacuguaccucggccgcaggcggcaggcgucccagagccacgcgggguucgcucgucucaggcgggucuugccugccaaccgcugagcucccuucaaugucaaaaggaaaagcguugucguccccggacgcggcgcgggagcaggcagcgcuccagaggagccacagaggcagaaccgagcgccaggcugagcucaaagccauuucuccgcugacauccaguagugcucuuccagggcucgggcgcugugggucuccguaggucucccgcguggugcggcggugccucgcuuauuuucccuccucuccgugugcaguaucccgagguggcugcgcaaccagcagcuuaggaaauaaagggaaagugcgagaguaagggagaguuccagccucucucucccucucucucucuccccuucucccccucucucucccucucccucucccucuuucacuuuuucuccuucccgcagagguucuggcucaagaaccuacagauggacggagcuuacaguacggcaucaaaaggcagacggauuggggugagccccgccagcgcuaggccaccuccucucccuggccguucgggacuggggacugcgcuguccuggcuuccuucucacauucauucucaccacucccuuuuuaccuucuacucccaggcccucccacucuaagcuggcuuuucagacacugagguccgccuuucccugcggucuucccuccccucucaguuuggagccccuccaagggcuccagaagaauauucagcuuuugugacgcuuccucaccacucuuauuuauguagucaagguaccggaugucuuaucuauauuuacauagauauuuuauguggcccccgcuaguuugcaggaaaguggguggaaaagggauuccagggcaggaaccaaagguagaugaucucugaaggcagagggucagggugcccacuuucuugagcaagguuucucggguuuuuucugggggauagacuguugcac

SEQ ID NO: 19839 - RNA, 2619 nt, Homo sapiens
cagugguuuccaccauaagaaacagcauugauuuccaaggcaaaucucccuuaacucuccguuggacucaugcugcaccucaugcuuccagguacuaaguuccuuauccaguaauaaaaccccuaauucugauauuuagguugcuucugacauuucugagaaguaaagcuaagcauaugcaccuagguacgcauacauauaugauauauauccaugcguccccugcuaagcgugagcuaugauagaaaaugcuuguucuaaugaagaaagcgucaaagcgcaauaaauuugacuuacuugcacaccauuuucauccaguuuguuuuuuaaauacaaacugaaccaaaacuggccaaguaguaguauuaagccaccugguaguauuaaggauuucaugcagaagauggggaacaccaagaagaccgcaaaaugcaaaccugcuacuuuuugauggcucgcagaaaaauaaauaaauuguuuuauaucaauagagacucgugaaaucaacacagaauaaaacccucgcccaggcaaaagccgcaacuucauggaaaauaaggagguggggggcaacgaggggguccagagcugagcggugcucuugugcaauugcucuaacgcgaacagcuggagcgccaggcugcugcgcucuccaccucuggugcaccgcuggccuggcggggagcccagccucgccgagaggacuccgggccggccuuagcgaacaauggacaggcgcccugcaaaggccgccccucagacagcuguccuccagcggggcuggccggggucugcuuggcugggaagugaggcaggcagaggcgagcgggaggcggaggcugccaguggugaggugcgggcgggggcgggcgaggagagcggucaggaccgugcccagacccgcgccucucgggccgcagcucgccgggcacugacgggcucuucacgccgucgcagcugguugguuggggggaagcgggauugaggagcaggagggugagcugggggagagggguggaauagagcucucuccggggugccccggccaggaggcuccuaacuuuggagggacccugaggaugauucucaaaaaggggggagaaacugcaccguccacugggaaagccucuuccccugcccaacgccgcucgaguccccggugcccucgcccugaaacgcguccgugccaaccugggauucguaagguuaaauaguaugugguccccccucaucaaaucugagguuggcaacaauuucggggaugcagcccucgaguuggccucugcuuuacaccuggaggaggagcggagccguucugggcauccuacagaaacugacaagcgcgccccgguaccccccagauccauaccacggcccacggggagcgggcgcaagaaagagcucagucucccuggcccccgagaucaaaaaauaccuucaucuccucauugaucucccuuuucacugggugagccggcuuccugcuccguuuauuuucgggaggucucccuucuuucuccauuucugccauguuuuugugucugguuucuguggagaugaaauggcugcugccgccgccggcgguggugguggcggcggcggcggcgguggagguggugcugaugguggcgaggcuggcggagguagcggugcuggcggggccggaccgagccgcgagggggagggcaggcgccgagaagcggggucucuucuagcggcggaggacgucaguggcugucacggguaaggauagugcggagagucucggggaugccgccgccgucgcuccggcuccugcugccgccgccgccgccgccgcagccaacgccgccgcugcugccgcugccccugccgcccucgcugccgcugccgcucccgccgccgccgccgccgggccgcauccucggggccccguggagucgucagccaucuuccgucgcucgguccguccgcaugggcgcggggagcaagggccggcgcggagagcggccccgggcgugcgugcgcggcugugugugagcccgggagagcgcgccagccccggcgcccagcgccucccgcgagccgagccgggggcgggccgggggccggcgcgggaggaggggagggagcgcggccgggagggggucggagggaggggaaagguggggggggcgaggacagccccccggcucucgagcgggcguggcuuccaccgucacuggauacgcggaugcugcgcggcuccgggggcugcucgcagccgccuguucauccgcggcgggcacgggcggcucgcggcgccccccgcggccgccaccuccccgccacacgccaggggcgccggcgcccgcucggaacccagcccugcuucucagcuccgcgaggugggcuggguugcguguggaguugguuuuugagcccguccuaggagccgcugaggaaaaaugaaugggggugaaaggagaagguugggcggcgggaggucgcgagaccugaggucgccuggcuagagggccgccgucccccggggaggguugacugagccugccgccucgggggugcaacgcuggggucucggggaaaggaaaccacagcccggacgagcuuccccccacugagcugccagaauaguuuccc

SEQ ID NO: 19840 - RNA, 2619 nt, Homo sapiens
gggaaacuauucuggcagcucaguggggggaagcucguccgggcugugguuuccuuuccccgagaccccagcguugcacccccgaggcggcaggcucagucaacccuccccgggggacggcggcccucuagccaggcgaccucaggucucgcgaccucccgccgcccaaccuucuccuuucacccccauucauuuuuccucagcggcuccuaggacgggcucaaaaaccaacuccacacgcaacccagcccaccucgcggagcugagaagcagggcuggguuccgagcgggcgccggcgccccuggcguguggcggggagguggcggccgcggggggcgccgcgagccgcccgugcccgccgcggaugaacaggcggcugcgagcagcccccggagccgcgcagcauccgcguauccagugacgguggaagccacgcccgcucgagagccggggggcuguccucgccccccccaccuuuccccucccuccgacccccucccggccgcgcucccuccccuccucccgcgccggcccccggcccgcccccggcucggcucgcgggaggcgcugggcgccggggcuggcgcgcucucccgggcucacacacagccgcgcacgcacgcccggggccgcucuccgcgccggcccuugcuccccgcgcccaugcggacggaccgagcgacggaagauggcugacgacuccacggggccccgaggaugcggcccggcggcggcggcggcgggagcggcagcggcagcgagggcggcaggggcagcggcagcagcggcggcguuggcugcggcggcggcggcggcggcagcaggagccggagcgacggcggcggcauccccgagacucuccgcacuauccuuacccgugacagccacugacguccuccgccgcuagaagagaccccgcuucucggcgccugcccucccccucgcggcucgguccggccccgccagcaccgcuaccuccgccagccucgccaccaucagcaccaccuccaccgccgccgccgccgccaccaccaccgccggcggcggcagcagccauuucaucuccacagaaaccagacacaaaaacauggcagaaauggagaaagaagggagaccucccgaaaauaaacggagcaggaagccggcucacccagugaaaagggagaucaaugaggagaugaagguauuuuuugaucucgggggccagggagacugagcucuuucuugcgcccgcuccccgugggccgugguauggaucugggggguaccggggcgcgcuugucaguuucuguaggaugcccagaacggcuccgcuccuccuccagguguaaagcagaggccaacucgagggcugcauccccgaaauuguugccaaccucagauuugaugaggggggaccacauacuauuuaaccuuacgaaucccagguuggcacggacgcguuucagggcgagggcaccggggacucgagcggcguugggcaggggaagaggcuuucccaguggacggugcaguuucuccccccuuuuugagaaucauccucagggucccuccaaaguuaggagccuccuggccggggcaccccggagagagcucuauuccaccccucucccccagcucacccuccugcuccucaaucccgcuuccccccaaccaaccagcugcgacggcgugaagagcccgucagugcccggcgagcugcggcccgagaggcgcgggucugggcacgguccugaccgcucuccucgcccgcccccgcccgcaccucaccacuggcagccuccgccucccgcucgccucugccugccucacuucccagccaagcagaccccggccagccccgcuggaggacagcugucugaggggcggccuuugcagggcgccuguccauuguucgcuaaggccggcccggaguccucucggcgaggcugggcuccccgccaggccagcggugcaccagagguggagagcgcagcagccuggcgcuccagcuguucgcguuagagcaauugcacaagagcaccgcucagcucuggacccccucguugccccccaccuccuuauuuuccaugaaguugcggcuuuugccugggcgaggguuuuauucuguguugauuucacgagucucuauugauauaaaacaauuuauuuauuuuucugcgagccaucaaaaaguagcagguuugcauuuugcggucuucuugguguuccccaucuucugcaugaaauccuuaauacuaccagguggcuuaauacuacuacuuggccaguuuugguucaguuuguauuuaaaaaacaaacuggaugaaaauggugugcaaguaagucaaauuuauugcgcuuugacgcuuucuucauuagaacaagcauuuucuaucauagcucacgcuuagcaggggacgcauggauauauaucauauauguaugcguaccuaggugcauaugcuuagcuuuacuucucagaaaugucagaagcaaccuaaauaucagaauuagggguuuuauuacuggauaaggaacuuaguaccuggaagcaugaggugcagcaugaguccaacggagaguuaagggagauuugccuuggaaaucaaugcuguuucuuaugguggaaaccacug

SEQ ID NO: 19841 - RNA, 2495 nt, Homo sapiens
gagcucgugguugucuuugccacuaucuuccugugcgauuucagacaagccaccucccucacuaagccuaaauuuccccauguguaacgugcaggcauuguacccuagaggcaucaaaguccccuccaggacagaugcuaaggaaagauaggcuaggagcaaagccgucugagguggccugaccagagccacacgaggcucuucucacugggcgaggcucuuugaggaaccgagaguugcugggacccagcccgcccucgagagagcaaacagagcggcgcuccccucccccgaccccggcccuuuguccggaauccagcugugcccugcgggggaggagcgggcucgcguggcgcggccccagggccccggcgcugauuggccgguggcgcgggcagcagccgggcaggcacgcuccuggcccgggcgaagcagauaaagcgugccaaggggcacacgacuugcugcucaggaaaucccugcggucucaccgccgcgccucgagagagagcgugacagaggccucggaccccauucucucuucuuuucuccuuuggggcuggggcaacucccaggcgggggcgccugcagcucagcugaacuuggcgaccagaagcccgcugagcuccccacggcccucgcugcucaucgcucucuauucuuuugcgccgguagaaagguaauauuuggaggccuccgagggacgggcaggggaaagagggauccucugacccagcgggggcugggaggauggcuguuuuuguuuuuucccaccuagccucggaaucgcggacugcgcccagugacggacucaaacuuacccuucccucugaccccgccguaggaugacgccucaacccucgggugcgcccacuguccaagugacccgugagacggagcgguccuuccccagagccucggaagacgaagugaccugccccacguccgccccgcccagccccacucgcacacgggggaacugcgcagaggcggaagagggaggcugccgaggggccccgaggaagcuccgggcacggcgcgggggacgcagccggccuaagagcgaguuggcacugagcaagcagcgacggagucggcgaaagaaggccaacgaccgcgagcgcaaucgaaugcacaaccucaacucggcacuggacgcccugcgcgguguccugcccaccuucccagacgacgcgaagcucaccaagaucgagacgcugcgcuucgcccacaacuacaucugggcgcugacucaaacgcugcgcauagcggaccacagcuuguacgcgcuggagccgccggcgccgcacugcggggagcugggcagcccaggcgguucccccggggacugggggucccucuacuccccagucucccaggcuggcagccugagucccgccgcgucgcuggaggagcgacccgggcugcugggggccaccuuuuccgccugcuugagcccaggcagucuggcuuucucagauuuucugugaaaggaccugucugucgcugggcugugggugcuaaggguaagggagagggagggagccgggagccguagaggguggccgacggcggcggcccucaaaagcacuuguuccuucugcuucucccuggcugaccccuggccggcccaggccuccacgggggcggcaggcuggguucauuccccggcccuccgagccgcgccaacgcacgcaacccuugcugcugcccgcgcgaagugggcauugcaaagugcgcucauuuuaggccuccucucugccaccaccccauaaucucauucaaagaauacuagaaugguagcacuacccggccggagccgcccaccgucuugggucgcccuacccucacucaagucugucugccucucagucucuuaccaccccuccuccaaugugauucaauccaauguuuggucucucagcgcuuacuccccuugccuugcuccaaagacgcugccgaucugcucuacucccaaucagguccgggauuucagggcgccucacucugccuuaaagccacgaaggcgacccucugccuucuccucgugcacuuuucggagccauugcccucccggggcggaagaccaggcugugaacugggaaagcgcuagcccggccagggagcaucuccccagccucccugcgaacugcgccugaaacgugagcugcgcugcaggugccuggagcaccgcgcaucuuuuuuuuuuaaaucuguuuguaaauuauaugaugccuuuugaaaucaauuuugguacaguaaauuauauggccccuccccuguuuuacacauuuguauuuauuaaugagauuucacagcagggaaaagccuauauuuuguauauuagauuauuuagggauugcuggaugagauuuuaagccaauaaaaaaaaauggaccuucaagaagccuuggcaagaugacuccauuguguguuggggagaggagggccacagucacuacagcugaggaagagcacuucuguccaaagagagg

SEQ ID NO: 19842 - RNA, 2495 nt, Homo sapiens
ccucucuuuggacagaagugcucuuccucagcuguagugacuguggcccuccucuccccaacacacaauggagucaucuugccaaggcuucuugaagguccauuuuuuuuuauuggcuuaaaaucucauccagcaaucccuaaauaaucuaauauacaaaauauaggcuuuucccugcugugaaaucucauuaauaaauacaaauguguaaaacaggggaggggccauauaauuuacuguaccaaaauugauuucaaaaggcaucauauaauuuacaaacagauuuaaaaaaaaaagaugcgcggugcuccaggcaccugcagcgcagcucacguuucaggcgcaguucgcagggaggcuggggagaugcucccuggccgggcuagcgcuuucccaguucacagccuggucuuccgccccgggagggcaauggcuccgaaaagugcacgaggagaaggcagagggucgccuucguggcuuuaaggcagagugaggcgcccugaaaucccggaccugauugggaguagagcagaucggcagcgucuuuggagcaaggcaaggggaguaagcgcugagagaccaaacauuggauugaaucacauuggaggaggggugguaagagacugagaggcagacagacuugagugaggguagggcgacccaagacggugggcggcuccggccggguagugcuaccauucuaguauucuuugaaugagauuauggggugguggcagagaggaggccuaaaaugagcgcacuuugcaaugcccacuucgcgcgggcagcagcaaggguugcgugcguuggcgcggcucggagggccggggaaugaacccagccugccgcccccguggaggccugggccggccaggggucagccagggagaagcagaaggaacaagugcuuuugagggccgccgccgucggccacccucuacggcucccggcucccucccucucccuuacccuuagcacccacagcccagcgacagacagguccuuucacagaaaaucugagaaagccagacugccugggcucaagcaggcggaaaagguggcccccagcagcccgggucgcuccuccagcgacgcggcgggacucaggcugccagccugggagacuggggaguagagggacccccaguccccgggggaaccgccugggcugcccagcuccccgcagugcggcgccggcggcuccagcgcguacaagcugugguccgcuaugcgcagcguuugagucagcgcccagauguaguugugggcgaagcgcagcgucucgaucuuggugagcuucgcgucgucugggaaggugggcaggacaccgcgcagggcguccagugccgaguugagguugugcauucgauugcgcucgcggucguuggccuucuuucgccgacuccgucgcugcuugcucagugccaacucgcucuuaggccggcugcgucccccgcgccgugcccggagcuuccucggggccccucggcagccucccucuuccgccucugcgcaguucccccgugugcgaguggggcugggcggggcggacguggggcaggucacuucgucuuccgaggcucuggggaaggaccgcuccgucucacgggucacuuggacagugggcgcacccgaggguugaggcgucauccuacggcggggucagagggaaggguaaguuugaguccgucacugggcgcaguccgcgauuccgaggcuaggugggaaaaaacaaaaacagccauccucccagcccccgcugggucagaggaucccucuuuccccugcccgucccucggaggccuccaaauauuaccuuucuaccggcgcaaaagaauagagagcgaugagcagcgagggccguggggagcucagcgggcuucuggucgccaaguucagcugagcugcaggcgcccccgccugggaguugccccagccccaaaggagaaaagaagagagaaugggguccgaggccucugucacgcucucucucgaggcgcggcggugagaccgcagggauuuccugagcagcaagucgugugccccuuggcacgcuuuaucugcuucgcccgggccaggagcgugccugcccggcugcugcccgcgccaccggccaaucagcgccggggcccuggggccgcgccacgcgagcccgcuccucccccgcagggcacagcuggauuccggacaaagggccggggucgggggaggggagcgccgcucuguuugcucucucgagggcgggcugggucccagcaacucucgguuccucaaagagccucgcccagugagaagagccucguguggcucuggucaggccaccucagacggcuuugcuccuagccuaucuuuccuuagcaucuguccuggaggggacuuugaugccucuaggguacaaugccugcacguuacacauggggaaauuuaggcuuagugagggagguggcuugucugaaaucgcacaggaagauaguggcaaagacaaccacgagcuc

SEQ ID NO: 19843 - RNA, 2516 nt, Homo sapiens
aguagggguuugacuguagugucucggcuccgcucgguuucuuuccgaaguuuaauuuuccggaauggcucccaaacaagggcuagggaggcggagccgccggcaccggaucuucgccuuuuuuggaaagucccagagaaccggaauuccuccccgccccgggaggcugagccgcagccuggagcagcucgcucuccugcuguggcugugacuggguccauggcgcgcccucucccccgcgaucccugcgccccggacccaggcugcagcuagggccgcgcgcccgggaccccagcgauccccgccgccugcgagcuggaagucgcgagcccggcggaguccgcgcggccgagcccguguaugcaaaucagccaugugacggcaaaagccgccuggcccagcccuguuccucaguccauauaugggcagcgacgucacggguauugaagaccugcccauaaauacuuagagcaacacuuuccgucuaacugagcgaggagcaauugauuaauagcucggcgaggggacucacugacuguuauaauaacacuacaccagcaacuccuggcuucccagcagccggaacacagacaggagagagucaguggcaaauagacauuuuucuuauuucuuaaaaaacagcaacuuguuugcuacuuuuauuucuguugauuuuuuuuucuugguguguguggugguuguuuuuaaguguggagggcaaaaggagauaccaucccaggcucaguccaaccccucuccaaaacggcuuuucugacacuccagguagcgagggaguugggucuccagguugugcgaggagcaaaugaugaccgccaaggccguagacaaaaucccaguaacucucagugguuuugugcaccagcugucugacaacaucuacccgguggaggaccucgccgccacgucggugaccaucuuucccaaugccgaacugggaggccccuuugaccagaugaacggaguggccggagguaagccgcgugucuucgcaggcccggaccugcgcggcccggaggugguggauggggugcagugggugugcgggaaucgcaggagaggauuggggcuccagguggacggugcugacugcacuggcuuugaagacuggaagugggugcaggaggaaccugcgacagcugagaccagggcgcgcgggcagaugcgccaggucgccagcaaaccggcgugcgugcgccccggcgcgcccagccccgggcgagcgcagggauggggguggaagaggcguccccccggguuucgaggcuugcguaggcccucuggccggcagcacuucgaccuccccucucccggggcaggggcaaagugacgguaaaguucggggcucucggggagagcugcgcgccuggagagccgagcggcggagaagcgccaggggaaagcgucgguagcucccuccugggcagagccgaccccgggaaaaucucggagcgcucccuucuugcggccuggaggcgcgcccccaccugcccgccgcccgcgaaguugaggggguuaguaaggcgggggcuccggccggcggaggcagcgagugggugguggaggagggcgcgcaacggcgggaagcagcccccggacugccgagggaggcccgcgggggcaccggcgacgccgguuuccuuggcgaugcuguggaaagucgucucucgcggcccccgcgccuuccucgaggccgggccacuggccuugggcugaggcggggacgcgcggcugucgggaaaggcggagaagauugggagggcacggaaaccuacggacuccuuccucuacaucccccauucgcuccagcagcccucggcugaagcgcagcgggagagggagggagaaaaaggcacaaggcgccggggauggggagcagccgggaaaucacccacccccuucucgggcucuccucucgguuuggcaccaucacggcacugacugggauaggucgauucuugggugguguuugucuuggugccucagccguggaacccccaggcaaaaaagagggagaaaagcuccgggcggaugaggcuuuuuaaaauauuguuguugcuauuauuggguguuuuuuauuggggacuagagccacagauggcuggggguggaggggaguugggaaaagcucauucugcuuuuuuggagguaguucuugaguuccauacugucaauggguugccacaguugggcuggccucuucuuacagucugugggccucaauuuccccaccuuuuggacuuugccacagcucuacagugcugagacucucggccuuggaaauggaccuaugugagcgggggugagaagggaguccuggcuguauuuucauuguuccaccuccauucugccuuuccccuccccagauggcaugaucaacauugacaugacuggagagaagaggucguuggaucucccauaucccagcagcuuugcucccgucucugcaccuagaaaccagaccuucacuuacaugggcaaguucuccauugacccuc

SEQ ID NO: 19844 - RNA, 2516 nt, Homo sapiens
gagggucaauggagaacuugcccauguaagugaaggucugguuucuaggugcagagacgggagcaaagcugcugggauaugggagauccaacgaccucuucucuccagucaugucaauguugaucaugccaucuggggaggggaaaggcagaauggagguggaacaaugaaaauacagccaggacucccuucucacccccgcucacauagguccauuuccaaggccgagagucucagcacuguagagcuguggcaaaguccaaaagguggggaaauugaggcccacagacuguaagaagaggccagcccaacuguggcaacccauugacaguauggaacucaagaacuaccuccaaaaaagcagaaugagcuuuucccaacuccccuccacccccagccaucuguggcucuaguccccaauaaaaaacacccaauaauagcaacaacaauauuuuaaaaagccucauccgcccggagcuuuucucccucuuuuuugccuggggguuccacggcugaggcaccaagacaaacaccacccaagaaucgaccuaucccagucagugccgugauggugccaaaccgagaggagagcccgagaagggggugggugauuucccggcugcuccccauccccggcgccuugugccuuuuucucccucccucucccgcugcgcuucagccgagggcugcuggagcgaaugggggauguagaggaaggaguccguagguuuccgugcccucccaaucuucuccgccuuucccgacagccgcgcguccccgccucagcccaaggccaguggcccggccucgaggaaggcgcgggggccgcgagagacgacuuuccacagcaucgccaaggaaaccggcgucgccggugcccccgcgggccucccucggcaguccgggggcugcuucccgccguugcgcgcccuccuccaccacccacucgcugccuccgccggccggagcccccgccuuacuaacccccucaacuucgcgggcggcgggcaggugggggcgcgccuccaggccgcaagaagggagcgcuccgagauuuucccggggucggcucugcccaggagggagcuaccgacgcuuuccccuggcgcuucuccgccgcucggcucuccaggcgcgcagcucuccccgagagccccgaacuuuaccgucacuuugccccugccccgggagaggggaggucgaagugcugccggccagagggccuacgcaagccucgaaacccggggggacgccucuuccacccccaucccugcgcucgcccggggcugggcgcgccggggcgcacgcacgccgguuugcuggcgaccuggcgcaucugcccgcgcgcccuggucucagcugucgcagguuccuccugcacccacuuccagucuucaaagccagugcagucagcaccguccaccuggagccccaauccucuccugcgauucccgcacacccacugcaccccauccaccaccuccgggccgcgcagguccgggccugcgaagacacgcggcuuaccuccggccacuccguucaucuggucaaaggggccucccaguucggcauugggaaagauggucaccgacguggcggcgagguccuccaccggguagauguugucagacagcuggugcacaaaaccacugagaguuacugggauuuugucuacggccuuggcggucaucauuugcuccucgcacaaccuggagacccaacucccucgcuaccuggagugucagaaaagccguuuuggagagggguuggacugagccugggaugguaucuccuuuugcccuccacacuuaaaaacaaccaccacacacaccaagaaaaaaaaaucaacagaaauaaaaguagcaaacaaguugcuguuuuuuaagaaauaagaaaaaugucuauuugccacugacucucuccugucuguguuccggcugcugggaagccaggaguugcugguguaguguuauuauaacagucagugaguccccucgccgagcuauuaaucaauugcuccucgcucaguuagacggaaaguguugcucuaaguauuuaugggcaggucuucaauacccgugacgucgcugcccauauauggacugaggaacagggcugggccaggcggcuuuugccgucacauggcugauuugcauacacgggcucggccgcgcggacuccgccgggcucgcgacuuccagcucgcaggcggcggggaucgcuggggucccgggcgcgcggcccuagcugcagccuggguccggggcgcagggaucgcgggggagagggcgcgccauggacccagucacagccacagcaggagagcgagcugcuccaggcugcggcucagccucccggggcggggaggaauuccgguucucugggacuuuccaaaaaaggcgaagauccggugccggcggcuccgccucccuagcccuuguuugggagccauuccggaaaauuaaacuucggaaagaaaccgagcggagccgagacacuacagucaaaccccuacu

SEQ ID NO: 19845 - RNA, 2919 nt, Homo sapiens
cucaccgccaccccugaaacugaagacccccaaacccacuuuaauuccuggagacggccccucgauccacccaaaaggcugccaccaccucgaacccacaccccugucccgguuccgcccuggguccagccacaucuccccaaaugcauucucuggcuccggaaggggacccgggcgcucgcccccaacugccccccgcagcggccgggcccggcgccugcccaccccgcgcgggacacggccucgcccccgccacucccgcgccgcgccccgccccgcgccccgccccgcccgcggcccgcgggaccuuuauagggagcgccggccgcgcgcugggaagucggugccgcugccgucucugcguucgccaugcgucccggggcgccagggccacucuggccucugcccuggggggcccuggcuugggccgugggcuucgugagcuccaugggcucggggaaccccgcgcccggugaguggggcggccagaggggcgggcggggcgggccacccacguggggcugcgcggaaugcggccggggggacgucggggggcgcggcggcggcggcgggggcgagggcgguguccggcgcaagcuggagccgggaaggucugaaggagggucaccaagaggucagcagagcagagguuucuaaucacaaugaccgcugacauuuauugagcgcuuagugucuaccucuccccucccugaaccugugccaucccgauagugccggagcucucuucaucuccgucuuccagauggggaaacugaggcucagggucacacagccuguagcaggcaaagccaggguucuagccgcgaccguccgggucgguccuggugccgagagguagugcugggugucgggagccaggcccuccagcuggggcugagagcuuucccggguccuggguagacggggcauggagucucacaccugggacuugccgggaggugccaggcaggagacggccccacuccuggccucaguuuccccuccuaugaugggugccaaggugcugcguuccacaagcuggucccuggcagugucugugaaccagcaagcgcucugggaugggggcuguggccguuccugcccccagggacgggggaagaaauggggggcucucuggcuccccaccccccaucccugcagccccaccccaccccagcccugcgccaaagggagagcagagcccccuccccgaaggccacgucccuggggagacagugagcucaugcaaggggaauguucccaaguuggagugaguaagaggcgggccaggcggugggggggcugccaggcgcggggcuccgcgugcccucgcccucgggugcugucuagacagagggcagaggcgggagaagcggcuccagggccugcugacccugacaugcccagugccugguguuuggugguguuugagggguugggcagggugccagccccuggccugggggcuuggaggguacgggaagggaccuccugggguggguggggguugguggugaggcugugggggggggcacguggagcucagaggggaggagacauuuccaggguucuggagccaggguggggacacccaugugguuuucugccccuucuuccuggguggggguagaucauuccgugcguaacuacucagcaccaccugcaugcaucugugggcgggccagaagcugggugucaggaguggcccaggagagcaccccguuccccggcccgcaggugguguuugcuggcuccagcagggccaggaggccaccugcagccuggugcuccagacugaugucacccgggccgagugcugugccuccggcaacauugacaccgccugguccaaccucacccacccggggaacaagaucaaccuccucggcuucuugggccuuguccacugccuucccugcaaaggugagaccucaggccagaagcagggcagacgucucagcucaggaccagccacaaacagucaugguggucgagggccgaacguccagggacugagcccgucacagggguauguaggaggcugcagggggaucccagccucagagagggacuggggggacuucccgguucccaggcuccagccucuugcagcucaggacucaggaagagaccacguggcuccagccuuugcuggggcugagcucucugccuggguggcucuucccaccuggucgauaaaugucuggcuugcaccuagcuccugggaagguggguuugccauucuggccugugaccccaaauguccacaccagggaccuucacugcagacuccagggucugcggugggguuacagcugcauguuuaacaagcauuugccucgggacccuguuuugagaggaugccucccacaucagacuaggggcucuugguuggcgaguggcacagaacgaaugaauaagauucuccgcacuggaggaugaugguuuuuuuuuuuuuuuuuuuuuuuuuuccugagauggagccucgcucugucacccaggcuggagugcaguggugcgauuuuggcucacugcaacuucggccuccgagguucaggugauucucuuuccucggccuccccaggggcugggacugcaggcgcgcgccaccacaccuggcuaauuuuuauguuuuugguagagacaggguuucaccacauuggccaggcuggucucaaacuccugaccucaagugaucugccagccuuggccucccaaagugcugggauuacaggcgugagccaccaugccuggccuguuggggcacaucuugaaggaggugggcauuagagcugggguguugggggaugucuaggaguuugccagauggggccgguaugggagaguggaucaggagagaacauggcuugagguuagguccugguggguggggucaggcagaggagccaaggggaggcu

SEQ ID NO: 19846 - RNA, 2919 nt, Homo sapiens
agccuccccuuggcuccucugccugaccccacccaccaggaccuaaccucaagccauguucucuccugauccacucucccauaccggccccaucuggcaaacuccuagacaucccccaacaccccagcucuaaugcccaccuccuucaagaugugccccaacaggccaggcaugguggcucacgccuguaaucccagcacuuugggaggccaaggcuggcagaucacuugaggucaggaguuugagaccagccuggccaauguggugaaacccugucucuaccaaaaacauaaaaauuagccaggugugguggcgcgcgccugcagucccagccccuggggaggccgaggaaagagaaucaccugaaccucggaggccgaaguugcagugagccaaaaucgcaccacugcacuccagccugggugacagagcgaggcuccaucucaggaaaaaaaaaaaaaaaaaaaaaaaaaaccaucauccuccagugcggagaaucuuauucauucguucugugccacucgccaaccaagagccccuagucugaugugggaggcauccucucaaaacagggucccgaggcaaaugcuuguuaaacaugcagcuguaaccccaccgcagacccuggagucugcagugaaggucccugguguggacauuuggggucacaggccagaauggcaaacccaccuucccaggagcuaggugcaagccagacauuuaucgaccaggugggaagagccacccaggcagagagcucagccccagcaaaggcuggagccacguggucucuuccugaguccugagcugcaagaggcuggagccugggaaccgggaaguccccccagucccucucugaggcugggaucccccugcagccuccuacauaccccugugacgggcucagucccuggacguucggcccucgaccaccaugacuguuuguggcugguccugagcugagacgucugcccugcuucuggccugaggucucaccuuugcagggaaggcaguggacaaggcccaagaagccgaggagguugaucuuguuccccgggugggugagguuggaccaggcggugucaauguugccggaggcacagcacucggcccgggugacaucagucuggagcaccaggcugcagguggccuccuggcccugcuggagccagcaaacaccaccugcgggccggggaacggggugcucuccugggccacuccugacacccagcuucuggcccgcccacagaugcaugcagguggugcugaguaguuacgcacggaaugaucuacccccacccaggaagaaggggcagaaaaccacauggguguccccacccuggcuccagaacccuggaaaugucuccuccccucugagcuccacgugcccccccccacagccucaccaccaacccccacccaccccaggaggucccuucccguacccuccaagcccccaggccaggggcuggcacccugcccaaccccucaaacaccaccaaacaccaggcacugggcaugucagggucagcaggcccuggagccgcuucucccgccucugcccucugucuagacagcacccgagggcgagggcacgcggagccccgcgccuggcagcccccccaccgccuggcccgccucuuacucacuccaacuugggaacauuccccuugcaugagcucacugucuccccagggacguggccuucggggagggggcucugcucucccuuuggcgcagggcuggggugggguggggcugcagggaugggggguggggagccagagagccccccauuucuucccccgucccugggggcaggaacggccacagcccccaucccagagcgcuugcugguucacagacacugccagggaccagcuuguggaacgcagcaccuuggcacccaucauaggaggggaaacugaggccaggaguggggccgucuccugccuggcaccucccggcaagucccaggugugagacuccaugccccgucuacccaggacccgggaaagcucucagccccagcuggagggccuggcucccgacacccagcacuaccucucggcaccaggaccgacccggacggucgcggcuagaacccuggcuuugccugcuacaggcugugugacccugagccucaguuuccccaucuggaagacggagaugaagagagcuccggcacuaucgggauggcacagguucagggaggggagagguagacacuaagcgcucaauaaaugucagcggucauugugauuagaaaccucugcucugcugaccucuuggugacccuccuucagaccuucccggcuccagcuugcgccggacaccgcccucgcccccgccgccgccgccgcgccccccgacguccccccggccgcauuccgcgcagccccacguggguggcccgccccgcccgccccucuggccgccccacucaccgggcgcgggguuccccgagcccauggagcucacgaagcccacggcccaagccagggccccccagggcagaggccagaguggcccuggcgccccgggacgcauggcgaacgcagagacggcagcggcaccgacuucccagcgcgcggccggcgcucccuauaaaggucccgcgggccgcgggcggggcggggcgcggggcggggcgcggcgcgggaguggcgggggcgaggccgugucccgcgcggggugggcaggcgccgggcccggccgcugcggggggcaguugggggcgagcgcccggguccccuuccggagccagagaaugcauuuggggagauguggcuggacccagggcggaaccgggacagggguguggguucgaggugguggcagccuuuuggguggaucgaggggccgucuccaggaauuaaaguggguuugggggucuucaguuucagggguggcggugag

SEQ ID NO: 19847 - RNA, 2370 nt, Homo sapiens
gggcaggccccgggggacgagccugagacggggugggccggggcagggggcgggcgcaggcuggagacccccgcccaguccccgcgcggccggggcacggcgggagggggcgcccgcggcccucccgacgcucgggcgggacaaaggccggagcccgggccccuccccggcgggugcggcggcggcggcccgcgcuccgacaguccgcgcggccggguccugcgcccggggcgaccccggcgccccgccccgccgccgccugacuucucggcgcccgaggucgcgcgcgcggaggcgggggcggcccgggaucuccaagcgccgccgcgcccuccucccgcccgcccuccgcccgcccgcucggcggcggcggcggcggcggaggaggcggagaaggcuggcaggcggcggccgggagagcgagcgcggcggccggaccggggccauggcgcccgcgcagcgcccgcugcucccgcugcugcuccugcuguuaccgcugccgccgccgcccuucgcgcgcgccgaggacgccgcccgcgccaacucggaccgcuacgccgucuacuggaaccgcagcaaccccaggugagcgcggccgcgcgcggggggcgcccggggaccccccaacgccccccaagccgcgcccggccucgcgcccccggagcuccgggcgccccccacgcgcgcgccgccgccgggaugcgggcgcccgguucccgcgggagccccccagggagcuccggccccccggaguuugggggacucgcccuuuucgcgccugccuuccccggggcgccccauugcccuacggacuguggggacucgcgccccacaucccccagagcgccgacgucuccuggaguuuggggaaccccucugguacccuccgaugccggguagccccugaguugccugccuggacuuggggggaccccugauccacccgcuucucuggggagcccccucgguuucgcauuugguggggauccccggggaccuuggcaccggaggugggggacuguggcccucgagggaucucuggguucguccugcccgcagguccccagaugaacuuggggaaguuggagugucccucccucaggacccagcaucugcuucacuccagggggccaagggcccagcuuugaaaggagacugaggggccggggagcugggggucagccccgggaggggcagugggauggaguccucucuuguccucugggcgcugaccaggaaacugaggugcagaggggaugaggagcuggcucaaggucaugcaagggggggacuugggggcaggacccagguggcccagugcccugccugccacgcccggccgagaugccgcacccgccugcugcaggcccccuuguuuugaaccagguccgggccaggcacaacgugggggacaggagaagcccccguuggucagagcaaaaaaaguuugccggggccuggccauggccuggacguggguagaacccucugaaccaucccagggucuccaagacaggagcaggcugcagcuucccugggggucccgugggagccggggcuuuggggguccuggggcucgggagggagucagccccagcacucagggugucaccgucuuccuaaggcacacggagcugcacaucgggggcugaggcggcccccccccacucuucugcuacuggucacuuucucuccguuuuccagccgcuuccugugccgaccgagccgcccucuggagcccgccaccccuccuuguccccucugucuccugcuguccucgguccccgggaggaaaguugcaugaaggggucucuuugaggcgggcucggggacaagggcggcccguguuccgccguggggguggggaacacgcacaggcccaccccccacccuggucaacggccucgggucgggcccugggggcugagggcagggaccccgggccgcugggggacggcuggcccaccucagagcggguccccgagccgcccgcugugcuggucacauguggguuugauuaaggcugucgcuggccgugcggggaguccagcgggcagcgcuuccccggcccaaguuuuugguuucagcugcggaaucucccguccccagcguggccuguccuuuguucuagcaaacgccaaacacacgaggacccggcaaccgggggaggaagguggucaccagggccguccugcugccccaccugccacagggcugugggcugcgggccggacccccggccaggggaaggaaguggccuccccagugccuggcuuggcccagccaccuccuguugcuccgggucugaccugguugcccagcucaaaccgcugccugagggaacggccuugcugguccgcagagccgacc

SEQ ID NO: 19848 - RNA, 2370 nt, Homo sapiens
ggucggcucugcggaccagcaaggccguucccucaggcagcgguuugagcugggcaaccaggucagacccggagcaacaggagguggcugggccaagccaggcacuggggaggccacuuccuuccccuggccggggguccggcccgcagcccacagcccuguggcagguggggcagcaggacggcccuggugaccaccuuccucccccgguugccggguccucguguguuuggcguuugcuagaacaaaggacaggccacgcuggggacgggagauuccgcagcugaaaccaaaaacuugggccggggaagcgcugcccgcuggacuccccgcacggccagcgacagccuuaaucaaacccacaugugaccagcacagcgggcggcucggggacccgcucugaggugggccagccgucccccagcggcccggggucccugcccucagcccccagggcccgacccgaggccguugaccaggguggggggugggccugugcguguuccccacccccacggcggaacacgggccgcccuuguccccgagcccgccucaaagagaccccuucaugcaacuuuccucccggggaccgaggacagcaggagacagaggggacaaggagggguggcgggcuccagagggcggcucggucggcacaggaagcggcuggaaaacggagagaaagugaccaguagcagaagagugggggggggccgccucagcccccgaugugcagcuccgugugccuuaggaagacggugacacccugagugcuggggcugacucccucccgagccccaggacccccaaagccccggcucccacgggacccccagggaagcugcagccugcuccugucuuggagacccugggaugguucagaggguucuacccacguccaggccauggccaggccccggcaaacuuuuuuugcucugaccaacgggggcuucuccugucccccacguugugccuggcccggaccugguucaaaacaagggggccugcagcaggcgggugcggcaucucggccgggcguggcaggcagggcacugggccaccuggguccugcccccaagucccccccuugcaugaccuugagccagcuccucauccccucugcaccucaguuuccuggucagcgcccagaggacaagagaggacuccaucccacugccccucccggggcugacccccagcuccccggccccucagucuccuuucaaagcugggcccuuggcccccuggagugaagcagaugcuggguccugagggagggacacuccaacuuccccaaguucaucuggggaccugcgggcaggacgaacccagagaucccucgagggccacagucccccaccuccggugccaagguccccggggauccccaccaaaugcgaaaccgagggggcuccccagagaagcggguggaucagggguccccccaaguccaggcaggcaacucaggggcuacccggcaucggaggguaccagagggguuccccaaacuccaggagacgucggcgcucugggggauguggggcgcgaguccccacaguccguagggcaauggggcgccccggggaaggcaggcgcgaaaagggcgagucccccaaacuccggggggccggagcucccuggggggcucccgcgggaaccgggcgcccgcaucccggcggcggcgcgcgcguggggggcgcccggagcuccgggggcgcgaggccgggcgcggcuuggggggcguugggggguccccgggcgccccccgcgcgcggccgcgcucaccugggguugcugcgguuccaguagacggcguagcgguccgaguuggcgcgggcggcguccucggcgcgcgcgaagggcggcggcggcagcgguaacagcaggagcagcagcgggagcagcgggcgcugcgcgggcgccauggccccgguccggccgccgcgcucgcucucccggccgccgccugccagccuucuccgccuccuccgccgccgccgccgccgccgagcgggcgggcggagggcgggcgggaggagggcgcggcggcgcuuggagaucccgggccgcccccgccuccgcgcgcgcgaccucgggcgccgagaagucaggcggcggcggggcggggcgccggggucgccccgggcgcaggacccggccgcgcggacugucggagcgcgggccgccgccgccgcacccgccggggaggggcccgggcuccggccuuugucccgcccgagcgucgggagggccgcgggcgcccccucccgccgugccccggccgcgcggggacugggcgggggucuccagccugcgcccgcccccugccccggcccaccccgucucaggcucgucccccggggccugccc

SEQ ID NO: 19849 - RNA, 1781 nt, Homo sapiens
gcccccccccccgcucccacgguggguaacacggugugaauuucuucacugguuuuucuucucccgccccuccgggaggggguggggacccuguuuuaaggcacugggcgccuccccacccggccucaguuuccccaacggcccagggacugaaggaagggggcgggugcccgggggccggggggggcgcgggcgcggggaggggcggugcgcgggggugggcgcggggcgggccgcgggcgcgugggggcggcggcgccaccuuaaggcggcucagcccgcggcucccggccgagccccgccggagggaggcggcuccgcgcggggcccgccgcccgcgccgccgccaccgaaacccggccgcggcgcgcccgaccuucugcgccggcugccgcggccgcccucgccgcgcucccgccccggccgcugccccugcccgccccgcucgccccgcgcaccccaacccggggaggggcucccacgaccccgggcgcgcgcgcuugggggcgcgccagggacuccagggucccuugccccgcgccgcuucucccuccucccucuuucuucgggcagccuccccaccaccccacuucagccucccccacucuugccgccuccauaucaucaagcucugguggcgccuggggggcuuuucggaucggcaggauguacccccagggaaggcacccggugagugcggacugcggggagggggcccccaguguccgggaacucagacccugacguuucccccacaccccccccagaccccgcuccaguccggccagcccuucaaguucucgaucuuggagaucugcgaccgcaucaaagaagaauuccaguuucuucaggcucaauaccacaggugaggggggccgccccaggggccgcgggaguucaccugggcgccggggcggggcgaggccuccgggguauagggcggggaggaggggcucccgguuggagggggggcgcgacaaaggccuccagguggaagcgcaggugcagaggggucuggggacagucagagcuggggcauuuggagcccaggaaggggcggggagggacugggacaggagguggggggaggucuguaaggaagucgggagggggagauccagccucucacuuuggaagccggcccacauggggcgggugggagccccuugcccucucucuucuucucagccucaagcuagaaugugagaagcuggccagcgagaagacggaaaugcagcgacauuaugucauggugagggcacuuaugaugccagggugaggggagaggcgggcagggcuuugagucacgguggacucugggguaggucccugccccacuccgaaccucgucuuccccgucuguacauugggcagguugggauuucaggcucucuaggaggguccucccagcucugggaauggggagacagggaggaccccucgccugaugggagucucugucgggccagggccucuggacacuuccuaccugcccugccucucuggggagaguagagggggcccuuccaggcagagcccccgcuuccuccucugggaccccguggagcuggggggggcucugcuuccugcugugauuccccugaaccuggggacucuuggaagacccuggcaucaccuaucuggaggagggcacccaucuccacccuagacguucuuacuugguuuuuccuuugcaguauuaugagaugucguacgggcucaacauugaaaugcauaagcagguaacuggguugggguuacgcguguucaggagggagggu

SEQ ID NO: 19850 - RNA, 1781 nt, Homo sapiens
acccucccuccugaacacgcguaaccccaacccaguuaccugcuuaugcauuucaauguugagcccguacgacaucucauaauacugcaaaggaaaaaccaaguaagaacgucuaggguggagaugggugcccuccuccagauaggugaugccagggucuuccaagaguccccagguucaggggaaucacagcaggaagcagagccccccccagcuccacggggucccagaggaggaagcgggggcucugccuggaagggcccccucuacucuccccagagaggcagggcagguaggaaguguccagaggcccuggcccgacagagacucccaucaggcgagggguccucccugucuccccauucccagagcugggaggacccuccuagagagccugaaaucccaaccugcccaauguacagacggggaagacgagguucggaguggggcagggaccuaccccagaguccaccgugacucaaagcccugcccgccucuccccucacccuggcaucauaagugcccucaccaugacauaaugucgcugcauuuccgucuucucgcuggccagcuucucacauucuagcuugaggcugagaagaagagagagggcaaggggcucccacccgccccaugugggccggcuuccaaagugagaggcuggaucucccccucccgacuuccuuacagaccuccccccaccuccugucccagucccuccccgccccuuccugggcuccaaaugccccagcucugacuguccccagaccccucugcaccugcgcuuccaccuggaggccuuugucgcgcccccccuccaaccgggagccccuccuccccgcccuauaccccggaggccucgccccgccccggcgcccaggugaacucccgcggccccuggggcggccccccucaccugugguauugagccugaagaaacuggaauucuucuuugaugcggucgcagaucuccaagaucgagaacuugaagggcuggccggacuggagcggggucuggggggggugugggggaaacgucagggucugaguucccggacacugggggcccccuccccgcaguccgcacucaccgggugccuucccuggggguacauccugccgauccgaaaagccccccaggcgccaccagagcuugaugauauggaggcggcaagagugggggaggcugaaguggggugguggggaggcugcccgaagaaagagggaggagggagaagcggcgcggggcaagggacccuggagucccuggcgcgcccccaagcgcgcgcgcccggggucgugggagccccuccccggguuggggugcgcggggcgagcggggcgggcaggggcagcggccggggcgggagcgcggcgagggcggccgcggcagccggcgcagaaggucgggcgcgccgcggccggguuucgguggcggcggcgcgggcggcgggccccgcgcggagccgccucccuccggcggggcucggccgggagccgcgggcugagccgccuuaagguggcgccgccgcccccacgcgcccgcggcccgccccgcgcccacccccgcgcaccgccccuccccgcgcccgcgccccccccggcccccgggcacccgcccccuuccuucagucccugggccguuggggaaacugaggccggguggggaggcgcccagugccuuaaaacaggguccccacccccucccggaggggcgggagaagaaaaaccagugaagaaauucacaccguguuacccaccgugggagcgggggggggggc

SEQ ID NO: 19851 - RNA, 2644 nt, Homo sapiens
cucgcucccuggggguuuggggcaacuuccccgcuacgucgcccagggauuuuaaauaauugccagccaccagaaacccccuaacccuuaauucuucccuccgagacccagcccgcugcuugccacuucccucuccaaacgcuggcggggguggguggcagcaccgaggcgauuuucuucgucuuuuuuuccuccggguuuugucauggaaacgcugacacaaccuccagacggcggccgagcccggccggggacugagggcuuuugggacccugcgggagcgcggcgcgcacaccgcacuccccgggcaacagcuggacgcgaccauaucccggguaggggcggggggagcgcgacgcuccgccccggcgcuagggucccucccuccucccggcucuccgcaggcgcccuccccucgccgggggccgcgaguugcauuugguaaaacccagccccggaauauauagaucguuggagcgcaaugaaguagccuuuggagagaagggagagggcccgucggacagccacagcggccagcgcagcggcagcggcggcggcaccaccaucaccgcucgcaccccagccgcccggcccgcgaccaggcagcggcggccgccggcgggaucggaggaggcggcggagcggcgaggaggaggagcaggagcgcgcagccagcggguccacgcaucucagcacuuccagaccaacuccggcaccuuccacaccccugcccgggcugggggcuccgagagcggccgcgaagcgacuccgauccucccucugagccuugcucagcucugccccgcgccucccgggcuccgguccgcgcggcggggucccugcuccugcgccccgggcgcgcuucccggacaccccgguccccgcagccaggacaaagccaugaagccagcgcugcuggaagugaugaggaugaacagaaucugccggauggugcuggccacuugcuugggauccuuuauccuggucaucuucuauuuccaaaguauguugcacccagguagggggcgcguuagcgugguuuuguuggauauuuucuucucucucgcgcucuagcucgcuccgccugauuucugccucuuccaacccuaccucuccgccuucggccucuucggggcuccuggcugcccagagcuccuggcugcccagaucuacccgggucaccgcgucgggauggggaggagaagggaaggugugcuucgcccucuucuuccuaccggcuccgggcuggaggaugggaccaggaggggcgguaguuuuuuuuuuuuuuuuuuucuucuucuuuuuuucuuugugucccuugucugucugucugcgagguagcagggaaacggagaggugugggaagcaaccgggggugaggggcugguuugaggagaacgaaacucccucccugcugcugccgaggucggaggaugaaagaguuacccggagccggcugcucugcgcccgggcgagccgccucuuccugguugccgggccgggggcgaaggguguacgccccggcgagguugcgagucccugcagcaggcugggagcccgggacugggcucccacgugucccgggcuccgcgcagagcugagcagguguggagaguggucgggugcccagcguugccccuccaccacgcgccggccguuugcccccgggguccggguccgcagugaccuugcggcuggugccccggggccugcuccagcccccagcccugagcuggaaacuccgagcuccugggucacgccuugaccacugcaguuuuggaggaaacuuuggccagguccugggcugaccguccguuugcaucccccacuucugggauccgagcaacgggaaucccccgggcggcgugggaaugaaccccauuccuccggucccuuguggcucaggcaaaguuccacguccgaaaucuggacugggggagggacgaggcucgucgcuuccuaggggugcgagggaaaguuuggguucuggagagggaggggcgcccucgagcgcggcggccgggggugagcagcucggcugcgaagcccaacagguagaacguuccgagaagccuuccggguaacgcgggucuccccgccaagccguggcuccccugcucccuuuuacccucccuuagcagcccccugccgggccacguuggcucagaaauccauuuucuacgccuccgaguugccuuucucagcguagucacagcaauaauuugcuuuucuaauugcaaggaggagggagguggaaacgcauuuccuuccagggaagugggguugguguuuuucauuuuugccucccgccuucuccuuucacuguguaucuaacacuuuaaacagacgcagucccgaauucaucaagccugcguuugggucgauggcagaggaauaaagcuguucuuuccaucaaacaggcagggcugcaggcugcagauuccuugacagcgcagggacagacggccccuuugccccacucggucuggagcaguuguuaaggcagccacacugccaaggauaugguccgacucuaccacauguaaccucaggacguccgagccagcccuguuaaagauggcuuuuguuugcagcuggguauuuuuaguuuaaugucagcaaacuacagcgguguuugucuccu

SEQ ID NO: 19852 - RNA, 2644 nt, Homo sapiens
aggagacaaacaccgcuguaguuugcugacauuaaacuaaaaauacccagcugcaaacaaaagccaucuuuaacagggcuggcucggacguccugagguuacaugugguagagucggaccauauccuuggcaguguggcugccuuaacaacugcuccagaccgaguggggcaaaggggccgucugucccugcgcugucaaggaaucugcagccugcagcccugccuguuugauggaaagaacagcuuuauuccucugccaucgacccaaacgcaggcuugaugaauucgggacugcgucuguuuaaaguguuagauacacagugaaaggagaaggcgggaggcaaaaaugaaaaacaccaaccccacuucccuggaaggaaaugcguuuccaccucccuccuccuugcaauuagaaaagcaaauuauugcugugacuacgcugagaaaggcaacucggaggcguagaaaauggauuucugagccaacguggcccggcagggggcugcuaagggaggguaaaagggagcaggggagccacggcuuggcggggagacccgcguuacccggaaggcuucucggaacguucuaccuguugggcuucgcagccgagcugcucacccccggccgccgcgcucgagggcgccccucccucuccagaacccaaacuuucccucgcaccccuaggaagcgacgagccucgucccucccccaguccagauuucggacguggaacuuugccugagccacaagggaccggaggaaugggguucauucccacgccgcccgggggauucccguugcucggaucccagaagugggggaugcaaacggacggucagcccaggaccuggccaaaguuuccuccaaaacugcaguggucaaggcgugacccaggagcucggaguuuccagcucagggcugggggcuggagcaggccccggggcaccagccgcaaggucacugcggacccggaccccgggggcaaacggccggcgcgugguggaggggcaacgcugggcacccgaccacucuccacaccugcucagcucugcgcggagcccgggacacgugggagcccagucccgggcucccagccugcugcagggacucgcaaccucgccggggcguacacccuucgcccccggcccggcaaccaggaagaggcggcucgcccgggcgcagagcagccggcuccggguaacucuuucauccuccgaccucggcagcagcagggagggaguuucguucuccucaaaccagccccucacccccgguugcuucccacaccucuccguuucccugcuaccucgcagacagacagacaagggacacaaagaaaaaaagaagaagaaaaaaaaaaaaaaaaaaacuaccgccccuccuggucccauccuccagcccggagccgguaggaagaagagggcgaagcacaccuucccuucuccuccccaucccgacgcggugacccggguagaucugggcagccaggagcucugggcagccaggagccccgaagaggccgaaggcggagagguaggguuggaagaggcagaaaucaggcggagcgagcuagagcgcgagagagaagaaaauauccaacaaaaccacgcuaacgcgcccccuaccugggugcaacauacuuuggaaauagaagaugaccaggauaaaggaucccaagcaaguggccagcaccauccggcagauucuguucauccucaucacuuccagcagcgcuggcuucauggcuuuguccuggcugcggggaccgggguguccgggaagcgcgcccggggcgcaggagcagggaccccgccgcgcggaccggagcccgggaggcgcggggcagagcugagcaaggcucagagggaggaucggagucgcuucgcggccgcucucggagcccccagcccgggcagggguguggaaggugccggaguuggucuggaagugcugagaugcguggacccgcuggcugcgcgcuccugcuccuccuccucgccgcuccgccgccuccuccgaucccgccggcggccgccgcugccuggucgcgggccgggcggcuggggugcgagcggugaugguggugccgccgccgcugccgcugcgcuggccgcuguggcuguccgacgggcccucucccuucucuccaaaggcuacuucauugcgcuccaacgaucuauauauuccggggcuggguuuuaccaaaugcaacucgcggcccccggcgaggggagggcgccugcggagagccgggaggagggagggacccuagcgccggggcggagcgucgcgcuccccccgccccuacccgggauauggucgcguccagcuguugcccggggagugcggugugcgcgccgcgcucccgcagggucccaaaagcccucaguccccggccgggcucggccgccgucuggagguugugucagcguuuccaugacaaaacccggaggaaaaaaagacgaagaaaaucgccucggugcugccacccacccccgccagcguuuggagagggaaguggcaagcagcgggcugggucucggagggaagaauuaaggguuaggggguuucugguggcuggcaauuauuuaaaaucccugggcgacguagcggggaaguugccccaaacccccagggagcgag

SEQ ID NO: 19853 - RNA, 2739 nt, Homo sapiens
aaccguguuuguugaaugaauacagaaccccguuugcucugggagagcacagaaaacagucuucuaucauauaucauagccagcugcaaacagcagauggcuucccauaucccagagaguaagaaccagagagagagagaaagagagagaguuugggucuuucuccucugugccugcucucuccagagaaacuggagggguagcaguuagcauucccccgcugguuccaccaagcacagucaaggucucuaggacauggccaccccucaccuguggaagcgguccugcugggguggguggguguuaguugguucugguuugggucagagacacccaguggcccaggugggcguggggccagggcgcagacgagaaggggcacgagggcuccgcuccgaggacccagcggcaagcaccggucccgggcgcgccccagcccacccacucgcgugcccacggcggcauuauucccuauaaggaucugaacgauccgggggcggccccgccccguuaccccuugcccccggccccgcccccuuuuuggagggccgaugagguaaugcggcucugccauuggucugagggggcgggccccaacagcccgaggcgggguccccgggggcccagcgcuauaucacucggccgcccaggcagcggcgcagagcgggcagcaggcaggcggcgggcgcucagacggcuucuccuccuccucuugcuccuccagcuccugcuccuucgccgggaggccgcccgccgaguccugcgccagcgccgaggcagccucgcugcgccccaucccgucccgccgggcacucggagggcagcgcgccggaggccaagguugccccgcacggcccggcgggcgagcgagcucgggcugcagcagccccgccggcggcgcgcacggcaacuuuggagaggcgagcagcagccccggcagcggcggcagcagcggcaaugaccccuuggcucgggcucaucgugcuccugggcagcuggagccugggggacuggggcgccgaggcgugcacaugcucgcccagccacccccaggacgccuucugcaacuccgacaucgguaagcgcuccuggugccccgcccgagccccacgcugcagccaggacugcagcgcugcuuagggaggcagggcgagccccacuccuuuccucugccccaggagaggggcagacgggguuggggcggaguggagaaacucgauguccuugggcgggggcgcuggcauagcugagaggggaagaugcccugcagaggaaacucacaguggcugagggagccccuggccgccuuugcuuuccuaacuuaggucgugagguuccuaccgguccuuuugacaucuggaaaauguccccauucacuacuaacggaggaagggcuagaagagaaggguggggaaaggguucccaaaacuuggaaugcuaacuaaagugcugggaaauugaauaguuaaaaaaaaaaaaaaaaguugcccgccaugugcacggaaaguugcaggagaaacuuggaguacuccgagucugcaucaucuccugcgccuaugaaauucauucuuuucacugagacccaacccagcugcaggcuucccaggcaagcgcuaaccgagcuucugggacugccaaguuuggguggauuuaagggggaaaaugaggagaaagcuguggcauugacccacgcccuggaggcacuguguuugagaguguugauagccagcagaaggugcgaggggucacucaccacauagcugugaaaauucacaggaaggcuauuuuuuucccccuugaauguguguggggagggggagaauggguaguggaaaacagauuugucaccaaaagaacaaaccugccaagggucacaucacggugacaguuccagacuggacuuagugucuugaguagagagacccuguaaagagaccuccuacuccuuaguguguauggagggccccgagagcauccugggaggcuugucugggaguguuugggacacuuguguuuggauggcuaaagguggaguggcaucugggaaacaucucucuccuccuuuccagcccauaaagcgugcaaguccaguggcucugcugggagagugugugugugugcacugggcugggcugggcgguggggugggacagccuugccgcccucugccugugucgauucagaggugaagaauggagcguguguguuuuaaguacagucauaaaggagaaggaaauuuuccacugagucuugggugagggacucuaccagcguguuguggugaggagggggaggagguaggagcuuggcaggggaggcagugagggccgggaggggcacugcuggugggcugggcugagccuagaggucagaguggggguguggugaccagaaugucagugcaguuggcagcugaggguguuugugugaccugaggucacccuuguaagaggcucccuggggccugcaugguacauccuccccucuccugggggaacccagcuggcccaggauuuguggauugcuuagaaagauccuuuugggcagccugaagacuggggaggguuuuccucccuccuccaccuccacccacauuccacuuacccuuucccuccucaucccaguugguaacauucccaccugauuaguguggggaguugcugcugcagcugaguucugguuuugcccagcaggaucacacacgugcggccaggaggcuggcagguggaaucagggugu

SEQ ID NO: 19854 - RNA, 2739 nt, Homo sapiens
acacccugauuccaccugccagccuccuggccgcacgugugugauccugcugggcaaaaccagaacucagcugcagcagcaacuccccacacuaaucaggugggaauguuaccaacugggaugaggagggaaaggguaaguggaauguggguggagguggaggagggaggaaaacccuccccagucuucaggcugcccaaaaggaucuuucuaagcaauccacaaauccugggccagcuggguucccccaggagaggggaggauguaccaugcaggccccagggagccucuuacaagggugaccucaggucacacaaacacccucagcugccaacugcacugacauucuggucaccacacccccacucugaccucuaggcucagcccagcccaccagcagugccccucccggcccucacugccuccccugccaagcuccuaccuccucccccuccucaccacaacacgcugguagagucccucacccaagacucaguggaaaauuuccuucuccuuuaugacuguacuuaaaacacacacgcuccauucuucaccucugaaucgacacaggcagagggcggcaaggcugucccaccccaccgcccagcccagcccagugcacacacacacacucucccagcagagccacuggacuugcacgcuuuaugggcuggaaaggaggagagagauguuucccagaugccacuccaccuuuagccauccaaacacaagugucccaaacacucccagacaagccucccaggaugcucucggggcccuccauacacacuaaggaguaggaggucucuuuacagggucucucuacucaagacacuaaguccagucuggaacugucaccgugaugugacccuuggcagguuuguucuuuuggugacaaaucuguuuuccacuacccauucucccccuccccacacacauucaagggggaaaaaaauagccuuccugugaauuuucacagcuauguggugagugaccccucgcaccuucugcuggcuaucaacacucucaaacacagugccuccagggcgugggucaaugccacagcuuucuccucauuuucccccuuaaauccacccaaacuuggcagucccagaagcucgguuagcgcuugccugggaagccugcagcuggguugggucucagugaaaagaaugaauuucauaggcgcaggagaugaugcagacucggaguacuccaaguuucuccugcaacuuuccgugcacauggcgggcaacuuuuuuuuuuuuuuuuaacuauucaauuucccagcacuuuaguuagcauuccaaguuuugggaacccuuuccccacccuucucuucuagcccuuccuccguuaguagugaauggggacauuuuccagaugucaaaaggaccgguaggaaccucacgaccuaaguuaggaaagcaaaggcggccaggggcucccucagccacugugaguuuccucugcagggcaucuuccccucucagcuaugccagcgcccccgcccaaggacaucgaguuucuccacuccgccccaaccccgucugccccucuccuggggcagaggaaaggaguggggcucgcccugccucccuaagcagcgcugcaguccuggcugcagcguggggcucgggcggggcaccaggagcgcuuaccgaugucggaguugcagaaggcguccuggggguggcugggcgagcaugugcacgccucggcgccccagucccccaggcuccagcugcccaggagcacgaugagcccgagccaaggggucauugccgcugcugccgccgcugccggggcugcugcucgccucuccaaaguugccgugcgcgccgccggcggggcugcugcagcccgagcucgcucgcccgccgggccgugcggggcaaccuuggccuccggcgcgcugcccuccgagugcccggcgggacgggauggggcgcagcgaggcugccucggcgcuggcgcaggacucggcgggcggccucccggcgaaggagcaggagcuggaggagcaagaggaggaggagaagccgucugagcgcccgccgccugccugcugcccgcucugcgccgcugccugggcggccgagugauauagcgcugggcccccggggaccccgccucgggcuguuggggcccgcccccucagaccaauggcagagccgcauuaccucaucggcccuccaaaaagggggcggggccgggggcaagggguaacggggcggggccgcccccggaucguucagauccuuauagggaauaaugccgccgugggcacgcgagugggugggcuggggcgcgcccgggaccggugcuugccgcuggguccucggagcggagcccucgugccccuucucgucugcgcccuggccccacgcccaccugggccacugggugucucugacccaaaccagaaccaacuaacacccacccaccccagcaggaccgcuuccacaggugagggguggccauguccuagagaccuugacugugcuugguggaaccagcgggggaaugcuaacugcuaccccuccaguuucucuggagagagcaggcacagaggagaaagacccaaacucucucucuuucucucucucucugguucuuacucucugggauaugggaagccaucugcuguuugcagcuggcuaugauauaugauagaagacuguuuucugugcucucccagagcaaacgggguucuguauucauucaacaaacacgguu

SEQ ID NO: 19855 - RNA, 2548 nt, Homo sapiens
gcguguuagaggugaugggaguuacuauaacgcgugugcugcucccuucugccaggagcccacugcuuuugcacacaagcugcauuuugcgcauugacucaggucccaguugcucuucauaucuccgugaaugauuggagugcaaagauacuguucugagcgcuucccguuuucugaaagccaugucucucaggcaugccucgcuuaguuggcgaugggguugguugacuguuuucguuuuuuucuucuucucuuuucuucuucuucuucuuuuuuuuuucuuuuccuuuucucccccucccaacgccacugacaagaaagcacuaaagaugcagguugugcgaucacccuauaacauaaggaaaagaacaggagagguuaauuugaacguguaggcuagugguagagggagauggaggucuggggaaagagucugucagguagacaucucuuuuaacaugucccaguauucgguucaccaguaucucugcaccucacuacuacccuucacuccuuggagaccugggcaaggccauuuucagaggccagugcugaaacuaacaaacuaggacuugaaaucgaccaacuuucacaaauucuuuaaauaaaaauccccuuaucuccuuggagacauccccacuuccacagacacucagagggaggacgaaggcaagaauaccccccugcccaccccaaaaugcaaccuaccugcuuccaaaguccauucgcaccagggccugaccaggccgagccccucagaaccaguuggugaagucgagaagcuccugcuccucggggcugagcgggucguaagagcccucguccgacgaguaggaugagaccggcgagccggccauggaguucaagucguuggaguaguugggggagauggugggcgacaggacgccugccuggaaggcggcgcucaccgcgucaugcucguccagcagcugcugcagcgcgcggauguacucgaccgccgagcgcagugucuccaccuuacucaucuucuuguuggccgcgccguuggggacgugcucccgaaggguggcaaagcccagguugaccaacuugacgcgguugcgcucgcgcucguugcggcgcgccacggcggccggcugcugcugcggcaggcuguagccaaagccgcugaaguugagccggcguuugcagcgcaucaguucgggcgaagacgagcgcugucgcuugacuugcuugggcgcugacuugugaccgcccccugagggcuggccgucggccgccggucucagcugcggcgccugcugcugcugcugcugcugcugcugcugcugcugcgcgcucugcgcugccgcugcggcggcugcggccgccgcggcugcggccguggcaaagaaacaggcugcgggcggcaggaagggcugcuggggcugcggcuggggcugcuggccggcgccgccgcucuccaucuuggcagagcuuuccaugcgcagcggcggccaaggagucgcggaaucagagcgauccgggacgcgaggugcggggcccgcgagggggacacagagagaacuugggugcaggaacagagagggaaagaaaaggaaauaugaagcgggagcccugacggaaguuaaaaaauauauacaaaauccccgggagacuucuuagagugggagcaaaaaaagugaaaaugcuuuuucuccucccugcacgccgccuccuccucccuccccuccucccuucgcggguuggcuucgggagccucgcguggcgcucgcgugugaggcugccgcuggcgccuucuuguuucuaagaaaaaaaaaagcagaagcagcagcaaaagucagugcugaacgcgcucugccgcgucucgcguuccucuccuacuaaggcugcgcucucuugcgccgggucucggucucuccagccguggcucaggcuguuuuuauuauuuuguuaacucccuuccuuucugauuuccuucuuucacucgcccucccuggccggaucccugucggugcgccuuccacguucccuggccagaagugagagagugcugggcugccggagugcguccgccuuuucaaugggacacccagccccacgcgcagcccuggccccgccucgccccccacuccccgcugcugcagcgagcggcugcagcccccacuccccccccuccucuuaccucuuccucccacccacucccuaaacucccccuccuccucuccucucccccccucccguuccuuucucccgcuccuugcaaacucuccauucagcuggguuuguuguugcagugcgugcgccuggcgcgugccggacucccggcugaauaaacaggcggcgcgcucggggcgggcugcugccggggguggcuuuaggaaggggguggggggcgucacaggagggacaaauggcucuaggaauugagguguauagguggaaagacuuggggugaagcucucuuggauucuacuaagaacuugaagcaaagcgcagggaaggguuugggcagaaaaaauggcacaggaacgguguggaggugaggagggaguggggcucgacu

SEQ ID NO: 19856 - RNA, 2548 nt, Homo sapiens
agucgagccccacucccuccucaccuccacaccguuccugugccauuuuuucugcccaaacccuucccugcgcuuugcuucaaguucuuaguagaauccaagagagcuucaccccaagucuuuccaccuauacaccucaauuccuagagccauuugucccuccugugacgccccccacccccuuccuaaagccacccccggcagcagcccgccccgagcgcgccgccuguuuauucagccgggaguccggcacgcgccaggcgcacgcacugcaacaacaaacccagcugaauggagaguuugcaaggagcgggagaaaggaacgggagggggggagaggagaggaggagggggaguuuagggagugggugggaggaagagguaagaggaggggggggagugggggcugcagccgcucgcugcagcagcggggaguggggggcgaggcggggccagggcugcgcguggggcugggugucccauugaaaaggcggacgcacuccggcagcccagcacucucucacuucuggccagggaacguggaaggcgcaccgacagggauccggccagggagggcgagugaaagaaggaaaucagaaaggaagggaguuaacaaaauaauaaaaacagccugagccacggcuggagagaccgagacccggcgcaagagagcgcagccuuaguaggagaggaacgcgagacgcggcagagcgcguucagcacugacuuuugcugcugcuucugcuuuuuuuuuucuuagaaacaagaaggcgccagcggcagccucacacgcgagcgccacgcgaggcucccgaagccaacccgcgaagggaggaggggagggaggaggaggcggcgugcagggaggagaaaaagcauuuucacuuuuuuugcucccacucuaagaagucucccggggauuuuguauauauuuuuuaacuuccgucagggcucccgcuucauauuuccuuuucuuucccucucuguuccugcacccaaguucucucugugucccccucgcgggccccgcaccucgcgucccggaucgcucugauuccgcgacuccuuggccgccgcugcgcauggaaagcucugccaagauggagagcggcggcgccggccagcagccccagccgcagccccagcagcccuuccugccgcccgcagccuguuucuuugccacggccgcagccgcggcggccgcagccgccgcagcggcagcgcagagcgcgcagcagcagcagcagcagcagcagcagcagcagcaggcgccgcagcugagaccggcggccgacggccagcccucagggggcggucacaagucagcgcccaagcaagucaagcgacagcgcucgucuucgcccgaacugaugcgcugcaaacgccggcucaacuucagcggcuuuggcuacagccugccgcagcagcagccggccgccguggcgcgccgcaacgagcgcgagcgcaaccgcgucaaguuggucaaccugggcuuugccacccuucgggagcacguccccaacggcgcggccaacaagaagaugaguaagguggagacacugcgcucggcggucgaguacauccgcgcgcugcagcagcugcuggacgagcaugacgcggugagcgccgccuuccaggcaggcguccugucgcccaccaucucccccaacuacuccaacgacuugaacuccauggccggcucgccggucucauccuacucgucggacgagggcucuuacgacccgcucagccccgaggagcaggagcuucucgacuucaccaacugguucugaggggcucggccuggucaggcccuggugcgaauggacuuuggaagcagguagguugcauuuuggggugggcagggggguauucuugccuucguccucccucugagugucuguggaaguggggaugucuccaaggagauaaggggauuuuuauuuaaagaauuugugaaaguuggucgauuucaaguccuaguuuguuaguuucagcacuggccucugaaaauggccuugcccaggucuccaaggagugaaggguaguagugaggugcagagauacuggugaaccgaauacugggacauguuaaaagagaugucuaccugacagacucuuuccccagaccuccaucucccucuaccacuagccuacacguucaaauuaaccucuccuguucuuuuccuuauguuauagggugaucgcacaaccugcaucuuuagugcuuucuugucaguggcguugggagggggagaaaaggaaaagaaaaaaaaaagaagaagaagaagaaaagagaagaagaaaaaaacgaaaacagucaaccaaccccaucgccaacuaagcgaggcaugccugagagacauggcuuucagaaaacgggaagcgcucagaacaguaucuuugcacuccaaucauucacggagauaugaagagcaacugggaccugagucaaugcgcaaaaugcagcuugugugcaaaagcagugggcuccuggcagaagggagcagcacacgcguuauaguaacucccaucaccucuaacacgc

SEQ ID NO: 19857 - RNA, 2518 nt, Homo sapiens
agagaaaaagcgccuccuuuaagugaaacgagacacgggagcgcgcggaaacaggcugggggccaggaggagaccuguccugcuuuuugcaucccuagggacucguuuuccuuuagguuucuaacucccaggguuagccuuaaacuccagaggggcuccaggaggggagacuggguggagaacuucucucccagauacuucucacgccuuuucuccaagcuuucuuuuggagggacgccccacacaccccggguggcccgggcgcggagggggagcggcgccgcgugguuaaguuucugaaagucaaacccaguccccggucuccggucuccgccccggggcuccagcugcacgcggggagcugcggcuguucuggcaaaggggccgcggcugcuuuaagagccgccucccccucuccuccuuugacaauggucugaaccgagcuuugcuucccaaagcaaaauuuguaauaugccauuuuuccgauggacgcuucuccuuuuggcugcugacggagccacgggaagaugccgagcuccugccacgccaccgggccggggcacguuccgggagggcgccggggcacgcgugugucugagcugccuuucuccucccguugcuagggaaaugguccaggagugcugggugugagccucccuucuccucaagccggagacugcgguugucauugaucaauugaagaagcaaggacccgaaaucacagacauuagguacagaagcugucuuugaguuuuacugucuccuuucgcuguauuuuuugaccaccuccccggccccaccccgcccccagggaagaugagaugcaaauuccuccuuguugauuaccguuaggugccuuuugcuuucaccucauccucuccaucuccuaucucucuaccuccugccuacuuggcuguguccuguugggcaggaugaacaauuuuaguguggaaaugaugaagucaacuucuucaagguggugggggguguggcugagagauaacuguccaguaguguggguugagcuggcucuggcuguccguaaaugcacuaggguaaagaaaguguaaaauguguccauuaaaggugauaaucauauuucccgaggacagaggcuuucaaagaguuaaauaggagggagaauauucauguaauguaaucagacaauggcuaggauuucucucacugaauuacuccuuguagguuaacugagguggagcugggaugguucuuaagacuaaauguuuucagaagaaacucacuauggauaauaauuacauucuuaccucuaguagggccgaauuccuagugauaugauuaaauaaagucauuuguugacagaaaaaagaaaaaaagcuuuuuguagcacucucauaucugaagagguacugcuuggauggcauauauuguuaaggaacacauuggaucuugaaagcccuugagugaggacuccagugggcauucaaacuuuuauuuugaaaucugagaaauuuaaaagacagucaaggcuaugugcuaagaauaaaggaguuauuuuccugauauaaaauucuuccggcuaaauuuaagcacugggauaauuaagccaaucagauuuauuauuacuuuuuuucuuucucaacaaaauuaacaaugucucugacuagguuucaaaaccuucaguaauuuaaugaggaaagcaucaauaucuagaugaagauaacauaauuuauauaucaaauugacuuugaggggggaaugaugaaaaagcaaauaucaaggcaaauuguuaaaaugcccuuucuggcuuuucagaaauuaugugaugaaugcaguuuuuaguauugauacugauuauaaaaguuaaaagugauguaucugggugaaacgcacuagacauugaaugaccauagccuuccggacugugcaagcugcuucagaugucauccauuuuuuaaaaggguguuuaacucuuauauugaauauauaucuuuaauugcuuuuaauacuuaaaaugugcaaaaugugcauuuaagaaauguuauacugcauuuuaaggauuaaucaaauauuuuguaauuuauguuagaaucugaauucuaaugaaagaaacuaagcuaguucaugaaaguggccuuauuuuuuuguagacuauuuuuuucuaauuuugauaagaagacuuuggauuuacucauuuggguugacugcaagguauaagcagcauauauucaucuuauuuccuaaguaaauuuugcauaauuugauuuuuauaaauuggauuugaagaguucaaaaguaucuacuagaauuaaaccuuuacagcagcagaaugagucguaaagguaaaauauuguuucuacaaagauuaauguugaucacuuuauaauagaaauuaauacuuacauuuguaauugcccuuuauauguuuugcuguguguucucagucagguaaccuauuauauauuuucuuuuuuuuccucuaagcauagauuauuggcccucuuucaugaaagagagaacuaaaguuuuaacauguaaa

SEQ ID NO: 19858 - RNA, 2518 nt, Homo sapiens
uuuacauguuaaaacuuuaguucucucuuucaugaaagagggccaauaaucuaugcuuagaggaaaaaaaagaaaauauauaauagguuaccugacugagaacacacagcaaaacauauaaagggcaauuacaaauguaaguauuaauuucuauuauaaagugaucaacauuaaucuuuguagaaacaauauuuuaccuuuacgacucauucugcugcuguaaagguuuaauucuaguagauacuuuugaacucuucaaauccaauuuauaaaaaucaaauuaugcaaaauuuacuuaggaaauaagaugaauauaugcugcuuauaccuugcagucaacccaaaugaguaaauccaaagucuucuuaucaaaauuagaaaaaaauagucuacaaaaaaauaaggccacuuucaugaacuagcuuaguuucuuucauuagaauucagauucuaacauaaauuacaaaauauuugauuaauccuuaaaaugcaguauaacauuucuuaaaugcacauuuugcacauuuuaaguauuaaaagcaauuaaagauauauauucaauauaagaguuaaacacccuuuuaaaaaauggaugacaucugaagcagcuugcacaguccggaaggcuauggucauucaaugucuagugcguuucacccagauacaucacuuuuaacuuuuauaaucaguaucaauacuaaaaacugcauucaucacauaauuucugaaaagccagaaagggcauuuuaacaauuugccuugauauuugcuuuuucaucauuccccccucaaagucaauuugauauauaaauuauguuaucuucaucuagauauugaugcuuuccucauuaaauuacugaagguuuugaaaccuagucagagacauuguuaauuuuguugagaaagaaaaaaaguaauaauaaaucugauuggcuuaauuaucccagugcuuaaauuuagccggaagaauuuuauaucaggaaaauaacuccuuuauucuuagcacauagccuugacugucuuuuaaauuucucagauuucaaaauaaaaguuugaaugcccacuggaguccucacucaagggcuuucaagauccaauguguuccuuaacaauauaugccauccaagcaguaccucuucagauaugagagugcuacaaaaagcuuuuuuucuuuuuucugucaacaaaugacuuuauuuaaucauaucacuaggaauucggcccuacuagagguaagaauguaauuauuauccauagugaguuucuucugaaaacauuuagucuuaagaaccaucccagcuccaccucaguuaaccuacaaggaguaauucagugagagaaauccuagccauugucugauuacauuacaugaauauucucccuccuauuuaacucuuugaaagccucuguccucgggaaauaugauuaucaccuuuaauggacacauuuuacacuuucuuuacccuagugcauuuacggacagccagagccagcucaacccacacuacuggacaguuaucucucagccacaccccccaccaccuugaagaaguugacuucaucauuuccacacuaaaauuguucauccugcccaacaggacacagccaaguaggcaggagguagagagauaggagauggagaggaugaggugaaagcaaaaggcaccuaacgguaaucaacaaggaggaauuugcaucucaucuucccugggggcgggguggggccggggagguggucaaaaaauacagcgaaaggagacaguaaaacucaaagacagcuucuguaccuaaugucugugauuucggguccuugcuucuucaauugaucaaugacaaccgcagucuccggcuugaggagaagggaggcucacacccagcacuccuggaccauuucccuagcaacgggaggagaaaggcagcucagacacacgcgugccccggcgcccucccggaacgugccccggcccgguggcguggcaggagcucggcaucuucccguggcuccgucagcagccaaaaggagaagcguccaucggaaaaauggcauauuacaaauuuugcuuugggaagcaaagcucgguucagaccauugucaaaggaggagagggggaggcggcucuuaaagcagccgcggccccuuugccagaacagccgcagcuccccgcgugcagcuggagccccggggcggagaccggagaccggggacuggguuugacuuucagaaacuuaaccacgcggcgccgcucccccuccgcgcccgggccacccgggguguguggggcgucccuccaaaagaaagcuuggagaaaaggcgugagaaguaucugggagagaaguucuccacccagucuccccuccuggagccccucuggaguuuaaggcuaacccugggaguuagaaaccuaaaggaaaacgagucccuagggaugcaaaaagcaggacaggucuccuccuggcccccagccuguuuccgcgcgcucccgugucucguuucacuuaaaggaggcgcuuuuucucu

SEQ ID NO: 19859 - RNA, 1890 nt, Homo sapiens
uaacuuaaaauuacagagcuuaaaauauauaaacauuuuuuguauaaccagaagcccauugcuacaauucaaagacugucaccauacuguucaucaguaacaaagaaaacucuccucuuaggccuucugcuaguccugguaagaaaaauccuauuucagaccauuaaagcuaaguuauuuugacauaaucaugauucuuuucaauaaacauuaaacaugacauuguggaauaucaaaucuaaccaaaaaugccuguacuuaacaaaacgaagauuuuuguccgaauuaucucuggcuacacucaacacuuccagcaggcaguugcucaacuuuccaaugucugcauaaaauacaguucugaagccaauuuuuuuagauuaaaauaaaaagccacccuuuagcauaaaccuucauucaacgaaauuggguaaauaagauuuaauuaagaaaauuaggagccgcguucauugcaaaccguaguuuacuuuagcauuucacuuguaauuaaguuaggggcuuagggaugcauugaaaacaccaaaggauaaguaucucaaaguucuaaaaaugucucaauacuaaaaugauguucuggggugauuuugcaaggaccagaagacaucauacauugcgaacccagugaggguggcaucgcggacgaacagaagaugcuuucacgcugguuaucugucuuucccaggccucggcucccuugacuuugcagcgauacccaaaauucuuugaaagagaagggagggaaggcaucugggucccagggagucucugcauccaacccaggaaaggagggggccggcucccuggcgggaacuucccggaggccgcgccagccccgcgagggaccccagccaugcagggcgacgccgagcgggccccgcggcgcgcugggcucccccgccgcccccggccgguccccgccgacucacccaggccgcgccagcccagcgcgccgucgcagcuguccagaacagcgcagagcucuccgagcagcgcgggcggcaggucgaacagcagcgugugcgccgacagcgcgccgcgggccccacaguuccccgccauggcucggcugcccgagccccggggacgaggcggaguccaggucccugcacgccugcgacaggccguuacacaaccgcggaaauccugcuuccacgacggcagcagagcccuaggaacacgccguucuccggucacugcaggggcggugcccacgugacgcaaggcgcgccucgcccgagaugccccugcguccgccuggccaggccuggggguuacccgacccggguucucccuucgcuggcuuugcgccccuucacaccucugcgguggggacggagcugccgagacaagcagagugcgaacuggagaaagcccagagcucagagcucccaggagcccaccgugccccacggcuaggcggucuccugguguggacggcuagcggugucauuacuucuuacaaaaguuuauuuuugaaagcuucucccuuccuuccuucuucccuuccuuucuuuucuuccuuuuuucuuuguuuugagucagguucucacucugucgcccaggcaggagcgcaguggcgcuaucucagcucacggagccuccaccuauugggcucaagcgauccucccaccucagccucccgaguagcugggaccacagucgcacgccaccacguccggcuaauuauuuuuuuucguuuuucguagagagggagugucguuaugcugcccaggcugguuucaaacuccuggccucaagcgauccucccaccuccggcuucccaaagugcugggauucgggguguuagccacugucccggacuacuucuuuuuuauccugucagaaaaacuauccauguucaucgaggaacac

SEQ ID NO: 19860 - RNA, 1890 nt, Homo sapiens
guguuccucgaugaacauggauaguuuuucugacaggauaaaaaagaaguaguccgggacaguggcuaacaccccgaaucccagcacuuugggaagccggaggugggaggaucgcuugaggccaggaguuugaaaccagccugggcagcauaacgacacucccucucuacgaaaaacgaaaaaaaauaauuagccggacgugguggcgugcgacuguggucccagcuacucgggaggcugaggugggaggaucgcuugagcccaauagguggaggcuccgugagcugagauagcgccacugcgcuccugccugggcgacagagugagaaccugacucaaaacaaagaaaaaaggaagaaaagaaaggaagggaagaaggaaggaagggagaagcuuucaaaaauaaacuuuuguaagaaguaaugacaccgcuagccguccacaccaggagaccgccuagccguggggcacggugggcuccugggagcucugagcucugggcuuucuccaguucgcacucugcuugucucggcagcuccguccccaccgcagaggugugaaggggcgcaaagccagcgaagggagaacccgggucggguaacccccaggccuggccaggcggacgcaggggcaucucgggcgaggcgcgccuugcgucacgugggcaccgccccugcagugaccggagaacggcguguuccuagggcucugcugccgucguggaagcaggauuuccgcgguuguguaacggccugucgcaggcgugcagggaccuggacuccgccucguccccggggcucgggcagccgagccauggcggggaacuguggggcccgcggcgcgcugucggcgcacacgcugcuguucgaccugccgcccgcgcugcucggagagcucugcgcuguucuggacagcugcgacggcgcgcugggcuggcgcggccugggugagucggcggggaccggccgggggcggcgggggagcccagcgcgccgcggggcccgcucggcgucgcccugcauggcuggggucccucgcggggcuggcgcggccuccgggaaguucccgccagggagccggcccccuccuuuccuggguuggaugcagagacucccugggacccagaugccuucccucccuucucuuucaaagaauuuuggguaucgcugcaaagucaagggagccgaggccugggaaagacagauaaccagcgugaaagcaucuucuguucguccgcgaugccacccucacuggguucgcaauguaugaugucuucugguccuugcaaaaucaccccagaacaucauuuuaguauugagacauuuuuagaacuuugagauacuuauccuuugguguuuucaaugcaucccuaagccccuaacuuaauuacaagugaaaugcuaaaguaaacuacgguuugcaaugaacgcggcuccuaauuuucuuaauuaaaucuuauuuacccaauuucguugaaugaagguuuaugcuaaaggguggcuuuuuauuuuaaucuaaaaaaauuggcuucagaacuguauuuuaugcagacauuggaaaguugagcaacugccugcuggaaguguugaguguagccagagauaauucggacaaaaaucuucguuuuguuaaguacaggcauuuuugguuagauuugauauuccacaaugucauguuuaauguuuauugaaaagaaucaugauuaugucaaaauaacuuagcuuuaauggucugaaauaggauuuuucuuaccaggacuagcagaaggccuaagaggagaguuuucuuuguuacugaugaacaguauggugacagucuuugaauuguagcaaugggcuucugguuauacaaaaaauguuuauauauuuuaagcucuguaauuuuaaguua

SEQ ID NO: 19861 - RNA, 2690 nt, Homo sapiens
ugacuuaauggauuaacaucuuaguuaaaauauuagaacaagcacuuuuaaaaacaaaaagcaguguguugauucaaaaucuaaauuacauuguaugcugcaaccuugccauacaagcaguuuaagcacugugacaaaauucuagauaaguagcaaagagcuacuuaucuuaauauaaaaauuuccagauauucauauagggcccuaauaaaagucaucagaaauuagacugauauaucagcugggaccggaauuaaaagaauauauguuuaaaugguccaaauauaaacuugauguucaaaauuacuggcaaggggccaguacaguggauucuggucuucgaaggccguuucaccacaaguauuagguaagucaacacaucacugaggaaaaagaaagcauacauauguuuccuggcaauaaaauccacucuucacuauccagcacaguauuuuuuagaaauccauugaaaaaugugaaauuagaaccuguuguauuucccaagaagugcuauuaaaguuacuuccaaaauaugaaucuauaaaaaacaggguuuuuuugaaaaacaauacuaugcagaaagaaacaugaaacugauaucacugcucaaguuacuauuuacaaauugcaaauugaauaaaguuaaauauuguaaauaucugccauuaaucugaacugacaauuuuauaaguuauaugaacccugaaguuuuuuuauagacaaaauuguuuuugaaaaucgaucuugccaccagcgcugcaaaugaaaauaugaagagauaaaccagagaguacugaauauaaucuaugcuucauagagucauguuucaacuaauuuaugaguccuaguuugccauaucuuauuugacaauuuagucuauugguagaaaaaacaaaagcaaacuaaaaucuccuaagaaaucucagcucuaaggaauuauaauuuauauucuuccauucccgauaaaauuaagaagcaagaagcuuugacgacuacucaucacaaacguaaaaguccaugcaauuucacauuuaccuuuaucccuaccuuuguacuuuaaaauaacugcuuuuuaaaauaauaaucugauauuaaauuccccccaacaguucccacaugauucaagaagauuaucuuauaaagucuuacuguaacgacuucauaacugccacuuccgauagcuauuagcccuaaaccaaauaaggcaggaacagcacuuuucauucauauaguuugacucgaaauagcccaguguaaaacuucaaaaauagacuuggaugccuuuuucugcuuaaaaacaaagcaaaacugauaccuggcaaacucgggguucuguucgauuuuggccugugaaaugccaggcgggcccgcuggagucuggcccagcagcggggcagcagcgcagggagggcgggcggcgggugcgcucccgggugcgccccucccugccgccugcccgccgccccgcacccccguccucuccgaggcgcgcggcgaaaagcgcaggccuggcgggccgguucccacgccucgggcccguuaucugagcggcaaccccggcagggucgacgcacagagcagagggcuccgggauggaccccuccccugccucccgcgggcugccccgccagaucccucucuccugggcccgcgcggggcgagaggcucccgcggguucagguucgcucccgggacaggauaaggugucagugaggcugccagacgccucccuucggcggguggggggaaaccagcccugaccuccuuccguucggccccucaccgcuggcgcggggcgcaacccuucugcuccccuucucggcugaggcaggggcuguccccgcagguggccgagggggcgcagcaggcgcagaauggaaucccggcucggggucacacccuaacguggcagggucggggugggaggggugaggcgaggaggagaggggaggggagcccgaacuuaccggacugcgcacuucccagagccgcggccaggcagaggcagaggcagagggagaggcagagcgagagggggcgcgggaggguccgccgcgggcucauggaaaggccaggcagccgccgccgguguccgaaccucgcucccucccuccccggcuccgggcgacggacggggcggcgggaggcaugacgggaaauuccugggcacgggcagccgaguccaaauaugagcauaggagacgagcgagggaggaccacggagcgcgccggccgcggacggggcccgcugcccggggcucggcggccgccaacucccuccuccucugcccuguccucuuccuccuccuccuccuccucugcaccguccuccuccuccuccuucucugcccugcccuccugcuccucuccucccccucguccuccucugccccagggcugccggccgccuucugccugggggcaucccuuuccaacucgggaccccagaacacagccaagcgcccaccuggcguguuccaccugagaccgcugaaggagugggaaacggacaaaccaacacgaagagaccggacagcgagccagggaccugugggaagacgugucagggguuguugagagcguugguggugaggggauaaaaaguugugggagagugaggcaggagcagggcugccaguuaguuacuuggccauccuauacauacagaacgagcacucacuguaauacgg

SEQ ID NO: 19862 - RNA, 2690 nt, Homo sapiens
ccguauuacagugagugcucguucuguauguauaggauggccaaguaacuaacuggcagcccugcuccugccucacucucccacaacuuuuuauccccucaccaccaacgcucucaacaaccccugacacgucuucccacaggucccuggcucgcuguccggucucuucguguugguuuguccguuucccacuccuucagcggucucagguggaacacgccaggugggcgcuuggcuguguucuggggucccgaguuggaaagggaugcccccaggcagaaggcggccggcagcccuggggcagaggaggacgagggggaggagaggagcaggagggcagggcagagaaggaggaggaggaggacggugcagaggaggaggaggaggaggaagaggacagggcagaggaggagggaguuggcggccgccgagccccgggcagcgggccccguccgcggccggcgcgcuccgugguccucccucgcucgucuccuaugcucauauuuggacucggcugcccgugcccaggaauuucccgucaugccucccgccgccccguccgucgcccggagccggggagggagggagcgagguucggacaccggcggcggcugccuggccuuuccaugagcccgcggcggacccucccgcgcccccucucgcucugccucucccucugccucugccucugccuggccgcggcucugggaagugcgcaguccgguaaguucgggcuccccuccccucuccuccucgccucaccccucccaccccgacccugccacguuagggugugaccccgagccgggauuccauucugcgccugcugcgcccccucggccaccugcggggacagccccugccucagccgagaaggggagcagaaggguugcgccccgcgccagcggugaggggccgaacggaaggaggucagggcugguuuccccccacccgccgaagggaggcgucuggcagccucacugacaccuuauccugucccgggagcgaaccugaacccgcgggagccucucgccccgcgcgggcccaggagagagggaucuggcggggcagcccgcgggaggcaggggagggguccaucccggagcccucugcucugugcgucgacccugccgggguugccgcucagauaacgggcccgaggcgugggaaccggcccgccaggccugcgcuuuucgccgcgcgccucggagaggacgggggugcggggcggcgggcaggcggcagggaggggcgcacccgggagcgcacccgccgcccgcccucccugcgcugcugccccgcugcugggccagacuccagcgggcccgccuggcauuucacaggccaaaaucgaacagaaccccgaguuugccagguaucaguuuugcuuuguuuuuaagcagaaaaaggcauccaagucuauuuuugaaguuuuacacugggcuauuucgagucaaacuauaugaaugaaaagugcuguuccugccuuauuugguuuagggcuaauagcuaucggaaguggcaguuaugaagucguuacaguaagacuuuauaagauaaucuucuugaaucaugugggaacuguuggggggaauuuaauaucagauuauuauuuuaaaaagcaguuauuuuaaaguacaaagguagggauaaagguaaaugugaaauugcauggacuuuuacguuugugaugaguagucgucaaagcuucuugcuucuuaauuuuaucgggaauggaagaauauaaauuauaauuccuuagagcugagauuucuuaggagauuuuaguuugcuuuuguuuuuucuaccaauagacuaaauugucaaauaagauauggcaaacuaggacucauaaauuaguugaaacaugacucuaugaagcauagauuauauucaguacucucugguuuaucucuucauauuuucauuugcagcgcugguggcaagaucgauuuucaaaaacaauuuugucuauaaaaaaacuucaggguucauauaacuuauaaaauugucaguucagauuaauggcagauauuuacaauauuuaacuuuauucaauuugcaauuuguaaauaguaacuugagcagugauaucaguuucauguuucuuucugcauaguauuguuuuucaaaaaaacccuguuuuuuauagauucauauuuuggaaguaacuuuaauagcacuucuugggaaauacaacagguucuaauuucacauuuuucaauggauuucuaaaaaauacugugcuggauagugaagaguggauuuuauugccaggaaacauauguaugcuuucuuuuuccucagugauguguugacuuaccuaauacuuguggugaaacggccuucgaagaccagaauccacuguacuggccccuugccaguaauuuugaacaucaaguuuauauuuggaccauuuaaacauauauucuuuuaauuccggucccagcugauauaucagucuaauuucugaugacuuuuauuagggcccuauaugaauaucuggaaauuuuuauauuaagauaaguagcucuuugcuacuuaucuagaauuuugucacagugcuuaaacugcuuguauggcaagguugcagcauacaauguaauuuagauuuugaaucaacacacugcuuuuuguuuuuaaaagugcuuguucuaauauuuuaacuaagauguuaauccauuaaguca

SEQ ID NO: 19863 - RNA, 2690 nt, Homo sapiens
ccaccugccaucugcccaguauauguuagguacaggaggagggggagguguggcuagugcaggaaaauaaugcagagaagauacaacccacuaagccaagaauguggggacaguuacagcugugccuccccugcuucccuuccuggaggagcugaaagauggggaauuccugaggaugggccuaaaggggcugggcucacugguagaagugggaauaucagagacugacuaguguagcuuggucaccuagucccuacuaaaaagccuuauagccuuuccuaggaugagacuuugaggcuccuagacaaaggcacucucccaggaggaaaaucuuaggcccucccucccaugagggucauugcaacaugagacccaagggaguugugaagucagccccagccccgccuacuguuccugggugcuaauccccagcacagaccacucaggaggagggauuggcugaggagcuuggagagggggcgucaucaccucacccaaagguuaaauagggguugagauaugaugcucaggagaagcgcuuucuuucgcgagcacccugaaccagaccaugacccagacccucaaguacgccuccagaguguuccaucgcguccgcugggcgcccgaguugggcgccucccuaggcuaccgagaguaccacucagcacgccggagcuuggcagacaucccaggccccucuacgcccagcuuucuggccgaacuuuucugcaagggggggcugucgaggcuacacgagcugcagguaggaagggacgccuuucccgagacagagugcuggggaaacugguuuugacagcgucagaaaggacugacuagugcagagcaaaugugggacagccagagagaacggaugcccaugaaauaaggaaaaggcgaguugaggcugggggcgguguggcuacacucgggcagagcccgucccgacucuuagcagagggcgcugcgaaagcgccuucucgcuguccugagguguggagauccugcagauaaaguacaagugcgcgggagggggaggccggagugggcaguacccuccgccugcuugcggcuuaaagcuacauggguuccuuuucauucacugaggacucguccugagauggacaguccagacauggaacuuuuagagauuucuccucgaccgagaugaucagagagguccugaaugucugccuugcacaaaguuccgguuuugcccaucacacucaaacuuucuagggaugggaaaugagagaggaggaguuugcaguaucaaaggcauacacuaguugggcacccgagaaagagcagaagcucccuauucccaagcccagucaacgcccuuggcgugggcacaggucaagcugaaaguccccgcccagguauccaaguguccgcuguguccgcucccccaggugcagggcgccgcgcacuucgggccgguguggcuagccagcuuugggacagugcgcaccguguacguggcugccccugcacucgucgaggagcugcugcgacaggagggaccccggcccgagcgcugcagcuucucgcccuggacggagcaccgccgcugccgccagcgggcuugcggacugcucacugcgugagucuucucugcccccagaagcccagacgcccugcagcggcccucuccugcugcgggucccgaaacuaucaaucugggggcauggugggaggucggcugucccacucuaccauugggcaucuugggguucccaucccagucugcuucacccacacucagguugagccccaaccucacuccccgccuaccuccuuauccuuugaggcccgaauccugggaacugggggaaccggaggaauugggcuaggguacaaggaucuggauggaaugaauguaagguucugugacucaaguuacccgggaaccccggccccugagggcaggaaaugaguaaagaggaagggggcuggaagacaggcgcaggccggugcagguuuccguaccccaagggggcagacgcaaucccucuccuggccaccgcagccgaacgcgcuccuucacugcagccagucccgucgagccguccccaccuucccgaugcgcacucucuccucaacccugcagggaaggcgaagaauggcaaaggcuccgcagucuccuggccccgcuccuccuccggccucaagcggccgcccgcuacgccggaacccugaacaacguagucugcgaccuugugcggcgucugaggcgccagcggggacguggcacggggccgcccgcccugguucgggacguggcgggggaauuuuacaaguucggacuggaaggugagucccaggacagagcugggcaggcgucgggggcgcccuaccagagccucccggaacccugacggcgcccccucccgacaaggcaucgccgcgguucugcucggcucgcgcuugggcugccuggaggcucaagugccacccgacacggagaccuucauccgcgcugugggcucgguguuuguguccacgcuguugaccauggcgaugccccacuggcugcgccaccuugugccugggcccuggggccgccucugccgagacugggaccagauguuugcauuugguaaggcacaggucgagguggaaaugggggaauguaaagcuguccagggguagcgagguauucacgugccuucuacccacgcagcucagag

SEQ ID NO: 19864 - RNA, 2690 nt, Homo sapiens
cucugagcugcguggguagaaggcacgugaauaccucgcuaccccuggacagcuuuacauucccccauuuccaccucgaccugugccuuaccaaaugcaaacaucuggucccagucucggcagaggcggccccagggcccaggcacaagguggcgcagccaguggggcaucgccauggucaacagcguggacacaaacaccgagcccacagcgcggaugaaggucuccgugucggguggcacuugagccuccaggcagcccaagcgcgagccgagcagaaccgcggcgaugccuugucgggagggggcgccgucaggguuccgggaggcucugguagggcgcccccgacgccugcccagcucuguccugggacucaccuuccaguccgaacuuguaaaauucccccgccacgucccgaaccagggcgggcggccccgugccacguccccgcuggcgccucagacgccgcacaaggucgcagacuacguuguucaggguuccggcguagcgggcggccgcuugaggccggaggaggagcggggccaggagacugcggagccuuugccauucuucgccuucccugcaggguugaggagagagugcgcaucgggaagguggggacggcucgacgggacuggcugcagugaaggagcgcguucggcugcgguggccaggagagggauugcgucugcccccuugggguacggaaaccugcaccggccugcgccugucuuccagcccccuuccucuuuacucauuuccugcccucaggggccgggguucccggguaacuugagucacagaaccuuacauucauuccauccagauccuuguacccuagcccaauuccuccgguucccccaguucccaggauucgggccucaaaggauaaggagguaggcggggagugagguuggggcucaaccugagugugggugaagcagacugggaugggaaccccaagaugcccaaugguagagugggacagccgaccucccaccaugcccccagauugauaguuucgggacccgcagcaggagagggccgcugcagggcgucugggcuucugggggcagagaagacucacgcagugagcaguccgcaagcccgcuggcggcagcggcggugcuccguccagggcgagaagcugcagcgcucgggccggggucccuccugucgcagcagcuccucgacgagugcaggggcagccacguacacggugcgcacugucccaaagcuggcuagccacaccggcccgaagugcgcggcgcccugcaccugggggagcggacacagcggacacuuggauaccugggcggggacuuucagcuugaccugugcccacgccaagggcguugacugggcuugggaauagggagcuucugcucuuucucgggugcccaacuaguguaugccuuugauacugcaaacuccuccucucucauuucccaucccuagaaaguuugagugugaugggcaaaaccggaacuuugugcaaggcagacauucaggaccucucugaucaucucggucgaggagaaaucucuaaaaguuccaugucuggacuguccaucucaggacgaguccucagugaaugaaaaggaacccauguagcuuuaagccgcaagcaggcggaggguacugcccacuccggccucccccucccgcgcacuuguacuuuaucugcaggaucuccacaccucaggacagcgagaaggcgcuuucgcagcgcccucugcuaagagucgggacgggcucugcccgaguguagccacaccgcccccagccucaacucgccuuuuccuuauuucaugggcauccguucucucuggcugucccacauuugcucugcacuagucaguccuuucugacgcugucaaaaccaguuuccccagcacucugucucgggaaaggcgucccuuccuaccugcagcucguguagccucgacagcccccccuugcagaaaaguucggccagaaagcugggcguagaggggccugggaugucugccaagcuccggcgugcugagugguacucucgguagccuagggaggcgcccaacucgggcgcccagcggacgcgauggaacacucuggaggcguacuugagggucugggucauggucugguucagggugcucgcgaaagaaagcgcuucuccugagcaucauaucucaaccccuauuuaaccuuugggugaggugaugacgcccccucuccaagcuccucagccaaucccuccuccugaguggucugugcuggggauuagcacccaggaacaguaggcggggcuggggcugacuucacaacucccuugggucucauguugcaaugacccucaugggagggagggccuaagauuuuccuccugggagagugccuuugucuaggagccucaaagucucauccuaggaaaggcuauaaggcuuuuuaguagggacuaggugaccaagcuacacuagucagucucugauauucccacuucuaccagugagcccagccccuuuaggcccauccucaggaauuccccaucuuucagcuccuccaggaagggaagcaggggaggcacagcuguaacuguccccacauucuuggcuuaguggguuguaucuucucugcauuauuuuccugcacuagccacaccucccccuccuccuguaccuaacauauacugggcagauggcaggugg

SEQ ID NO: 19865 - RNA, 2844 nt, Homo sapiens
ggguucccuuccuccugcaagguugcaccaagcggcaguucggggaaauagggccuucaauuacccaguguguaucucuugagugucuguuaaauaauggggggcagggcggggaggagggggagagggaggcugugccucagucuuuguuagccaggcagagcguuuauuuuccagggguuguuuccuuuaucuucauccuaacauucaaacuugacuugaguuuuagcgcgcccccgcccuaccuccucccaaagcccuuauuugcccauccuugccuacaagcucagaacgagcaggcaauggaauggaugucgugggagcaggcgguugagaugccaguguuuggaggcuaaggacugggggcugugagcgaggaccuucccgcguuugcuccgcgcccccgcaguuuccuccgcgcccacuagaaggcgccggggcgcucgcauuccccgcgcggagccgaagcagccgcaacgagccgggagcugagccgcgcugcgcugcggugcgaagagccgggcggcggccagagcccuccccgcgcugccagugggacgcggagccagggauccccggcuuugccccggggcuggggugcaacagacucuuaacuugguccucgcgccccgccaaccgcccccgggcaggaaacgcccagaaccaccaccgcgccgcgcuccacaaaagccccgggaguuccaagacgggagggaucgggcgcgcuccagaggcaggagggucccccacacccucaggcucaugcccagcucccccaucgggcagcccccagccccaugaggacccucaggccggggcgagagcccggcacagcccggaccgaaauuuugccgcugccuuagagcguuagacaggucagugcccgggggugggugggggugggauugguuggugaggggaggaggaggaggcgggaggaggcgggaggaggcgcgcuucccgguccacucugucccccgcgccgcuugccgaggccacucaucgggucaccuccgccgggggcgcccgccagcacgggcaugauucugcauuuuuuccugacaggcuagguguggagccgcccuccgcagcccaccccggcccaggugaugcucagacugaggagucgggggcgcgccggccagggcgggcggcgggcuuggggacugccacugcccugauagagcggggcuuuuccgcuuacgcacggccgcgucgaaaccgcggcauccaaaugucuucagcauuaagaugccaggccucgggugugugaggaaaccgagaugcaggagagggcgagaagaaaggaggccgggagacccuggggccugggaagugaggggagggguaccgggaaaaccgcggcuggcagugcaaacccuagcgcgauguguggaguggagagcgcucuugggagccggcaggagccucugaggacgcgggggccaagggccccaucccuugcccucccuucuucccucccuuucucacuccccacccuacccccaccuaggauguggcugggccgccgggcccugugcgcucugguccuucugcucgccugcgccucgcuggggcuccuguacgcgagcacccgggacgcgcccggccuccggcuaccucuugcgccgugggcgcccccgcaaagcccccgcaggcccgagcugccagaucuugcuccugagccccgcuacgcacacaucccggucaggaucaaggagcaaguaguggggugagugccgaccgcggcggcgcagcgcagcgcucgcuggggguggucugggggcuuuuguuuucuccacugcugggcucagaugccugcauucuccuaacgggcuguguggagugaagugggagguggaagugggaggcugcugaggcuugggcuggggaaaaucuguucucccugaaccuugccauggggauaaggauggggaugggcgugggagguugugcagucaagggagggcccugaaagacucccugagguccugauucagguaugagaagagacuccaggugggguccugguugguggguaggcagcuccugaaauccugguaauuggcccuauccuacaacucuaaaauccagauuuaggggauaggucauccgauccuuggucccccucccgaggacuauuugaagggcagcauuuaaggggacagagccuagacagacagaauugcagggccaagguguggggugcugugucaguguuuaugggaugaauggagcuguguagcugggcucugaugacccucacuaccuacccccuucaggcugcuggcuuggaacaacugcaguugugaguccaguggggggggccucccccuccccuuccagaaacaaguccgagcuauugaccucaccaaggccuuugacccugcagagcugagggcugccucugccacaagagagcaggaguuccaggccuuucugucgagguaccagcuugaaagaagcgcaugacuccucagggggagagcagugauugugccgggagggagagacccucuccccccgacucugcucuguccucuccuuccuccacugccaggagccaguccccagcugaccagcugcucauagccccugccaacuccccgcuccaguacccccuacaggguguggaaguucagccccucaggagcaucuuggugccagguagggaggagggucccagaggaugaccucagccacaguggggguggcagagcccaagguuggguggggaagaaugggagaugauuggaaugggaggugggaaccucugaugaaugggggacuuaagcucaaacggcggcuuaggaggugggaagugaggacagaagggacucuagg

SEQ ID NO: 19866 - RNA, 2844 nt, Homo sapiens
ccuagagucccuucuguccucacuucccaccuccuaagccgccguuugagcuuaagucccccauucaucagagguucccaccucccauuccaaucaucucccauucuuccccacccaaccuugggcucugccacccccacuguggcugaggucauccucugggacccuccucccuaccuggcaccaagaugcuccugaggggcugaacuuccacacccuguaggggguacuggagcggggaguuggcaggggcuaugagcagcuggucagcuggggacuggcuccuggcaguggaggaaggagaggacagagcagagucggggggagagggucucucccucccggcacaaucacugcucucccccugaggagucaugcgcuucuuucaagcugguaccucgacagaaaggccuggaacuccugcucucuuguggcagaggcagcccucagcucugcagggucaaaggccuuggugaggucaauagcucggacuuguuucuggaaggggagggggaggccccccccacuggacucacaacugcaguuguuccaagccagcagccugaaggggguagguagugagggucaucagagcccagcuacacagcuccauucaucccauaaacacugacacagcaccccacaccuuggcccugcaauucugucugucuaggcucuguccccuuaaaugcugcccuucaaauaguccucgggagggggaccaaggaucggaugaccuauccccuaaaucuggauuuuagaguuguaggauagggccaauuaccaggauuucaggagcugccuacccaccaaccaggaccccaccuggagucucuucucauaccugaaucaggaccucagggagucuuucagggcccucccuugacugcacaaccucccacgcccauccccauccuuauccccauggcaagguucagggagaacagauuuuccccagcccaagccucagcagccucccacuuccaccucccacuucacuccacacagcccguuaggagaaugcaggcaucugagcccagcaguggagaaaacaaaagcccccagaccacccccagcgagcgcugcgcugcgccgccgcggucggcacucaccccacuacuugcuccuugauccugaccgggaugugugcguagcggggcucaggagcaagaucuggcagcucgggccugcgggggcuuugcgggggcgcccacggcgcaagagguagccggaggccgggcgcgucccgggugcucgcguacaggagccccagcgaggcgcaggcgagcagaaggaccagagcgcacagggcccggcggcccagccacauccuagguggggguaggguggggagugagaaagggagggaagaagggagggcaagggauggggcccuuggcccccgcguccucagaggcuccugccggcucccaagagcgcucuccacuccacacaucgcgcuaggguuugcacugccagccgcgguuuucccgguaccccuccccucacuucccaggccccagggucucccggccuccuuucuucucgcccucuccugcaucucgguuuccucacacacccgaggccuggcaucuuaaugcugaagacauuuggaugccgcgguuucgacgcggccgugcguaagcggaaaagccccgcucuaucagggcaguggcaguccccaagcccgccgcccgcccuggccggcgcgcccccgacuccucagucugagcaucaccugggccggggugggcugcggagggcggcuccacaccuagccugucaggaaaaaaugcagaaucaugcccgugcuggcgggcgcccccggcggaggugacccgaugaguggccucggcaagcggcgcgggggacagaguggaccgggaagcgcgccuccucccgccuccucccgccuccuccuccuccccucaccaaccaaucccacccccacccacccccgggcacugaccugucuaacgcucuaaggcagcggcaaaauuucgguccgggcugugccgggcucucgccccggccugaggguccucauggggcugggggcugcccgaugggggagcugggcaugagccugagggugugggggacccuccugccucuggagcgcgcccgaucccucccgucuuggaacucccggggcuuuuguggagcgcggcgcgguggugguucugggcguuuccugcccgggggcgguuggcggggcgcgaggaccaaguuaagagucuguugcaccccagccccggggcaaagccggggaucccuggcuccgcgucccacuggcagcgcggggagggcucuggccgccgcccggcucuucgcaccgcagcgcagcgcggcucagcucccggcucguugcggcugcuucggcuccgcgcggggaaugcgagcgccccggcgccuucuagugggcgcggaggaaacugcgggggcgcggagcaaacgcgggaagguccucgcucacagcccccaguccuuagccuccaaacacuggcaucucaaccgccugcucccacgacauccauuccauugccugcucguucugagcuuguaggcaaggaugggcaaauaagggcuuugggaggagguagggcgggggcgcgcuaaaacucaagucaaguuugaauguuaggaugaagauaaaggaaacaaccccuggaaaauaaacgcucugccuggcuaacaaagacugaggcacagccucccucucccccuccuccccgcccugccccccauuauuuaacagacacucaagagauacacacuggguaauugaaggcccuauuuccccgaacugccgcuuggugcaaccuugcaggaggaagggaaccc

SEQ ID NO: 19867 - RNA, 2512 nt, Homo sapiens
cgccacacucacaagugcacagaagcacacacagguauuuggacacacaaacacucauauacccacaccuccccgugcaguuauacauauucacacacccgcaguguguacacauguaaacacauucucacaugcacauaagcugggcuaaccagcagauccacucucccuguugacuccaacacggaggccccacagcugcagcucacacacacacacucagauagaucccauugcucauauccucacgcucacucucacucaagucuccaccagauguuucauucccccucagggggcaaaggaaauuaaaccagaucuguccacaggggaguuuauuugccugggagaguggagaugaggugggaggaaguggaaaggaggggcaagagaaugccauaccuaccaccucuugaccccaggccuucacacaugggugggugggugguagggcacagaccccccccacuccuccaguucacuaaggacagaguugggcagcaagucccuaagaagcuccugcuaguggaagcaguuuucauggaggggcuccucugccuaccgugcagccccucaaggucaccagguggggcugggagggccagggagcucuaaugcuagcuucacuggggcagccccugcccugcugggguuugccaaaugugauuuggcugagcaggcagagguccaaguguugggggaagaaauacaccccuucuagacucuacaggggcugaggguacagagaaugaggguuuggggaaugaccugccugcccccaaacuagguaggucacaguugggggucagaaaacagggaagccauaggcaggggaggcugguagaaggaaaaugggggacuggggccugggcccccauugcgggcacacaccaggggcauaggcagauggcugcacugugaggcaggcacugacacucacucaugcaaagccaacaccacacaccacaccaguauacacauguacccucggccccaguacuggaccaagccuggcuucccuggacacaugcacacaggugcacacggugacccacgcccuccacccagcacauaugagcacagcauguucgcagguugaagccuccaagucaggaaggaggcagaucaagucugagcucccuuagccucuggcucuucgcccgagagccucagggaaagaggccuuggagugggguuggaggcagggagggcaugggaggagagacuccccuuccagacagccucccccuucaguggggcacgagaggggggugugucugugaggucgugcaggggagauggugucuccgugggaaaugugaugggaggcuggcuguagccaaguucagccgugucugccugaguccgugugugcgugugugcucgggccauggaugcucccgacacagagcccaccuggcauggugacaagugcagagaagagaaaugggaaggcggggguggagggguggaaggacagacagacagugaggcaggcgagcgagacuggcgcggaaagacggcaaggcugacacccugcuggcuugucugucugucucgcacucccgcucugucuggcgcacucgcgggucgggcuucguccccucccccgccgcgccugaagucggcugcaagggggaccuccgcccggcacccucuccaagccucagccaacuugcgcuaggagagugcccguccugaaucgggcagucugucuguccgcuucccccgcgccgcgcaaaguugggacgcucggagcugggggcggggcgggcgcacggagccccucgcacacugggaccuucgcgucccggaaccccgcgcccgcgcuagcgccccagcccugccacucuuaccuuccuaaggagccacgggccaaagagcaagaggaaccauuccgggagcagccgcaucuucucuggcggcugagcggggcaggcugggcgggucucgggcaggcgggagccaggccuagggacgcggggcuccgggcgggcggcggggcggcugcgggagcggcgggagcggcgggagcggcgggagcggcggcgcggcccgcggacugggcgcgaggcgcggagccggcgcugggggcggggcgcgggcgggggagaaaguugggucugacuccgcgggcggggggcggggcuccgcggcgcuccaaucccggccgcgccccgcgcgcccccucccgcccagcugggggcaccgaaggugacuuucacaccggcacgccccggacacgccccuggcccaggugcgaagcggagggggucgaggggcucaggcacuggucccccgagaggccgcgucugugcgcccaggaggaacggggcagggcguggggcucugggcuccgggcccgugcaccuggagugggggcgccgcggagcccagccggacgacgcucuccaagccccgggccucugcccuguucagggccaaggugugucggggcaggcgcagggcaggggccgagguggggacgggcggggccucgggcggcugccgc

SEQ ID NO: 19868 - RNA, 2512 nt, Homo sapiens
gcggcagccgcccgaggccccgcccguccccaccucggccccugcccugcgccugccccgacacaccuuggcccugaacagggcagaggcccggggcuuggagagcgucguccggcugggcuccgcggcgcccccacuccaggugcacgggcccggagcccagagccccacgcccugccccguuccuccugggcgcacagacgcggccucucgggggaccagugccugagccccucgacccccuccgcuucgcaccugggccaggggcguguccggggcgugccggugugaaagucaccuucggugcccccagcugggcgggagggggcgcgcggggcgcggccgggauuggagcgccgcggagccccgccccccgcccgcggagucagacccaacuuucucccccgcccgcgccccgcccccagcgccggcuccgcgccucgcgcccaguccgcgggccgcgccgccgcucccgccgcucccgccgcucccgccgcucccgcagccgccccgccgcccgcccggagccccgcgucccuaggccuggcucccgccugcccgagacccgcccagccugccccgcucagccgccagagaagaugcggcugcucccggaaugguuccucuugcucuuuggcccguggcuccuuaggaagguaagaguggcagggcuggggcgcuagcgcgggcgcgggguuccgggacgcgaaggucccagugugcgaggggcuccgugcgcccgccccgcccccagcuccgagcgucccaacuuugcgcggcgcgggggaagcggacagacagacugcccgauucaggacgggcacucuccuagcgcaaguuggcugaggcuuggagagggugccgggcggaggucccccuugcagccgacuucaggcgcggcgggggaggggacgaagcccgacccgcgagugcgccagacagagcgggagugcgagacagacagacaagccagcagggugucagccuugccgucuuuccgcgccagucucgcucgccugccucacugucugucuguccuuccaccccuccacccccgccuucccauuucucuucucugcacuugucaccaugccaggugggcucugugucgggagcauccauggcccgagcacacacgcacacacggacucaggcagacacggcugaacuuggcuacagccagccucccaucacauuucccacggagacaccaucuccccugcacgaccucacagacacaccccccucucgugccccacugaagggggaggcugucuggaaggggagucucuccucccaugcccucccugccuccaaccccacuccaaggccucuuucccugaggcucucgggcgaagagccagaggcuaagggagcucagacuugaucugccuccuuccugacuuggaggcuucaaccugcgaacaugcugugcucauaugugcuggguggagggcgugggucaccgugugcaccugugugcauguguccagggaagccaggcuugguccaguacuggggccgaggguacauguguauacugguguggugugugguguuggcuuugcaugagugagugucagugccugccucacagugcagccaucugccuaugccccuggugugugcccgcaaugggggcccaggccccagucccccauuuuccuucuaccagccuccccugccuauggcuucccuguuuucugacccccaacugugaccuaccuaguuugggggcaggcaggucauuccccaaacccucauucucuguacccucagccccuguagagucuagaagggguguauuucuucccccaacacuuggaccucugccugcucagccaaaucacauuuggcaaaccccagcagggcaggggcugccccagugaagcuagcauuagagcucccuggcccucccagccccaccuggugaccuugaggggcugcacgguaggcagaggagccccuccaugaaaacugcuuccacuagcaggagcuucuuagggacuugcugcccaacucuguccuuagugaacuggaggaguggggggggucugugcccuaccacccacccacccaugugugaaggccuggggucaagaggugguagguauggcauucucuugccccuccuuuccacuuccucccaccucaucuccacucucccaggcaaauaaacuccccuguggacagaucugguuuaauuuccuuugcccccugagggggaaugaaacaucugguggagacuugagugagagugagcgugaggauaugagcaaugggaucuaucugagugugugugugugagcugcagcuguggggccuccguguuggagucaacagggagaguggaucugcugguuagcccagcuuaugugcaugugagaauguguuuacauguguacacacugcgggugugugaauauguauaacugcacggggagguguggguauaugaguguuuguguguccaaauaccugugugugcuucugugcacuugugaguguggcg

SEQ ID NO: 19869 - RNA, 3048 nt, Homo sapiens
ggguccccugccccaggucccccaggcaguggugauagcuucucuccaaguucaagggggcucuuggggcuaaaacugcgggcacugccugccuuuuccccugggcugccaugcccauugcucaugcucccuuuccggguacccgcagucucagagaucuugaagagcgggaugcuggagacgggaacagcaggcacugguugacugaagagcccuggauugguggcccacucucucagugccuucugcaggcgccggacauggaggggcuugguggccaugcccacaagugccaugaucuccagaaacuccuccucacccgccucacacagcugcugcacgucguccccucccugcuggaugaaggucucauaguaggaaaggagguuggcgcgcugcaggacccgguacagcugcagcucccccagcguccgaggcagugccauggcucgggcacugggccugagaaggaggggcacaagagagaggcagucggugcaagucccccuacuggguaccaacccacacuaacaauuguucccucuuuccugccugcuuuucuuccccucccucauuuggaugcuauccugcccagugcccaggucugaguacagacucucagaaucaggcacugcucagaggcauggacaagccagugccguccuagacuggcccgaagccccaaaagucaguggccugugucuguaggagucgaagcgucuuacaaccuuaucuucagcuuuuaucuuuuuggucuggggcaagaagaacuugagcgcugaggcugaccagcaccgaccugggauggcuggaccucccucucccccaaaacacaauccucaccuuccccucuaaacacucagcagucucaacacugaagugaagucacccauacuaaagugaauguaggagcccagucucccccacaguggacgcugcuggccagcuucauucccugugaaggggccacagccccagguggcuaaaagggaggguguggcaccuucccuggcuuucccacucagugagccagguggugccuuacucuucuccgcucagcuuuucccagggguuaagcauuuauuuauuuauuuauuuauuuauuuauuugagacggagucucgcucugucacccaggcuggagugcaguggcgcugucacugcaaccuccgccucccggguucaagcgauucuccugccucagccuccugaguagcugagauuacaggcgcccgccaccaugcccggcuaauuuuuguauuuuuaguagaaacgggguuucaccauguuggucaggcugggcucgaauuccugaccucgugauccacccgccucagccucccaaagugcugggauuacaggccugagccaccgggcccgcccggccugguuaagcauucuuaacgcacgcuuccucucuccccucagaaccucuccacccuuccaggcugcccagugcuccucaguggccccucuccuagcagugacacuccccacuuccucggucagccuuuuccuucagcucaggggccguggcagggggaggggcgcaauuguucugcuccggggccguuccgcccacacacacucccacagugguagcgucuguaggcgaaaaccgcccaggggcucccgccuacucuccucucccauauuuuccacccgcaucuucaaguggagugggggagcggcucaaggccucuugaugaaggggcugcacacugaaacuccccuccccgcucugugaauaaagggacagauaugggaaggaacgccuaaggccucccugccucccucgucacccccccuuucccccgcugaugcuccuuuaacucaaaggcaccgggggcccgcgcgcuccgugccaacgagggacugaggcaacugagcguccccccaccuuccgcacugaugccagcucgagcuccagggcauccccuggugcuuggaggcucccacauucuuugcagggggcucuuaggccagauggagcccacagaguaaaccaggaauggagauuuggguacuacucuuucauauccagcuucaucagaugcuugccugcucccagggcccccuaauucgaagacgcacccccuuuuccaucagucuccaccccccacccccguccugcuuccccacguccuccccucgaccuccgcccucuggaccccauucccaaguccagcuccacccaucuccacuccccgcugccucccuuugcccacuaacuugagucugggcugcaggguccggcgggcgcuguccccuccgcccggcggcugcucggcugugggggaaggcgcucugugcauggacggccggagaucacccgggcugcccuucucggugcccggcgcucggcgccugcugcgugcugcccucuuccccgcgcacgaugccguguccaccgcuguccaggcucugucccucccuccacgucuucucucuccgagccuccgcgccucugucugugccucugcccccccacccuccccggcugcgcuugccgccucuccgcgccuccgcccccgcaggacgcacagggagcgaggcccggagcugcgcuggcugccgggcuggcgggcggagggcgugggcagagccgggggcgggggugggggcgggggccggggaggcgggcgcuggggccucucggccgcggagacgccgcggcuuagagacugggagaggcggagacggggggggaggggguguggagcaggaggcgggggcggggauucagagccggggcgccgaauuggggaccgaggugaccgaggcccggcugugcagggcgggcuuggggacccagcgggcggggcgaggucguucugugccgcccacgccggaugcacagccggcccucuuggcgcccacguacccacgugagcgccccgccggcgacauuccuucucucccccaccccuccgagcugagagaggaguuucacaaccacgcacaaguacacaaagacacagaagcgcacggacgugcacacgcgccuaaacaacuacggggacgcccguugcccauacucaggccuug

SEQ ID NO: 19870 - RNA, 3048 nt, Homo sapiens
caaggccugaguaugggcaacgggcguccccguaguuguuuaggcgcgugugcacguccgugcgcuucugugucuuuguguacuugugcgugguugugaaacuccucucucagcucggaggggugggggagagaaggaaugucgccggcggggcgcucacguggguacgugggcgccaagagggccggcugugcauccggcgugggcggcacagaacgaccucgccccgcccgcuggguccccaagcccgcccugcacagccgggccucggucaccucgguccccaauucggcgccccggcucugaauccccgcccccgccuccugcuccacacccccuccccccccgucuccgccucucccagucucuaagccgcggcgucuccgcggccgagaggccccagcgcccgccuccccggcccccgcccccacccccgcccccggcucugcccacgcccuccgcccgccagcccggcagccagcgcagcuccgggccucgcucccugugcguccugcgggggcggaggcgcggagaggcggcaagcgcagccggggagggugggggggcagaggcacagacagaggcgcggaggcucggagagagaagacguggagggagggacagagccuggacagcgguggacacggcaucgugcgcggggaagagggcagcacgcagcaggcgccgagcgccgggcaccgagaagggcagcccgggugaucuccggccguccaugcacagagcgccuucccccacagccgagcagccgccgggcggaggggacagcgcccgccggacccugcagcccagacucaaguuagugggcaaagggaggcagcggggaguggagauggguggagcuggacuugggaaugggguccagagggcggaggucgaggggaggacguggggaagcaggacgggggugggggguggagacugauggaaaagggggugcgucuucgaauuagggggcccugggagcaggcaagcaucugaugaagcuggauaugaaagaguaguacccaaaucuccauuccugguuuacucugugggcuccaucuggccuaagagcccccugcaaagaaugugggagccuccaagcaccaggggaugcccuggagcucgagcuggcaucagugcggaagguggggggacgcucaguugccucagucccucguuggcacggagcgcgcgggcccccggugccuuugaguuaaaggagcaucagcgggggaaagggggggugacgagggaggcagggaggccuuaggcguuccuucccauaucugucccuuuauucacagagcggggaggggaguuucagugugcagccccuucaucaagaggccuugagccgcucccccacuccacuugaagaugcggguggaaaauaugggagaggagaguaggcgggagccccugggcgguuuucgccuacagacgcuaccacugugggagugugugugggcggaacggccccggagcagaacaauugcgccccucccccugccacggccccugagcugaaggaaaaggcugaccgaggaaguggggagugucacugcuaggagaggggccacugaggagcacugggcagccuggaaggguggagagguucugaggggagagaggaagcgugcguuaagaaugcuuaaccaggccgggcgggcccgguggcucaggccuguaaucccagcacuuugggaggcugaggcggguggaucacgaggucaggaauucgagcccagccugaccaacauggugaaaccccguuucuacuaaaaauacaaaaauuagccgggcaugguggcgggcgccuguaaucucagcuacucaggaggcugaggcaggagaaucgcuugaacccgggaggcggagguugcagugacagcgccacugcacuccagccugggugacagagcgagacuccgucucaaauaaauaaauaaauaaauaaauaaauaaaugcuuaaccccugggaaaagcugagcggagaagaguaaggcaccaccuggcucacugagugggaaagccagggaaggugccacacccucccuuuuagccaccuggggcuguggccccuucacagggaaugaagcuggccagcagcguccacugugggggagacugggcuccuacauucacuuuaguaugggugacuucacuucaguguugagacugcugaguguuuagaggggaaggugaggauuguguuuugggggagagggagguccagccaucccaggucggugcuggucagccucagcgcucaaguucuucuugccccagaccaaaaagauaaaagcugaagauaagguuguaagacgcuucgacuccuacagacacaggccacugacuuuuggggcuucgggccagucuaggacggcacuggcuuguccaugccucugagcagugccugauucugagagucuguacucagaccugggcacugggcaggauagcauccaaaugagggaggggaagaaaagcaggcaggaaagagggaacaauuguuaguguggguugguacccaguagggggacuugcaccgacugccucucucuugugccccuccuucucaggcccagugcccgagccauggcacugccucggacgcugggggagcugcagcuguaccggguccugcagcgcgccaaccuccuuuccuacuaugagaccuucauccagcagggaggggacgacgugcagcagcugugugaggcgggugaggaggaguuucuggagaucauggcacuugugggcauggccaccaagccccuccauguccggcgccugcagaaggcacugagagagugggccaccaauccagggcucuucagucaaccagugccugcuguucccgucuccagcaucccgcucuucaagaucucugagacugcggguacccggaaagggagcaugagcaaugggcauggcagcccaggggaaaaggcaggcagugcccgcaguuuuagccccaagagcccccuugaacuuggagagaagcuaucaccacugccugggggaccuggggcaggggaccc

SEQ ID NO: 19871 - RNA, 2640 nt, Homo sapiens
gcaucugucuacuccaugaccccaccugcccaucccagggagggcccugcccuucagaugcccccugagucagggccccucagcuccccagggcccaggagaaggggacaggagagaagcggggagggcacuuguuguggcuggugacuaacgcagcugggcuccugccagcacgccaugucguugguuggggagccugcggccuugccccugcacugcccacccugcggccccucgccccugcagccagccucucagccucuccccuuccucagggagugcacuccaggacuggggaucaggagaggagggacccagaaagggcuggaguugggguggugggguccuggugggggugcugggagcaaggggagggagugaagcggaagcugccuggggucugggagacauggugacuccugcuuggauggucaggaggaggggauggaugagggccucuggagggaaaaaucugcaggagguuugagguggcccagggccggaggggacaaagguggggaggagaaggccuaugcuccaucuccugaccuuucgccccccaccaucguaccccuccuuuccccgggcucuggaggaggcucuggcccuggguuuuaggggugaauggugaggucaugucggggggccccaaucauccaucuguccuguccgcaucagaccccagacccugucuccacagcucuccccgcuucugaggguuugcaggggcaguuggugaggagccugguggcucaugccuauggugcagugagcgaggcagaggcugccuucucucucuggaucuucccccgacccauucugacuccucuaagaucugcccucacccugggccuggguugagggaggaccucccuccauggcuuccccugggcucccaccauccucccugacugugcuggucuuggcugcacccucccaggcccuaaugagccuccagaucucagagaccccuggauccaagguaccccgagaggcccauccucugggugagcucagccccuugcaacagcagacaugcagaucccaggaggccgugacccccaucagcccagaucccccacuccacuccauaugggggcuccaggaggucuggggggaggggaaaccucagcaccucccccagcccagcagggaaggagcugggcgggccccaggggucucacugcuccucaggacacacugucccggaccccugccccugcccucugcucugaccucgcccagccagcggccugccaucccccugcgagucugagaggcagggggaacggggugggggcggguuuggguccuggccucucugccuuucccuuccaggcuuggcuaucgcgacuuagccgcccaguccggccacuuguugucgccaccgccucccgggccgccuucccggcgcgccgggcuggggguccccgcagggcugcagggaaggggcuacggccgcagguggggacgggggcggccccgcagcgggcaagagcagggcagucgcccucuccccuucugcugcugcccgagcagauugaauuuuuaaagcgacacgagcggaaugucaaugcgagcagagagccgcgggcgggcgccgcggaggggaucaggaugcgggugcuccggccgggccggcgcugggggcucagcgcggacccccgccccaguccgccgcguugccgcaccgucaccgccgacugcgcggccccgugaccccgcugcggggcccggcaaguuuccgcagcgcuggggaccacgcgggcaggggcugggccgcucuccgccugagcgacccccaccgcggcgccccggggugcggacaggucuugccgcggggcacagcugcuagcuggggcgcccaccuggcaaccggcaccugcggaccgccccccgccccccgcccccgcgccccuggcccgcgcuucaccugggcgcacagguaggagggccgccggggcggggaucccggcggacacucacccuccagcucguccuccgggauguccaccgggcgcugcuccgacagcagguugggcacgguguagaugccccgguacaucaacgccgccgucaccggguggaacggcaucuuggaggcuccgcgcccgcccgcccgccgcaaacuuugaggccggggcucaugggccgguggcggccccgggggcggcuggagcgggcggggcgcgcggcugcggagggcggcggcggcagcggcgaggcuggggacgccccuccgggggccuagcgcccccgcgccccgggccgccgggccaugccgcccgcucccucgucgggcucccagccggggccccgcaggggcagcgggggcggcgccgcucuggccuuuccgagagcuccggcugccucgcgcggugcccgccgcgcccgcuccucggugccccgcgcgcuccgcgcugcucgccgcccgcuaguccgcucgccggcgcggccgcuaccggcccggcgcucaggcuguagccgccucuccgcucgcucgcucgcucguucugugccgcgcuggcugcgcuccccgccucccccgccagccgcccgcccgcccccuccgcgcuccccacccccagcccgccccuucccgccgccggccccugagcggccgccccaaaccugcccggg

SEQ ID NO: 19872 - RNA, 2640 nt, Homo sapiens
cccgggcagguuuggggcggccgcucaggggccggcggcgggaaggggcgggcuggggguggggagcgcggagggggcgggcgggcggcuggcgggggaggcggggagcgcagccagcgcggcacagaacgagcgagcgagcgagcggagaggcggcuacagccugagcgccgggccgguagcggccgcgccggcgagcggacuagcgggcggcgagcagcgcggagcgcgcggggcaccgaggagcgggcgcggcgggcaccgcgcgaggcagccggagcucucggaaaggccagagcggcgccgcccccgcugccccugcggggccccggcugggagcccgacgagggagcgggcggcauggcccggcggcccggggcgcgggggcgcuaggcccccggaggggcguccccagccucgccgcugccgccgccgcccuccgcagccgcgcgccccgcccgcuccagccgcccccggggccgccaccggcccaugagccccggccucaaaguuugcggcgggcgggcgggcgcggagccuccaagaugccguuccacccggugacggcggcguugauguaccggggcaucuacaccgugcccaaccugcugucggagcagcgcccgguggacaucccggaggacgagcuggagggugaguguccgccgggauccccgccccggcggcccuccuaccugugcgcccaggugaagcgcgggccaggggcgcgggggcggggggcggggggcgguccgcaggugccgguugccaggugggcgccccagcuagcagcugugccccgcggcaagaccuguccgcaccccggggcgccgcggugggggucgcucaggcggagagcggcccagccccugcccgcgugguccccagcgcugcggaaacuugccgggccccgcagcggggucacggggccgcgcagucggcggugacggugcggcaacgcggcggacuggggcggggguccgcgcugagcccccagcgccggcccggccggagcacccgcauccugauccccuccgcggcgcccgcccgcggcucucugcucgcauugacauuccgcucgugucgcuuuaaaaauucaaucugcucgggcagcagcagaaggggagagggcgacugcccugcucuugcccgcugcggggccgcccccguccccaccugcggccguagccccuucccugcagcccugcggggacccccagcccggcgcgccgggaaggcggcccgggaggcgguggcgacaacaaguggccggacugggcggcuaagucgcgauagccaagccuggaagggaaaggcagagaggccaggacccaaacccgcccccaccccguucccccugccucucagacucgcagggggauggcaggccgcuggcugggcgaggucagagcagagggcaggggcagggguccgggacaguguguccugaggagcagugagaccccuggggcccgcccagcuccuucccugcugggcugggggaggugcugagguuuccccuccccccagaccuccuggagcccccauauggaguggagugggggaucugggcugaugggggucacggccuccugggaucugcaugucugcuguugcaaggggcugagcucacccagaggaugggccucucgggguaccuuggauccaggggucucugagaucuggaggcucauuagggccugggagggugcagccaagaccagcacagucagggaggauggugggagcccaggggaagccauggagggagguccucccucaacccaggcccagggugagggcagaucuuagaggagucagaaugggucgggggaagauccagagagagaaggcagccucugccucgcucacugcaccauaggcaugagccaccaggcuccucaccaacugccccugcaaacccucagaagcggggagagcuguggagacagggucuggggucugaugcggacaggacagauggaugauuggggccccccgacaugaccucaccauucaccccuaaaacccagggccagagccuccuccagagcccggggaaaggagggguacgaugguggggggcgaaaggucaggagauggagcauaggccuucuccuccccaccuuuguccccuccggcccugggccaccucaaaccuccugcagauuuuucccuccagaggcccucauccauccccuccuccugaccauccaagcaggagucaccaugucucccagaccccaggcagcuuccgcuucacucccuccccuugcucccagcacccccaccaggaccccaccaccccaacuccagcccuuucugggucccuccucuccugauccccaguccuggagugcacucccugaggaaggggagaggcugagaggcuggcugcaggggcgaggggccgcagggugggcagugcaggggcaaggccgcaggcuccccaaccaacgacauggcgugcuggcaggagcccagcugcguuagucaccagccacaacaagugcccuccccgcuucucuccuguccccuucuccugggcccuggggagcugaggggcccugacucagggggcaucugaagggcagggcccucccugggaugggcagguggggucauggaguagacagaugc

SEQ ID NO: 19873 - RNA, 2613 nt, Homo sapiens
gagguuugcgcagggaggggccuugcugcggagauggaggaggggaugguucugcucugcagaggaguggaaaaggaacagaaaaagcuaugcaucaaaaucccagcuuucccugcuagugcuggcaaagacuuagaaaccauccaggugguuggagauucucaacuauugucgaucacagaugcuuuuggaaaaucacugaagccucugcccucucucucaaaaacaacgcaaaguuuuacagacaguuucgugagacaucauggaacuccccggauuaagcagcccaguugaucuacccuccucuuucaacucaaaaagaaaugaaaaccagagagggcaaguguuggucaaggucacccugcagcugcugggcacagccucagggcagcgcaaucuagcugacucagggcugcaaggaguugggggaggggcagacuugggaggcucccagcuucccuaaaggagaaaggggacauuaaaacaugaaagggcccaccagccaccuccgccacaggcaacaacugacuguaguaaugguucccucuaggaagaaaggaugcgaaaagguccugacccacccccacguggaagauuuaagguaggaacguuaagcacugagcagguagugggaaggagccugguaggggugagaggaauagaguuucuugcgggguguaggagagggcauggcagcauuggcggggaagccuugcuacuuagaagggcuaagagucuccagcgcuugcagaccagaauccugcaccacuuuuuuccuguagaggaaacuuguuuuuuucuugacgggggagggaucucagaguggggucgccuaagcuugggguagagagcagcagggggcccagaguugaaguacagccguaaagaaccuggaaagggggaaccgaaggacaacccagaguuggggcgucccacaagagacccagaguaaaacugcgauuuaacuaggggcaugcacuuugcagagggaaggugagcagcgcgccacuccacgcgcaguccggcagcgcccccuugggucacgcagcccaaaaguucgcugcggggucagcaggggcgccccuccccccacccgcgcgccugcguaccucggaaccacuccucggacugcagcgugcucugcaccgcguggccuucaagcugcgcgcgaaucucgcgcagcgccgacgucacgucgcacuucagggcgucgcgcgucucggccugcaucugcgccugcgcggcgccggagcccuggaucuggccgagcagcucgcccaccucuuccuggugguggcgccgcagguagccgcacuccuccugcagcgccugcgccuucuucugcagguccacgcgcgccgccucggccuccugcgcgaagcgcgccagcgcgcgggccgccgccucggccuccucucgcugccgggccucgucgucuaggcgcuggcgcacgugcgcgauguccucgagcaggugcuccugcuccaggcguagcugaccgcgcgccgcgcccaggcgcagcaccgcgccgcgcaucucgcggaccucgcgcucguacagcucgcccauagcggagcggcccgccugcugcugccgcagcgccgcagccucgcccuccaggcugcgguugugcgccuccagcugccgcaccuugucgauguacccggcgaagcggucguucagcgccugcagcugcuccuucucacugcgugagguggccaccgccaccaugcagcccuccggcccguugcucagcguguccagcgagucggugcuugaggcggcgccugcgccacggaagcggcugggcgaggcggacacggagcucacggacguccguguccacgaguggaagccgcuggaggagccagcggcggagcgcgucccgccugcgccacccuuucgggcuagcgcguaguggaggcugccgccgccaugcagcggcgcgaacggggcgcccagcagcgcguccgcgccgccgaagcucaucauggccugagcaggugcgcgaggccgggacggggcgggaggcacugcggcagcaccagggcgccggcccuuuuauagccgccgcggccggguccaaccccuuggcagugagaggguggggaggagggccccgcccucuccgccuccuccccugcggccccccggccgaccggcuccgccgcagugagaggggcggggcaggggaccgaggagggaaggggaaucgacgcugcgucagaggagacccucgaggucggggaagcgggcagaggacucccggagugggccagugaggacccccgggugcgcgucggaagagccugcgaguguguucggaauaagaaaggggacuugaaacagggagaggacaaggagaaaccugaugggaauaggggcaggaugcccucgggauggagcaauggaagauugcagucauuaggaugaggggaucccuguaugagacaggacacgaggcuuuccaaauaguuaagagaggcuuucaggauagggggugcagagacugugcagccagccccggaacagaggagggagcaaggcaguccugaaugggagcauggacgcuccauagaacggagacaggagaccccugaccgggggagguac

SEQ ID NO: 19874 - RNA, 2613 nt, Homo sapiens
guaccucccccggucaggggucuccugucuccguucuauggagcguccaugcucccauucaggacugccuugcucccuccucuguuccggggcuggcugcacagucucugcacccccuauccugaaagccucucuuaacuauuuggaaagccucguguccugucucauacagggauccccucauccuaaugacugcaaucuuccauugcuccaucccgagggcauccugccccuauucccaucagguuucuccuuguccucucccuguuucaaguccccuuucuuauuccgaacacacucgcaggcucuuccgacgcgcacccggggguccucacuggcccacuccgggaguccucugcccgcuuccccgaccucgagggucuccucugacgcagcgucgauuccccuucccuccucgguccccugccccgccccucucacugcggcggagccggucggccggggggccgcaggggaggaggcggagagggcggggcccuccuccccacccucucacugccaagggguuggacccggccgcggcggcuauaaaagggccggcgcccuggugcugccgcagugccucccgccccgucccggccucgcgcaccugcucaggccaugaugagcuucggcggcgcggacgcgcugcugggcgccccguucgcgccgcugcauggcggcggcagccuccacuacgcgcuagcccgaaaggguggcgcaggcgggacgcgcuccgccgcuggcuccuccagcggcuuccacucguggacacggacguccgugagcuccguguccgccucgcccagccgcuuccguggcgcaggcgccgccucaagcaccgacucgcuggacacgcugagcaacgggccggagggcugcaugguggcgguggccaccucacgcagugagaaggagcagcugcaggcgcugaacgaccgcuucgccggguacaucgacaaggugcggcagcuggaggcgcacaaccgcagccuggagggcgaggcugcggcgcugcggcagcagcaggcgggccgcuccgcuaugggcgagcuguacgagcgcgagguccgcgagaugcgcggcgcggugcugcgccugggcgcggcgcgcggucagcuacgccuggagcaggagcaccugcucgaggacaucgcgcacgugcgccagcgccuagacgacgaggcccggcagcgagaggaggccgaggcggcggcccgcgcgcuggcgcgcuucgcgcaggaggccgaggcggcgcgcguggaccugcagaagaaggcgcaggcgcugcaggaggagugcggcuaccugcggcgccaccaccaggaagaggugggcgagcugcucggccagauccagggcuccggcgccgcgcaggcgcagaugcaggccgagacgcgcgacgcccugaagugcgacgugacgucggcgcugcgcgagauucgcgcgcagcuugaaggccacgcggugcagagcacgcugcaguccgaggagugguuccgagguacgcaggcgcgcggguggggggaggggcgccccugcugaccccgcagcgaacuuuugggcugcgugacccaagggggcgcugccggacugcgcguggaguggcgcgcugcucaccuucccucugcaaagugcaugccccuaguuaaaucgcaguuuuacucugggucucuugugggacgccccaacucuggguuguccuucgguucccccuuuccagguucuuuacggcuguacuucaacucugggcccccugcugcucucuaccccaagcuuaggcgaccccacucugagaucccucccccgucaagaaaaaaacaaguuuccucuacaggaaaaaaguggugcaggauucuggucugcaagcgcuggagacucuuagcccuucuaaguagcaaggcuuccccgccaaugcugccaugcccucuccuacaccccgcaagaaacucuauuccucucaccccuaccaggcuccuucccacuaccugcucagugcuuaacguuccuaccuuaaaucuuccacgugggggugggucaggaccuuuucgcauccuuucuuccuagagggaaccauuacuacagucaguuguugccuguggcggagguggcuggugggcccuuucauguuuuaauguccccuuucuccuuuagggaagcugggagccucccaagucugccccucccccaacuccuugcagcccugagucagcuagauugcgcugcccugaggcugugcccagcagcugcagggugaccuugaccaacacuugcccucucugguuuucauuucuuuuugaguugaaagaggaggguagaucaacugggcugcuuaauccggggaguuccaugaugucucacgaaacugucuguaaaacuuugcguuguuuuugagagagagggcagaggcuucagugauuuuccaaaagcaucugugaucgacaauaguugagaaucuccaaccaccuggaugguuucuaagucuuugccagcacuagcagggaaagcugggauuuugaugcauagcuuuuucuguuccuuuuccacuccucugcagagcagaaccauccccuccuccaucuccgcagcaaggccccucccugcgcaaaccuc

SEQ ID NO: 19875 - RNA, 2834 nt, Homo sapiens
uuugcaccugccuccuggcuggaaagugaguucccacugugcugucccucccuggggcccagcacggggcccggccccacaccgaccugaagagguugguaggaugacugaaugaauugacgcugggaugcagcagggcccaugggcagaggcuccagagccugggaaggaugggguggccuuucuguggcccuccgaauugagagaggucucagaggccugacaccacggcuuuccguccaggguuccuggucacccgcggagggcucagagccccgguggacucggggucccgccuuaaggggggugccuagggcagaaggaggagggaugucggcccccucagacccgcaccccaggcccuccccaccaccuuuccuucccucaggcccucugucuucccagucgccccgcccccugccccucuguccuaggcgcaagucuccgggcuugggacgcucgccgccagcgcccgcccgccugccccgccccuagccccccgccccccgccccccgcccccccgcagccccuccguccacucucggcuccuccuucucuuccuccuccuccuccccggggguggggagccggcuccggaagccccggcgcccccgccccgggccccgccagcgcuuuggagacggcuauccgcgcgggagugcgccacgcggggccggagcgccuauuagccgccaggaccucggagcgccccgaccaccccugagccccucuggcuucggagccccccagcaccccuucccggguccccucgcccacccuaauccacucucccucccuuucccggauucccucgcucaccccauccucucucccgccccuuccuggauucccucacccgucucgauccccucuccgcccuuucccagagacccagagccccugaccccccgcgcccuccccggagccccccgcgcgugccgcggccauggcggccgugcgcggggcgccccugcucagcugccuccuggcguugcuggcccugugcccuggagggcgcccgcagacggugcugaccgacgacgagaucgaggaguuccucgagggcuuccugucagagcuagaaccugagccccgggaggacgacguggaggccccgccgccucccgagcccaccccgcggguccgaaaagcccaggcggggggcaagccagggaagcggccagggacggccgcagaagguaagagcccagggcagggcggggguguggggggcuggcaucucaggugggaacagggggauucgguagggucuggccacuccccagucugcuaggggaggaauggcuggcuuacuaaugcgcacgcgagcccagaugccuggagggacccugugcuaggccgaggucagcgcuggcguggaggcacauccagcacccgggcggcagggccgcuuuugggggccgguggcucuaggguuggugcugugguuguacgggucgcuuauccccauuccuccaguacgcgacagguacuaggcuugagccacaggggacugugcugugucacccccugccauacuaaugggaccacucucccuguugguggcacagcuucacgucgucccucccuccugccuuugcccuccuacuccaggaggucucacguaggugagagaguuucaggugguggugagcacagggcuucaggugguggugagcaaugggugguccuacauuaguacaggaaauuagaugaggugaugcaucacugaagcauuuaacccacggccucuugcauaaucaguugucaguaaaucuuagcuguuuucaucguggcccucuggaagguggcagagggucuugugaucccugucucccaggagauuccaaggcaccauccaacauuccugaugucagcagccccuccccugccaccccagcucuagaucuuuccuggcugcuucccacacccugggcugccugugccccuccugccucuggcucuccuuccaggcuugcucuccuggcucuggggcaccgcucuagcagcccugcguccccuggcugucugcauuugguagcuuuccuguguuucugccaaacuucccucaugcuccccaccucucaucagguucucaacagcacuugcagcuccugcuuaggguccugggaggauucccauggggaauccucacaaccagucccugcucccucucccagacucugaaaugagugugcagccacaagcucccuaccugucuuuucuguccucugugugaucccugaaccccccaggacucccuauccuuccaaucaauuccaaaccccuuacuucucgaaaggagaccacuuccucuucuuugggcuucaauacucaaccaagugucccuuuucuuugaagcuuuucuugccccguaggagaccaggggaaggucuugggcccaugucccuuccuuuguauggcaguuggcagggaugaccagaugcuccuccaggccuggauggcucagucaccucucugccccuucugugcccagaacagaauaguggaggaguggauaguaaggaaccccuauugagguuuuggcagguggggggaugagggccucccccugggaacugggaacccuacgcucagucuuuagagagguugagauugguggucacagccccagacuugcagacagaaaaucuggguccggaucccaguuugccacuugggcaaaugacuuaaccucucaguuugcugauccgcacugggaacugacaagagucccugugcccagguucugggcaucuagagaggggccucaugggggcacagagcuggcucuguucauuugacacgagucugcaucuuggacagugccucc

SEQ ID NO: 19876 - RNA, 2834 nt, Homo sapiens
ggaggcacuguccaagaugcagacucgugucaaaugaacagagccagcucugugcccccaugaggccccucucuagaugcccagaaccugggcacagggacucuugucaguucccagugcggaucagcaaacugagagguuaagucauuugcccaaguggcaaacugggauccggacccagauuuucugucugcaagucuggggcugugaccaccaaucucaaccucucuaaagacugagcguaggguucccaguucccagggggaggcccucauccccccaccugccaaaaccucaauagggguuccuuacuauccacuccuccacuauucuguucugggcacagaaggggcagagaggugacugagccauccaggccuggaggagcaucuggucaucccugccaacugccauacaaaggaagggacaugggcccaagaccuuccccuggucuccuacggggcaagaaaagcuucaaagaaaagggacacuugguugaguauugaagcccaaagaagaggaaguggucuccuuucgagaaguaagggguuuggaauugauuggaaggauagggaguccugggggguucagggaucacacagaggacagaaaagacagguagggagcuuguggcugcacacucauuucagagucugggagagggagcagggacugguugugaggauuccccaugggaauccucccaggacccuaagcaggagcugcaagugcuguugagaaccugaugagagguggggagcaugagggaaguuuggcagaaacacaggaaagcuaccaaaugcagacagccaggggacgcagggcugcuagagcggugccccagagccaggagagcaagccuggaaggagagccagaggcaggaggggcacaggcagcccagggugugggaagcagccaggaaagaucuagagcugggguggcaggggaggggcugcugacaucaggaauguuggauggugccuuggaaucuccugggagacagggaucacaagacccucugccaccuuccagagggccacgaugaaaacagcuaagauuuacugacaacugauuaugcaagaggccguggguuaaaugcuucagugaugcaucaccucaucuaauuuccuguacuaauguaggaccacccauugcucaccaccaccugaagcccugugcucaccaccaccugaaacucucucaccuacgugagaccuccuggaguaggagggcaaaggcaggagggagggacgacgugaagcugugccaccaacagggagaguggucccauuaguauggcagggggugacacagcacaguccccuguggcucaagccuaguaccugucgcguacuggaggaauggggauaagcgacccguacaaccacagcaccaacccuagagccaccggcccccaaaagcggcccugccgcccgggugcuggaugugccuccacgccagcgcugaccucggccuagcacagggucccuccaggcaucugggcucgcgugcgcauuaguaagccagccauuccuccccuagcagacuggggaguggccagacccuaccgaaucccccuguucccaccugagaugccagccccccacacccccgcccugcccugggcucuuaccuucugcggccgucccuggccgcuucccuggcuugccccccgccugggcuuuucggacccgcggggugggcucgggaggcggcggggccuccacgucguccucccggggcucagguucuagcucugacaggaagcccucgaggaacuccucgaucucgucgucggucagcaccgucugcgggcgcccuccagggcacagggccagcaacgccaggaggcagcugagcaggggcgccccgcgcacggccgccauggccgcggcacgcgcggggggcuccggggagggcgcggggggucaggggcucugggucucugggaaagggcggagaggggaucgagacgggugagggaauccaggaaggggcgggagagaggauggggugagcgagggaauccgggaaagggagggagaguggauuagggugggcgaggggacccgggaaggggugcuggggggcuccgaagccagaggggcucagggguggucggggcgcuccgagguccuggcggcuaauaggcgcuccggccccgcguggcgcacucccgcgcggauagccgucuccaaagcgcuggcggggcccggggcgggggcgccggggcuuccggagccggcuccccacccccggggaggaggaggaggaagagaaggaggagccgagaguggacggaggggcugcgggggggcggggggcggggggcggggggcuaggggcggggcaggcgggcgggcgcuggcggcgagcgucccaagcccggagacuugcgccuaggacagaggggcagggggcggggcgacugggaagacagagggccugagggaaggaaaggugguggggagggccuggggugcgggucugagggggccgacaucccuccuccuucugcccuaggcaccccccuuaaggcgggaccccgaguccaccggggcucugagcccuccgcgggugaccaggaacccuggacggaaagccguggugucaggccucugagaccucucucaauucggagggccacagaaaggccaccccauccuucccaggcucuggagccucugcccaugggcccugcugcaucccagcgucaauucauucagucauccuaccaaccucuucaggucgguguggggccgggccccgugcugggccccagggagggacagcacagugggaacucacuuuccagccaggaggcaggugcaaa

SEQ ID NO: 19877 - RNA, 2577 nt, Homo sapiens
gcccuucagagcccaggccaggucuugcccaaggugggggagcggcggcacacaggggccagcucuccaggcugcagaugccugccugguggcuccugcucucccgcacucacuggugaccaggacaacaucucuugcaccucagcuuucucaucuacaaagcagagccaggauuagaguugaagcugaaagaagggggacccuguugccaggcugcuccagcuccccucagcagcaucagagcccugagcccugaaccaccagccaaaacuugucacccaagggcuuugcugcuggggugaugggacauccaggggguccugagacaaggggguccuuuggguucuugcaugccugacacccaacaucaggagugggcguggcugguggggcaucacugggugcccugaagcugggcucuugguucuggccccugguguggcccccagggcaggggaacggcugagcuguugggauggagcagaaaccaaaggccaaagguuuuuauaacucauucaaggucaccaagcaagccagaacagagccagcacaagacccuggggcugggaagucugggccugcacucccugccucccaccuagagcagaggcagcagccugugucaccccaaaccaggccccaggccccagcaguggucccaucucugggugacuucuugcccacagcaaggugcccuuggcccuacccacacauggcugaccuccacgccaggacuguccaggcucggcucuuucuaggccccguagaccccaucagccuccaccagcauuuguugacccagccuaaggacagguggucugcacacccagggccauugcuaaucaggccaccucccccaaggccuuccaccuuccagacccaacuuaggcuuuauuccaccaccuggcccuccauccgggcuuccuaggcucuggccaguccugcuccucccuccagagccaugaccagucgccggcccaggacagaccgggugcaacugaggacccucccgguggucaccugaucguacuggggguaucagccggacaccccgccuccagaacccgcugccucuguccagagcggcccagccccagcaggcuggcagcucggugcaaacaacgggaugcagcgggcgggaugcgagccccacgaucccugggucggaagccaagggcuuaagcccccacguucuuucuggcucgcggcgggcacuucgugcgccccaccuuccccgcaguucugagagaggcgguagcaggguucagauggagggaaggacagggcgcggaaaggggaggggacucgaggggggccagggggaugggggagaggggugaaaggugagcgauggaaagagaacccgggcuggagaggggagaggcugaaggcagggaaagaguggccacggccucaccugugcggggcccgggucgguccgccucgggcagcagcagcucggcgcgggcagccuccccaggcauggccuggccgugcgcccgcccgucccucaguccuuccgacccuccgucaguccgugccgccgccccgccgagccugcgcggccaccgccccucggccgggcggugggggcagugggugacgucaggccgccccgcccgccugucccagcgagugagcgugcgcgggcucgccaggcacugcggagggcguagggggggcucccuccccgcccccaccccacccggcuguggccucccucucgcugugggcgguuucgugggggagcgggggugggcgccugcgcccggucccacccuuuccacagcauuuacgagggaggguuucagggccaauuggaagcuggguugccucaggguggcauucgcccguggccaggaagaggcggggacgccccuagaacccugguugugggaggcuggggaggugguugggauucugggaugcucggagcgcuuuggguggaguuggcggcgcagccuccuuccccgcugaccaagcagagggugcagggccuggggagggagggggccccgcccagcccgaugccuccaugcaaaaggugagcuggagcugcagcucuggagugauuggcugguccuggcagucgucggucuccguggcaaccgccuccugucuccauggcaaccagggauggagccgacgagagcgcaccagggaaggcgacccggaugggucggucuccaggucucuaggcaacucggugaucuguccuaucaucuccccuccacccccacacuaggcaguagaaggaaaaggaagaaaguguuucccucuauuccuggcagcacccucugccacaccucccaggaggaagcccgccccgugaauuuccugaaaugccucuugcuuucacacaggcuacugcgccacccagauucacugagcaccccuccucccccgugccaggcaccagggagacagaugaaugagacauugucaucaccccugacugggguggggggaaucagaguagccauugucacaggcagggagggagguuucaacauccucagucuucuguggguucuaacuuugagcucaugaagccaggggcugcccucugacuccccc

SEQ ID NO: 19878 - RNA, 2577 nt, Homo sapiens
gggggagucagagggcagccccuggcuucaugagcucaaaguuagaacccacagaagacugaggauguugaaaccucccucccugccugugacaauggcuacucugauuccccccaccccagucaggggugaugacaaugucucauucaucugucucccuggugccuggcacgggggaggaggggugcucagugaaucuggguggcgcaguagccugugugaaagcaagaggcauuucaggaaauucacggggcgggcuuccuccugggagguguggcagagggugcugccaggaauagagggaaacacuuucuuccuuuuccuucuacugccuaguguggggguggaggggagaugauaggacagaucaccgaguugccuagagaccuggagaccgacccauccgggucgccuucccuggugcgcucucgucggcuccaucccugguugccauggagacaggaggcgguugccacggagaccgacgacugccaggaccagccaaucacuccagagcugcagcuccagcucaccuuuugcauggaggcaucgggcugggcggggcccccucccuccccaggcccugcacccucugcuuggucagcggggaaggaggcugcgccgccaacuccacccaaagcgcuccgagcaucccagaaucccaaccaccuccccagccucccacaaccaggguucuaggggcguccccgccucuuccuggccacgggcgaaugccacccugaggcaacccagcuuccaauuggcccugaaacccucccucguaaaugcuguggaaagggugggaccgggcgcaggcgcccacccccgcucccccacgaaaccgcccacagcgagagggaggccacagccggguggggugggggcggggagggagcccccccuacgcccuccgcagugccuggcgagcccgcgcacgcucacucgcugggacaggcgggcggggcggccugacgucacccacugcccccaccgcccggccgaggggcgguggccgcgcaggcucggcggggcggcggcacggacugacggagggucggaaggacugagggacgggcgggcgcacggccaggccaugccuggggaggcugcccgcgccgagcugcugcugcccgaggcggaccgacccgggccccgcacaggugaggccguggccacucuuucccugccuucagccucuccccucuccagcccggguucucuuuccaucgcucaccuuucaccccucucccccaucccccuggccccccucgaguccccuccccuuuccgcgcccuguccuucccuccaucugaacccugcuaccgccucucucagaacugcggggaagguggggcgcacgaagugcccgccgcgagccagaaagaacgugggggcuuaagcccuuggcuuccgacccagggaucguggggcucgcaucccgcccgcugcaucccguuguuugcaccgagcugccagccugcuggggcugggccgcucuggacagaggcagcggguucuggaggcgggguguccggcugauacccccaguacgaucaggugaccaccgggaggguccucaguugcacccggucuguccugggccggcgacuggucauggcucuggagggaggagcaggacuggccagagccuaggaagcccggauggagggccaggugguggaauaaagccuaaguugggucuggaagguggaaggccuugggggagguggccugauuagcaauggcccugggugugcagaccaccuguccuuaggcugggucaacaaaugcugguggaggcugauggggucuacggggccuagaaagagccgagccuggacaguccuggcguggaggucagccauguguggguagggccaagggcaccuugcugugggcaagaagucacccagagaugggaccacugcuggggccuggggccugguuuggggugacacaggcugcugccucugcucuaggugggaggcagggagugcaggcccagacuucccagccccagggucuugugcuggcucuguucuggcuugcuuggugaccuugaaugaguuauaaaaaccuuuggccuuugguuucugcuccaucccaacagcucagccguuccccugcccugggggccacaccaggggccagaaccaagagcccagcuucagggcacccagugaugccccaccagccacgcccacuccugauguugggugucaggcaugcaagaacccaaaggacccccuugucucaggacccccuggaugucccaucaccccagcagcaaagcccuugggugacaaguuuuggcuggugguucagggcucagggcucugaugcugcugaggggagcuggagcagccuggcaacagggucccccuucuuucagcuucaacucuaauccuggcucugcuuuguagaugagaaagcugaggugcaagagauguuguccuggucaccagugagugcgggagagcaggagccaccaggcaggcaucugcagccuggagagcuggccccugugugccgccgcucccccaccuugggcaagaccuggccugggcucugaagggc

SEQ ID NO: 19879 - RNA, 2544 nt, Homo sapiens
aucuuauaacucacaucaaccuauacuacagugcuacuaaggugguaaucaugaugauugcuaaagcccaagaaugacgauguguaucaguauuucuaagaucacuuuuugaauaccccaaaaugcacaauaauguacgacacuuggcaaaugacauaacuuugccccgagagacaaaugccuccagcagcuuuaacagcugaccagagccaguguauguuucaggcaucuugccuuuccaugaauccagcauuucucaggggugaacagagccagccuugccgagccagaaaauaacuucacccgggcguggaacucuacagcuacauaaauuauaaagggacuguucauccugcuagcccuagaugggggccugcccagugacaucuguccaacgugaucguuggggaguugggggaauuaggauggggagaauucucccagccuucagcugugcaaggcaggaacuuuauuucucauauaacuaggugaggcuggcuaagaaugcuugaaagaacagcugccaaauccauuuaaacaacccccgcuccuuuuuuuaagggaacaaugugaugcccuuaccagagucgcugucugccugauacugauaguggcuaagccaagaggguaacucugccaaauguuugcauuuuuccucuucuggggcuccccuuaacaacaucucauucccccccccauuucagauuaagaagggagacagcccuaggacugauuccaauucccuuccgugucauugaaauugacuuaguccacauugcccgcacccaccacgcaccuggaaguuuguuugaggucggcgcaggugcagggguggcccgaguuguaagaaugguaugguacugaaaguggcacgcggaguucaaaccuacacucuguuguggccgcuggguaaccuuaagaaguuacuucuuuuucagcuucagguuuuccaaccgcagaagauaucaaaacccgaauccacuuuacuuguuuuuggacauaccgggacuagacauugcuuugcaaaccaaaaggcugugcaaagucaguauuuuaaaagagagguacuauuuccuacaacgugccugcccaccuuccuugguccaaauccgccuauaucccccccauccccaagcaucccugggauugcaguccgugugcacccccgugcggggcgaggagaaucuccuguguccaggaucuuuccaacagcuaaacaucgguaccgcuccccucagcuccggaaaccuuuaacccauuuucacugaaagcgcuuugcaauuuacaaguacucugcacuuagagaaucgagcaaguagagggccggcuggggagggucccuccggcgaccgccuucaccuuucccggagcgccuucaguuuccccacauauuaucuccagugagaagaaaagcggagucucccgcagcggcacccagcaacccccaggcccuucggcgccagugcgccgggugcugcacgcagcgcaccuggcgcgggcggcucaccuggagcuggcggcgcuggcagcagguaggcgcgcaggcggcugacggcacuagcguugacgcagagcccgcggccguccagcagcgccugcagcggucgcgccucgucgggcgacggcuggcagcgaaggccggagccacagcgcucgguguagaugccgcacggcuggcccucgcucagugcgcacgucaggcagcagccgcagcccggcucgcgcaccagcuccgcgcacacggcgggcggaggcgcgcacugggccagugcacgcgcgucgcacggcucgcagcgcaccacgggacccaagcccgccgagcucgcgccagcccgcgccaccggcggcccgcggagcagcaccagcagagucagcgcagcggcccagagcgugggucgcgcccgcugcaugacgccugcaaccggggcacgcugcuuggcaggcugggcgcgcagggauggggcgacaguacacggcgcgaagcuguggaauccaggcaggaagcggcugauccucagcgcccagccgcagugcucgcaucugggcggcccgggcgcgccggccgcuauauagaagccgggguggcccaggacacgccccggaacggcgcgcccaggaguggggguugggaggggggcgggucggcgcaggcacggcugcgggggcccgugcuucgcccugagcagccggggccgagcucgggggcgugcagcucgagacucgcccgggcaccugcuccucgugcgcacgcccggagcccgggucaccuugucgucuacaagaaccaaggugugcccggccaccccggcacuccaggccaccucagcacccccggucaccccagucacuccuggccaacucagcacccccgaucuccuugaccccgccgcccuuaccccuuccgcucucggggugaggucucccugcggcgagccggugucggggaaacuggcauacagcgcuccgcauucguguguaccucguggagcuuucuaaaauuuaauuccguuggcaggcgaagucuugggacauuucugacuuaca

SEQ ID NO: 19880 - RNA, 2544 nt, Homo sapiens
uguaagucagaaaugucccaagacuucgccugccaacggaauuaaauuuuagaaagcuccacgagguacacacgaaugcggagcgcuguaugccaguuuccccgacaccggcucgccgcagggagaccucaccccgagagcggaagggguaagggcggcggggucaaggagaucgggggugcugaguuggccaggagugacuggggugaccgggggugcugagguggccuggagugccgggguggccgggcacaccuugguucuuguagacgacaaggugacccgggcuccgggcgugcgcacgaggagcaggugcccgggcgagucucgagcugcacgcccccgagcucggccccggcugcucagggcgaagcacgggcccccgcagccgugccugcgccgacccgccccccucccaacccccacuccugggcgcgccguuccggggcguguccugggccaccccggcuucuauauagcggccggcgcgcccgggccgcccagaugcgagcacugcggcugggcgcugaggaucagccgcuuccugccuggauuccacagcuucgcgccguguacugucgccccaucccugcgcgcccagccugccaagcagcgugccccgguugcaggcgucaugcagcgggcgcgacccacgcucugggccgcugcgcugacucugcuggugcugcuccgcgggccgccgguggcgcgggcuggcgcgagcucggcgggcuugggucccguggugcgcugcgagccgugcgacgcgcgugcacuggcccagugcgcgccuccgcccgccgugugcgcggagcuggugcgcgagccgggcugcggcugcugccugacgugcgcacugagcgagggccagccgugcggcaucuacaccgagcgcuguggcuccggccuucgcugccagccgucgcccgacgaggcgcgaccgcugcaggcgcugcuggacggccgcgggcucugcgucaacgcuagugccgucagccgccugcgcgccuaccugcugccagcgccgccagcuccaggugagccgcccgcgccaggugcgcugcgugcagcacccggcgcacuggcgccgaagggccuggggguugcugggugccgcugcgggagacuccgcuuuucuucucacuggagauaauauguggggaaacugaaggcgcuccgggaaaggugaaggcggucgccggagggacccuccccagccggcccucuacuugcucgauucucuaagugcagaguacuuguaaauugcaaagcgcuuucagugaaaauggguuaaagguuuccggagcugaggggagcgguaccgauguuuagcuguuggaaagauccuggacacaggagauucuccucgccccgcacgggggugcacacggacugcaaucccagggaugcuuggggaugggggggauauaggcggauuuggaccaaggaaggugggcaggcacguuguaggaaauaguaccucucuuuuaaaauacugacuuugcacagccuuuugguuugcaaagcaaugucuagucccgguauguccaaaaacaaguaaaguggauucggguuuugauaucuucugcgguuggaaaaccugaagcugaaaaagaaguaacuucuuaagguuacccagcggccacaacagaguguagguuugaacuccgcgugccacuuucaguaccauaccauucuuacaacucgggccaccccugcaccugcgccgaccucaaacaaacuuccaggugcguggugggugcgggcaauguggacuaagucaauuucaaugacacggaagggaauuggaaucaguccuagggcugucucccuucuuaaucugaaaugggggggggaaugagauguuguuaaggggagccccagaagaggaaaaaugcaaacauuuggcagaguuacccucuuggcuuagccacuaucaguaucaggcagacagcgacucugguaagggcaucacauuguucccuuaaaaaaaggagcggggguuguuuaaauggauuuggcagcuguucuuucaagcauucuuagccagccucaccuaguuauaugagaaauaaaguuccugccuugcacagcugaaggcugggagaauucuccccauccuaauucccccaacuccccaacgaucacguuggacagaugucacugggcaggcccccaucuagggcuagcaggaugaacagucccuuuauaauuuauguagcuguagaguuccacgcccgggugaaguuauuuucuggcucggcaaggcuggcucuguucaccccugagaaaugcuggauucauggaaaggcaagaugccugaaacauacacuggcucuggucagcuguuaaagcugcuggaggcauuugucucucggggcaaaguuaugucauuugccaagugucguacauuauugugcauuuugggguauucaaaaagugaucuuagaaauacugauacacaucgucauucuugggcuuuagcaaucaucaugauuaccaccuuaguagcacuguaguauagguugaugugaguuauaagau

SEQ ID NO: 19881 - RNA, 2556 nt, Homo sapiens
ccccgggauagacagggaaggcagguuacagaacugcgcaggguggucaacugggauccacaaggccuuagcccagaaaccacaguuacuuugaaaaguaaaguuuucugggucgucuggcucuaggguuggaaugagccaaagacacugguagggaguccauaggaguaaggagaaguuaaaagcagggccaggcuggggaggucagagccagaaccgcggaguguacaagcucccaaguccaggcaaaauucugaauccggcagaagccagcuucauguugcacaagcaaagguucacuuggugcccggacggcaggccgcccagagcaugaggcguuguuucauuuuguuucacguguuuuugaaaagguagagacuacaaagggccaauguggagggcuaauugcacuucuuguccacuuagacacuugguuccuuuaaaggucuccagggcugcgccccugccccagaucccgcaaucaccacuccagcugaccucucugugcccagccacugaaagaucgcugacgcgaaaucccaccgcaccucaaccgcaguaacgggcccaggcuucgcagagggccagaggacgccgaaggggccacuguagaggggggcgaccccaagaugcggccugaggucgggagcgccucagcugcggccagcguccuucguugccagcgcgcacccggccuucucucugcccagucugggcugcggaccgcagggucccagcagggggugaagggugacuggccuagcaccucaaagggucucggggauuugugaagccggagggcagcaagucgcgugcugccauccuuguagcugaacccgcggccccaggacacggucgagaacagagaacuaggccucagcggcguagcccacgcagacccgagcugggaggucgaagccucgcccccgccgcugccgggaacccggggugccacucucaggggucagggaggggcgcuggaaacugggccuggggcccuggggggccaucgcuacaccccgcuuagcgggaucgcugugaagcaagccagggacucgggcuaggacguucaaggagagaaguuagagcuaaagaagcuccccccagccccguucccgcccccgucuucugggacccaagaccugggcugagggaguccagcuuguaggaaggggaccggaagggaagcagccagggcucuagggccgaaggaaaaugggacucaaagcugcgacggcuuugcgaagcugcagcgugaguuuucaaagacuuucuccaaacuuagcacuucagcuugguuacuucggaggaggcgggggagggggcugcgggccgcgacagcgccccgggguccucggcucaccaagaggggagccaggccgcucccacagccccgaccaccugcuggggaccggggaagccgggauccauuugaggagggggagauaaggguaaccaacgcgcucccggaguccgggguggccccgcggcuuucuccuuaccugcccucagcugccggggccguucaccaucuaccuggaucucucacagagacccgccgggcagccaaccugcaaaacagagcagcacuggaauuacccuggcggcuggucuaggacccccagguuucuuucuuuucccaacuuccuucuucccaccucuaucuuuuuuuucaauggcuuugugcguguccuucuggguuucacuuuauugcacagacacuuuguuugcuaagccccacacguucucaggacauugccucgccugggaucgcgccgaggggccgcaagggggggaauucgaggggcagaguugggagguggcucggcguugccgcggcacucccggugcaacguggaggcaguggggacugggaaguccugcagagucacuuugcaaacuaaauaaaucaagcgauuuaccuugucggaguggcuugucuugcucgguuguuuaggugauuggaaauguagccugaugaagauugaucaccuuucuacugcccuccccggguaugugaacgcgaggcgagugcguaacggggcuaggccgccaaucgggggccccgcgcgggcugagugacagggagccgggcaauggcugcgcgagccggggguuaccuccgcgcgcccccgcccucccccgccccccacaccccgcccuccccgcccucccgccccgccccggucgcgcgcuaacuccgggacucggcuggcaaaagcggcgcagagcuaggcgaggaaggcgagcggagagcccgaguccuggccgcggagggggccgugggucuccaggccugcccugggcgcccccgcccuucucgcgcucucggcgcuccggagggaguggcagggaggaggcgaggugcuggagaaccgguuccuucgcucucccgcgcgcuacagggcucagccgcucgggugugggcgccaggacccgggggcggcgggcuggaggagcccgggccucggccccucucccggcgccgcgggccccagcguuuucuuccccggcgccgccaccugagaccgacgccgcgggcugcucgugccggcg

SEQ ID NO: 19882 - RNA, 2556 nt, Homo sapiens
cgccggcacgagcagcccgcggcgucggucucagguggcggcgccggggaagaaaacgcuggggcccgcggcgccgggagaggggccgaggcccgggcuccuccagcccgccgcccccggguccuggcgcccacacccgagcggcugagcccuguagcgcgcgggagagcgaaggaaccgguucuccagcaccucgccuccucccugccacucccuccggagcgccgagagcgcgagaagggcgggggcgcccagggcaggccuggagacccacggcccccuccgcggccaggacucgggcucuccgcucgccuuccucgccuagcucugcgccgcuuuugccagccgagucccggaguuagcgcgcgaccggggcggggcgggagggcggggagggcgggguguggggggcgggggagggcgggggcgcgcggagguaacccccggcucgcgcagccauugcccggcucccugucacucagcccgcgcggggcccccgauuggcggccuagccccguuacgcacucgccucgcguucacauacccggggagggcaguagaaaggugaucaaucuucaucaggcuacauuuccaaucaccuaaacaaccgagcaagacaagccacuccgacaagguaaaucgcuugauuuauuuaguuugcaaagugacucugcaggacuucccaguccccacugccuccacguugcaccgggagugccgcggcaacgccgagccaccucccaacucugccccucgaauucccccccuugcggccccucggcgcgaucccaggcgaggcaauguccugagaacguguggggcuuagcaaacaaagugucugugcaauaaagugaaacccagaaggacacgcacaaagccauugaaaaaaaagauagaggugggaagaaggaaguugggaaaagaaagaaaccuggggguccuagaccagccgccaggguaauuccagugcugcucuguuuugcagguuggcugcccggcgggucucugugagagauccagguagauggugaacggccccggcagcugagggcagguaaggagaaagccgcggggccaccccggacuccgggagcgcguugguuacccuuaucucccccuccucaaauggaucccggcuuccccgguccccagcagguggucggggcugugggagcggccuggcuccccucuuggugagccgaggaccccggggcgcugucgcggcccgcagcccccucccccgccuccuccgaaguaaccaagcugaagugcuaaguuuggagaaagucuuugaaaacucacgcugcagcuucgcaaagccgucgcagcuuugagucccauuuuccuucggcccuagagcccuggcugcuucccuuccgguccccuuccuacaagcuggacucccucagcccaggucuugggucccagaagacgggggcgggaacggggcuggggggagcuucuuuagcucuaacuucucuccuugaacguccuagcccgagucccuggcuugcuucacagcgaucccgcuaagcgggguguagcgauggccccccagggccccaggcccaguuuccagcgccccucccugaccccugagaguggcaccccggguucccggcagcggcgggggcgaggcuucgaccucccagcucgggucugcgugggcuacgccgcugaggccuaguucucuguucucgaccguguccuggggccgcggguucagcuacaaggauggcagcacgcgacuugcugcccuccggcuucacaaauccccgagacccuuugaggugcuaggccagucacccuucacccccugcugggacccugcgguccgcagcccagacugggcagagagaaggccgggugcgcgcuggcaacgaaggacgcuggccgcagcugaggcgcucccgaccucaggccgcaucuuggggucgccccccucuacaguggccccuucggcguccucuggcccucugcgaagccugggcccguuacugcgguugaggugcggugggauuucgcgucagcgaucuuucaguggcugggcacagagaggucagcuggaguggugauugcgggaucuggggcaggggcgcagcccuggagaccuuuaaaggaaccaagugucuaaguggacaagaagugcaauuagcccuccacauuggcccuuuguagucucuaccuuuucaaaaacacgugaaacaaaaugaaacaacgccucaugcucugggcggccugccguccgggcaccaagugaaccuuugcuugugcaacaugaagcuggcuucugccggauucagaauuuugccuggacuugggagcuuguacacuccgcgguucuggcucugaccuccccagccuggcccugcuuuuaacuucuccuuacuccuauggacucccuaccagugucuuuggcucauuccaacccuagagccagacgacccagaaaacuuuacuuuucaaaguaacugugguuucugggcuaaggccuuguggaucccaguugaccacccugcgcaguucuguaaccugccuucccugucuaucccgggg

SEQ ID NO: 19883 - RNA, 2562 nt, Homo sapiens
gcuccgccucccgcuccuccgccgucugccgccugcaccgggggagggagagggacaguaccgucaugcacccggcaccgcggggccgccggcggggccccggcccucccgggagccgaggccauccgggagccucgaggcgcagaacccgucugccucccagcccgcgcuuuacgcccgaggcucuuauauccagggagccgguuaggaucauuuguuuuuguugugugccagagggucuccaggaggggacucugcccgccgcccaccugcacgcccggguauuguggcuucaccaacaauaaagauuguuccuuucgccagauagcaagggcagggccuauguguaacugacuuggcccugcgggaaccggggucgcugggguccgcgggugagcaggcuggcucugcaccacccgcacgacgcccgggggcugggucagucucauccaguucgcccagggccugucuugaaccccuuuccagacgcgaucgcuucgccguuuacggguugaaucaaaacagagaucggauaaaaacgcggcuggaauggagacgcggagauggggggagaggaaaccggcguccacgaggauuguugaaaauccgagagggcgggcuggaagaaggaggagaaggagagugcgagaggcccgugugugugcgcgugugugugugugugugugugccuguguguuuggggcgggggugggugagaggaaaucaagugaacgcaggagaccguacaaaacacggggagagaguuggaggggcucacgaaagauggggauggggauggaggagaaaccaaggcgugggagaccacgauggagagagaagcacaggccagcgagaagggugaaaggaagagguacaaucugcgaaggcgggguggggguguguuugggggaggcagaggggggcggggguaguggauagccuuaaaauagggcuagugcgaggcugcggcucggggcgggacaggugaagggcagguguaaggugggccgggucaggccucucucaccgccacuugguccuccgguuuuggaaccaggucuugaccugcgcguccgucauuuugagggacuuggcgagcgccgcccucucggcagaggccagguacuucuggcgauggaagcgcuuuuccagcucgcagaucugcacccgggaaaaggacgugcgcggcuucuuacgcuugggcggcguccgguucugguagggguggccgaugcgccgggucacggugaagggcgugagugcggccgccgcugcggagacacaggagggccccugaagcccagcccggcuccgccaccguucaggccccaugcggaccccguggcgccccgugggacacggagagcuccgcuauuucgcuggucgcgcgcguuuccagagacaccaagccggucgggagacccccucgcccccugucccuucccccgggcacgggcuuauuuuccugcaacucuccgauuacccuccccaccacggcugcccggggcccuggggccgaggccuccgccgcgcuugggccucugaaaugguuuccgggaguggagcgcacagggcgcggcgccucuggccccgagagggcggaggccuggagccuggucgccagcucugcucaccugugaagcggucuuucacgaagcggcggcugcucuccauccaggggaaauugagaccgccaaggcuggagaccgugggcacggagggcauggcggguagcgcgcuuggcagaggcgguggcacggccccgggcagcggccugugcgccggcacccggaucacgccugcgggcgcuaggcucagguucacacuguaagaucccgcguccucgaagggcgcgccgaggcccgcaaaggaggcgggcagagacggguauguggcgcccggacggcccccggggggcccucccagguagcuggcgccgucggggccccgcggggcgggugcgcuguccugguccgggcuguuaaggaucuggucgaugccgaagcugaugggcucgugcgggugcggggucugcgcgcuggcgggcgccuccauccugggcgggcggaagggcugggcugggcugggcggggaggcggcuggguccccguuacggcgcggccauggagcgcccggcgccucucgucgcacugaaacuuugccaagagugcgcgggcccgacaggcucugugucaucuuucuugaaccgaaccuggaguuuccgcugcuaauuccucuccugccgcagccauuggcugcgaucaacaagccucucuccucucauuggcucccggcuuucaauaaaggccuaauucauggaaauaggagcuuagggacuguuccaaggugacaucauuuuaacaaacgaacaauaggucaaauuuauuagcagggauaaugggcggcggauauuagagcccgaaccacagccucccaaacccgaaaucuaacgaagcugcaauuagcagacgcuccccgcuccuccgggccgggccgcuucccagacaccgcgcuggguggguagagcgcuccgcuugugaaauugucuuuugcugagugggu

SEQ ID NO: 19884 - RNA, 2562 nt, Homo sapiens
acccacucagcaaaagacaauuucacaagcggagcgcucuacccacccagcgcggugucugggaagcggcccggcccggaggagcggggagcgucugcuaauugcagcuucguuagauuucggguuugggaggcugugguucgggcucuaauauccgccgcccauuaucccugcuaauaaauuugaccuauuguucguuuguuaaaaugaugucaccuuggaacagucccuaagcuccuauuuccaugaauuaggccuuuauugaaagccgggagccaaugagaggagagaggcuuguugaucgcagccaauggcugcggcaggagaggaauuagcagcggaaacuccagguucgguucaagaaagaugacacagagccugucgggcccgcgcacucuuggcaaaguuucagugcgacgagaggcgccgggcgcuccauggccgcgccguaacggggacccagccgccuccccgcccagcccagcccagcccuuccgcccgcccaggauggaggcgcccgccagcgcgcagaccccgcacccgcacgagcccaucagcuucggcaucgaccagauccuuaacagcccggaccaggacagcgcacccgccccgcggggccccgacggcgccagcuaccugggagggccccccgggggccguccgggcgccacauacccgucucugcccgccuccuuugcgggccucggcgcgcccuucgaggacgcgggaucuuacagugugaaccugagccuagcgcccgcaggcgugauccgggugccggcgcacaggccgcugcccggggccgugccaccgccucugccaagcgcgcuacccgccaugcccuccgugcccacggucuccagccuuggcggucucaauuuccccuggauggagagcagccgccgcuucgugaaagaccgcuucacaggugagcagagcuggcgaccaggcuccaggccuccgcccucucggggccagaggcgccgcgcccugugcgcuccacucccggaaaccauuucagaggcccaagcgcggcggaggccucggccccagggccccgggcagccgugguggggaggguaaucggagaguugcaggaaaauaagcccgugcccgggggaagggacagggggcgagggggucucccgaccggcuuggugucucuggaaacgcgcgcgaccagcgaaauagcggagcucuccgugucccacggggcgccacgggguccgcauggggccugaacgguggcggagccgggcugggcuucaggggcccuccugugucuccgcagcggcggccgcacucacgcccuucaccgugacccggcgcaucggccaccccuaccagaaccggacgccgcccaagcguaagaagccgcgcacguccuuuucccgggugcagaucugcgagcuggaaaagcgcuuccaucgccagaaguaccuggccucugccgagagggcggcgcucgccaagucccucaaaaugacggacgcgcaggucaagaccugguuccaaaaccggaggaccaaguggcggugagagaggccugacccggcccaccuuacaccugcccuucaccugucccgccccgagccgcagccucgcacuagcccuauuuuaaggcuauccacuacccccgccccccucugccucccccaaacacacccccaccccgccuucgcagauuguaccucuuccuuucacccuucucgcuggccugugcuucucucuccaucguggucucccacgccuugguuucuccuccauccccauccccaucuuucgugagccccuccaacucucuccccguguuuuguacggucuccugcguucacuugauuuccucucacccacccccgccccaaacacacaggcacacacacacacacacacacgcgcacacacacgggccucucgcacucuccuucuccuccuucuuccagcccgcccucucggauuuucaacaauccucguggacgccgguuuccucuccccccaucuccgcgucuccauuccagccgcguuuuuauccgaucucuguuuugauucaacccguaaacggcgaagcgaucgcgucuggaaagggguucaagacaggcccugggcgaacuggaugagacugacccagcccccgggcgucgugcggguggugcagagccagccugcucacccgcggaccccagcgaccccgguucccgcagggccaagucaguuacacauaggcccugcccuugcuaucuggcgaaaggaacaaucuuuauuguuggugaagccacaauacccgggcgugcaggugggcggcgggcagaguccccuccuggagacccucuggcacacaacaaaaacaaaugauccuaaccggcucccuggauauaagagccucgggcguaaagcgcgggcugggaggcagacggguucugcgccucgaggcucccggauggccucggcucccgggagggccggggccccgccggcggccccgcggugccgggugcaugacgguacugucccucucccucccccggugcaggcggcagacggcggaggagcgggaggcggagc

SEQ ID NO: 19885 - RNA, 2589 nt, Homo sapiens
gcaaagccggcagcgcgaguugagucuauuguuucuuaaauugccaucaggguuuuuuuuuuuuuuuuuuuuuuuuuuuuuuuuuuuucuuccugcuucuucaagugaaggguaccucuacaaaaggaaacuccagccccuccuguccuccaccggccugugaucauuacaaaaaaaaaaaaaaaaaagcaaaaaaaaaaaaaaagcacccaaaccaaaaaucaaccaaccaaacaacccccaacagccaagcauacaucucuaauuuuauuauuuuggucuuuucguuggauuuucccuuucuucuuuuuuucggguuaucgcucaguuuugagcagagguuuacauuuuuuaaaaauuugcuuuccagcccgccuugaucuucuaagugcgaguucaucgucugagaaaaaaaaaaaucucugguuggcguuuuuguuucuuuucuuuucuuucuuuucuuuccuuuuuuuuuuuuuuuaauuuuuuucaagggggaggagauuuuccacaagaaaagguuguuuucauguuugggauucaggaaagcauccaacggaguggaagcagcaugaaggaagagccgcugggcagcggcaugaacgcggugcggacguggaugcagggcgccggggugcuggacgccaacacggcggcgcagagguggguacugcgcggggaccgcggccgaggugagccgcgagcgggagagccgggaggcggaggcggcagcggcagcggcagcugcugccgcggggccgggcggcggggugaguccgcagccgcugcgcuccgcucuccgccggggcuccgcgcucuccagccgcucugccuucgucgccugcggccggaggaccuggagcugucugcgaggagcccacgcuuugccagcacuuuccccugccucgucugugacuguuuucauuuuguuuuaacccagaagaggcgucucaacacagcauguuggagaucuguguuuuauguuuuuaugugauugcucuuucuuuuccggccggcucucuuuucuucuuucccuucgcucuuccuuucccucuuuucuuuuuucuuucuuucuuucucuuccuuccuuccuuuuucuuucuuuuuucuuuuucuuucuuuuuuucuuuccuccuuuucuuuuuccuuuuucuuucucuuuccucuuccugccuuucuuuuuucuuucuuccuucuuuccuuucuccccccuuuauuuucuucucuucuccuuccucuuccuuucuuccccucuucccuccuuccauuucuuucguucuucguucuuuccugucucucuuccugccuucuuuucuuucuucuuucuuucauuuccuucucucauuucuuucccccaccuucccuuaauuucucccucacucuuuuccuuccucccuuccucucuccauuuucuuucucuucuuucuucagcuucccuccuuucuccucuuucuccuuuccuuaccucucuggcuuuccuguuuuuucgucccauuucuccccugagucuucucuuauuucugcuaucucguucuccuucccucccucucugucuuucaguuuuuucuuagucuaccgguagaauagcaacucccaacuuuaauucugauaucucccaaaagucuucuccagccccugucaccauggccccuuccagcccuucucucacucgcagcucccuagacacuagacuguguggccuggaggcauugcccuuggagguugaccugagggaacuuuccugggcacacccaaggcucuuucccaggcuccuggucccaagugagaaauggccuuuuuccccccauuaagccaccagcugagcuugggacagugggagaucugguggccccaggcccuaucggacucagagugcggaaggggaagaaggaagaugacuaauuacaucaucuccagcuucccugggcuggggacaaguguccccaacacuguucccauccccacugaguauuaggaugggggugggugguagugagagugaauuggguaacugggcuggaagugaaagugugugcgcggggcgcucguguguguucuucuaugugugugugugugccugugcgcgcuuguguugggcagguccggcugucaguggccgccuggcgccccaggcgcuccagccucccaucgccggccggcgcacugagccagcagcccuggccuuuaggauuucuggaaugagugugaggauuucugcggaacagcgaaacuuuguuaggacaggucuuuaagaaaacaccccucuucccuuuuucacagcgaccacccgcgacaguucugagccccgcccucggacccuucuccacaugcuuuuuggugguggggggauguggcuucccaaggccgggcacucgcaguuggccagagcuugagggguuccuggaggguggcugcugcggcgagacgccgagcauguuuuccauccauucccaccugcccugcuagcugagacgugagauucgaggggugccggaauauaacuguggguucuacuccgcgaagguggguucacuucauccaccgccacuuuucuuccuccccacgcagugcgugucagguaggaguaaa

SEQ ID NO: 19886 - RNA, 2589 nt, Homo sapiens
uuuacuccuaccugacacgcacugcguggggaggaagaaaaguggcgguggaugaagugaacccaccuucgcggaguagaacccacaguuauauuccggcaccccucgaaucucacgucucagcuagcagggcaggugggaauggauggaaaacaugcucggcgucucgccgcagcagccacccuccaggaaccccucaagcucuggccaacugcgagugcccggccuugggaagccacauccccccaccaccaaaaagcauguggagaaggguccgagggcggggcucagaacugucgcggguggucgcugugaaaaagggaagagggguguuuucuuaaagaccuguccuaacaaaguuucgcuguuccgcagaaauccucacacucauuccagaaauccuaaaggccagggcugcuggcucagugcgccggccggcgaugggaggcuggagcgccuggggcgccaggcggccacugacagccggaccugcccaacacaagcgcgcacaggcacacacacacacauagaagaacacacacgagcgccccgcgcacacacuuucacuuccagcccaguuacccaauucacucucacuaccacccacccccauccuaauacucaguggggaugggaacaguguuggggacacuuguccccagcccagggaagcuggagaugauguaauuagucaucuuccuucuuccccuuccgcacucugaguccgauagggccuggggccaccagaucucccacugucccaagcucagcugguggcuuaauggggggaaaaaggccauuucucacuugggaccaggagccugggaaagagccuugggugugcccaggaaaguucccucaggucaaccuccaagggcaaugccuccaggccacacagucuagugucuagggagcugcgagugagagaagggcuggaaggggccauggugacaggggcuggagaagacuuuugggagauaucagaauuaaaguugggaguugcuauucuaccgguagacuaagaaaaaacugaaagacagagagggagggaaggagaacgagauagcagaaauaagagaagacucaggggagaaaugggacgaaaaaacaggaaagccagagagguaaggaaaggagaaagaggagaaaggagggaagcugaagaaagaagagaaagaaaauggagagaggaagggaggaaggaaaagagugagggagaaauuaagggaaggugggggaaagaaaugagagaaggaaaugaaagaaagaagaaagaaaagaaggcaggaagagagacaggaaagaacgaagaacgaaagaaauggaaggagggaagaggggaagaaaggaagaggaaggagaagagaagaaaauaaaggggggagaaaggaaagaaggaagaaagaaaaaagaaaggcaggaagaggaaagagaaagaaaaaggaaaaagaaaaggaggaaagaaaaaaagaaagaaaaagaaaaaagaaagaaaaaggaaggaaggaagagaaagaaagaaagaaaaaagaaaagagggaaaggaagagcgaagggaaagaagaaaagagagccggccggaaaagaaagagcaaucacauaaaaacauaaaacacagaucuccaacaugcuguguugagacgccucuucuggguuaaaacaaaaugaaaacagucacagacgaggcaggggaaagugcuggcaaagcgugggcuccucgcagacagcuccagguccuccggccgcaggcgacgaaggcagagcggcuggagagcgcggagccccggcggagagcggagcgcagcggcugcggacucaccccgccgcccggccccgcggcagcagcugccgcugccgcugccgccuccgccucccggcucucccgcucgcggcucaccucggccgcgguccccgcgcaguacccaccucugcgccgccguguuggcguccagcaccccggcgcccugcauccacguccgcaccgcguucaugccgcugcccagcggcucuuccuucaugcugcuuccacuccguuggaugcuuuccugaaucccaaacaugaaaacaaccuuuucuuguggaaaaucuccucccccuugaaaaaaauuaaaaaaaaaaaaaaaggaaagaaaagaaagaaaagaaaagaaacaaaaacgccaaccagagauuuuuuuuuuucucagacgaugaacucgcacuuagaagaucaaggcgggcuggaaagcaaauuuuuaaaaaauguaaaccucugcucaaaacugagcgauaacccgaaaaaaagaagaaagggaaaauccaacgaaaagaccaaaauaauaaaauuagagauguaugcuuggcuguuggggguuguuugguugguugauuuuugguuugggugcuuuuuuuuuuuuuuugcuuuuuuuuuuuuuuuuuuguaaugaucacaggccgguggaggacaggaggggcuggaguuuccuuuuguagagguacccuucacuugaagaagcaggaagaaaaaaaaaaaaaaaaaaaaaaaaaaaaaaaaaaaacccugauggcaauuuaagaaacaauagacucaacucgcgcugccggcuuugc

SEQ ID NO: 19887 - RNA, 2729 nt, Homo sapiens
gccccccgccccggcugcggucgaccugcacucccacuccagccuuaccugaggccgacucgcacgagcccacgcggggcugcgggagccgaucgggaucccggccgccggcccccaccccacccccucgcggcgccggcgacggcggugcugcggccccuuuaaauccgggccgccccgcccugcgccgucgacuccgcggcggccccagauccaggccccagauccaggccgggccgcggcucucgccgcccagcccagcccagcccggcccggcccggcccugccgcggaggcgaggccgccagugucccgcgccccugauaucugcagugagccugauaccugccucugcccuucugagccuguuccucuucccugaguacagggcacaaagcuugcgcccugaggggcggccggcgcgcucccuggcccgguccccgcccggccccgggccccccgccccuccccgacccggggccggggccccugccgccgccgccgccgccuuccgaccccugcgccccggccccggucccccgggccaugcagccucggccccgcgggcgcccgccgcgcacccgaggagaugaggcuccgcaauggcaccuuccugacgcugcugcucuucugccugugcgccuuccucucgcuguccugguacgcggcacucagcggccagaaaggugagcgcgacccccgcccggcccgcaccuggcgcaccugggcgucggcggcgggagcgggcccggcgguggccgcggaaggcggccggaagccgacgcaggcgccccuuccccgcccgggcggcgcgaggacgccccucccacccucccccacuuguuugcugcuggagccgcggcguucuccucgggcccgggccgcgcccgugggugcuccggaccggacuccgcgggcgcagcugucccgacgcugagcuggggacccgugggguucucggagaggggcagagacccaaggucacagaggucccggaacgccagccacagccaccugggcaggagcuggggcggcgugagggacacaggcgcgagggcacccccccacccugcugccugcugccccgcgccggccugggcgaccccggcgugacacccgguccugggacucccuucggcgcccagaacgcgucggcagcauccggccugugggagggagggagggagggagggaggcguccugaggcagcccggccccugcugcccugcgcucccgugcggccccagcccguccuccgcaccccgagcuucccgggcuggcccccgcccuccgcgugcgcccagcgcucuugcaggcggagggugcgggccgauccccccgcgccgccccgcuggccggucuuggcgaugguggggccgaguagggccugagcccucggaggcgcucuucccccggccuggagguuccgggagaguggccuccugccugccugccugcuggaggccuaagcgggcugaguccagcugccccucggccuccccgccaccugcuucccuguuucccugucccggagcgccaucccagagaggcugcggaggagggcgagggaaccuggacccuuccggacccuccgagcuccaucuacccacgccgagcucugccagcacgcccgccugccgcacuuguucugccagagcagaggccugggcuggccuuggggcuccagggccagagaggcaucacccagggacucugcggggagccugccugacacgggagggauggcugggcagaggccgugcuggcgggguauauuaucaagggcaggcauggcuggggcagaauucucuguagguagggugugucaccuggggaaggacauucuggguccuuggcagggugacuauaaaagcacacuggcaugaaggccuagguggggccauaucugaagggcuggggcaugcucuuugagucguggguagagccgugagcccuugcccuuuguccugagccagugugugccucccgcagcagccacaugcccgcggauugaugucaggagccaccucugcaagccuggcuuaccacagggagccaggcuccaggacagcagagugagggagaggcacuggcuccauggcacccacugugucuggggggcauccaggaggcuggcucucugagggccuggggaacaggagagcaaagaaggggagcacuuagauucacgagcccagccccuaggggauagaagccuaaggauccugugagguaugaguauggggugacauaggccucccuugucgaggggcugucacuguuucuguggugacccaguaguaccaggucuuuggaggccucaagagaagcugggaaucugggcucuuaugugaacccaucucguugucacauguagaaaaucugucuuaaaccccuggugaaaccagacguagccagucggaggccagauuggaaccuggccuccacuuugcagccagcggggguccaggaacuugagggaaggacccaggaaguggaaucugcagggaaggaaggaggugggcagggaaccagagaggaagggcagcaggugugggcaucauccuggaaacgcaaggucaagcccaggacggccucuuagaccaacgcaaaauggacccuggagaaggguuuggggcccaauuuccuaucuagcccgugcagcagcucugccagcgcucaaacuguggcccucggucaagcaccugcugaggaucugcccagggaggc

SEQ ID NO: 19888 - RNA, 2729 nt, Homo sapiens
gccucccugggcagauccucagcaggugcuugaccgagggccacaguuugagcgcuggcagagcugcugcacgggcuagauaggaaauugggccccaaacccuucuccaggguccauuuugcguuggucuaagaggccguccugggcuugaccuugcguuuccaggaugaugcccacaccugcugcccuuccucucugguucccugcccaccuccuuccuucccugcagauuccacuuccuggguccuucccucaaguuccuggacccccgcuggcugcaaaguggaggccagguuccaaucuggccuccgacuggcuacgucugguuucaccagggguuuaagacagauuuucuacaugugacaacgagauggguucacauaagagcccagauucccagcuucucuugaggccuccaaagaccugguacuacugggucaccacagaaacagugacagccccucgacaagggaggccuaugucaccccauacucauaccucacaggauccuuaggcuucuauccccuaggggcugggcucgugaaucuaagugcuccccuucuuugcucuccuguuccccaggcccucagagagccagccuccuggaugccccccagacacagugggugccauggagccagugccucucccucacucugcuguccuggagccuggcucccugugguaagccaggcuugcagagguggcuccugacaucaauccgcgggcauguggcugcugcgggaggcacacacuggcucaggacaaagggcaagggcucacggcucuacccacgacucaaagagcaugccccagcccuucagauauggccccaccuaggccuucaugccagugugcuuuuauagucacccugccaaggacccagaauguccuuccccaggugacacacccuaccuacagagaauucugccccagccaugccugcccuugauaauauaccccgccagcacggccucugcccagccaucccucccgugucaggcaggcuccccgcagagucccugggugaugccucucuggcccuggagccccaaggccagcccaggccucugcucuggcagaacaagugcggcaggcgggcgugcuggcagagcucggcguggguagauggagcucggaggguccggaaggguccagguucccucgcccuccuccgcagccucucugggauggcgcuccgggacagggaaacagggaagcagguggcggggaggccgaggggcagcuggacucagcccgcuuaggccuccagcaggcaggcaggcaggaggccacucucccggaaccuccaggccgggggaagagcgccuccgagggcucaggcccuacucggccccaccaucgccaagaccggccagcggggcggcgcggggggaucggcccgcacccuccgccugcaagagcgcugggcgcacgcggagggcgggggccagcccgggaagcucggggugcggaggacgggcuggggccgcacgggagcgcagggcagcaggggccgggcugccucaggacgccucccucccucccucccucccucccacaggccggaugcugccgacgcguucugggcgccgaagggagucccaggaccgggugucacgccggggucgcccaggccggcgcggggcagcaggcagcagggugggggggugcccucgcgccugugucccucacgccgccccagcuccugcccagguggcuguggcuggcguuccgggaccucugugaccuugggucucugccccucuccgagaaccccacggguccccagcucagcgucgggacagcugcgcccgcggaguccgguccggagcacccacgggcgcggcccgggcccgaggagaacgccgcggcuccagcagcaaacaagugggggagggugggaggggcguccucgcgccgcccgggcggggaaggggcgccugcgucggcuuccggccgccuuccgcggccaccgccgggcccgcucccgccgccgacgcccaggugcgccaggugcgggccgggcgggggucgcgcucaccuuucuggccgcugagugccgcguaccaggacagcgagaggaaggcgcacaggcagaagagcagcagcgucaggaaggugccauugcggagccucaucuccucgggugcgcggcgggcgcccgcggggccgaggcugcauggcccgggggaccggggccggggcgcaggggucggaaggcggcggcggcggcggcaggggccccggccccgggucggggaggggcggggggcccggggccgggcggggaccgggccagggagcgcgccggccgccccucagggcgcaagcuuugugcccuguacucagggaagaggaacaggcucagaagggcagaggcagguaucaggcucacugcagauaucaggggcgcgggacacuggcggccucgccuccgcggcagggccgggccgggccgggcugggcugggcugggcggcgagagccgcggcccggccuggaucuggggccuggaucuggggccgccgcggagucgacggcgcagggcggggcggcccggauuuaaaggggccgcagcaccgccgucgccggcgccgcgaggggguggggugggggccggcggccgggaucccgaucggcucccgcagccccgcgugggcucgugcgagucggccucagguaaggcuggagugggagugcaggucgaccgcagccggggcggggggc

SEQ ID NO: 19889 - RNA, 2448 nt, Homo sapiens
ggcugcagucuugggcggguuuggacugcgacgagcaggccacgauagaucaaccaggugguagccccagggaccuucagguuguuggaggaaaacugggcacuagaccagcuaaaggccccggaguaggucgacgagagauuucugagaaggcuggcagaccaccgcggaucuuugucuuuuuacguggagccaugggcgaggcgcucaagaacuugcugaaggagcucgacuucuucaagccucgggccagguccuggagcaugaggucgucagccaggacgcccagaaaugcacuggugguggaacugaggaugguggcggccaccuguacggggcgccuggcagcaagacugccacuuccaccaccggucgcaucuggcuccguggugccucgcaggccuggaucgccaagaaggcggcgcagcgcguacgaggagccgggccgcagguacugguaggcgcgacgcccgcugugaucacgcacgugcaccugggcacccagacgcaccaccagcagcacggcagcguccucguggccgugcagugcagccaggugcagcggcguguagccgccgugggagcgugcguucacgucgacuggugcgccacugcgccgcgcgaccuccaccagcugcagcgccaucucgccgucgccgcucuuggcggcccaaugcagggccgugaagccagacaugaagucgcgcuuggccgccaagccgcggucgcgcagcagcagcccgugcagcugguggguccagcggcccccggcaguccgcacgagccacucgugcucggacggcuccaggggcaccgcggacggcggcggcgcggcgggcaacuccucggcgucagggcucagcagacgcgggccggcgcgcgacaggcgccucaggugcggggagcggcccgggcccaggccgaggcccagaccggacucuuccaccgagagccgccucagcagcagaggggagcuccgcgggcucggcuccuccgacagcugccggcgcaggccgggcuccuccgcccggaggcggagcguggcgggggccgggacgcagcgcaccggcagcauacagggcuucugcugcggcggcccuuucgcugccccgggcccgggcuccgcgucuggcggaucagagcagggcgaugccgccucagaaggggcccuaggcgguggggccgcgucugcggagggucucucgguggccugggcuagcucaagggcuggaagcggugggucggcggaccgcuccccgggcggcugagcgggcucggaggccggcccccccgggguguccuguggcucuguuggcagacccagguccccuggcggcuccacuggccgcggcacccggaccaagggcggagcucccggggcagaggcgcuccgcggcaagaccgucgaaguggguuucgacggcugggccgcugcccccggggggccgaagggugcgggcucgggcuccgggggccggggcuucuuccucagcaccacgaacuugacgccgucgagcuccuucaccaccgccacguuguugacgaacugcuugaagcggucccugcgggcggcgcggccccgcgggucgccggcaucgagcagcggcuugaagcggcucagcagcucggaguugcgcaccuucccgccgugcuccugcaggaagcccagcaccgccgccuggcucaccccggcagccgcagcggcggcggcggcggccagcgccaugguggggcccuggguuccuggcucccggggcgggugggcgccgcgucgccgcgggacgcgcgggagcgggguuccgggaggcgcggccgcgcucaccuggugccuuccccgcggccagccgggcguguccccgaagcuggaccucggucgcgccagugccgcugggccggggcgucucggggcgaagggcgccgggggccgcggggagcgcccacccccagcgccccgccgggccccggccuucgggguagguuucugccuuuguauucuguccaaugggcgccugcuuccaucccccgcgccgcgcucgccuuacaggugacagcugcccccgcgaugcagagggaaccggagcagaaauucccgccgccccccgcccgccccagaauuaaaggcgcagcgcuccagcucuggucucgguugcuagguggguguguucccuagggacgccgcgguccgccaaggaggaauggauuuuuauuccuuuaauaaacauuuaaccacugcaaaacaccaagcgaugauuucagaacaaucuuuuuuuuuuaaaggucgucaauaccacuccaguuuuuuuuuuuuuuuacuguguuucaugcaggaaaacggcuucaugagauuuacagcaaaaccaauucacucugcgcggcaaugcacguuacucuagguuuagagagacguuuucaaaagcaauuuucucaugguaagagaauacauuuuca

SEQ ID NO: 19890 - RNA, 2448 nt, Homo sapiens
ugaaaauguauucucuuaccaugagaaaauugcuuuugaaaacgucucucuaaaccuagaguaacgugcauugccgcgcagagugaauugguuuugcuguaaaucucaugaagccguuuuccugcaugaaacacaguaaaaaaaaaaaaaaacuggagugguauugacgaccuuuaaaaaaaaaagauuguucugaaaucaucgcuugguguuuugcagugguuaaauguuuauuaaaggaauaaaaauccauuccuccuuggcggaccgcggcgucccuagggaacacacccaccuagcaaccgagaccagagcuggagcgcugcgccuuuaauucuggggcgggcggggggcggcgggaauuucugcuccgguucccucugcaucgcgggggcagcugucaccuguaaggcgagcgcggcgcgggggauggaagcaggcgcccauuggacagaauacaaaggcagaaaccuaccccgaaggccggggcccggcggggcgcugggggugggcgcuccccgcggcccccggcgcccuucgccccgagacgccccggcccagcggcacuggcgcgaccgagguccagcuucggggacacgcccggcuggccgcggggaaggcaccaggugagcgcggccgcgccucccggaaccccgcucccgcgcgucccgcggcgacgcggcgcccacccgccccgggagccaggaacccagggccccaccauggcgcuggccgccgccgccgccgcugcggcugccggggugagccaggcggcggugcugggcuuccugcaggagcacggcgggaaggugcgcaacuccgagcugcugagccgcuucaagccgcugcucgaugccggcgacccgcggggccgcgccgcccgcagggaccgcuucaagcaguucgucaacaacguggcgguggugaaggagcucgacggcgucaaguucguggugcugaggaagaagccccggcccccggagcccgagcccgcacccuucggccccccgggggcagcggcccagccgucgaaacccacuucgacggucuugccgcggagcgccucugccccgggagcuccgcccuugguccgggugccgcggccaguggagccgccaggggaccugggucugccaacagagccacaggacaccccgggggggccggccuccgagcccgcucagccgcccggggagcgguccgccgacccaccgcuuccagcccuugagcuagcccaggccaccgagagacccuccgcagacgcggccccaccgccuagggccccuucugaggcggcaucgcccugcucugauccgccagacgcggagcccgggcccggggcagcgaaagggccgccgcagcagaagcccuguaugcugccggugcgcugcgucccggcccccgccacgcuccgccuccgggcggaggagcccggccugcgccggcagcugucggaggagccgagcccgcggagcuccccucugcugcugaggcggcucucgguggaagaguccggucugggccucggccugggcccgggccgcuccccgcaccugaggcgccugucgcgcgccggcccgcgucugcugagcccugacgccgaggaguugcccgccgcgccgccgccguccgcggugccccuggagccguccgagcacgaguggcucgugcggacugccgggggccgcuggacccaccagcugcacgggcugcugcugcgcgaccgcggcuuggcggccaagcgcgacuucaugucuggcuucacggcccugcauugggccgccaagagcggcgacggcgagauggcgcugcagcugguggaggucgcgcggcgcaguggcgcaccagucgacgugaacgcacgcucccacggcggcuacacgccgcugcaccuggcugcacugcacggccacgaggacgcugccgugcugcugguggugcgucugggugcccaggugcacgugcgugaucacagcgggcgucgcgccuaccaguaccugcggcccggcuccucguacgcgcugcgccgccuucuuggcgauccaggccugcgaggcaccacggagccagaugcgaccggugguggaaguggcagucuugcugccaggcgccccguacagguggccgccaccauccucaguuccaccaccagugcauuucugggcguccuggcugacgaccucaugcuccaggaccuggcccgaggcuugaagaagucgagcuccuucagcaaguucuugagcgccucgcccauggcuccacguaaaaagacaaagauccgcgguggucugccagccuucucagaaaucucucgucgaccuacuccggggccuuuagcuggucuagugcccaguuuuccuccaacaaccugaaggucccuggggcuaccaccugguugaucuaucguggccugcucgucgcaguccaaacccgcccaagacugcagcc

SEQ ID NO: 19891 - RNA, 2743 nt, Homo sapiens
gaaacgccgggagcugcgaguguccaggugagcgccccgcccgcucagccgccagaucaaccuuagcgcuggggcgcgggcuggggucgccaggcggugcguucugcccgcgcggggcugagaguuaggggccggggccggauccggggccgggggucgcgccgcuagccgccagcagcgcaguccgggccgccacccugcacccuccgcccuguuucugcacccgucuggguucuugugccgccgcccgcaagccuucccgagcucaggguggugaggucagcggcgcccuucgugcaguucccucggcugucgggcggggcugggaacuuggccgcucuucccugucaggcucccgggaaguggcggccugaccccgggcugccggcuguugggagcgggggcgcggcguccgccuggcccugaggggccucuucauauuggcuaagcccguucugcacccucccaagggcugggaguccuaggucuuguccgggcaggguccagcuuggagcccauuagaugggccauuggaucagaaagucuuuucucccccagacauccuuguggaaccagcguuguuuuuccuuggcagcugcggagacccgugauaauucguuaacuaauucaacaaacgggacccuucugugugccagaaaccgcaagcaguugcuaacccagugggacaggcggauuggaagagcgggaagguccuggcccagagcaguguggugagcgcugugcuggaagggaaugcgggcaguggguacuugguagagcacugacugccuccggccagaggacuucccggaggaggugacccaugagcuggaguggucagaggaaggcuggcaaaagggcaucguggacagaggaacagccuaugugagugggagcagagaccuuggccaaugccauuccuuauggccuuguaguggaagcaaggugauggggaaggaacacuguaggggauagcuguccacggacgcugucuacaagacccuggagugagauaacgugccugguacugugcccugcauguguaagaugcccaguugaccuucgcagcaggagccuggaucagggcacuuccugccucagguauugcuggacagcccaggugggucccuggccuuuguauucuauuugacuuuaagauggugcaggagaauacaaaaaacuauccgggcaugguggcgcgcgccuguagucccagcuacucgggaggcuaaggcaggagaaucgcuugaaccugggaggcagagguugcagugagccaagaucgugccacugcacuccagccugggagacagagcgagacuccaucuuaaaaaaaaaauaaaaaagagagauggugcaggagagcauugggaucccucccaagacugugacuguugucuuuugcuguagagugacacccgagauuugugcuucuugauaauagacuaccuggggccucacagccccagcccucuuguaggaaauccuguccuaggagcaagggcuggaguccguuacguuguagcuuggggcauucuuaaaugucccagacuuuguggagauccauuguccaccuaagaauuuauaggauguuuuuggggucugcugcuuguucucagccugugucucaucugacauuagguuccauaauuuagucucuguuaaaugaacuaggauuuccuuuggcuuguacuuaaacugccccugagguguccaaggugcagccucucacugugguucugggccucagcgcccagucucucugguugcuucuccccacucacagaauguuuggucuuugaauucuuuucuuuuagggccuccuuguucuuacacagccgaguguccacuguguggcccagccaaugaagccacguagcaaggauggagugaguuggcugggggccucaucccaaagaugcugucauacuggaucacccuaguucucugagagcucagcaggcagacuuggugacagcuuagcugaggcauugucuguggcaugugauaggcccuuguauccugucgaaagcucugcauugggguacucuagacagugcuuacuuagucaccgguuuagacuggccccagcugaucucaguucaucccuugagugccuucugccuguuuggcuucugacuggagcgugccuggggcuagaaugagggacgagagagaggagguggccgaggcacuauucuugccuguggguagcucguacucugagauugcugcuucauauuggcagcuggccaugugccaggggaggagcccggcugugagugcucaucaaaggaagagacuacgugggugcagcucugaggaaugagucgguugagggaaucuagggucuccucauuuccuaagaaggccucccuuuuucacucugcccucccacauccuugggagggucugagacuggaagcaaggccuuggcugauguguggccacgcuggcugauagugugcagagggcuaggaggugugucccuggcuccuggggucugucaagaguuuacuauuaugcagauggaaguuggcaggaaaagcugugaugcaaguacaugcaagcccagcagagugcuggagugagaguuaaacuucgggaaaguugcucacaucuagcaauuuggacauuugaaguuccuuaggguaagacaucagccuguccuagagcaaagagggcuggaagguccuguggucugugggcuuuguguuacggacauggaaugagagauagaaag

SEQ ID NO: 19892 - RNA, 2743 nt, Homo sapiens
cuuucuaucucucauuccauguccguaacacaaagcccacagaccacaggaccuuccagcccucuuugcucuaggacaggcugaugucuuacccuaaggaacuucaaauguccaaauugcuagaugugagcaacuuucccgaaguuuaacucucacuccagcacucugcugggcuugcauguacuugcaucacagcuuuuccugccaacuuccaucugcauaauaguaaacucuugacagaccccaggagccagggacacaccuccuagcccucugcacacuaucagccagcguggccacacaucagccaaggccuugcuuccagucucagacccucccaaggaugugggagggcagagugaaaaagggaggccuucuuaggaaaugaggagacccuagauucccucaaccgacucauuccucagagcugcacccacguagucucuuccuuugaugagcacucacagccgggcuccuccccuggcacauggccagcugccaauaugaagcagcaaucucagaguacgagcuacccacaggcaagaauagugccucggccaccuccucucucucgucccucauucuagccccaggcacgcuccagucagaagccaaacaggcagaaggcacucaagggaugaacugagaucagcuggggccagucuaaaccggugacuaaguaagcacugucuagaguaccccaaugcagagcuuucgacaggauacaagggccuaucacaugccacagacaaugccucagcuaagcugucaccaagucugccugcugagcucucagagaacuagggugauccaguaugacagcaucuuugggaugaggcccccagccaacucacuccauccuugcuacguggcuucauuggcugggccacacaguggacacucggcuguguaagaacaaggaggcccuaaaagaaaagaauucaaagaccaaacauucugugaguggggagaagcaaccagagagacugggcgcugaggcccagaaccacagugagaggcugcaccuuggacaccucaggggcaguuuaaguacaagccaaaggaaauccuaguucauuuaacagagacuaaauuauggaaccuaaugucagaugagacacaggcugagaacaagcagcagaccccaaaaacauccuauaaauucuuagguggacaauggaucuccacaaagucugggacauuuaagaaugccccaagcuacaacguaacggacuccagcccuugcuccuaggacaggauuuccuacaagagggcuggggcugugaggccccagguagucuauuaucaagaagcacaaaucucgggugucacucuacagcaaaagacaacagucacagucuugggagggaucccaaugcucuccugcaccaucucucuuuuuuauuuuuuuuuuaagauggagucucgcucugucucccaggcuggagugcaguggcacgaucuuggcucacugcaaccucugccucccagguucaagcgauucuccugccuuagccucccgaguagcugggacuacaggcgcgcgccaccaugcccggauaguuuuuuguauucuccugcaccaucuuaaagucaaauagaauacaaaggccagggacccaccugggcuguccagcaauaccugaggcaggaagugcccugauccaggcuccugcugcgaaggucaacugggcaucuuacacaugcagggcacaguaccaggcacguuaucucacuccagggucuuguagacagcguccguggacagcuauccccuacaguguuccuuccccaucaccuugcuuccacuacaaggccauaaggaauggcauuggccaaggucucugcucccacucacauaggcuguuccucuguccacgaugcccuuuugccagccuuccucugaccacuccagcucaugggucaccuccuccgggaaguccucuggccggaggcagucagugcucuaccaaguacccacugcccgcauucccuuccagcacagcgcucaccacacugcucugggccaggaccuucccgcucuuccaauccgccugucccacuggguuagcaacugcuugcgguuucuggcacacagaagggucccguuuguugaauuaguuaacgaauuaucacgggucuccgcagcugccaaggaaaaacaacgcugguuccacaaggaugucugggggagaaaagacuuucugauccaauggcccaucuaaugggcuccaagcuggacccugcccggacaagaccuaggacucccagcccuugggagggugcagaacgggcuuagccaauaugaagaggccccucagggccaggcggacgccgcgcccccgcucccaacagccggcagcccggggucaggccgccacuucccgggagccugacagggaagagcggccaaguucccagccccgcccgacagccgagggaacugcacgaagggcgccgcugaccucaccacccugagcucgggaaggcuugcgggcggcggcacaagaacccagacgggugcagaaacagggcggagggugcaggguggcggcccggacugcgcugcuggcggcuagcggcgcgacccccggccccggauccggccccggccccuaacucucagccccgcgcgggcagaacgcaccgccuggcgaccccagcccgcgccccagcgcuaagguugaucuggcggcugagcgggcggggcgcucaccuggacacucgcagcucccggcguuuc

SEQ ID NO: 19893 - RNA, 2883 nt, Homo sapiens
gaacauucucucagaaaaugaggccuuuugucaucuaacccaaagaaaauuaagcggguggauggcuagaaagaguucaucuccaggggggacccugaaauccuuuauauucuucccgguuuucuagggaaccauccccuacauagaugccccaggcaucuggggcuuuucuggcagcugaagcugccuucagaaggccaggguuauuuuccaguucuggggaagguaaguucuaguuccaccuaagucaaagcccagcccuuuccuucuccccacccuuccccacuccagccaucucuaaaagcaaaaaaaaaaaaaaaaaaaccgguuuuccauuuuaaauuauuuuauuguauauuaaaaaaccaaauaaagcaauaacuuuaaagaccucagacacacacaguauaaacaccuggguaagguuuuguucguguccauguugacaccggaacuaccguuaaagugcaaguuuuguuuuguguuccuuugugcaguuucacucacauguaaacaagucacuuggcuaugauuugacccacgcccccccgcuuaguuuugggagggcagaggcucuaccggcugucacagcaacccggaaucacagacaagauaaugccccguggguccugacccucaagcgggcaugacgguuucuugaagccuagcagaggcuggauaacuucacaucccucccccaccccgcgcucacucuuaggucuuugagaagauaaauccacccucggcugggcccucgcucccaaaguuauggggguggcgggccucaaugggggaccggggguggggaauagucccagucuuggcccguucucuuuccuuccggagcagaugaccgucccuucucgguucaguggcgccuccccagugcugggggcggaucgccgggaggggagacgccaguccgcgcgcgcucccggccuggggcgcaccgggccguuggauuugacuuaacaaaaagguccuccuuagguugugucgccagcgcggcggggcuccuagcugaugacgcagcgcuccuuguccuuggccuggcugccggcgcuggccuucucgcggauguacaugaggucgcuguguacgcugggccggcgcgcgaagggugccacgaugccaaaggcgucgcccgggucgccgccgccgccgccgcugccggcccgcagcagcuucuuguuccgcagcgccuucuugugcagcacgucgcaguacugcaccgagaccuugcggugcaggucugggcucaucucgcugggcagcuuggccauggcgaagagcgcgcggaacaucugguccaggcugcuguucuucuuggccgagaucucgaaguaggcgcagcgcugggggucgucgcccaccagcugcucgaucucgcgcugguccaccucgcgguagaagucgcggucacccuuguugccgcagaugaccaggggcacguccacguucuccuugguuuuguucuugaggcaagacuuggugucgaggaucugcugccugagccgcugcaccuccucgaaggagucgcgguuguccagacugaacaccaggaugaaaacgucuccuagagggggcacagagagcagaaaaggagaaggugaggguggccgcccaggggacaagucgggcugacuuugaggccgcgcggggcgcgcuagccucucuaagcgcgaagcgcacuacucggcgcgcggcagccggaccggcgcucgcggggcgcccuggccgaggguuccccgcccuucccucccgcaccugcccggcccccggcucaccugugaggauggagaggcgccgcauggcggggaacgggugguugccggacgugucgaggaugucgagcugguagaccucgccgcggauggaguagaacuugcgguggaaguccucgaugguaggcguguaggcguccucgaagcggccggugaggaagcgcgacacgauggccgucuugcccaccuuggacgagccgaggaugaccaugcgauagcaguucuuggccgggauacucagcuccgagucgcucgggcacaucuucuugaucaucgcggccaguuucauugggcagaggggccgcgagggcgggcgcggggccgagagaagggcagagagcggcugagggucgcugggguggcacgcggggugagcggcuggagggcucugcucgggcugggcgcggcucgggcuuggggcuccggcuccgcucgggcugggcucgggcuaggcugggcucggcugggguucucccaggaucugggcacaggccgcuugcucuggcuuuggcgcccggccgccgcccuuauaugcagccugcucggcugccccgccccggcccucccagcucggugcgucacgccccgcggggcccgccucccccgcaccggcucccagucccggcgaccucgucacccgcugccgggcuccugcucucugggcgcgggggcuggggggagcaguccagggucgggcugaggcuggaggcgcucggacuccgcuuuuccacugccgcgggcucggcggccgcaggggcgucgggguucuggucccggcggugccccugucccucugcgacuucgggcaaggacccccauuccugcaccucccgcgcgcguacacuuauuuucuuugguucucaguuuccccagagaauaggaaucuaguaaguaacccaguaagcgcagcagcguuugcugagugcuugcgcggaccguauauugcaguccucagagcacagccccagccccagcccccuuccgcuccgguccccagccgggcucuuguucccgggaggcgaccgccgggcggacgcgggguuucagggccucaggcgcggagcucggcaccgcgcgcucgggccgccagagggcagca

SEQ ID NO: 19894 - RNA, 2883 nt, Homo sapiens
ugcugcccucuggcggcccgagcgcgcggugccgagcuccgcgccugaggcccugaaaccccgcguccgcccggcggucgccucccgggaacaagagcccggcuggggaccggagcggaagggggcuggggcuggggcugugcucugaggacugcaauauacgguccgcgcaagcacucagcaaacgcugcugcgcuuacuggguuacuuacuagauuccuauucucuggggaaacugagaaccaaagaaaauaaguguacgcgcgcgggaggugcaggaauggggguccuugcccgaagucgcagagggacaggggcaccgccgggaccagaaccccgacgccccugcggccgccgagcccgcggcaguggaaaagcggaguccgagcgccuccagccucagcccgacccuggacugcuccccccagcccccgcgcccagagagcaggagcccggcagcgggugacgaggucgccgggacugggagccggugcgggggaggcgggccccgcggggcgugacgcaccgagcugggagggccggggcggggcagccgagcaggcugcauauaagggcggcggccgggcgccaaagccagagcaagcggccugugcccagauccugggagaaccccagccgagcccagccuagcccgagcccagcccgagcggagccggagccccaagcccgagccgcgcccagcccgagcagagcccuccagccgcucaccccgcgugccaccccagcgacccucagccgcucucugcccuucucucggccccgcgcccgcccucgcggccccucugcccaaugaaacuggccgcgaugaucaagaagaugugcccgagcgacucggagcugaguaucccggccaagaacugcuaucgcauggucauccucggcucguccaaggugggcaagacggccaucgugucgcgcuuccucaccggccgcuucgaggacgccuacacgccuaccaucgaggacuuccaccgcaaguucuacuccauccgcggcgaggucuaccagcucgacauccucgacacguccggcaaccacccguuccccgccaugcggcgccucuccauccucacaggugagccgggggccgggcaggugcgggagggaagggcggggaacccucggccagggcgccccgcgagcgccgguccggcugccgcgcgccgaguagugcgcuucgcgcuuagagaggcuagcgcgccccgcgcggccucaaagucagcccgacuuguccccugggcggccacccucaccuucuccuuuucugcucucugugcccccucuaggagacguuuucauccugguguucagucuggacaaccgcgacuccuucgaggaggugcagcggcucaggcagcagauccucgacaccaagucuugccucaagaacaaaaccaaggagaacguggacgugccccuggucaucugcggcaacaagggugaccgcgacuucuaccgcgagguggaccagcgcgagaucgagcagcuggugggcgacgacccccagcgcugcgccuacuucgagaucucggccaagaagaacagcagccuggaccagauguuccgcgcgcucuucgccauggccaagcugcccagcgagaugagcccagaccugcaccgcaaggucucggugcaguacugcgacgugcugcacaagaaggcgcugcggaacaagaagcugcugcgggccggcagcggcggcggcggcggcgacccgggcgacgccuuuggcaucguggcacccuucgcgcgccggcccagcguacacagcgaccucauguacauccgcgagaaggccagcgccggcagccaggccaaggacaaggagcgcugcgucaucagcuaggagccccgccgcgcuggcgacacaaccuaaggaggaccuuuuuguuaagucaaauccaacggcccggugcgccccaggccgggagcgcgcgcggacuggcgucuccccucccggcgauccgcccccagcacuggggaggcgccacugaaccgagaagggacggucaucugcuccggaaggaaagagaacgggccaagacugggacuauuccccacccccggucccccauugaggcccgccacccccauaacuuugggagcgagggcccagccgaggguggauuuaucuucucaaagaccuaagagugagcgcggggugggggagggaugugaaguuauccagccucugcuaggcuucaagaaaccgucaugcccgcuugagggucaggacccacggggcauuaucuugucugugauuccggguugcugugacagccgguagagccucugcccucccaaaacuaagcgggggggcgugggucaaaucauagccaagugacuuguuuacaugugagugaaacugcacaaaggaacacaaaacaaaacuugcacuuuaacgguaguuccggugucaacauggacacgaacaaaaccuuacccagguguuuauacugugugugucugaggucuuuaaaguuauugcuuuauuugguuuuuuaauauacaauaaaauaauuuaaaauggaaaaccgguuuuuuuuuuuuuuuuuuugcuuuuagagauggcuggaguggggaaggguggggagaaggaaagggcugggcuuugacuuagguggaacuagaacuuaccuuccccagaacuggaaaauaacccuggccuucugaaggcagcuucagcugccagaaaagccccagaugccuggggcaucuauguaggggaugguucccuagaaaaccgggaagaauauaaaggauuucaggguccccccuggagaugaacucuuucuagccauccacccgcuuaauuuucuuuggguuagaugacaaaaggccucauuuucugagagaauguuc

SEQ ID NO: 19895 - RNA, 2744 nt, Homo sapiens
gcagugggauggggaaggauagggcaacagugccaagaggggagcagagcgcggggaaccuggagagggagggucagggcugcggagggcugagcugcgguggagagcucuggggccccucaccaagcuaguggcgucuuggguggaagucaggcccccagagauccggccggccuuagcugucacucaggcaaccccggagccgccgcagacaccggauccacuggaagggggcgaagccgcggggaggaaugggggacacuggggaaggggcgucgccccugccgcccccgcccucuccagugccauugggcggcugcugcggagcccgcgccaccuuuucuccaucccaccccgcccgucuggccccgccuggccgcugguccgcgccccgcugcgcucguccgggggcugguccggcccgggccuuugacgucaccagcaaguuugcugcccucggcgucccacguguggcggcggccagcggcggcccaggaggcagccggugagcgccugcgagcagaguggcgggggccgcugacaggucccgcgcagcccagcccagcccagccacgcggcucacaggugggguccaagagcaguuuggagcaacccggcgcuacggagagggguggacggcucugcacgggccuccugucucccgcucgggcagagggacucggggggaccucgcuccuuggcugagagaaccugaacucgggcggagagaacgcgcccaggcgggcaaggggaccagagaaagccggggcuggaagucacugucgcucgccacugucuggagcgcacggagcgcagaggcccggcagccgcgcgugcccucacggggaccgagccagugaugcaggaucgcugagcggagauccgcgccgagaagucucucggggccggggcugagacgcacgccuucgacaccgcugccaagaccccgauuccggcgacucuugcggggaaccgaggggccaaggcugccccaagcucaggacuugggcgagucuaagacgaugguuucuuaagcacggacccgcguuccccuucccgcucccucgacuggaggcagggauccugcgcggggcccccgggauuccguuuccccgcggagccccggccgcugccucccgggacaguucgcacggccacaggggcgcacggcgauguggccuccguccagcgcgcuggcccgccggggggaugcucuggcaccugucgggguccaggccuagcauggccggcgcguugcccgacgucgccuccggcuaggauggccccuccgggcccggccagugcccucuccaccucggccgagccgcugucccgcagcaucuuccggaaguucuugcugaugcucugcucccugcucacgucccuuuacgucuucuacugccuggccgagcgcugccagacccuguccggccccgucguggggcuguccggcggcggcgaggaggcgggggccccugguggcggcguccuggccggaggcccgagggagcuggcgguguggccggcggcggcacagagaaagcgccuccugcaacugccgcaguggcggaggcgccggccgcccgcgccccgcgacgacggcgaggaggcggccugggaagaagaguccccuggccugucaggggguccgggcggcuccggggccggaagcaccguggccgaggccccgccggggacccuggcgcugcuccuggacgaaggcagcaagcagcugccgcaggccaucaucaucggagugaagaagggcggcacgcgggcgcugcuggaguuccugcgcgugcaccccgacgugcgcgccgugggcgccgagccccacuucuucgaccgcagcuacgacaagggccucgccugguaccggugagcggggcgggcccgggcuggggcugaaggauccggggguccugggcugggaaagacguggaggagcccucggugacccccaguucgcccuccuccccacuucaugcagaaggcgaagggucgucaagggucuuucuucccucuccgccuucuccuuccugggaaguggauguugaaggagagagugggagggaaauucuggccuucauaauuuucauccuugggaaucccuugccagcaaauagccagucuggucucuuucuccugcucugcgaaaguauucauguauuuaacuaaaggaaaaaaaaaaagucucuucuaaauuagaaaccuguucaacaauuaauagauugccuucuccuucccaaggaagcccguuuucauucuuuaucuuuuggaaaguucuuugugguuaacacagucuuuaccaucagguauuuauuuaccuugaccuuuugccagauaguuguccuaggugggaaguaauauagagacuuaguaaaagugucaagaaccagagaaucuggguaguuuggaaaauauaugucugucugagcaagggaaagcaaccaggcacuguauuuuaaaggacgcuuggcaauaacuuuuguuugagggcaaggaaugaguuuuguaaagugcuuuugauauuugcagggaaaaguaacuuuugucuuuugacugacagaaacuuuucuaaagaucuucaauccucuuuacaaauaagguagccaauuaaaagaagaagacaacagagagaaaaauacauuggcacaacuuugccaauacaguuuaggaaauaagucuggcuuagaucuuaaucuuaaauuugccagucucuucaaauucagaccaccuuuaau

SEQ ID NO: 19896 - RNA, 2744 nt, Homo sapiens
auuaaagguggucugaauuugaagagacuggcaaauuuaagauuaagaucuaagccagacuuauuuccuaaacuguauuggcaaaguugugccaauguauuuuucucucuguugucuucuucuuuuaauuggcuaccuuauuuguaaagaggauugaagaucuuuagaaaaguuucugucagucaaaagacaaaaguuacuuuucccugcaaauaucaaaagcacuuuacaaaacucauuccuugcccucaaacaaaaguuauugccaagcguccuuuaaaauacagugccugguugcuuucccuugcucagacagacauauauuuuccaaacuacccagauucucugguucuugacacuuuuacuaagucucuauauuacuucccaccuaggacaacuaucuggcaaaaggucaagguaaauaaauaccugaugguaaagacuguguuaaccacaaagaacuuuccaaaagauaaagaaugaaaacgggcuuccuugggaaggagaaggcaaucuauuaauuguugaacagguuucuaauuuagaagagacuuuuuuuuuuuccuuuaguuaaauacaugaauacuuucgcagagcaggagaaagagaccagacuggcuauuugcuggcaagggauucccaaggaugaaaauuaugaaggccagaauuucccucccacucucuccuucaacauccacuucccaggaaggagaaggcggagagggaagaaagacccuugacgacccuucgccuucugcaugaaguggggaggagggcgaacugggggucaccgagggcuccuccacgucuuucccagcccaggacccccggauccuucagccccagcccgggcccgccccgcucaccgguaccaggcgaggcccuugucguagcugcggucgaagaaguggggcucggcgcccacggcgcgcacgucggggugcacgcgcaggaacuccagcagcgcccgcgugccgcccuucuucacuccgaugaugauggccugcggcagcugcuugcugccuucguccaggagcagcgccaggguccccggcggggccucggccacggugcuuccggccccggagccgcccggacccccugacaggccaggggacucuucuucccaggccgccuccucgccgucgucgcggggcgcgggcggccggcgccuccgccacugcggcaguugcaggaggcgcuuucucugugccgccgccggccacaccgccagcucccucgggccuccggccaggacgccgccaccaggggcccccgccuccucgccgccgccggacagccccacgacggggccggacagggucuggcagcgcucggccaggcaguagaagacguaaagggacgugagcagggagcagagcaucagcaagaacuuccggaagaugcugcgggacagcggcucggccgagguggagagggcacuggccgggcccggaggggccauccuagccggaggcgacgucgggcaacgcgccggccaugcuaggccuggaccccgacaggugccagagcauccccccggcgggccagcgcgcuggacggaggccacaucgccgugcgccccuguggccgugcgaacugucccgggaggcagcggccggggcuccgcggggaaacggaaucccgggggccccgcgcaggaucccugccuccagucgagggagcgggaaggggaacgcggguccgugcuuaagaaaccaucgucuuagacucgcccaaguccugagcuuggggcagccuuggccccucgguuccccgcaagagucgccggaaucggggucuuggcagcggugucgaaggcgugcgucucagccccggccccgagagacuucucggcgcggaucuccgcucagcgauccugcaucacuggcucgguccccgugagggcacgcgcggcugccgggccucugcgcuccgugcgcuccagacaguggcgagcgacagugacuuccagccccggcuuucucugguccccuugcccgccugggcgcguucucuccgcccgaguucagguucucucagccaaggagcgagguccccccgagucccucugcccgagcgggagacaggaggcccgugcagagccguccaccccucuccguagcgccggguugcuccaaacugcucuuggaccccaccugugagccgcguggcugggcugggcugggcugcgcgggaccugucagcggcccccgccacucugcucgcaggcgcucaccggcugccuccugggccgccgcuggccgccgccacacgugggacgccgagggcagcaaacuugcuggugacgucaaaggcccgggccggaccagcccccggacgagcgcagcggggcgcggaccagcggccaggcggggccagacgggcggggugggauggagaaaagguggcgcgggcuccgcagcagccgcccaauggcacuggagagggcgggggcggcaggggcgacgccccuuccccagugucccccauuccuccccgcggcuucgcccccuuccaguggauccggugucugcggcggcuccgggguugccugagugacagcuaaggccggccggaucucugggggccugacuuccacccaagacgccacuagcuuggugaggggccccagagcucuccaccgcagcucagcccuccgcagcccugacccucccucuccagguuccccgcgcucugcuccccucuuggcacuguugcccuauccuuccccaucccacugc

SEQ ID NO: 19897 - RNA, 2492 nt, Homo sapiens
agauagaagagagcgccucuccaaccucccggcagagcuucgguugagucggacagauucacccagcgcacucggguugcucccugucucgacuaggaagcgaacuucggagaugauguauaaaauucagccugggggcugagaggugcuaacuucuauuucaggguuagugaggguacaguaagccucccagaaagcugcaauucuggaggaacucugaauuucauccccaagcgagcucugccccaauagccuccuccuuucagcugggucccgccuccuuauacagccuuacggucuguaaaccagccagugcccccauucaccccucacuucccgcacucccaggccaguuucucuccuuccccuccccccuucacuccuccucuuuccgggagccucgugccggguccuagaggggcagaaucuggaugucgaagggggcggggucggguccuaucccuccuacccuugggccgcggaauauaaggcuccaggcgagcagggaaccgguccacacaggguccggaggagcaauggucacccgggaucgagcugagaauagggacggccccaaggugagaggcgggaggggagggagcagaggucccugguuuggcuaggggacugggccccugacgccgucggucuggagagaggcuggggacgcagggguggaaggggagcggugcuccagaacuccaggagccagaagcuggagaggaagcugcaaaauaugaagaaggggacaggggucagagccagaccugagugggcggcgggaacauaggacuaggggccucgguaaugggugucggcaccuuguggccuggggagggggccgguguuggaguaaaauaagcaauuagagggcagagccaagggaggagggugggaacgaaaagagaagaggauaggcacuugcuccacucuggcugugagccgggcggggcuggcccaaggcggucuuguacagaaggucccggggcguugguuccagaggccccagacugguggaagauuuuaggagaaccguggagaaggugaaggccuggaggguuuugagggaaaagaggcggcgcggucgcgcuagguaucucccuuucuauacucagggccgccaggucugagcccggcaccgugcggcgcacgugcgugcgcgcagagaguccccaaaguucuccacugagacaaagagaaacugcaccagacggagacguagagagaaaagaggaggagagacacagagaggggaggagggaggacgagacugagagaggagaaugcgaagauccggggaggcgagcuacagaaacugaucuaggggcauugggagggggagcggagagggaucgaauggggccggcccuaggcaaucuggggucuuguggccgggguggaagccgggcucucccagcggcgggauccgacgccggggcggccgcacugagucucggucuggucggcccgcucuccuuuucucgcuggucgcagaugcucaagccgcuuguggagaagcggcgccgggaccgcaucaaccgcagccuggaagagcugaggcugcugcugcuggagcggacccgggaccaggucagucccuccgcuagcccuagguccccaagcuucccguuuccgcgucccagggcuucccacugggguggggacacaagcuugguuggcaacccuggccccaaggcauccucacccgagucccgccuuuggaauuccaucccagacccccacucgcucucagaacgcgaucuucuucgccaccccucgggucuguaaguuucacgccugguucuguaaauuucgcucccggggucggucaguuucacccuuugggucucuaaguguccgguucccccucccccacagccagccucugaugagccagccucuguuaugucgggugguuaauuucauucccuggguugcgguuucaaaucuccuccucacgcguugggcauugguuccaaccccuaggauuggacaguuucgucucagggugggccaggacuuuccuuggucaucuccacuccgcauuuggucgcgcguucugugggcagugcgcaaaugcgaucgggggcaccaccagcucccgcauccgucccucccuucuucccccugccacuuucccccuuucuccccaccccuuucugucucugcgcccuccccucccgucuguagaaccuccggaacccgaagcuggagaaagcggagauauuggaguucgccgugggcuacuugagggagcgaagccggguggagcccccggguacagcgcggggguggggcagcggagggagggaggggggacgccaggaggcuccggccggggcagagugggcgggcccugcgguggauggugggcuuggggaguggccgguucugcuccgaggcgagguuaauaacacccgcgcgugucugucucugugucucccucauuuucucccucuuuccguccaucuggcuuccugucucugugcgcc

SEQ ID NO: 19898 - RNA, 2492 nt, Homo sapiens
ggcgcacagagacaggaagccagauggacggaaagagggagaaaaugagggagacacagagacagacacgcgcggguguuauuaaccucgccucggagcagaaccggccacuccccaagcccaccauccaccgcagggcccgcccacucugccccggccggagccuccuggcguccccccucccucccuccgcugccccacccccgcgcuguacccgggggcuccacccggcuucgcucccucaaguagcccacggcgaacuccaauaucuccgcuuucuccagcuucggguuccggagguucuacagacgggaggggagggcgcagagacagaaagggguggggagaaagggggaaaguggcagggggaagaagggagggacggaugcgggagcugguggugcccccgaucgcauuugcgcacugcccacagaacgcgcgaccaaaugcggaguggagaugaccaaggaaaguccuggcccacccugagacgaaacuguccaauccuagggguuggaaccaaugcccaacgcgugaggaggagauuugaaaccgcaacccagggaaugaaauuaaccacccgacauaacagaggcuggcucaucagaggcuggcugugggggagggggaaccggacacuuagagacccaaagggugaaacugaccgaccccgggagcgaaauuuacagaaccaggcgugaaacuuacagacccgagggguggcgaagaagaucgcguucugagagcgagugggggucugggauggaauuccaaaggcgggacucgggugaggaugccuuggggccaggguugccaaccaagcuuguguccccaccccagugggaagcccugggacgcggaaacgggaagcuuggggaccuagggcuagcggagggacugaccuggucccggguccgcuccagcagcagcagccucagcucuuccaggcugcgguugaugcggucccggcgccgcuucuccacaagcggcuugagcaucugcgaccagcgagaaaaggagagcgggccgaccagaccgagacucagugcggccgccccggcgucggaucccgccgcugggagagcccggcuuccaccccggccacaagaccccagauugccuagggccggccccauucgaucccucuccgcucccccucccaaugccccuagaucaguuucuguagcucgccuccccggaucuucgcauucuccucucucagucucguccucccuccuccccucucugugucucuccuccucuuuucucucuacgucuccgucuggugcaguuucucuuugucucaguggagaacuuuggggacucucugcgcgcacgcacgugcgccgcacggugccgggcucagaccuggcggcccugaguauagaaagggagauaccuagcgcgaccgcgccgccucuuuucccucaaaacccuccaggccuucaccuucuccacgguucuccuaaaaucuuccaccagucuggggccucuggaaccaacgccccgggaccuucuguacaagaccgccuugggccagccccgcccggcucacagccagaguggagcaagugccuauccucuucucuuuucguucccacccuccucccuuggcucugcccucuaauugcuuauuuuacuccaacaccggcccccuccccaggccacaaggugccgacacccauuaccgaggccccuaguccuauguucccgccgcccacucaggucuggcucugaccccuguccccuucuucauauuuugcagcuuccucuccagcuucuggcuccuggaguucuggagcaccgcuccccuuccaccccugcguccccagccucucuccagaccgacggcgucaggggcccaguccccuagccaaaccagggaccucugcucccuccccucccgccucucaccuuggggccgucccuauucucagcucgaucccgggugaccauugcuccuccggacccuguguggaccgguucccugcucgccuggagccuuauauuccgcggcccaaggguaggagggauaggacccgaccccgcccccuucgacauccagauucugccccucuaggacccggcacgaggcucccggaaagaggaggagugaaggggggaggggaaggagagaaacuggccugggagugcgggaagugaggggugaaugggggcacuggcugguuuacagaccguaaggcuguauaaggaggcgggacccagcugaaaggaggaggcuauuggggcagagcucgcuuggggaugaaauucagaguuccuccagaauugcagcuuucugggaggcuuacuguacccucacuaacccugaaauagaaguuagcaccucucagcccccaggcugaauuuuauacaucaucuccgaaguucgcuuccuagucgagacagggagcaacccgagugcgcugggugaaucuguccgacucaaccgaagcucugccgggagguuggagaggcgcucucuucuaucu

SEQ ID NO: 19899 - RNA, 3351 nt, Homo sapiens
gacuccaucauugcugucauucccggccucaagccuccaccgcccccacacgugccgccacagggagcggcccgaucaaggcgugacgcuccgaaggguggggccucacuuauuccccuauuuaaaggggaaagaggccgcggcgccggccccaggacccgacccggccccaggagagugugcucguucuguucacggagcuggccgcguuagcgacguccucgaguccgcggcgggcacgaugcagcucuuggugaggguacccucucuuccggagcggggcgagcuggacugcaacaucugcuaccguccuuucaaccucgggugccgcgcgccccgccgccugcccggaacggcgcgcgcccgcugcggccacacgaucugcaccgccugccuccgcgagcuggcggcgcgcggggacggcggcggggcggccgcgcgcguggugcgccugcgccgcguggucacgugccccuucugccgcgcgcccucgcagcucccucgcggcggccucacggagauggcucuugacucggacuuguggucgcgauuggaggaaaaagcgcgggccaagugcgaacgagaugaggcugggaacccggccaaggaaagcagcgacgcugacggagaggcggaggaagaaggggagagcgagaagggggcggggccuaggagugcuggguggcgcgcgcuccggcggcucugggacaggguccuggggccugcgcggcgcuggcggcguccgcugccuagcaacggugaggggcugcccggggaggaugcaggggagagagcgccgaggaauaccgagguucguuggcaugcuccugcugccacuaacccuucuucuuucccccagugcucuacugugcggagaucaaggacauuggccaccugacccguugcacguuguaaccgaggaacucggaagcuacagccgaaggaaggugggagcugcagccucgcgggggcugaugucaagacuacucucucucagaucccaggauuggcaugugaugagagagaugagccgaaggcaggagggaacgcccugggagguguugaugcugaguuggggaggcuccuagacgaacucgcccccaucuacugacugugccagucuuacauuuucaggauggaguggccaagggaugauauaaacaaagccuacguuaccgugggaagaagacagacuguuuucuuagcugggacguuggcuuuuguccaggguggcucuggugugugggagcaacaggucccauuuuagcaauucuuugucaaugguuugaauuuuuuuuuuuuuuaagauggaacgggagagaagaggcuaauuuucgcgucauguuaaucucacuucucuggcauguaagggugcugguaugccugcugucuccccacucccaguucuguguuccagaaauugagauggcucccugccugugacuaugauuaggagccuugcuucauuucagaaucucccuucaaccugcuagggcagguaucagaaauuccaaagggcauuuaugugaggcaccuaauuagagccuaucaaaguaggaagggagagccauuugaaaggcaucauauuucaaacuuuugcuauuaucuguguuaucuuuacagucacgggaacacacuagcgcuacugaaaagauacuuauacaauuuuaagugucuuuaaaauuugugucccauaaugggacaucaccuguuguauauaugccauguauucuauuuuagaauccuguaucuuaugaccauaaagucauagucaaggaccagcaguguugguguacugucaacggaagugcacagucucacucuaggaucccacuccagacuuccugaaucagacucuggcaggguuuuuuguuuuuuuguuuuuguuuugagccagagucucacugugucgcccaggcuggagugcaguggcgugaucucggcucacugcagccuccgccucccagguucaagcgauucuccugccucauccuccggaguagcugggauuacaggcgccugccaccacaccuggcuaauuuuuguauuuuuaguagagaugggguuucgccauguuugucaggcuggucucaaaacuccugaccucaggugauggcgcccaccuuggccucccaaagugcugggauuauaggagugagccaccgcgccgggccagacucuggcauuuuaacaaucccaggugaugugugugcaugugaaaauuuaaguaccauuggucuagauccuacacucuuuaggauaucaccaucuguagguagaauauuuaaagcauaauagguaugacugauagauuauuuuauccaaaguucuuuuuuuuuuuuuuugagauggagucuugcucuguugcccagacuggagugcaguggcgugaucucggcucacugcaagcucugccuccuggguucacgccauucuccugccucagccucccaaguagcuggggcuacaggcacccaccaccacgccuggcuaauuuuuuuguauuuuuaguagagaugggguuucaccguguuagccaggauggucucgaucuccugaccucaugauccgccugccucggccucccaaagugcuaggauuacaggcgugagccaccacgcccggccccaaaguucuaaaguaacauucuauugcuaaagaaauccuaaccuacuauguaacauuuuucucuuaguuaaaaaugugaacuuauuauuaaccucaauuuuuuagaggccuccaaucuuuuuaaaauauaaauauuuuugauugacaaaucauaauuauacacuuauggggguauaaaccucaauuuuuguaacccuauuuuggcauuuuccuguccuuacaucucagcuuaaaugcucccucuuuugggaggccuuuuucugccuucaacauaguagagccuuuucccccaccccucuguaacauaaugcccuguuuuauuuuuacugcuuuuauuuucaugcuuuguggguguccccacuggaguguaagcccuaugggagcaagggcugaccugugacuguuuuaucuccagggccaacagcaguguuacuguauaguauguacucaauaaauauuuguuggcuuuaucucuuauuuuuuaauauaauagccuugugaacuaagugucuggccucucucaaucucucagaggcucuguuuagugaacaauaaacaucaaggaagugccuagcaguucaaaucuuugguaagcuagacagaucugacccucaacgccuuaaaaaaaaaaaaaaaaaaagugugccuuugcuucauacuggagcugaaccuguggagcuguagugaccucuacugacucuuaggggaacuaagcaacuugaa

SEQ ID NO: 19900 - RNA, 3351 nt, Homo sapiens
uucaaguugcuuaguuccccuaagagucaguagaggucacuacagcuccacagguucagcuccaguaugaagcaaaggcacacuuuuuuuuuuuuuuuuuuuaaggcguugagggucagaucugucuagcuuaccaaagauuugaacugcuaggcacuuccuugauguuuauuguucacuaaacagagccucugagagauugagagaggccagacacuuaguucacaaggcuauuauauuaaaaaauaagagauaaagccaacaaauauuuauugaguacauacuauacaguaacacugcuguuggcccuggagauaaaacagucacaggucagcccuugcucccauagggcuuacacuccaguggggacacccacaaagcaugaaaauaaaagcaguaaaaauaaaacagggcauuauguuacagaggggugggggaaaaggcucuacuauguugaaggcagaaaaaggccucccaaaagagggagcauuuaagcugagauguaaggacaggaaaaugccaaaauaggguuacaaaaauugagguuuauacccccauaaguguauaauuaugauuugucaaucaaaaauauuuauauuuuaaaaagauuggaggccucuaaaaaauugagguuaauaauaaguucacauuuuuaacuaagagaaaaauguuacauaguagguuaggauuucuuuagcaauagaauguuacuuuagaacuuuggggccgggcgugguggcucacgccuguaauccuagcacuuugggaggccgaggcaggcggaucaugaggucaggagaucgagaccauccuggcuaacacggugaaaccccaucucuacuaaaaauacaaaaaaauuagccaggcgugguggugggugccuguagccccagcuacuugggaggcugaggcaggagaauggcgugaacccaggaggcagagcuugcagugagccgagaucacgccacugcacuccagucugggcaacagagcaagacuccaucucaaaaaaaaaaaaaaagaacuuuggauaaaauaaucuaucagucauaccuauuaugcuuuaaauauucuaccuacagauggugauauccuaaagaguguaggaucuagaccaaugguacuuaaauuuucacaugcacacacaucaccugggauuguuaaaaugccagagucuggcccggcgcgguggcucacuccuauaaucccagcacuuugggaggccaaggugggcgccaucaccugaggucaggaguuuugagaccagccugacaaacauggcgaaaccccaucucuacuaaaaauacaaaaauuagccaggugugguggcaggcgccuguaaucccagcuacuccggaggaugaggcaggagaaucgcuugaaccugggaggcggaggcugcagugagccgagaucacgccacugcacuccagccugggcgacacagugagacucuggcucaaaacaaaaacaaaaaaacaaaaaacccugccagagucugauucaggaagucuggagugggauccuagagugagacugugcacuuccguugacaguacaccaacacugcugguccuugacuaugacuuuauggucauaagauacaggauucuaaaauagaauacauggcauauauacaacaggugaugucccauuaugggacacaaauuuuaaagacacuuaaaauuguauaaguaucuuuucaguagcgcuaguguguucccgugacuguaaagauaacacagauaauagcaaaaguuugaaauaugaugccuuucaaauggcucucccuuccuacuuugauaggcucuaauuaggugccucacauaaaugcccuuuggaauuucugauaccugcccuagcagguugaagggagauucugaaaugaagcaaggcuccuaaucauagucacaggcagggagccaucucaauuucuggaacacagaacugggaguggggagacagcaggcauaccagcacccuuacaugccagagaagugagauuaacaugacgcgaaaauuagccucuucucucccguuccaucuuaaaaaaaaaaaaaauucaaaccauugacaaagaauugcuaaaaugggaccuguugcucccacacaccagagccacccuggacaaaagccaacgucccagcuaagaaaacagucugucuucuucccacgguaacguaggcuuuguuuauaucaucccuuggccacuccauccugaaaauguaagacuggcacagucaguagaugggggcgaguucgucuaggagccuccccaacucagcaucaacaccucccagggcguucccuccugccuucggcucaucucucucaucacaugccaauccugggaucugagagagaguagucuugacaucagcccccgcgaggcugcagcucccaccuuccuucggcuguagcuuccgaguuccucgguuacaacgugcaacgggucagguggccaauguccuugaucuccgcacaguagagcacugggggaaagaagaaggguuaguggcagcaggagcaugccaacgaaccucgguauuccucggcgcucucuccccugcauccuccccgggcagccccucaccguugcuaggcagcggacgccgccagcgccgcgcaggccccaggacccugucccagagccgccggagcgcgcgccacccagcacuccuaggccccgcccccuucucgcucuccccuucuuccuccgccucuccgucagcgucgcugcuuuccuuggccggguucccagccucaucucguucgcacuuggcccgcgcuuuuuccuccaaucgcgaccacaaguccgagucaagagccaucuccgugaggccgccgcgagggagcugcgagggcgcgcggcagaaggggcacgugaccacgcggcgcaggcgcaccacgcgcgcggccgccccgccgccguccccgcgcgccgccagcucgcggaggcaggcggugcagaucguguggccgcagcgggcgcgcgccguuccgggcaggcggcggggcgcgcggcacccgagguugaaaggacgguagcagauguugcaguccagcucgccccgcuccggaagagaggguacccucaccaagagcugcaucgugcccgccgcggacucgaggacgucgcuaacgcggccagcuccgugaacagaacgagcacacucuccuggggccgggucggguccuggggccggcgccgcggccucuuuccccuuuaaauaggggaauaagugaggccccacccuucggagcgucacgccuugaucgggccgcucccuguggcggcacgugugggggcgguggaggcuugaggccgggaaugacagcaaugauggaguc

SEQ ID NO: 19901 - RNA, 2656 nt, Homo sapiens
gggaggccggguugacacaaagacccaucucaaccucggauccuuucacgcuucucuccccaacguacccagauccgggacccacaccaccccaccccagacuccaagucccaauacaaauaggugagcgcugccaagccccuggcaggaccugacggccuuucuuucccucuuuucagcgccucugccggaggcaaccccaaaggcacccucuccccacaacuccucauuccuccuccuccugccaaggcagggggcucucugggagaacuuuuucaaaacuuuacccuuuuucagacaagcuuggggggcggggagacuuuauccaguuuccaggagacacacaucccuccccgacccacaagaaagcaccccccgcucccccaaaggucgucucggcuagacaggaacguuugccacagaagccacacggaucaauaugacaguuuuacaaagagcccggaguuggccguuuugaaguuuggugcauuugugccgcauggcagccagaggcccgggggugcggaggucccccugcuguuccccaagcaggggguguggacacccagaugcucaccuaucccaaagaagacuagaaaucacuccacuaggaggguggucugagggggacaccgcugggcgccugacgcggcgcagcggucuggagagcgccgcccagagagugccgccgggugacuugucaccucgggggacgggugcugagugauggucaagcugcagaacagcugggugggcaguucacgccccccaacgugcucagggagugggugguuucagcgagagagugagugacagugaauggcagccacgugagagucacagcugggcagcuuggccaccccagacugacggggucaagagggggaccccccccaccgcacuugacacaaaagagcccagagccccggcgagaugaaggggguggagccggggguaucugguuccccagacacucuucucuccgcuccccaauccgaauggacugcugucccugcacaggcugggggagcgaggggacgagcuccugccuuauuccaggaaguggucugcguggacuguggccaccaccugccccuacucaucagcagcccacaaacauucacaagaccccucccucgcgugccaccgcaugccccucaguuggcgggcaccuaagucuccgcggguggagggggguccgauggacaccguccccacucugccuguccaaguccugagcggagggggcaggcccgucggcugcuccgugcggggaaaccccacucucccucgguccaaccccaccggggccagagcccgaggggcgcucgcgcggccgccccucccccacgugccccucccccacgccgccguccggccgccagggucucggcggucccucgcucggccagggagggggcccuggcuucgccuuggccguuuccugccuacccccuccccgccgaggguaaaaaaaaaaccuccuccuccuccucccccgaaagccgcgaccgaguggcccgguccgcgcgcgcagcucgcgcccagcgcucuccagccgggguggcggcggcggcggcggcggcggcggcggcggcggcgggggaggggugcggcgggggaggggaggaggccuggccccgcggucgcagccgccaccgcccgccccgaccucccggaccgccgcggggccacgggcccgagccccggauucgcgcuccggauucgccucggcucggccgcgcggugggugccucgcccccgcccggcuucgcgcgcccgcggcucccacucgggcuuggggggggagucggggcgggcgcuuaccuggcggcgggggcggcggcggcgggggcagcgguggcggcggcggcggcggcggcgggaagagguggcagccgggggggcuguggcggucgcggccccggucguggcccggcccgcgcccgaguacucccucgucgucguccuccucaucguccucgucggccgccuccaccuccuccuccuccuccucgucgcccucuucuuccuccucuucuuccuccuccgacaccaccaucuccuccuccuccuccuccucgucccucagaggggaagccauccuguggcucuggcccccccaccacccccccacccaccgcccgcccgccucccccaccgcuaccaccaccaccuccuccuccuccuccuccuccuccuccuccuccuccucggcggcggcguccuccuccuccucaccgccucccccagccccccaaacccccgggccaccccccuccgaaacccccacccucggggccgccgucugaggaggggggccaaaccacccccaaaaauugucuuggaaaaaauugaggaaagacuuuuuuuccuucucucuuuccucccaagagaacaagaaagggggauuuaaaauauauauauauauacauauauauauauauauauauguauauauauaaaaguuuucgacuucucucugccccccucuccguugcuuuaaauauauuuaaauucugaggggggcgcucagaaauauuucucagagcugaggcacuaagauggccgccuugaaauuauuuuuaaaacaacccccccuccagcaccgccacccccuccauaaagaaagggagaggggggaaaauccccuuuu

SEQ ID NO: 19902 - RNA, 2656 nt, Homo sapiens
aaaaggggauuuuccccccucucccuuucuuuauggaggggguggcggugcuggaggggggguuguuuuaaaaauaauuucaaggcggccaucuuagugccucagcucugagaaauauuucugagcgccccccucagaauuuaaauauauuuaaagcaacggagaggggggcagagagaagucgaaaacuuuuauauauauacauauauauauauauauauauguauauauauauauauuuuaaaucccccuuucuuguucucuugggaggaaagagagaaggaaaaaaagucuuuccucaauuuuuuccaagacaauuuuugggggugguuuggccccccuccucagacggcggccccgaggguggggguuucggagggggguggcccggggguuuggggggcugggggaggcggugaggaggaggaggacgccgccgccgaggaggaggaggaggaggaggaggaggaggaggaggaggugguggugguagcggugggggaggcgggcgggcgguggguggggggguggugggggggccagagccacaggauggcuuccccucugagggacgaggaggaggaggaggaggagaugguggugucggaggaggaagaagaggaggaagaagagggcgacgaggaggaggaggaggagguggaggcggccgacgaggacgaugaggaggacgacgacgagggaguacucgggcgcgggccgggccacgaccggggccgcgaccgccacagcccccccggcugccaccucuucccgccgccgccgccgccgccgccaccgcugcccccgccgccgccgcccccgccgccagguaagcgcccgccccgacuccccccccaagcccgagugggagccgcgggcgcgcgaagccgggcgggggcgaggcacccaccgcgcggccgagccgaggcgaauccggagcgcgaauccggggcucgggcccguggccccgcggcgguccgggaggucggggcgggcgguggcggcugcgaccgcggggccaggccuccuccccucccccgccgcaccccucccccgccgccgccgccgccgccgccgccgccgccgccgccaccccggcuggagagcgcugggcgcgagcugcgcgcgcggaccgggccacucggucgcggcuuucgggggaggaggaggaggagguuuuuuuuuuacccucggcggggaggggguaggcaggaaacggccaaggcgaagccagggcccccucccuggccgagcgagggaccgccgagacccuggcggccggacggcggcgugggggaggggcacgugggggaggggcggccgcgcgagcgccccucgggcucuggccccggugggguuggaccgagggagagugggguuuccccgcacggagcagccgacgggccugcccccuccgcucaggacuuggacaggcagaguggggacgguguccaucggaccccccuccacccgcggagacuuaggugcccgccaacugaggggcaugcgguggcacgcgagggaggggucuugugaauguuugugggcugcugaugaguaggggcaggugguggccacaguccacgcagaccacuuccuggaauaaggcaggagcucguccccucgcucccccagccugugcagggacagcaguccauucggauuggggagcggagagaagagugucuggggaaccagauacccccggcuccacccccuucaucucgccggggcucugggcucuuuugugucaagugcgguggggggggucccccucuugaccccgucagucugggguggccaagcugcccagcugugacucucacguggcugccauucacugucacucacucucucgcugaaaccacccacucccugagcacguuggggggcgugaacugcccacccagcuguucugcagcuugaccaucacucagcacccgucccccgaggugacaagucacccggcggcacucucugggcggcgcucuccagaccgcugcgccgcgucaggcgcccagcggugucccccucagaccacccuccuaguggagugauuucuagucuucuuugggauaggugagcaucuggguguccacacccccugcuuggggaacagcagggggaccuccgcacccccgggccucuggcugccaugcggcacaaaugcaccaaacuucaaaacggccaacuccgggcucuuuguaaaacugucauauugauccguguggcuucuguggcaaacguuccugucuagccgagacgaccuuugggggagcggggggugcuuucuugugggucggggagggaugugugucuccuggaaacuggauaaagucuccccgccccccaagcuugucugaaaaaggguaaaguuuugaaaaaguucucccagagagcccccugccuuggcaggaggaggaggaaugaggaguuguggggagagggugccuuugggguugccuccggcagaggcgcugaaaagagggaaagaaaggccgucagguccugccaggggcuuggcagcgcucaccuauuuguauugggacuuggagucuggggugggguggugugggucccggaucuggguacguuggggagagaagcgugaaaggauccgagguugagaugggucuuugugucaacccggccuccc

SEQ ID NO: 19903 - RNA, 2573 nt, Homo sapiens
uacuggccaccauucacaagcaaacccucauaccaccccgcagagacuggacccucagauuugaauagcaacaucucucuccuggugcccuucagaagccaaacuuugaacacaguuccugaaaugaaagaccuaacacuagccuagcuacaaaucucucagagacggcuuguuagaaccuucaacagucaccccacccucaguucacacccagcacccugggcagaggcagggaggaaaggcagaaucucccacagccuucccuuggugggaucucuccauggcucccccgccugaaguaaggacccaagggccggcuguucccaccacccuggacucccaauccuuccaucucagaggacacuucuuccaugaaguccucuggcucucccaagcauugcuggauucuucucaucccaggggcuggaguuugaguucccugagggaauggauugcaugggacccacuucguguaggccccgaauggguggacugauggggacggugcccaguguggaaagauuguaaaucgugucacacaguguccucuguccccugugucucaacgucccagcuugaccaucccucuuggaagaauuccaccccucaccugcaccugugccggucaccagacccccuccacccccccaacccccgaccacuacagcucccugaguccugccauggucagccuggggaggcuuccaagucauccgacugucacagacaccuggcuggcugaugcacacaaaucaccacagcgaccacuccucccuccgucaccgacaugggagcaaaaccugcagccucgguaaaacucauacuaucagcagccccccaacccacaaagcagucccagaaggcucccaaggccaggcggugggauacagacaacuuccgccgugaagaaccccccuaacacaccccccaagacccgcccccucaugaacguucccaggguccagggggugggcacgagcuaaaaauagacggggcugcggagcuagugagagccggagggagggaaggggcgcucuuuggaggugggggacgcccguguggagcggacaggccccgagagggagugugagcgccggcgcggacacgcaggcggagcuggcgaccccccgcccgagggggcuccgcggggggcgggaaggcggcugugaccuacuuucuccgccuccgcacggccagccggggagauuagacuggcgauucggcccccucccagcccagagcccggcagggaggcuggacgccggggacccgggaggggagcuggggccgcgucggcgggacccugcgcccccgaggcgucgccccgcggcuuucccccgccccuugcgugccggcccugcguaccccagcuggucccggugcggcccauaaacuggugcguccucggguuccacacgaacuccuuccacuccucaaccaccugcccgcagcucuucuucucuuucuggaugaccaucuugguggcgcggggcgaguccgggcgcggggcgggggguugcggagaagcgggggcgccgcgcgcugaagcccuccacacacccaaaagcacggggagcgaaggcggcgcgggcaaaggagaccccccucagauaugcagcugcugcagauuccggggugcacgaccacgcgcugcggggugcuggcagcgcggcggaagaugcaccgauccuaggccccccaacugcgaugaaaaggggugcugucagagcaggggagaauaacaagaggaagggguaugaaugcagcuucaccccccaccaaaccgucuagaaacaaaacgaaauggggugcaaaaacagacggcuacaaaaaccgagcagaacgcagaaaaaaagcgggguacaaaaaggcagagagaggugggggagggggccgccccgaaauccaagaugcaaagaagcuguggaacgaagcucaaggcucgcuccgccaagcggagaccacugcaccggugguggcucagccgcggggguggggcggggacgcgcagcugggggacagccagggauggggggccccccaggcggaggcuccgcuccucagcagugcgaggcccgcggucgccgagcgcggucuuuauacucugcggcucugggggugcccgcccccuucccacccccagaagcuccgccuccucgccacuggcccaggcgaccucauacauauguaaauauggagagguugggcccgccccccugacuucucuuagggaccuagcugucucuccauuacccccaccccagguacuagacugggacagggugggaggaagagauagagggcguguccgggcggaguagagggaaagauaaccccagagaaacacaacggcagagagagaagccgauauaugcucaaaggugggggccccaggcagggaguuagaaagagacuaagauacagaugcggcggaagaguccgggagcagauggggcagaaugucagaggaauaaagagcuagagaucaagaaagagagcgaagagaccagccgggaggcuggccgagccaggagggaagcuaggacaggccccgcagagauggauaaaggcca

SEQ ID NO: 19904 - RNA, 2573 nt, Homo sapiens
uggccuuuauccaucucugcggggccuguccuagcuucccuccuggcucggccagccucccggcuggucucuucgcucucuuucuugaucucuagcucuuuauuccucugacauucugccccaucugcucccggacucuuccgccgcaucuguaucuuagucucuuucuaacucccugccuggggcccccaccuuugagcauauaucggcuucucucucugccguuguguuucucugggguuaucuuucccucuacuccgcccggacacgcccucuaucucuuccucccacccugucccagucuaguaccugggguggggguaauggagagacagcuaggucccuaagagaagucaggggggcgggcccaaccucuccauauuuacauauguaugaggucgccugggccaguggcgaggaggcggagcuucugggggugggaagggggcgggcacccccagagccgcagaguauaaagaccgcgcucggcgaccgcgggccucgcacugcugaggagcggagccuccgccuggggggccccccaucccuggcugucccccagcugcgcguccccgccccacccccgcggcugagccaccaccggugcaguggucuccgcuuggcggagcgagccuugagcuucguuccacagcuucuuugcaucuuggauuucggggcggcccccucccccaccucucucugccuuuuuguaccccgcuuuuuuucugcguucugcucgguuuuuguagccgucuguuuuugcaccccauuucguuuuguuucuagacgguuugguggggggugaagcugcauucauaccccuuccucuuguuauucuccccugcucugacagcaccccuuuucaucgcaguuggggggccuaggaucggugcaucuuccgccgcgcugccagcaccccgcagcgcguggucgugcaccccggaaucugcagcagcugcauaucugaggggggucuccuuugcccgcgccgccuucgcuccccgugcuuuuggguguguggagggcuucagcgcgcggcgcccccgcuucuccgcaaccccccgccccgcgcccggacucgccccgcgccaccaagauggucauccagaaagagaagaagagcugcgggcaggugguugaggaguggaaggaguucguguggaacccgaggacgcaccaguuuaugggccgcaccgggaccagcugggguacgcagggccggcacgcaaggggcgggggaaagccgcggggcgacgccucgggggcgcagggucccgccgacgcggccccagcuccccucccggguccccggcguccagccucccugccgggcucugggcugggagggggccgaaucgccagucuaaucuccccggcuggccgugcggaggcggagaaaguaggucacagccgccuucccgccccccgcggagcccccucgggcggggggucgccagcuccgccugcguguccgcgccggcgcucacacucccucucggggccuguccgcuccacacgggcgucccccaccuccaaagagcgccccuucccucccuccggcucucacuagcuccgcagccccgucuauuuuuagcucgugcccacccccuggacccugggaacguucaugagggggcgggucuugggggguguguuagggggguucuucacggcggaaguugucuguaucccaccgccuggccuugggagccuucugggacugcuuuguggguuggggggcugcugauaguaugaguuuuaccgaggcugcagguuuugcucccaugucggugacggagggaggaguggucgcuguggugauuugugugcaucagccagccaggugucugugacagucggaugacuuggaagccuccccaggcugaccauggcaggacucagggagcuguaguggucggggguuggggggguggagggggucuggugaccggcacaggugcaggugagggguggaauucuuccaagagggauggucaagcugggacguugagacacaggggacagaggacacugugugacacgauuuacaaucuuuccacacugggcaccguccccaucaguccacccauucggggccuacacgaagugggucccaugcaauccauucccucagggaacucaaacuccagccccugggaugagaagaauccagcaaugcuugggagagccagaggacuucauggaagaaguguccucugagauggaaggauugggaguccaggguggugggaacagccggcccuuggguccuuacuucaggcgggggagccauggagagaucccaccaagggaaggcugugggagauucugccuuuccucccugccucugcccagggugcugggugugaacugaggguggggugacuguugaagguucuaacaagccgucucugagagauuuguagcuaggcuaguguuaggucuuucauuucaggaacuguguucaaaguuuggcuucugaagggcaccaggagagagauguugcuauucaaaucugaggguccagucucugcggggugguaugaggguuugcuugugaaugguggccagua

SEQ ID NO: 19905 - RNA, 2524 nt, Homo sapiens
cauucucccccuucccacccugcagccagcuuccccucucacugaaggagcugguauccucuggggugcccuggaugcuuccgucgggauucgccuggagguagaaacccuggcggcagaacaguuuggugacgaugccuuugagcugaggcucuggagagagagacauucaucuuugaaaaugacaucuccguucccagaaacauuccuacacuuggcaggauuagagggaagaaaggagaaugaaaggaaggaagagggucccagggccccagcucucuuauccuccaagcacgcucucucccaccucucuuucacuccugggaaagcuggugugggucccuucuguuuccuauaaccaggagcuuucaguguaauuuauugaaauuuauuuaaauggcuuaauuccuacccuacagcucaaccagaagggggaaggagugggggaggagggaggggagagauauaucaaaaggcagggacagagggagaccagcagggguacugaaggggcagcguguuugcgaaggugggggaucuuggcagcagcaaauugaccacaggguaggggcucucccucaggagugggggugggacugggccugacgcugacucagcaccugcugcggcugccgcuagcuuggcgagagccuugccuuggcccagcgccggccugucugacacugacccaucugucugucugucugucugucugucaguccgcuggcucccgggggcccaguucucccugaggcucagccucuccccuucggccagguaacucgccugggguaagggggaccuuaccaaggauauggggggugggagcugaggagauggagaggcaggcugagucacgugggggcccgguccuacucagagggugggcugcggauuguaccacuaugggcagccgguggcgcggggaggagggcgcgagguggcuacccuuaggggagcugggagcgggcgggagcagggccagagggacucccugacugucguacauggacggggaccaauucuaacucucacaacucuccucccccaucgcuugcucucugccgacuucccuguccccccuuguaggugguacgacccccgagucggcgcccaucucuagccgugaacugugucugaguuccugccagcguaggguccccugagccuacgggacccgauuucggaguggcgcggggguuaugggaggggugcccagcuccguucuugaagcgcaggucacaggaggagggcgcauagagggcuggcuggcgagguagcugcaaggacacccgagggagagcuggggagauuggcucggagccagcagagcucgaccaggaggaaccgagcccaggcguggaggagcgggagaaccggggcaggcgggggcugggggggggcgugcggcuggagcugcagaaauccuuggggugacccaggcaucuggaaacccccgggccccuccgcuccagauugaaagaaucgcgagaaccggcacguaggcggaggacgauggggguggggacugcuguguugggaaggggggacgagcaggaacuacgaggcuuucggggcgccaggcagccccucaagccuuccccuugaccucgaaaauaaggagacuccggguuauggacaaaagagaagggaaacugaggcacagucuggcagggacuuugucguccuggcccacccccuuccacuuucggggagccccucagccgggcccuauucuucagagucccuggccucaaucucccaggcagagaaaccucuggccgggagaccccgccccagccgcacucacccgggccgcgguccggccgcgcgggccgccccccgcacagucgcaccuuggacagcaggaugaggagcugcuucuggcaaagggacuuggugccgcggggacacacgcgccgcugcgccgacaccggccggcugcccccgggcucgcggaccucccgcuucugccggaucaggcuacuggccagcgccgccauagcgccccgggaggagacacccccaaaccggcaggcgcccggagcgcgcugggcucccccagaggagcccgcucacuagggcaugcucuugacgcucaggccccgacucgcugccccacccacaggaccugaggauaagccccagacccccccccucacguaccccccuccacagcagccaguuaccacccgugggcccagugcuggcuccaccagauccagcagccuauguacuccucaguggaucccacccucgaguuuugccuccuauugaaaacguccccuuucccuccucuccagugucuguccucacuucaccuaucccaaagccaagacccacuaaauuuccaagacgugguuuaaauaucuucaggcaccuuuccacuguauuuuggggcacacuccugccaaauccacucuuguaaucuacagggugugggacuuuagcuuugggaauauucgcucaucccaccccuacuggggcacugccaaugucaggaaggaacccaaccuugguguuu

SEQ ID NO: 19906 - RNA, 2524 nt, Homo sapiens
aaacaccaagguuggguuccuuccugacauuggcagugccccaguaggggugggaugagcgaauauucccaaagcuaaagucccacacccuguagauuacaagaguggauuuggcaggagugugccccaaaauacaguggaaaggugccugaagauauuuaaaccacgucuuggaaauuuagugggucuuggcuuugggauaggugaagugaggacagacacuggagaggagggaaaggggacguuuucaauaggaggcaaaacucgagggugggauccacugaggaguacauaggcugcuggaucugguggagccagcacugggcccacgggugguaacuggcugcuguggagggggguacgugagggggggggucuggggcuuauccucagguccuguggguggggcagcgagucggggccugagcgucaagagcaugcccuagugagcgggcuccucugggggagcccagcgcgcuccgggcgccugccgguuugggggugucuccucccggggcgcuauggcggcgcuggccaguagccugauccggcagaagcgggagguccgcgagcccgggggcagccggccggugucggcgcagcggcgcguguguccccgcggcaccaagucccuuugccagaagcagcuccucauccugcuguccaaggugcgacugugcggggggcggcccgcgcggccggaccgcggcccgggugagugcggcuggggcggggucucccggccagagguuucucugccugggagauugaggccagggacucugaagaauagggcccggcugaggggcuccccgaaaguggaagggggugggccaggacgacaaagucccugccagacugugccucaguuucccuucucuuuuguccauaacccggagucuccuuauuuucgaggucaaggggaaggcuugaggggcugccuggcgccccgaaagccucguaguuccugcucguccccccuucccaacacagcaguccccacccccaucguccuccgccuacgugccgguucucgcgauucuuucaaucuggagcggaggggcccggggguuuccagaugccugggucaccccaaggauuucugcagcuccagccgcacgcccccccccagcccccgccugccccgguucucccgcuccuccacgccugggcucgguuccuccuggucgagcucugcuggcuccgagccaaucuccccagcucucccucggguguccuugcagcuaccucgccagccagcccucuaugcgcccuccuccugugaccugcgcuucaagaacggagcugggcaccccucccauaacccccgcgccacuccgaaaucgggucccguaggcucaggggacccuacgcuggcaggaacucagacacaguucacggcuagagaugggcgccgacucgggggucguaccaccuacaaggggggacagggaagucggcagagagcaagcgaugggggaggagaguugugagaguuagaauugguccccguccauguacgacagucagggagucccucuggcccugcucccgcccgcucccagcuccccuaaggguagccaccucgcgcccuccuccccgcgccaccggcugcccauagugguacaauccgcagcccacccucugaguaggaccgggcccccacgugacucagccugccucuccaucuccucagcucccaccccccauauccuugguaaggucccccuuaccccaggcgaguuaccuggccgaaggggagaggcugagccucagggagaacugggcccccgggagccagcggacugacagacagacagacagacagacagaugggucagugucagacaggccggcgcugggccaaggcaaggcucucgccaagcuagcggcagccgcagcaggugcugagucagcgucaggcccagucccacccccacuccugagggagagccccuacccuguggucaauuugcugcugccaagaucccccaccuucgcaaacacgcugccccuucaguaccccugcuggucucccucugucccugccuuuugauauaucucuccccucccuccucccccacuccuucccccuucugguugagcuguaggguaggaauuaagccauuuaaauaaauuucaauaaauuacacugaaagcuccugguuauaggaaacagaagggacccacaccagcuuucccaggagugaaagagaggugggagagagcgugcuuggaggauaagagagcuggggcccugggacccucuuccuuccuuucauucuccuuucuucccucuaauccugccaaguguaggaauguuucugggaacggagaugucauuuucaaagaugaaugucucucucuccagagccucagcucaaaggcaucgucaccaaacuguucugccgccaggguuucuaccuccaggcgaaucccgacggaagcauccagggcaccccagaggauaccagcuccuucagugagaggggaagcuggcugcagggugggaagggggagaaug

SEQ ID NO: 19907 - RNA, 2280 nt, Homo sapiens
ccccgccccccacgcccgccaaaccgccccccuugcgggccacuuuggccuccuccaccgcggcacggagggcccgggccggguccccgcggagccgggccaauucuccgagcagcgcagcggagucgucccccguacggagcugucggccguucagaaaauagugaggcaacgucccggccucgagcacucggccgagcucgucuagcagcccgaggcagcaggcgcccgcauuuucuggccgcgccagguagagcgcaggcagccgcucgcacgcccaguacagcagcguccgcaggagguagggcgccgccgcccgggucccggccaccagcgggcgcaguagcgccugggccgccgcgugcgccugcagcagcggcgcugguaugcgcgcuuugagcgccagcuccuggcgggcaaaacagagcugccaggcggaggcgcacggccgcucggugccgccaccgggcaccagguagaaggaagccgacucagaggccagcggaccggcccacgaguggcuccgagcccccucgggccagcccgccacggacaccacugggaucaggucgaagagcaggaggcggcgagggggcucagggguagccaggaggacgguggugaaacccgcguggcgagcugcgugcaccagacgcggagcacccgggacagggaucagagacucggcgaccgccgccagcguagcaaagaaccaggcagccaccugggcggaacauaaugugggccacgcuucccgagccuccgacggcuuugggacugggcuuucgacggcugccuuggugacgucacuacucauuguuuucaaaggugcgguagagccaaggucgacgacgucaugcugaggcgacucggacgcugaaacgucacuaggcgauuuuuccaaagacaccggcgccucgugcucagugacguagcugugcggcuggucuacagagcuuugccaguccuuggaacuuucuucgcucuccguucgguggaucgaaucacgugcuccugggacuggggguccuaagcaauccugccacaucucccggauggggguuccgcacaccaucucugggaggcagaccugugcguaacaggauuccagguccaguugcaguucagugccguccagugaaaacaugggcacuaggagugugaagccggcaucguagugagguccccgggcguagggacccaggggugcaugccccagauccagggagcccucgcgaaucccaccacgaagcagcaagagcucugccuggggaggaaagcgagggucccggcggugaacuagaccuaaaaaaagggaacggaucgugagggcgucgcccaaagccggggcgggggcgggggcguggugaggcugagagcugugaguucccaaaggcaaguaggguuacuuaccaagcaaagagaagacaaaguccuuggcccggaggagaucggcucccggcuugggcccgucacuccagcucuccugcacacccagcuccuggaucagcugggucaauuccugcagcugcgccccggagcagaagucgauguccgugagcggccgagcuggggccgggggcggcgggccccaccagggggcacucccccagacugcggaagccaugcgguucuaucgcuuugggcugcggaaaacacggaagggagguggcuuugcugccacaaagucguccccguucuucccucuuccugaggccgagcgagugccccagacacaaccuacaaaugggucuguagaugauggguucuaaauuuaguccucaaaaugaacaaauaaauaccucuucuauccuggcccuuuucucauaggcagguccccgcccccaugaacugguucaccggacucagcagguaaaaaguaacuguuggcuccuccuacggaaugcaguagccagccuccgcugccgccccuugucuaccucccuuuaccucuuuuuuggaagaggcuuauuagucugcggcuucccccuuaugggaagcaguaaggguggggagcagaaauagauucaacagguuacuucuuccugaugcccacguggccacgccccuacauuuucagccacgccccuuucuggaggcugucgaggugguuuccgccgggucgggucgccagucagagcucaaucacucuuuuggcccugcugaaaucccgcguuauccugggaguuguaguuucccgcucuacuagggcgugguagccacgcccccacauccuuuccuguuccgcugaaguagugccugauggaaguuguaguuccu

SEQ ID NO: 19908 - RNA, 2280 nt, Homo sapiens
aggaacuacaacuuccaucaggcacuacuucagcggaacaggaaaggaugugggggcguggcuaccacgcccuaguagagcgggaaacuacaacucccaggauaacgcgggauuucagcagggccaaaagagugauugagcucugacuggcgacccgacccggcggaaaccaccucgacagccuccagaaaggggcguggcugaaaauguaggggcguggccacgugggcaucaggaagaaguaaccuguugaaucuauuucugcuccccacccuuacugcuucccauaagggggaagccgcagacuaauaagccucuuccaaaaaagagguaaagggagguagacaaggggcggcagcggaggcuggcuacugcauuccguaggaggagccaacaguuacuuuuuaccugcugaguccggugaaccaguucaugggggcggggaccugccuaugagaaaagggccaggauagaagagguauuuauuuguucauuuugaggacuaaauuuagaacccaucaucuacagacccauuuguagguugugucuggggcacucgcucggccucaggaagagggaagaacggggacgacuuuguggcagcaaagccaccucccuuccguguuuuccgcagcccaaagcgauagaaccgcauggcuuccgcagucugggggagugcccccugguggggcccgccgcccccggccccagcucggccgcucacggacaucgacuucugcuccggggcgcagcugcaggaauugacccagcugauccaggagcugggugugcaggagagcuggagugacgggcccaagccgggagccgaucuccuccgggccaaggacuuugucuucucuuugcuugguaaguaacccuacuugccuuugggaacucacagcucucagccucaccacgcccccgcccccgccccggcuuugggcgacgcccucacgauccguucccuuuuuuuaggucuaguucaccgccgggacccucgcuuuccuccccaggcagagcucuugcugcuucguggugggauucgcgagggcucccuggaucuggggcaugcaccccugggucccuacgcccggggaccucacuacgaugccggcuucacacuccuagugcccauguuuucacuggacggcacugaacugcaacuggaccuggaauccuguuacgcacaggucugccucccagagauggugugcggaacccccauccgggagauguggcaggauugcuuaggacccccagucccaggagcacgugauucgauccaccgaacggagagcgaagaaaguuccaaggacuggcaaagcucuguagaccagccgcacagcuacgucacugagcacgaggcgccggugucuuuggaaaaaucgccuagugacguuucagcguccgagucgccucagcaugacgucgucgaccuuggcucuaccgcaccuuugaaaacaaugaguagugacgucaccaaggcagccgucgaaagcccagucccaaagccgucggaggcucgggaagcguggcccacauuauguuccgcccagguggcugccugguucuuugcuacgcuggcggcggucgccgagucucugaucccugucccgggugcuccgcgucuggugcacgcagcucgccacgcggguuucaccaccguccuccuggcuaccccugagcccccucgccgccuccugcucuucgaccugaucccagugguguccguggcgggcuggcccgagggggcucggagccacucgugggccgguccgcuggccucugagucggcuuccuucuaccuggugcccgguggcggcaccgagcggccgugcgccuccgccuggcagcucuguuuugcccgccaggagcuggcgcucaaagcgcgcauaccagcgccgcugcugcaggcgcacgcggcggcccaggcgcuacugcgcccgcugguggccgggacccgggcggcggcgcccuaccuccugcggacgcugcuguacugggcgugcgagcggcugccugcgcucuaccuggcgcggccagaaaaugcgggcgccugcugccucgggcugcuagacgagcucggccgagugcucgaggccgggacguugccucacuauuuucugaacggccgacagcuccguacgggggacgacuccgcugcgcugcucggagaauuggcccggcuccgcggggacccggcccgggcccuccgugccgcgguggaggaggccaaaguggcccgcaaggggggcgguuuggcgggcguggggggcgggg

SEQ ID NO: 19909 - RNA, 2530 nt, Homo sapiens
ugaacugcacaguggcagcaguuggagagagccuaggcagauggcaaggaaaggguuaaaagagauuguacgguugagggguggggguucucuccugggaaauuuggagccaaaggccugcccucucagggugagccaauauuguugaccaaugagccacauccauuguacugcccaagugccacccugcugaauaaaccuggucucuggccagcuccuuaaggugagcuagugucucugaaacccaccaccuaucucccuuccuccugaccaucaaggcccaaugacucugucuucuagcugaggccagcucugacaaauucuugagguucuagacucuguaccugcucuggggaccaggaauggguccuucuucacugcugcugcugcugcugcugcugcugcuggaggccucgucuccacuggggagccuggcuugggggcaagguugaccagaacuucucuccccgaccaggcucccugcuugggaggccugagaguuuagcacgauguacuuguacuuuuuccaguugcaggccuuggggucagggcuggcuggacugggggggccuugacugcagcuucgagauucaguaggugggucuggguguccuucggagcgccugggacuaccugguggaggggccguuggggguguuggggguucugcuuccagggggcgcagggagaugcccagagguucauagcuggggaaagugugaugaacguuagugccauuuccuaaacucugccuuugcccuuaacaccucacccacagagaacgccgagccagggucccucaccuggccuggaugaagcgguggcaugccuggaccacgugcuccaucugcaaauagguggcggccgcuaggacugcuggugcaguggcuggagagaggcgcaggcgcgaaguguacaugaaguccaauagaggggcgaagccucucgcuucgggacccccgggcagagagagcacguccaccccgacucccgcacggccccggaaaauugaauagaagaagccacuagagagagagcagauaaguccuuugggggcuggggaaccaagggagacaugcgcagcuucaggaagccccgcccccugaaaaagucccgccuccucacuaucaccccgcccccaauucugggacgcuccgccuccugcuucugaaagacuuggcuucggauucccucucaacggcccuguggucccaccccuuucccauuuggccccgccccaggccccaccccucgaaccugcaggcgaugagaacugccuugugugcucugagggguugcccgccaaccagcagcgugacgucagugaggaucccgcgcaggcgcagcucguugagguugcccagcacgucggaggaguggcgagugaacucgcggacguagcccagcgcucccuccggggcggcgggggaacccauagcgacacaggccuguagaggccguggaaagugcucuggauccaggcaguccuaagacgccuucccuccucuguuugccuuuuccuuccgaggugcaacuagagccaggacuuccagccccuagccccggcacacgcagccucccuccuaauucuucuuguucauucugcccucuacgacacccucgcucccuugccucuuccagaucccacagcgcuuggagccaguugaagguuccacaccgcggcgucguuggcgagcguggggaaucccgcgcccaucgcccuggguucgacccccagugccccuccagcaccgccacuccccucugcgcgccugugucucagguguccaacccugccucgagaucucacggccugccguccacacaccuccaaaucccagccgaggcucccuuccccgaacuacggaauucugcgacuccuaucuaguccccaaucccuaguuuagcccaauuucugggacucaggcucgcugauggcaagcuccacacaagcuccuacccucuugggggacccaggagucuggcucccucagucucuuguucuuacccccguccugcaggggccgcggcuucucuucuuaaggggggcggggucucucuccccucuuggccucggcuccuuuaucuggccgggaugucgggggcggggguggagguggggugaacgccugggucuguauccuuccuuccucccucgcucuccagauggcgaguccagggcggggucuccgucucgagggcgggaccucagaaacaagggguggucguaacguagggggucuugggucacugcaaguggacacgaggacggggauauuggaauuggggaggagguuagggauaucgagguuggcaauacgggagucugagucgucggaaggccugggccagugaaaauugguguguuggcuuuugggaggguuugccaggagccaaccuuugcugcaggacaaagugcauacggcaacccccucucccucucuuguacuguguuaagggagaaaagggggagcccaacgagacagcagguuugggcagacgacagugggcucccguagggucucagacg

SEQ ID NO: 19910 - RNA, 2530 nt, Homo sapiens
cgucugagacccuacgggagcccacugucgucugcccaaaccugcugucucguugggcucccccuuuucucccuuaacacaguacaagagagggagaggggguugccguaugcacuuuguccugcagcaaagguuggcuccuggcaaacccucccaaaagccaacacaccaauuuucacuggcccaggccuuccgacgacucagacucccguauugccaaccucgauaucccuaaccuccuccccaauuccaauauccccguccucguguccacuugcagugacccaagacccccuacguuacgaccaccccuuguuucugaggucccgcccucgagacggagaccccgcccuggacucgccaucuggagagcgagggaggaaggaaggauacagacccaggcguucaccccaccuccacccccgcccccgacaucccggccagauaaaggagccgaggccaagaggggagagagaccccgccccccuuaagaagagaagccgcggccccugcaggacggggguaagaacaagagacugagggagccagacuccugggucccccaagaggguaggagcuuguguggagcuugccaucagcgagccugagucccagaaauugggcuaaacuagggauuggggacuagauaggagucgcagaauuccguaguucggggaagggagccucggcugggauuuggagguguguggacggcaggccgugagaucucgaggcaggguuggacaccugagacacaggcgcgcagaggggaguggcggugcuggaggggcacugggggucgaacccagggcgaugggcgcgggauuccccacgcucgccaacgacgccgcgguguggaaccuucaacuggcuccaagcgcugugggaucuggaagaggcaagggagcgagggugucguagagggcagaaugaacaagaagaauuaggagggaggcugcgugugccggggcuaggggcuggaaguccuggcucuaguugcaccucggaaggaaaaggcaaacagaggagggaaggcgucuuaggacugccuggauccagagcacuuuccacggccucuacaggccugugucgcuauggguucccccgccgccccggagggagcgcugggcuacguccgcgaguucacucgccacuccuccgacgugcugggcaaccucaacgagcugcgccugcgcgggauccucacugacgucacgcugcugguuggcgggcaaccccucagagcacacaaggcaguucucaucgccugcagguucgagggguggggccuggggcggggccaaaugggaaaggggugggaccacagggccguugagagggaauccgaagccaagucuuucagaagcaggaggcggagcgucccagaauugggggcggggugauagugaggaggcgggacuuuuucagggggcggggcuuccugaagcugcgcaugucucccuugguuccccagcccccaaaggacuuaucugcucucucucuaguggcuucuucuauucaauuuuccggggccgugcgggagucgggguggacgugcucucucugcccgggggucccgaagcgagaggcuucgccccucuauuggacuucauguacacuucgcgccugcgccucucuccagccacugcaccagcaguccuagcggccgccaccuauuugcagauggagcacgugguccaggcaugccaccgcuucauccaggccaggugagggacccuggcucggcguucucugugggugagguguuaagggcaaaggcagaguuuaggaaauggcacuaacguucaucacacuuuccccagcuaugaaccucugggcaucucccugcgcccccuggaagcagaacccccaacacccccaacggccccuccaccagguagucccaggcgcuccgaaggacacccagacccaccuacugaaucucgaagcugcagucaaggcccccccaguccagccagcccugaccccaaggccugcaacuggaaaaaguacaaguacaucgugcuaaacucucaggccucccaagcagggagccuggucggggagagaaguucuggucaaccuugcccccaagccaggcuccccaguggagacgaggccuccagcagcagcagcagcagcagcagcagcagugaagaaggacccauuccugguccccagagcagguacagagucuagaaccucaagaauuugucagagcuggccucagcuagaagacagagucauugggccuugauggucaggaggaagggagauaggugguggguuucagagacacuagcucaccuuaaggagcuggccagagaccagguuuauucagcaggguggcacuugggcaguacaauggauguggcucauuggucaacaauauuggcucacccugagagggcaggccuuuggcuccaaauuucccaggagagaacccccaccccucaaccguacaaucucuuuuaacccuuuccuugccaucugccuaggcucucuccaacugcugccacugugcaguuca

SEQ ID NO: 19911 - RNA, 2762 nt, Homo sapiens
ugccaagguccucccagcuucucaccagcuucccagcugcccugcccgugcuguguacccucuggguuuccuugcacaauggggcggccauggagggugggggcagggugaccaaaacaggcagaaagggaaaaaacaagaagacaagguccaggguccucacccaaccccgccagaaggaaagcucgugaaggcagccuuuggaaggacucucccuggguucucuucuuccccucccugguccucacucaaaggacagcuuaaucucucucucucucucucuuacacacacacacauacacacacauacacacacacugaguuaggguuuccaguucaggguguguguguguguguguguguauguguauguguguguuuguguuuuuuguguguuuuguguguguguuuguguguguguuugugugucuguguuuguguguuuggguguguguuugugcguguguuuuuguguguguuuguguuugugcguguguuuugugugugucuguguguuugugugugugucuguguguguuugugagugugugugugugagagagagaguguguaugugugugugugugaguggggucuccuguggcaggaaggucagccaagcuacuauaaucauuccagggaacaucacucccuaccagcagagcugaaaucgcagcucuccugccuggcuacuuccccuggacaauaacaaccccagacuucuugcuacagaggaaguguggcugcccacaguugguguggcaacugcacagccuccacaguuggaucugcuguccuugacccauccagggccugugcuaggcccacccaagggcuccucccagucucccccucccccauccuaggaacuaacguuaaucccuuuugauucccaaagccuuaaagugucagaaccaaaccaccuagccccauuguacagaugagaacaccaaggcccagagagcacaggcacuuggcuaaagucacacagaugacagaaugguggaaguccaguucucuugcagguuggcuuccugacaccccagugcacucccuuccucuagagcucccccccagagcauccccugaagagcuccucuguuucccaaaccugccuggggaggggagguggggagcuggagguuuccugucugggcugagagugaaagggcugaaagaaggaacgaggaaggagcagccagcagccacaaaaggcuucaaagggcuugggccuccgccaaacuggcugugcacagcccaguggagccugcgcccacccugcggccaaggccauucauucucucucucccucacagaagcauuaggagacuagggccugggaggaagcuucccugcaacuccagguccugccacccaaggcgcgagcucugggaaugugucccgccuccugcuacagccccagcaggcaggaggcaaagcaggccaaccccaaccugccugcagccuggagcaggauuaugaaucagauguggcucuccagguuggaaggaauguggaucauagauagagacacuaaggcccaaggaagggccagagaguggcaaagacagcgcaggauccacgugggugaugauuuuuuuccuguaggucccuccugacggcagaagccaccuacagcuugaagucuucuuuggcgaagggaaaagacaggagagagagagggaaaggcaagcucccagguucccuguuggcgcagguggcauuuuggggggaaacaggguuaugcacugugggagauucgauucggagccaggggcugagccuaaggcugggaucuguguggcugagaucugugcucacuucgagguuuccgugcuugccuggacggcucuugcgcccugggaucuguaaaccccaaggguggugcgcccuggggucgccaugccccucagauucuuuacagggcaccucccauccggcaccuggagcuccugagugcgcgcgccccgggagagcugugcuccccgcgaaauccgugcgcuccagcucagggcucccgggaucggugcccguuagugggcacaggacgccggguguccgaagggcugccuggagaugcaacugaccuuggcgggcaucagaaugacgaguggcagcagcaggagcggggugacgaacaagaucacgaaggacuugaacuuggagacauagcucagcgccgaggccaucgcgcgggagggagacuggcgggcgagacgagugaggggcagcuagaggcgccgcgggcuuaagaaggggccacaguccccggggauuggggagggggcggugacaacuccgccccgcacgggggcgccuccccgcggcccuggggcggggccaccccucggggucugugggacgcgccugcccccaauucugccacccggcggcggugggaggcgucuuuggacuccaacgcuucgggccagcccucuaggggcagccugggcccuagcaucucgcgcuguccaagccucuccugcgcugccgaggcagaggugcgucccggggcugccaagcggggcguguuuuggucacuggugcugcccgcuuuggcguaaggcgcccucccgcguccgcaucugcucuuuccugggcucugaagggucccggaugaaacucucugcaggccucugggucucucaggucuaucuccccgaucucccucuccuuuccaucuccuuacuuccgccccuccggugucucuccgagagguguccccccacgccccgcgcccuccgcaccgcgggccucgcuuc

SEQ ID NO: 19912 - RNA, 2762 nt, Homo sapiens
gaagcgaggcccgcggugcggagggcgcggggcguggggggacaccucucggagagacaccggaggggcggaaguaaggagauggaaaggagagggagaucggggagauagaccugagagacccagaggccugcagagaguuucauccgggacccuucagagcccaggaaagagcagaugcggacgcgggagggcgccuuacgccaaagcgggcagcaccagugaccaaaacacgccccgcuuggcagccccgggacgcaccucugccucggcagcgcaggagaggcuuggacagcgcgagaugcuagggcccaggcugccccuagagggcuggcccgaagcguuggaguccaaagacgccucccaccgccgccggguggcagaauugggggcaggcgcgucccacagaccccgagggguggccccgccccagggccgcggggaggcgcccccgugcggggcggaguugucaccgcccccuccccaauccccggggacuguggccccuucuuaagcccgcggcgccucuagcugccccucacucgucucgcccgccagucucccucccgcgcgauggccucggcgcugagcuaugucuccaaguucaaguccuucgugaucuuguucgucaccccgcuccugcugcugccacucgucauucugaugcccgccaaggucaguugcaucuccaggcagcccuucggacacccggcguccugugcccacuaacgggcaccgaucccgggagcccugagcuggagcgcacggauuucgcggggagcacagcucucccggggcgcgcgcacucaggagcuccaggugccggaugggaggugcccuguaaagaaucugaggggcauggcgaccccagggcgcaccacccuugggguuuacagaucccagggcgcaagagccguccaggcaagcacggaaaccucgaagugagcacagaucucagccacacagaucccagccuuaggcucagccccuggcuccgaaucgaaucucccacagugcauaacccuguuuccccccaaaaugccaccugcgccaacagggaaccugggagcuugccuuucccucucucucuccugucuuuucccuucgccaaagaagacuucaagcuguagguggcuucugccgucaggagggaccuacaggaaaaaaaucaucacccacguggauccugcgcugucuuugccacucucuggcccuuccuugggccuuagugucucuaucuaugauccacauuccuuccaaccuggagagccacaucugauucauaauccugcuccaggcugcaggcagguugggguuggccugcuuugccuccugccugcuggggcuguagcaggaggcgggacacauucccagagcucgcgccuuggguggcaggaccuggaguugcagggaagcuuccucccaggcccuagucuccuaaugcuucugugagggagagagagaaugaauggccuuggccgcagggugggcgcaggcuccacugggcugugcacagccaguuuggcggaggcccaagcccuuugaagccuuuuguggcugcuggcugcuccuuccucguuccuucuuucagcccuuucacucucagcccagacaggaaaccuccagcuccccaccuccccuccccaggcagguuugggaaacagaggagcucuucaggggaugcucugggggggagcucuagaggaagggagugcacuggggugucaggaagccaaccugcaagagaacuggacuuccaccauucugucaucugugugacuuuagccaagugccugugcucucugggccuugguguucucaucuguacaauggggcuaggugguuugguucugacacuuuaaggcuuugggaaucaaaagggauuaacguuaguuccuaggaugggggagggggagacugggaggagcccuugggugggccuagcacaggcccuggaugggucaaggacagcagauccaacuguggaggcugugcaguugccacaccaacugugggcagccacacuuccucuguagcaagaagucugggguuguuauuguccaggggaaguagccaggcaggagagcugcgauuucagcucugcugguagggagugauguucccuggaaugauuauaguagcuuggcugaccuuccugccacaggagaccccacucacacacacacacauacacacucucucucucacacacacacacucacaaacacacacagacacacacacaaacacacagacacacacaaaacacacgcacaaacacaaacacacacaaaaacacacgcacaaacacacacccaaacacacaaacacagacacacaaacacacacacaaacacacacacaaaacacacaaaaaacacaaacacacacauacacauacacacacacacacacacacacccugaacuggaaacccuaacucaguguguguguauguguguguauguguguguguguaagagagagagagagagagauuaagcuguccuuugagugaggaccagggaggggaagaagagaacccagggagaguccuuccaaaggcugccuucacgagcuuuccuucuggcgggguugggugaggacccuggaccuugucuucuuguuuuuucccuuucugccuguuuuggucacccugcccccacccuccauggccgccccauugugcaaggaaacccagaggguacacagcacgggcagggcagcugggaagcuggugagaagcugggaggaccuuggca

SEQ ID NO: 19913 - RNA, 2569 nt, Homo sapiens
uaccccagcaagauggccacccacuucaggauuaucagcagagaggccugcuggagaagucuuuucucccagggcauucugccucucuccagucucugcaguaaaaggaccacccacccucaggcaagggagugggacugaggcauucuggagauucagccuucugccuagugauccuuggaccccugggaaguucuucccacaugaggcuugucuucuuuugcuuucagggaaggaaagcagagaagagccagcagaggcuggcuggccaugucuuagcgcuuugcacaucacccuggaauuuccuguucacacuugcuucaccagaacagagacuccuugagggcagggguugaugcccuguuuguucaucuguuuccugggggcacugugacccacucucuuuaacaggcuucucguggcugcagagcacugccuuuaugauagauaaacaaagacagggucugaggaguucagucugaggagaaacucggagagugcuggcauaggcacagguaacaggaaguggccacccagaccggcccagaggccugcgggcacaggucacucgcauauuuacagggacugccaugcagagcuggaugccaugcaggccugggggcuggcucagcgugggacuucagagacacauccugacccccagccugcucaguccgauggccugcccuccaccuccaugcuucccuuggcgauugcacagcuccucagacugaacuucucaugacucaauaagcagcccucagaagguaaauucccacagcgggcaacugcgcuaaccacccccagcccauggccccaaggucucagacccaguccaaaacugggguucucagccugcagcaagccaugggacccgggcccagcucuggcucuugcagcccacccuggaggcggggggucaucucugccaugagugccuaccuguggccugggugccaagggcagaaguggcaaucugugaccugugccugccuuuguucugaagcauggccagaagacauccugaagcauggccagaagacauccccccuuccccuguuuucuggagaccacugcccagcccaaagcuggugacccacguggccuuacugaccagcagaaaccagggagcccaccuggugcgcagaaccucaaguccuuccagcagccagggccccucagcuuccucugcgccuagaaaccaggccccagcaccagagggcaggagagcgcuuuucagcaccuggacaaggcccuuggggccucccaagagggucuuucuccacucccuguuccugagcuggggcugggcucugagagauccaaggaucugcccaguuugagagcuaaaagagaaagcgcucaccguuggggagagggcgcuggguggggcuggggugccugggagugugacacagccucuuccccauucuugaccuauggcccccuccccacgcaagccuuucccaccuccgcacccucacucgggaggugucgccgcucaacuggcuggggcggacucucccaccacauggaacaccgacacagcccgcagccccucccugcagcccucacugccccggcggaggaggggcacagaggccucuacucucaucuaggugaguccgaaacacguguggucccgcccgucccggccggaggggaucacccuuucccggucaacaagcacaaaagccgcggccgcaaacaaagacgcgccgcaaacucgccagggaggcgggacagcccgcgccgcacccccuccccaggccggacgggcgugcccggccgcgggguccccgcggcgccccgaaggcgcuccuaccuggcccgcgcggaccuccuucuccagcucgcgguggcgguugugccacacgagguagugcagcggauacuugcccucgggccccuuccuggcggaggcguuggcggggaucaucgcccgcuccucaugccggggccgcggcgcccggccggggaggagggacggcgccggagccggggcccggggccgcggggcggggggccggcgcugccugcucgcggggcugcggcucgggcaugugcgagcggcggcgggcgggggcggcgcgcccggcgcggugcgggcggcgcgggcgacgggcguccucgcgaggcggcggcggcgggcggcgcggagaggcccccacccgcccugggagggagcgggcacucggcggcgcugcgcggacucgcgcucgccucccacacccccgcacacaaagacgccgcucggcggagggagcaggcgcccgcagcgggcgcgggggcgcacgggacgcgggccccggggacgccgccgcagggacgcgcgcccgcagcccccggguccccacagcugcauagcccggcccucagcccgagcggccggcgcgggauacggggauguggggaugauggggagagaggaaggggaccaggcgccccggguagagcuugucagcucagccccgcggcaucaugggguuuguaguccgccucgugaaacuggggguggcagguggccgaagagggucugcacuguccccggaucucgugggagaguggg

SEQ ID NO: 19914 - RNA, 2569 nt, Homo sapiens
cccacucucccacgagauccggggacagugcagacccucuucggccaccugccacccccaguuucacgaggcggacuacaaaccccaugaugccgcggggcugagcugacaagcucuacccggggcgccugguccccuuccucucuccccaucauccccacauccccguaucccgcgccggccgcucgggcugagggccgggcuaugcagcuguggggacccgggggcugcgggcgcgcgucccugcggcggcguccccggggcccgcgucccgugcgcccccgcgcccgcugcgggcgccugcucccuccgccgagcggcgucuuugugugcgggggugugggaggcgagcgcgaguccgcgcagcgccgccgagugcccgcucccucccagggcgggugggggccucuccgcgccgcccgccgccgccgccucgcgaggacgcccgucgcccgcgccgcccgcaccgcgccgggcgcgccgcccccgcccgccgccgcucgcacaugcccgagccgcagccccgcgagcaggcagcgccggccccccgccccgcggccccgggccccggcuccggcgccgucccuccuccccggccgggcgccgcggccccggcaugaggagcgggcgaugauccccgccaacgccuccgccaggaaggggcccgagggcaaguauccgcugcacuaccucguguggcacaaccgccaccgcgagcuggagaaggagguccgcgcgggccagguaggagcgccuucggggcgccgcggggaccccgcggccgggcacgcccguccggccuggggagggggugcggcgcgggcugucccgccucccuggcgaguuugcggcgcgucuuuguuugcggccgcggcuuuugugcuuguugaccgggaaagggugauccccuccggccgggacgggcgggaccacacguguuucggacucaccuagaugagaguagaggccucugugccccuccuccgccggggcagugagggcugcagggaggggcugcgggcugugucgguguuccauguggugggagaguccgccccagccaguugagcggcgacaccucccgagugagggugcggaggugggaaaggcuugcguggggagggggccauaggucaagaauggggaagaggcugugucacacucccaggcaccccagccccacccagcgcccucuccccaacggugagcgcuuucucuuuuagcucucaaacugggcagauccuuggaucucucagagcccagccccagcucaggaacagggaguggagaaagacccucuugggaggccccaagggccuuguccaggugcugaaaagcgcucuccugcccucuggugcuggggccugguuucuaggcgcagaggaagcugaggggcccuggcugcuggaaggacuugagguucugcgcaccaggugggcucccugguuucugcuggucaguaaggccacgugggucaccagcuuugggcugggcaguggucuccagaaaacaggggaaggggggaugucuucuggccaugcuucaggaugucuucuggccaugcuucagaacaaaggcaggcacaggucacagauugccacuucugcccuuggcacccaggccacagguaggcacucauggcagagaugaccccccgccuccagggugggcugcaagagccagagcugggcccgggucccauggcuugcugcaggcugagaaccccaguuuuggacugggucugagaccuuggggccaugggcugggggugguuagcgcaguugcccgcugugggaauuuaccuucugagggcugcuuauugagucaugagaaguucagucugaggagcugugcaaucgccaagggaagcauggagguggagggcaggccaucggacugagcaggcugggggucaggaugugucucugaagucccacgcugagccagcccccaggccugcauggcauccagcucugcauggcagucccuguaaauaugcgagugaccugugcccgcaggccucugggccggucuggguggccacuuccuguuaccugugccuaugccagcacucuccgaguuucuccucagacugaacuccucagacccugucuuuguuuaucuaucauaaaggcagugcucugcagccacgagaagccuguuaaagagagugggucacagugcccccaggaaacagaugaacaaacagggcaucaaccccugcccucaaggagucucuguucuggugaagcaagugugaacaggaaauuccagggugaugugcaaagcgcuaagacauggccagccagccucugcuggcucuucucugcuuuccuucccugaaagcaaaagaagacaagccucaugugggaagaacuucccagggguccaaggaucacuaggcagaaggcugaaucuccagaaugccucagucccacucccuugccugagggugggugguccuuuuacugcagagacuggagagaggcagaaugcccugggagaaaagacuucuccagcaggccucucugcugauaauccugaaguggguggccaucuugcuggggua

SEQ ID NO: 19915 - RNA, 2722 nt, Homo sapiens
ggccgcccgagggcagagcgcgcgcgcggccgccgccccacggggucccgggagccggcgcccggagcugcgacuuacucaccucucccuucugcuucuuuucaucggccucugagggcgcagcgcccagggucuggcggaagacccugaugacagucggguccccaagccucggccuccagucuccccacgucuccauggccaacaccgcucuccccggcucgugcccuccccacucccuuccggcugccggcgcgcccucccucccugguggccccggcuccucucacccucugcucccacuuguugcaauugcuguacaaagggccggggcggggguggggggcgggcgagggcagccgggcccgaacuggcugccucugcccggccacggccaauccagagcgcgcccgcgcgggagggcccugggcagccgccgccggcgggcggagccgcgggcaaagcgcggagcucgccgaguagacggccccgccgcccgcugcccgccggggcucuccagcuucgccaugccgccguggggcgccgcccucgcgcucaucuuggccgugcucgcccuucucggccugcucggcccgcggcuccggggacccugggggcgcgccgucggagagaggacccugccgggggcccaagaccgagacgacggggaggaggcggacggcggaggcccggcggaccaguucagcgacgggcgcgagccacugccgggagggugcagccuuguuugcaagccgucggcccuggcccagugccugcugcgcgcccugcggcgcucagaggcgcuggaggccggcccgcgcuccugguucuccgggccccaccugcagacccucugccacuucguccugcccguagcgccugggccugagcuggcccgggaguaccugcaguuggcggacgaugggcuaguggcccuggacugggugguaggaccuuguguucggggccgccggaucaccagcgccgggggccuuccugcggugcuucuggugauccccaaugcguggggucgccucacccgcaacgugcucggccuuugcuugcucgcccuggagcgcggcuacuacccggucaucuuccaucgccgcggccaccacgguugcccacuggucagcccccggcugcagccuuucggggacccguccgaccucaaggaggcggucacauacauccgcuuccgacacccggcggcgccgcuguucgcggugagcgaaggcucgggcucggcgcugcuccuguccuaccugggcgagugcggcuccuccagcuacgugacaggcgccgccugcaucucgcccgugcugcgcugccgagagugguucgaggccggccugcccuggcccuacgagcggggcuuucugcuccaccagaagaucgcccucagcagguggguaacggaggccgcagaccagcauggaaagaauagagggccugagcuggcuaagaaucagaaacagcuaugcauagcauuggaacaggcgugggccaguuugggcaaaguucucugaacacaucuuccaaagccuuccaaacccuguaaucuagacagaaccggggaagcggguuuaaaggucaucgauggacucagcuaguaucgcugugcuagagcagggacuccuaacccggccccuugccucaucucggcacccccugcuguauccuagcaaucugagcaccuggcccacgacagcagagauaccugacauuuaccacuuagcccacagcuuaacagcucagcaaagagcacucuggaagcaauugcaaacgauuaucugcccagaauguuuacucacagucucugagccuggaggugacaggaaucagaaauaugguggcauuugaggccaggugcaguggcucccgccuguaaucccagcacuuugggaggccaaggcaggaggaucacuugagcccaagaguuugagacuaacuugggcaacauaggaaaaccugucucuacaaaaauuucuuuuuuuaauuagccgggugugguggcaugcaucuguggucccagcuacucaggagguugagaugggaggaucaccgaagcccagaaguucgaggcugcagagagcccuggucaggccacugcacucuagccugggugacagagcaacacccugucucaaaaaaaaauguuauauauauauauacacacacacgcauauauguaggcauuuauuaaaauuauuauuuuuuaaaaguauuuuuuuuuuuagacagucucacuuugucacccaggcugaaguguagugacaugaucucggcucacuguaaccuccaccuccugggugcaagcuauucuccugccuuagccucugaaguggcuggggacuacaggcgugcaccaccacacccagcuaauuuuuaauauuuuuuuugguagagacgggguuucuccauguuugccaggcuggucuggaaccccuaaugucaagugauccgccugccccagcuuucaaagugcuaggauuacaggugugagccaccgugcccagcuguuuguuuguuuuuugaggcaagaucuuacucugucgcccaggcuggagugcagugguggaaucaccacucauugcagccuugaguuccugggcucaggugacauuccuagccugcacucuggcuuucuuaggagauggcagaaugaggucgaagucauuauggcaacagugugguguagcagaaagaccugggauguggg

SEQ ID NO: 19916 - RNA, 2722 nt, Homo sapiens
cccacaucccaggucuuucugcuacaccacacuguugccauaaugacuucgaccucauucugccaucuccuaagaaagccagagugcaggcuaggaaugucaccugagcccaggaacucaaggcugcaaugaguggugauuccaccacugcacuccagccugggcgacagaguaagaucuugccucaaaaaacaaacaaacagcugggcacgguggcucacaccuguaauccuagcacuuugaaagcuggggcaggcggaucacuugacauuagggguuccagaccagccuggcaaacauggagaaaccccgucucuaccaaaaaaaauauuaaaaauuagcugggugugguggugcacgccuguaguccccagccacuucagaggcuaaggcaggagaauagcuugcacccaggagguggagguuacagugagccgagaucaugucacuacacuucagccugggugacaaagugagacugucuaaaaaaaaaaauacuuuuaaaaaauaauaauuuuaauaaaugccuacauauaugcguguguguguauauauauauauaacauuuuuuuuugagacaggguguugcucugucacccaggcuagagugcaguggccugaccagggcucucugcagccucgaacuucugggcuucggugauccucccaucucaaccuccugaguagcugggaccacagaugcaugccaccacacccggcuaauuaaaaaaagaaauuuuuguagagacagguuuuccuauguugcccaaguuagucucaaacucuugggcucaagugauccuccugccuuggccucccaaagugcugggauuacaggcgggagccacugcaccuggccucaaaugccaccauauuucugauuccugucaccuccaggcucagagacugugaguaaacauucugggcagauaaucguuugcaauugcuuccagagugcucuuugcugagcuguuaagcugugggcuaagugguaaaugucagguaucucugcugucgugggccaggugcucagauugcuaggauacagcagggggugccgagaugaggcaaggggccggguuaggagucccugcucuagcacagcgauacuagcugaguccaucgaugaccuuuaaacccgcuuccccgguucugucuagauuacaggguuuggaaggcuuuggaagauguguucagagaacuuugcccaaacuggcccacgccuguuccaaugcuaugcauagcuguuucugauucuuagccagcucaggcccucuauucuuuccaugcuggucugcggccuccguuacccaccugcugagggcgaucuucugguggagcagaaagccccgcucguagggccagggcaggccggccucgaaccacucucggcagcgcagcacgggcgagaugcaggcggcgccugucacguagcuggaggagccgcacucgcccagguaggacaggagcagcgccgagcccgagccuucgcucaccgcgaacagcggcgccgccgggugucggaagcggauguaugugaccgccuccuugaggucggacggguccccgaaaggcugcagccgggggcugaccagugggcaaccgugguggccgcggcgauggaagaugaccggguaguagccgcgcuccagggcgagcaagcaaaggccgagcacguugcgggugaggcgaccccacgcauuggggaucaccagaagcaccgcaggaaggcccccggcgcuggugauccggcggccccgaacacaagguccuaccacccaguccagggccacuagcccaucguccgccaacugcagguacucccgggccagcucaggcccaggcgcuacgggcaggacgaaguggcagagggucugcagguggggcccggagaaccaggagcgcgggccggccuccagcgccucugagcgccgcagggcgcgcagcaggcacugggccagggccgacggcuugcaaacaaggcugcacccucccggcaguggcucgcgcccgucgcugaacugguccgccgggccuccgccguccgccuccuccccgucgucucggucuugggcccccggcaggguccucucuccgacggcgcgcccccaggguccccggagccgcgggccgagcaggccgagaagggcgagcacggccaagaugagcgcgagggcggcgccccacggcggcauggcgaagcuggagagccccggcgggcagcgggcggcggggccgucuacucggcgagcuccgcgcuuugcccgcggcuccgcccgccggcggcggcugcccagggcccucccgcgcgggcgcgcucuggauuggccguggccgggcagaggcagccaguucgggcccggcugcccucgcccgccccccacccccgccccggcccuuuguacagcaauugcaacaagugggagcagagggugagaggagccggggccaccagggagggagggcgcgccggcagccggaagggaguggggagggcacgagccggggagagcgguguuggccauggagacguggggagacuggaggccgaggcuuggggacccgacugucaucagggucuuccgccagacccugggcgcugcgcccucagaggccgaugaaaagaagcagaagggagaggugaguaagucgcagcuccgggcgccggcucccgggaccccguggggcggcggccgcgcgcgcgcucugcccucgggcggcc

SEQ ID NO: 19917 - RNA, 2585 nt, Homo sapiens
ccccuccccucccuuccccuccggagcggcuggggcugcggcgccgcugcugacacggaucggccgcggccgccaccgggcggaggcugcgcggcgcagacccagacgggcggccccggagggcgcgcggcgauggcggcggcgggcaggcggcgggcgcggcgggcgagggguccgggcugagcugcgggccggcccggauggcgggcggcgcgggcuggucgggcgcccccgcggcucugcugcgcuccgugcgccgccugcgcgagguguucgaggugugcggccgcgaccccgacggcuuccugcgcguggagcgcgucgcggcgcucggacugcgcuucggccagggcgaggagguaagcuggcccgaccccagucccggcccggggaccccagcccagccccgccgccccucccccagcucccccgccgggucacccgcguggcccgaggcgguggccucccucccaauccccucccuccgccggagcccaggaccucggccccccccggguaucccuggcccagccgggcccucgcuuuccgccccccggcgcccgugccccgagcgucacgcgucacgccuaggguggcuucugcgcccaccuuccuuccucggccaugcagguccuucugagcggucugcacauccacccuugucugggggagagagcugccagaauccggcccuaggcuccccaccccacccggcgcugcggagaccaagaugcaagggucuguguacguccugcugggccgggccagggggugaaagggaccgguaggggugcucugcagccuuggcuccucggcugcacacacccugcccagacacggaaggaggugucugcuggggccaccguguacucccgggccagugucgggugaccucucauucaggcucugcugggcagccaggcuggcagcuggcuguguugguugcagcaggccaggcaaagccaggcucggggagugguggcugagcagagggcuuucauguggcggggccgcaucuauuuggggaaagcaggacuuacguagauuguuaacagggcuggaagcggagggucggugccgccaguaggguggacggagucauaucacuaaacgcacacuacaccaguguccucuggugccaccggcauggggacuggggacugugucucaaggggaggacaagacacccaccuggcugaaauggucagggguuuccccuggagccaaaagcccugagaaguggguuuccaaggccaucuaaggccucaggcccugcauggggggccuggggccaugggccucaaaugggcacuggcuggcauuguguucccagaacaggucggaccaggcauuucagaacaugggagaagcugggugauggccagguugggcccgugccucugcgucaccagagagugggaggcgauugagaaucaucucuccacccgcaccugggcaugggccgggacuugugagucgcugagagcugugggcagaagagagugaggcagcuucagggcuugagaacucagguacccaccacaggaaagaccacugcagugccugugagagcccagacugcccucugcggggcuuugcugagggacacugccugcugccaccaugacccuucuuccccaaaggccagccaagcccuuccguuuuuccaguggcucccaucuggggcaggcugagcagacuccuggcauggggauagucgcgcuccuuccucucagaacacagacugcaggucggguaaagaagcuaccagcucuggcugaaaccuggaguccccgaacucagagccucaguagugggaagggccucccaacaaccucuggcaggggccaccggccucagccacgugcccagcaagccucacccacuucucccccagcuggacaguuccugccauuagaaccuucucccucauacacucuagagacagaccugcuugucacuuagucaucaccguucugcacggggacucacauaggucucucuucuuugggggagccuuuaaauauuugaaaauagcacuccugccccuucucuccuucccagcuccauacucccauuuucccuucuccaggccaaauaccccaguuccugaagcccuaggccauuuccaugugacccaguagccagaccucuggcuucuggccuuggagcugccaucgacuaauucugugauucaguuuuccuagcaauaacaugaaagggcuggacaagcagaccgccccccgccgcccccaccaggacuauauuagccccaagaccucacacauaugcacacagcuuaggguggggcugccucugaauggggcacugcacucugcuuauauuaaguuucuggccaccgaaaccuccagggaucuguuuuagaaaccucugccaagccagggauucuccacccuucggggagggucagugauuuuuuucuuuuaaaagcauacucugagauuacuacagaagcgguggauaugcauugcagaaaacuggaaauagggacaagcaaaauaaaaaguauuguguccuaucucucaggcagcgccucaaugacacuucugucagaccuuuccaga

SEQ ID NO: 19918 - RNA, 2585 nt, Homo sapiens
ucuggaaaggucugacagaagugucauugaggcgcugccugagagauaggacacaauacuuuuuauuuugcuugucccuauuuccaguuuucugcaaugcauauccaccgcuucuguaguaaucucagaguaugcuuuuaaaagaaaaaaaucacugacccuccccgaaggguggagaaucccuggcuuggcagagguuucuaaaacagaucccuggagguuucgguggccagaaacuuaauauaagcagagugcagugccccauucagaggcagccccacccuaagcugugugcauaugugugaggucuuggggcuaauauaguccuggugggggcggcggggggcggucugcuuguccagcccuuucauguuauugcuaggaaaacugaaucacagaauuagucgauggcagcuccaaggccagaagccagaggucuggcuacugggucacauggaaauggccuagggcuucaggaacugggguauuuggccuggagaagggaaaaugggaguauggagcugggaaggagagaaggggcaggagugcuauuuucaaauauuuaaaggcucccccaaagaagagagaccuaugugaguccccgugcagaacggugaugacuaagugacaagcaggucugucucuagaguguaugagggagaagguucuaauggcaggaacuguccagcugggggagaagugggugaggcuugcugggcacguggcugaggccgguggccccugccagagguuguugggaggcccuucccacuacugaggcucugaguucggggacuccagguuucagccagagcugguagcuucuuuacccgaccugcagucuguguucugagaggaaggagcgcgacuauccccaugccaggagucugcucagccugccccagaugggagccacuggaaaaacggaagggcuuggcuggccuuuggggaagaagggucaugguggcagcaggcagugucccucagcaaagccccgcagagggcagucugggcucucacaggcacugcaguggucuuuccugugguggguaccugaguucucaagcccugaagcugccucacucucuucugcccacagcucucagcgacucacaagucccggcccaugcccaggugcggguggagagaugauucucaaucgccucccacucucuggugacgcagaggcacgggcccaaccuggccaucacccagcuucucccauguucugaaaugccugguccgaccuguucugggaacacaaugccagccagugcccauuugaggcccauggccccaggccccccaugcagggccugaggccuuagauggccuuggaaacccacuucucagggcuuuuggcuccaggggaaaccccugaccauuucagccaggugggugucuuguccuccccuugagacacaguccccaguccccaugccgguggcaccagaggacacugguguagugugcguuuagugauaugacuccguccacccuacuggcggcaccgacccuccgcuuccagcccuguuaacaaucuacguaaguccugcuuuccccaaauagaugcggccccgccacaugaaagcccucugcucagccaccacuccccgagccuggcuuugccuggccugcugcaaccaacacagccagcugccagccuggcugcccagcagagccugaaugagaggucacccgacacuggcccgggaguacacgguggccccagcagacaccuccuuccgugucugggcagggugugugcagccgaggagccaaggcugcagagcaccccuaccggucccuuucacccccuggcccggcccagcaggacguacacagacccuugcaucuuggucuccgcagcgccgggugggguggggagccuagggccggauucuggcagcucucucccccagacaaggguggaugugcagaccgcucagaaggaccugcauggccgaggaaggaaggugggcgcagaagccacccuaggcgugacgcgugacgcucggggcacgggcgccggggggcggaaagcgagggcccggcugggccagggauacccggggggggccgagguccugggcuccggcggagggaggggauugggagggaggccaccgccucgggccacgcgggugacccggcgggggagcugggggaggggcggcggggcugggcugggguccccgggccgggacuggggucgggccagcuuaccuccucgcccuggccgaagcgcaguccgagcgccgcgacgcgcuccacgcgcaggaagccgucggggucgcggccgcacaccucgaacaccucgcgcaggcggcgcacggagcgcagcagagccgcgggggcgcccgaccagcccgcgccgcccgccauccgggccggcccgcagcucagcccggaccccucgcccgccgcgcccgccgccugcccgccgccgccaucgccgcgcgcccuccggggccgcccgucugggucugcgccgcgcagccuccgcccgguggcggccgcggccgauccgugucagcagcggcgccgcagccccagccgcuccggaggggaagggaggggagggg

SEQ ID NO: 19919 - RNA, 4419 nt, Homo sapiens
gcuaccaagugacaggccacgauuugaucucaggccaguguguuaaacuccaauuugcgugcuccugucccuccccgcgcgucggcggagcucggggccggacuggaccugccgagggaggggcggacaguccugacggugcggggcggggcuggcggcugcccaggccuggcugaggcgccgcggccgggucccucuccaccugccgggcggagcgcacgggccaugggcugagccccgcugagcccgccgggccggccaugggcgaucgcgagcgcaacaagaagcggcugcuggagcugcugcgggcgccggacacaggcaacgcgcacugcgccgacugcggggcggcagguaagggcgcggcggcgcgggcagcgcgagacccccggccggaccccaggcccacccgacuccuccccucggccccaccgggucccgcccucggcccccuggacccagacguggcaccugcgggccccgaccccucccacccacaccgugaaccucucacccgagccccgagggccgucuccaccacacccugccccggccccuacgagcccaggcucugcuccccucgcgggaccagaugcgcaucuucccacgugcuuggacccggacacgagagccggcagccuagagcccuuccagucccgcucucuucccuggccaggcacccgaccgcccgaguccgggcucucgaugucugcgcacccaggcgcgccccacgcccucggacucagacaucccagccagggcuaaacgucgggcccaggccgccgacaguccugugcccccugcccgcucccagacgccccccgaaggccuccccagcgccccaccucggggacgccgagggcccccuaacucagccuccccaccugcagcuccgcgccgagccccgcggugcgccccccgcgcccuccucucgguuccuucugagucccuucacuuccacgucgcgcagccucagacucucuccccgggcccugaacugccuccaggaucuucaccccggucgccgcgcagcggccggugggcuaaccagaaggugccaggcuggccgcuuaguucgccuuaggugggagaaggggcgccccaccugccccagugccccgagcccagcccugguuucuucaccgcgcuuuccgcucagcuccucuccugccucauccccugcagaucccgacugggccucuuacaagcuggggaucuucaucugucucaacugcugcggcguccaccguaacuucccugacaucagcagaguuaaaucugugcgacuugacuucugggacgacaguauuguggagguagaaaggcaugcccguggagagccauggaacugcgggacuggaguagaggcagcgggcagggggcucccauucuacagagggggaaacugagaaccagagaggggcaagucuagcuagaggaaacacagcuuauaagauggcagcuuagacagaggccgagaguucaaauucuggcucuaucauuugcuuacuuuuuuuuuuuuuuuuuugagacggagucucgcuguguuguccaggcuggagugcaguggagcaaucuuggcucacugcaaccgcugccucccggguucaaguaauucuccugccucagcuucucaagcagcugggauuacaggcgccugccaccacacccggcuaauuuuuuuguacuuaguagagacgggguuucaccauguuggucacgcuggucucgaacuccugaccucaggcgauccaccaccucagccucccaaagugcugggauuacaggccugaaccauccugaaccgcuccuggccaucauuugcuuaccuauaagcugggaggcccugagcuagguacuuugaccuagcuguggacccucaguuuccacaucuguauucaagggauaccaccaccauuucucuuuuuuucuuucuuccuuuuuuuuuuuuuuuuuuuuuuuugagacggaguuucacucuugucgcccaggcuggagugcaacggccaaucucggcucacugcaaccucugccucuuggguucaagcaauucuccugccucagccuccugaguagcugggauuacaggcacccaccaccaugccccgcuaauuuuuguauuaauuuuuagcagagacgggguuuugccauguuggucagucuggucucgaacuccugaccuuggguaauccacccuccucggccucccaaagugcugggauuacaggcgugggccacugugccuggccacuaccaccaaugucacagcacuguugugaagaugauuguaggcucaguccagacacaaagaaagcugucaguuaacaguugcuguuguacgggugugguggcucacaccuauaaucccagcacuuuggggggcugaggcugguggauugcuugagcccagaaguucaagagcagccugggcaacauggugaaaccccgucuuuacaaaaaauacaaaaauuagcugggugugauggcaugcgccugucgucccagauacuucgggggcuggggugggaagaucaccugagccugugagaguguggcugcaaugagcugagaucgcaccacugcacuccagccagggugagagugagacccuaccucaaaaaaaaaaaaaaaguugcuguuaucauuagugaagucuuggacugggggaagggaaauaaccugauuuguggucuaaaguccuccuuucccccuaggcagaaagaggaccacuuugcucuccugcccucuggggguggaggauacccucagccugcaugguaauuccauuuuggucagaaaaccuccagagagcaggcaguucugcacugugcggguuggcugaggguuuccaggacuauuggggaagcaggcugacauuuacugaaugccuacucugugccagguacugugcuagacagcaccggacuggaggcuuuagugugaccuuacuaagugcugggucuugggagagaacaaugaacaagauaaggucccuggccauacagagcuuacauucuagugugggagaaaggcuggaaaccaguaaaccagcacauaaaccugaaggauuuuauuugcaccuuauaacucccauguuauauuuucuuuuuuguuuuuuuuguuuuuuuuuuuuuugagacggaguuucacucuuguugcccaggcuggagugcaaugaugcgaucuuggcucacugcaaccucugccucugggguucaagcgauucuugugccucagccuucugaguaacuaggauuacaggcaugcaccaccaugcucggcuaauuuuguauuuuuaguagaauuuuuacuagagacaggguuucacccuguuggucaggcuggucucaaacuccugaccuuaggugauccacccgccucggccucccaaagugcugggauuacaggcgugagccaccgugcccagcauuuuuuuuuuuuuuuuuuuugagaugcagucucacucugucacccagccuggagugcagugaguggcacgaucucggcucacugcaaccuccaccuccuggauucaagcgauucuccugccucagucuccugaguagcugggauuacaggcgcccgccaccaugcccggcuaauuuuuuguauuuuuaguagagaugggguuucgccauguuggccaggcuggucuugaacaccugaccugaggugauccaccugccuuagccucccaaagugcugggauuacaggugugagcuacagcgcccaauccucuguuauauuuccuucuucuucuuccuccuccuccucuucuucuucuuccuucuuccuucuucuucuucuucuucucuuuucuuuucuuuucuuuucuuucuuucuuuuuuuuuuuugagacggagucucacucacucuguugcccagguuggaguguaguggugugaucuuggcucacugcaaccuccuccuccuggguucaagcaauucuugugccucagccuccugaguagcuaggauuacaggcgugcaccaccauaccuggcuaauuuauuuauuuauuugagagagagucuugcucuauugccuaggcuugagggcaguggcaaaaucucggcucacugcaaccucugccucccggguucaagcaauuauccugccucaccuuucuguguccuggcuaauuuuuguauuuuuuuaguagagacaagguuucaccauguuggucaggcuggucucaaacugcugaccucaagugauccccagccuuggccucccacagugcugggauuacaggugugagccacugugccuggccauuuucuucauuuuuacgggugagauuccaagggucacucaucaaauaaauggcagucaggaucugaauccugcucuguugggauccaaagcuggcgacacagccuagcggccccugcagaggagaagaggagcaaugcucc

SEQ ID NO: 19920 - RNA, 4419 nt, Homo sapiens
ggagcauugcuccucuucuccucugcaggggccgcuaggcugugucgccagcuuuggaucccaacagagcaggauucagauccugacugccauuuauuugaugagugacccuuggaaucucacccguaaaaaugaagaaaauggccaggcacaguggcucacaccuguaaucccagcacugugggaggccaaggcuggggaucacuugaggucagcaguuugagaccagccugaccaacauggugaaaccuugucucuacuaaaaaaauacaaaaauuagccaggacacagaaaggugaggcaggauaauugcuugaacccgggaggcagagguugcagugagccgagauuuugccacugcccucaagccuaggcaauagagcaagacucucucucaaauaaauaaauaaauuagccagguaugguggugcacgccuguaauccuagcuacucaggaggcugaggcacaagaauugcuugaacccaggaggaggagguugcagugagccaagaucacaccacuacacuccaaccugggcaacagagugagugagacuccgucucaaaaaaaaaaaagaaagaaagaaaagaaaagaaaagaaaagagaagaagaagaagaagaaggaagaaggaagaagaagaagaggaggaggaggaagaagaagaaggaaauauaacagaggauugggcgcuguagcucacaccuguaaucccagcacuuugggaggcuaaggcagguggaucaccucaggucagguguucaagaccagccuggccaacauggcgaaaccccaucucuacuaaaaauacaaaaaauuagccgggcaugguggcgggcgccuguaaucccagcuacucaggagacugaggcaggagaaucgcuugaauccaggagguggagguugcagugagccgagaucgugccacucacugcacuccaggcugggugacagagugagacugcaucucaaaaaaaaaaaaaaaaaaaaugcugggcacgguggcucacgccuguaaucccagcacuuugggaggccgaggcggguggaucaccuaaggucaggaguuugagaccagccugaccaacagggugaaacccugucucuaguaaaaauucuacuaaaaauacaaaauuagccgagcaugguggugcaugccuguaauccuaguuacucagaaggcugaggcacaagaaucgcuugaaccccagaggcagagguugcagugagccaagaucgcaucauugcacuccagccugggcaacaagagugaaacuccgucucaaaaaaaaaaaaaacaaaaaaaacaaaaaagaaaauauaacaugggaguuauaaggugcaaauaaaauccuucagguuuaugugcugguuuacugguuuccagccuuucucccacacuagaauguaagcucuguauggccagggaccuuaucuuguucauuguucucucccaagacccagcacuuaguaaggucacacuaaagccuccaguccggugcugucuagcacaguaccuggcacagaguaggcauucaguaaaugucagccugcuuccccaauaguccuggaaacccucagccaacccgcacagugcagaacugccugcucucuggagguuuucugaccaaaauggaauuaccaugcaggcugaggguauccuccacccccagagggcaggagagcaaagugguccucuuucugccuagggggaaaggaggacuuuagaccacaaaucagguuauuucccuucccccaguccaagacuucacuaaugauaacagcaacuuuuuuuuuuuuuuugagguagggucucacucucacccuggcuggagugcaguggugcgaucucagcucauugcagccacacucucacaggcucaggugaucuucccaccccagcccccgaaguaucugggacgacaggcgcaugccaucacacccagcuaauuuuuguauuuuuuguaaagacgggguuucaccauguugcccaggcugcucuugaacuucugggcucaagcaauccaccagccucagccccccaaagugcugggauuauaggugugagccaccacacccguacaacagcaacuguuaacugacagcuuucuuugugucuggacugagccuacaaucaucuucacaacagugcugugacauuggugguaguggccaggcacaguggcccacgccuguaaucccagcacuuugggaggccgaggaggguggauuacccaaggucaggaguucgagaccagacugaccaacauggcaaaaccccgucucugcuaaaaauuaauacaaaaauuagcggggcaugguggugggugccuguaaucccagcuacucaggaggcugaggcaggagaauugcuugaacccaagaggcagagguugcagugagccgagauuggccguugcacuccagccugggcgacaagagugaaacuccgucucaaaaaaaaaaaaaaaaaaaaaaaaggaagaaagaaaaaaagagaaaugguggugguaucccuugaauacagauguggaaacugaggguccacagcuaggucaaaguaccuagcucagggccucccagcuuauagguaagcaaaugauggccaggagcgguucaggaugguucaggccuguaaucccagcacuuugggaggcugaggugguggaucgccugaggucaggaguucgagaccagcgugaccaacauggugaaaccccgucucuacuaaguacaaaaaaauuagccgggugugguggcaggcgccuguaaucccagcugcuugagaagcugaggcaggagaauuacuugaacccgggaggcagcgguugcagugagccaagauugcuccacugcacuccagccuggacaacacagcgagacuccgucucaaaaaaaaaaaaaaaaaaguaagcaaaugauagagccagaauuugaacucucggccucugucuaagcugccaucuuauaagcuguguuuccucuagcuagacuugccccucucugguucucaguuucccccucuguagaaugggagcccccugcccgcugccucuacuccagucccgcaguuccauggcucuccacgggcaugccuuucuaccuccacaauacugucgucccagaagucaagucgcacagauuuaacucugcugaugucagggaaguuacgguggacgccgcagcaguugagacagaugaagauccccagcuuguaagaggcccagucgggaucugcaggggaugaggcaggagaggagcugagcggaaagcgcggugaagaaaccagggcugggcucggggcacuggggcagguggggcgccccuucucccaccuaaggcgaacuaagcggccagccuggcaccuucugguuagcccaccggccgcugcgcggcgaccggggugaagauccuggaggcaguucagggcccggggagagagucugaggcugcgcgacguggaagugaagggacucagaaggaaccgagaggagggcgcggggggcgcaccgcggggcucggcgcggagcugcagguggggaggcugaguuagggggcccucggcguccccgagguggggcgcuggggaggccuucggggggcgucugggagcgggcagggggcacaggacugucggcggccugggcccgacguuuagcccuggcugggaugucugaguccgagggcguggggcgcgccugggugcgcagacaucgagagcccggacucgggcggucgggugccuggccagggaagagagcgggacuggaagggcucuaggcugccggcucucguguccggguccaagcacgugggaagaugcgcaucuggucccgcgaggggagcagagccugggcucguaggggccggggcagggugugguggagacggcccucggggcucgggugagagguucacggugugggugggaggggucggggcccgcaggugccacgucuggguccagggggccgagggcgggacccgguggggccgaggggaggagucgggugggccugggguccggccgggggucucgcgcugcccgcgccgccgcgcccuuaccugccgccccgcagucggcgcagugcgcguugccuguguccggcgcccgcagcagcuccagcagccgcuucuuguugcgcucgcgaucgcccauggccggcccggcgggcucagcggggcucagcccauggcccgugcgcuccgcccggcagguggagagggacccggccgcggcgccucagccaggccugggcagccgccagccccgccccgcaccgucaggacuguccgccccucccucggcagguccaguccggccccgagcuccgccgacgcgcggggagggacaggagcacgcaaauuggaguuuaacacacuggccugagaucaaaucguggccugucacuugguagc

SEQ ID NO: 19921 - RNA, 2605 nt, Homo sapiens
cuuccuaaguggucaguuucucuuccgcccugcgggcucuccuggcccaccaccugcgucggccgggacgcauccagggucucuacucuucgcuuccuccugcguccccuucuuccacgagcaccccagcuuccucuggcucucaccugaaccccgaagcguagugucuucucucuggacuaaagcggaacugagaaccgguggaaaagccccgcgccuaggcugcaaggcacuggcuuaacaaguccaaagguuaggugaaguuuggcugauaagcagaaccaguaaaagaaggucucuagccccccagcgugaguacaauggacccuggcaaagccccgcucccggcccaggucuucugcucuccaggucugccccuccggcucucccucucuccggguuucccccuccccaccaucauuugcauccagccgaaagcugggcccuucccacuaauuugcauaucuuauauggccuaaugguggcgaucauggcaaguuagaaguuuucugacuccuuucggaggagccuccgggaccccggggaguaacaggugucuggaggcugaaggguggagggguuccuggauuugggguuugcuugugaaacuccccuccacccuccucucucgcacccacccacccccucacccccuucuuuuuccguccuuggaaaaugguguccaagcucacgucgcuccagcaagaacuccugagcgcccugcugagcuccggggucaccaaggaggugcugguucaggccuuggaggaguugcugccauccccgaacuucggggugaagcuggagacgcugccccuguccccuggcagcggggccgagcccgacaccaagccggucuuccauacucucaccaacggccacgccaagggccgcuuguccggcgacgagggcuccgaggacggcgacgacuaugacacaccucccauccucaaggagcugcaggcgcucaacaccgaggaggcggcggagcagcgggcggagguggaccggaugcucagguaggcgcagagcgagguggaggggacccacccgaaccccuggagccccggccccgggccugagugacacugcgcccgaccacacucgccaagcccguuucccaccagagaagucccccggggggcgcucugcuucucucccaacacccggacccuucccaaucccuuagcgggacgacccugcggcccaccgggcuucuucuccccaggcccaggccagcguccgagacccaagggcuuuuccccgcggggcuggggcugggccggggagaacuggagcuguggagcccuuugccgggagguuugcccacgcgacugaaggugcgagugggugcagugaaaccgcugcgacuucccgggagcagagccucgcgccgcugcaagccccaggccgcgcauuuuuccugcgcgcugccucgggucuggaaagccgcaugucggccucggacacauugaccugcaugaugaccugcaguucuuugccgaaggacaggcggcauccggagccgggaucugggaggcgaguucccuggugggcacucuuguuagccgcgcccaugcaaggcccggaauuauccgggauccccaacgcggguuuagauuugcaaagggcauguuccaugcaggguccggguggacacgcgcggggccaaagaaacgaagcgcgguggugugggggcgaacgcgucucagaccucaguucgcagaggaucuggucucagucugagaaaggagggcguuuccagaccucgcugcccacccccggccucuccccgggaguucaggccggcuggcaguguauccccagggccgggaucguuuguggguccuccccgaccgcccuagacuuugacagcugguuacuaauuaucuaaggagccgagcgguucccugagacagcacgucgcucccgggccacuccgcuuuaggacagagcccaucgcguggcuucggacacugaagcgccgcgauuucggggcugagccuuggccgcacguccgcagcggcgguuuggggugggauaugaccuugcauuugaauuugugcuccgagggccuggcgguuugcccucuagccaaaacaaucaggggaacuuguagauuuuuuuuccccaaacacacuuugguauaauucauagguuugagguucuucccucgucgcucucccgcccggaggugauuucuccccuaccgggagagaacuccugcaagagaguuccgcgaggcggaaggugugagucgcggaggcuaagaggggucgagagaguggccccuaggagcggcuggggcgccagggcugccggggaggucgcucaggaccuggcggaugaaccaggcucccaccgccggccaccgggggccacagggccuaggcccucccacccggccgcaggcgcccgcuuucuagcgcggcgcuggaaggaccuggggcgccccuccgcacccagccccgcgccgggcuggccgcagcugagacguaacauaaacugcagcacguggaguugggguguuauuaauuuauuucuauaaaucaucaacagaaagauacacaaagagccgugauuagguugaaaagagaggcggguu

SEQ ID NO: 19922 - RNA, 2605 nt, Homo sapiens
aacccgccucucuuuucaaccuaaucacggcucuuuguguaucuuucuguugaugauuuauagaaauaaauuaauaacaccccaacuccacgugcugcaguuuauguuacgucucagcugcggccagcccggcgcggggcugggugcggaggggcgccccagguccuuccagcgccgcgcuagaaagcgggcgccugcggccgggugggagggccuaggcccuguggcccccgguggccggcggugggagccugguucauccgccagguccugagcgaccuccccggcagcccuggcgccccagccgcuccuaggggccacucucucgaccccucuuagccuccgcgacucacaccuuccgccucgcggaacucucuugcaggaguucucucccgguaggggagaaaucaccuccgggcgggagagcgacgagggaagaaccucaaaccuaugaauuauaccaaaguguguuuggggaaaaaaaaucuacaaguuccccugauuguuuuggcuagagggcaaaccgccaggcccucggagcacaaauucaaaugcaaggucauaucccaccccaaaccgccgcugcggacgugcggccaaggcucagccccgaaaucgcggcgcuucaguguccgaagccacgcgaugggcucuguccuaaagcggaguggcccgggagcgacgugcugucucagggaaccgcucggcuccuuagauaauuaguaaccagcugucaaagucuagggcggucggggaggacccacaaacgaucccggcccuggggauacacugccagccggccugaacucccggggagaggccgggggugggcagcgaggucuggaaacgcccuccuuucucagacugagaccagauccucugcgaacugaggucugagacgcguucgcccccacaccaccgcgcuucguuucuuuggccccgcgcguguccacccggacccugcauggaacaugcccuuugcaaaucuaaacccgcguuggggaucccggauaauuccgggccuugcaugggcgcggcuaacaagagugcccaccagggaacucgccucccagaucccggcuccggaugccgccuguccuucggcaaagaacugcaggucaucaugcaggucaauguguccgaggccgacaugcggcuuuccagacccgaggcagcgcgcaggaaaaaugcgcggccuggggcuugcagcggcgcgaggcucugcucccgggaagucgcagcgguuucacugcacccacucgcaccuucagucgcgugggcaaaccucccggcaaagggcuccacagcuccaguucuccccggcccagccccagccccgcggggaaaagcccuugggucucggacgcuggccugggccuggggagaagaagcccggugggccgcagggucgucccgcuaagggauugggaaggguccggguguugggagagaagcagagcgccccccgggggacuucucuggugggaaacgggcuuggcgaguguggucgggcgcagugucacucaggcccggggccggggcuccagggguucggguggguccccuccaccucgcucugcgccuaccugagcauccgguccaccuccgcccgcugcuccgccgccuccucgguguugagcgccugcagcuccuugaggaugggaggugugucauagucgucgccguccucggagcccucgucgccggacaagcggcccuuggcguggccguuggugagaguauggaagaccggcuuggugucgggcucggccccgcugccaggggacaggggcagcgucuccagcuucaccccgaaguucggggauggcagcaacuccuccaaggccugaaccagcaccuccuuggugaccccggagcucagcagggcgcucaggaguucuugcuggagcgacgugagcuuggacaccauuuuccaaggacggaaaaagaagggggugagggggugggugggugcgagagaggaggguggaggggaguuucacaagcaaaccccaaauccaggaaccccuccacccuucagccuccagacaccuguuacuccccggggucccggaggcuccuccgaaaggagucagaaaacuucuaacuugccaugaucgccaccauuaggccauauaagauaugcaaauuagugggaagggcccagcuuucggcuggaugcaaaugaugguggggagggggaaacccggagagagggagagccggaggggcagaccuggagagcagaagaccugggccgggagcggggcuuugccaggguccauuguacucacgcuggggggcuagagaccuucuuuuacugguucugcuuaucagccaaacuucaccuaaccuuuggacuuguuaagccagugccuugcagccuaggcgcggggcuuuuccaccgguucucaguuccgcuuuaguccagagagaagacacuacgcuucgggguucaggugagagccagaggaagcuggggugcucguggaagaaggggacgcaggaggaagcgaagaguagagacccuggaugcgucccggccgacgcagguggugggccaggagagcccgcagggcggaagagaaacugaccacuuaggaag

SEQ ID NO: 19923 - RNA, 2506 nt, Homo sapiens
ggggucggaaaagguaguggccgggagggagccugggcucugccuggagggcaaacaaccccgaaggccuggagaaugcaguugcugcagagcuuggcuccgggaaagacagcaguccgggcuacaacgcccgaggcugcccugucucuuccaagcuugaaggggcuucugggccgagucaggcucagacccuuucuucccaggcacaugcagccaaacccagacccauaguuuccaggaugcaagcagggccgcgucccgggcucccagcgcgccagcuggcggagaggcgggcgcccgcgggacuuggcugcccucucuagaagcaguuccuaacugggcagcgaggccacgcuaaccucugauccgaagcuggccgggaagggcccgcggggagguagcagcagaggcgugggaggaaaguacucaccggaagaagucguucuugcaguagaguuugccuucccuggagaagcacuucucggucagguugcauuuacauucacagcacuggacgcacuugacgugccaggcccuguccagcacguucaagagaaagcgguccaggaugggccuuuugcagccggcacagugaaccauggucuuugguuuggucugaugaggcccagagagagagaggggcaaaguagagcccaggggaugacuccugaagacaaucggcacgagcuccccagucucuccaaaaagaggacacacacucggccgugcaagccaaaacucgcaccaggaaaucaaaguaggguggaggaaacgaggcugaucggggccugggggggcgucucagugaagugugcagccggggagucccggggccccgggcuggagcggcgccgccugagcucccggggcgaggaaaagaagucucaggcgggagagaaugcgacccuucugcucagagcccgcggaggagugaaggucagcgagaacggcggcgggaacggaaauaaauaaauaaaaacggagaagaagaagacgacgacucgccgagcucggguugcgaggaaagcgccgcugaguucuccggggcuugagguagagcugucagaagucaaagugcaucugcuuuugucgggguaugagggcgacugugugcgugccaggcugcccaccacugggauuuccccccucuuuuuuuaaaaaagggaaggaaagaacaaaaggagcagagaagcuuuggauccuaaacugccggcaucgcgccgcgggucuggacgcgccgagcgcccgcgcugggccugggggagggggcgagggccgaccgcgggagaagggaaagaggggaggguaggaggaagaucuugguguugauugcuguuguugcuuagguuuccccgcuuuuggagaaguguuugugucaaucgaaaacagagagggacaacuccgugcggaggcagccaggcgcacucgcuccuucccuaccgccccagcccagucaccucggcccuuggccugccuggcggccuccguguccucagggcgacccucccugcgcccgggcuccuucgggaggcacuacgggcuggcuucucaccgcgccuggccgugcaucguggcuccagucacaacucgcggccgccugggcgcacagccccgcaucgcucggcccacgcucugucugccuccgucuaaccccacagucgcucgacuuucucuccuuuuccuuuuccccuucuuuuuuucguugugguggcaaaucuggguuuccuuucuagccuccuuccuuuuuuuuuuuuguuuuucuuuugcagcgggaggagucggggaggaggggggcagcuuggagagcuuuaaaaaaaaauguccuggcgcagcggcuacaguaggccggcggcuggaacggcucggcgcggaccgccgcugucgcgcccgggccgcggcuuguugcuggcccuccccgggcgcgucccucagucccuggucuccuggcccagucgccgccccggugcgucucuccccagcuccggcggcuuggucacugcuccuggcuguuggcugagcucuggaagcccccucgccuuaaugcagcgcccgccgacgucacugcggccugcgaccaaucagcgccucgcggucccucuguaaaccauucugcaucccccggcccgggagagugcggggagaccgcguuuagaggaucaguggcggcggcacccgcggccccgcgcggcgcggacggcgggcagcaccgugccugggcccccuccugcuccgguaaggcguggguuucgaugggagggacagagagagagcgggaauaggcgcaggcggaggccagaguucugcuguagaguggggguaguccaagaccgagccuuguggaagguuggggugcagccggguccggaaucccaggcggcuccccugcacugcugggcuuugcaauucagcggcuguugccauuguccccccguacuuucuugaccuggaaguuugucccaagcgcagcgcacaucuuuggagggggaggaggcucuuagcagcagaa

SEQ ID NO: 19924 - RNA, 2506 nt, Homo sapiens
uucugcugcuaagagccuccucccccuccaaagaugugcgcugcgcuugggacaaacuuccaggucaagaaaguacggggggacaauggcaacagccgcugaauugcaaagcccagcagugcaggggagccgccugggauuccggacccggcugcaccccaaccuuccacaaggcucggucuuggacuacccccacucuacagcagaacucuggccuccgccugcgccuauucccgcucucucucugucccucccaucgaaacccacgccuuaccggagcaggagggggcccaggcacggugcugcccgccguccgcgccgcgcggggccgcgggugccgccgccacugauccucuaaacgcggucuccccgcacucucccgggccgggggaugcagaaugguuuacagagggaccgcgaggcgcugauuggucgcaggccgcagugacgucggcgggcgcugcauuaaggcgagggggcuuccagagcucagccaacagccaggagcagugaccaagccgccggagcuggggagagacgcaccggggcggcgacugggccaggagaccagggacugagggacgcgcccggggagggccagcaacaagccgcggcccgggcgcgacagcggcgguccgcgccgagccguuccagccgccggccuacuguagccgcugcgccaggacauuuuuuuuuaaagcucuccaagcugccccccuccuccccgacuccucccgcugcaaaagaaaaacaaaaaaaaaaaaggaaggaggcuagaaaggaaacccagauuugccaccacaacgaaaaaaagaaggggaaaaggaaaaggagagaaagucgagcgacugugggguuagacggaggcagacagagcgugggccgagcgaugcggggcugugcgcccaggcggccgcgaguugugacuggagccacgaugcacggccaggcgcggugagaagccagcccguagugccucccgaaggagcccgggcgcagggagggucgcccugaggacacggaggccgccaggcaggccaagggccgaggugacugggcuggggcgguagggaaggagcgagugcgccuggcugccuccgcacggaguugucccucucuguuuucgauugacacaaacacuucuccaaaagcggggaaaccuaagcaacaacagcaaucaacaccaagaucuuccuccuacccuccccucuuucccuucucccgcggucggcccucgcccccucccccaggcccagcgcgggcgcucggcgcguccagacccgcggcgcgaugccggcaguuuaggauccaaagcuucucugcuccuuuuguucuuuccuucccuuuuuuaaaaaaagaggggggaaaucccaguggugggcagccuggcacgcacacagucgcccucauaccccgacaaaagcagaugcacuuugacuucugacagcucuaccucaagccccggagaacucagcggcgcuuuccucgcaacccgagcucggcgagucgucgucuucuucuucuccguuuuuauuuauuuauuuccguucccgccgccguucucgcugaccuucacuccuccgcgggcucugagcagaagggucgcauucucucccgccugagacuucuuuuccucgccccgggagcucaggcggcgccgcuccagcccggggccccgggacuccccggcugcacacuucacugagacgcccccccaggccccgaucagccucguuuccuccacccuacuuugauuuccuggugcgaguuuuggcuugcacggccgaguguguguccucuuuuuggagagacuggggagcucgugccgauugucuucaggagucauccccugggcucuacuuugccccucucucucucugggccucaucagaccaaaccaaagaccaugguucacugugccggcugcaaaaggcccauccuggaccgcuuucucuugaacgugcuggacagggccuggcacgucaagugcguccagugcugugaauguaaaugcaaccugaccgagaagugcuucuccagggaaggcaaacucuacugcaagaacgacuucuuccggugaguacuuuccucccacgccucugcugcuaccuccccgcgggcccuucccggccagcuucggaucagagguuagcguggccucgcugcccaguuaggaacugcuucuagagagggcagccaagucccgcgggcgcccgccucuccgccagcuggcgcgcugggagcccgggacgcggcccugcuugcauccuggaaacuaugggucuggguuuggcugcaugugccugggaagaaagggucugagccugacucggcccagaagccccuucaagcuuggaagagacagggcagccucgggcguuguagcccggacugcugucuuucccggagccaagcucugcagcaacugcauucuccaggccuucgggguuguuugcccuccaggcagagcccaggcucccucccggccacuaccuuuuccgacccc

SEQ ID NO: 19925 - RNA, 2492 nt, Homo sapiens
ucccgcucccgcccgcgccggccccagcagggcucggccauggcuccacucaccagcucccgccaccugggauccgcucccggaccucggccgcccgagccucccgacucgcccgcccaccggccucgcuuuccagugccugcugucucuuuccggggcgcagggacccccaggcggcgccacgacccggagcugggucggaggccaggcuggggcucgggccagagcggccgggccucugggcgcgggagaaggagggcgcccccucuccgcucggggucgugucaaugcuuugcacuuggggccggcgugcggcugcggguccuuccccaaggccccgggacccgggcuccccucgccucaggcccuuucggcgggucaggucggcccuccgcgcucuccaguccggcgcaggcagccgcaggcgcgggcgggcggugggggccggggcaggaggaggggucucggggcccggcggcccgucauugguuaauauuuuauucuguugacauguuuucuuacugcugaggcuuccgacaccuucucccaggcccccccucccggccggagcuuggccugagcugucaaaaccccgcccccggagacccacaauugguccaaaaagcguaaaaucagcaaucaaggggggccuggcucguuagcgcaggggauccgagcugggcaggacaugugagauagucacaguuuuccagagaucacgacaagaucuaaccagucgcgcgugguccccggcgccggagcgggccagcucagcccggcccagcccggccccgcgcagagcccccgccgcccccgcgcacagagccgggugccccuugcggugcgccggacgggaagccccgaggagcagcugcugcgcccgccacccgggucguccguccaccgcgcgcgccgccgcccgggccggggguccgagccgcgcgcccccggccccggccccggcccccgggcgccugggccggaugucccgaugagagagccggcgcuggcggccagcgccauggcuuaccacccguuccacgcgccacggcccgccgacuuccccauguccgccuuucuggcggcggcgcagcccuccuucuucccggcacucgcgcugccgcccggcgcgcuggccaagccgcugcccgacccgggccuggcgggggcggcggccgcggcggcggcggcggcagcagcggccgaggcggggcugcacgucucggcacugggcccgcacccgcccgccgcgcaucugcgcucccucaagagccuggagcccgaggacgagguggaggacgaccccaaggugacgcuggaggccaaggagcugugggaccaguuccacaagcuaggcacggagauggucaucaccaaguccgggagguagggcugccggccggcuggaaggcgcgcgggcgggcgggcgggcuggggcacgggacugcacggaucagagcagagcuggggacucccggcucccggcucccggcuccagguucuggcccugacgccacgcuucgcucccacggacaaccaaguugacuuuucucguuuggcaccggagcgauuuuuuuuuaaaacaaaaacgcuaaaauccuccgaaugaaauaaaacgaaaacauacugcuaaagaauagccccaaccguucugagucccagcgcagaggaggccccgcggcuuggcccuggcggucuccuccgccccgcgcucucgcucuucugcguccggguccgucuccgagcucgggggaaauucagccucucucagacucugcuccgaccccgaagccccuagugggaccugggcccagcuaaccccacgcugguugcucgguuccuggcagcgagccccgggucagccgagcccuccgccucaccgggcugggagcccuuucuccaccgcgggcauccgagcccuggacgcauccgccgccccaggccuuaaagccugaagaaagccacagccccggccccuccacccuucgacucagccaccgagaauccaggccucggguucacccucuucccccgaacugcacggccaggaugucuuaucaggcucuguagcccaguucccaauacaaacacccuccagauuuauuucugggagcuuccgucccaaguggguauuuccccugaacgaauuucggggagauuaaggagaagcgagaauauuucuagagggccuagacuucucuccugggcaucagcuuucaucucagaucagggagaaagaggguccccagaucugagcacaaggccuaaaggaggcuguuuaggagagggucugacaggcagaaaugggaucuccugggagcaacaaccacagguggggucguccgggcagugaugagagggcagagcagccgaccacaggggaaacagccaggcggcagcggugugcgcaacgaggagggauaaauaaaggaggagugggguccuggaaccuagaacagccgguuccaaugggaucuccucccuucccuccc

SEQ ID NO: 19926 - RNA, 2492 nt, Homo sapiens
gggagggaagggaggagaucccauuggaaccggcuguucuagguuccaggaccccacuccuccuuuauuuaucccuccucguugcgcacaccgcugccgccuggcuguuuccccuguggucggcugcucugcccucucaucacugcccggacgaccccaccugugguuguugcucccaggagaucccauuucugccugucagacccucuccuaaacagccuccuuuaggccuugugcucagaucuggggacccucuuucucccugaucugagaugaaagcugaugcccaggagagaagucuaggcccucuagaaauauucucgcuucuccuuaaucuccccgaaauucguucaggggaaauacccacuugggacggaagcucccagaaauaaaucuggaggguguuuguauugggaacugggcuacagagccugauaagacauccuggccgugcaguucgggggaagagggugaacccgaggccuggauucucgguggcugagucgaaggguggaggggccggggcuguggcuuucuucaggcuuuaaggccuggggcggcggaugcguccagggcucggaugcccgcgguggagaaagggcucccagcccggugaggcggagggcucggcugacccggggcucgcugccaggaaccgagcaaccagcgugggguuagcugggcccaggucccacuaggggcuucggggucggagcagagucugagagaggcugaauuucccccgagcucggagacggacccggacgcagaagagcgagagcgcggggcggaggagaccgccagggccaagccgcggggccuccucugcgcugggacucagaacgguuggggcuauucuuuagcaguauguuuucguuuuauuucauucggaggauuuuagcguuuuuguuuuaaaaaaaaaucgcuccggugccaaacgagaaaagucaacuugguuguccgugggagcgaagcguggcgucagggccagaaccuggagccgggagccgggagccgggaguccccagcucugcucugauccgugcagucccgugccccagcccgcccgcccgcccgcgcgccuuccagccggccggcagcccuaccucccggacuuggugaugaccaucuccgugccuagcuuguggaacuggucccacagcuccuuggccuccagcgucaccuuggggucguccuccaccucguccucgggcuccaggcucuugagggagcgcagaugcgcggcgggcgggugcgggcccagugccgagacgugcagccccgccucggccgcugcugccgccgccgccgccgcggccgccgcccccgccaggcccgggucgggcagcggcuuggccagcgcgccgggcggcagcgcgagugccgggaagaaggagggcugcgccgccgccagaaaggcggacauggggaagucggcgggccguggcgcguggaacgggugguaagccauggcgcuggccgccagcgccggcucucucaucgggacauccggcccaggcgcccgggggccggggccggggccgggggcgcgcggcucggacccccggcccgggcggcggcgcgcgcgguggacggacgacccggguggcgggcgcagcagcugcuccucggggcuucccguccggcgcaccgcaaggggcacccggcucugugcgcgggggcggcgggggcucugcgcggggccgggcugggccgggcugagcuggcccgcuccggcgccggggaccacgcgcgacugguuagaucuugucgugaucucuggaaaacugugacuaucucacauguccugcccagcucggauccccugcgcuaacgagccaggccccccuugauugcugauuuuacgcuuuuuggaccaauugugggucuccgggggcgggguuuugacagcucaggccaagcuccggccgggagggggggccugggagaaggugucggaagccucagcaguaagaaaacaugucaacagaauaaaauauuaaccaaugacgggccgccgggccccgagaccccuccuccugccccggcccccaccgcccgcccgcgccugcggcugccugcgccggacuggagagcgcggagggccgaccugacccgccgaaagggccugaggcgaggggagcccgggucccggggccuuggggaaggacccgcagccgcacgccggccccaagugcaaagcauugacacgaccccgagcggagagggggcgcccuccuucucccgcgcccagaggcccggccgcucuggcccgagccccagccuggccuccgacccagcuccgggucguggcgccgccugggggucccugcgccccggaaagagacagcaggcacuggaaagcgaggccggugggcgggcgagucgggaggcucgggcggccgagguccgggagcggaucccagguggcgggagcuggugaguggagccauggccgagcccugcuggggccggcgcgggcgggagcggga

SEQ ID NO: 19927 - RNA, 2755 nt, Homo sapiens
gaccuuauuuggacacuuucuaaaguuugaauugguuuaauucugcaaacugcauuuguaaagguaagaauuaacugucaagauagagccagucugcugcuaagauaaauucccuuaauaaacauuuccauuuuauuuuaagcagggagcuuuaucuuuaaauacuguaaaaaauuacaucucagaagcccuugucuaugauaguucacaaagaccagauauacucuaaaauguuaauacuguuuaucucuggguggugguauuacacgccauuuuauauuuuacguuucucaaaaagcaucauuaccuugcuaauugacgguaauacuguaauugaacaguauuuuaaaauuaaauuuuagauagcuuauauuaugaaauaccaacacaguccacuucuauggaagauuuguuaaaugauuuuccccuauugauaaacugcugcuuuaacaggagaaugaucugaucaggugucuauuagcuuggaugaagacaaaacagguuuacuuuccaggcccuucuuuucuuuaggcuuuugagaaaaucccaaaagugaguuugaacuuaauuacagcgaaucuugcaguaguaaacuuuuuggguggccagaguaacaccuuucauuacaacuaucagcugaauggcaaaagacuucccagguuuaccaauguuuucagagacuuacuaguauucuccucugucauuauuucggaacaauuccauugagaaacgcaauuguaaaccguuucuauuucaggccuauaaaaaccagaacugggaugaaaggcaaagccuugaccuuucuauuuuagacuuucaucuguguagcuaagccaucugcuuucuccccaccccaucccaucuacuuaauggacugaaaauacugcaccuaauugcaauuuaaucaaaacagccugacuuuuccacuuuaaugaauuauggcucuuucacccgaaggcuugcuugcaaaauuuugcuuacccuucccucucaauuccuucccacuucccucaauuauggaaugucaaaugucuaaacuaagagacuaggcuucccugugugaaaacaucuaaaaagcccuucacuuucaacacugagcaccugacggaaaaucuacuccauucucucaucuggauacggggccgguauaaccaucauuguugcaguuacgcaggaggcaccucgcagcucagucuagaaaggagucgcgucucugccgccaaacaacaaggcacucagcccgggaaaagacagacuggggugggaggaaaccucccggagaaagaagggaucugggaagaagagggagcucaagccugggaggaaggaccuuuccaggcaggaaagggaaagguugcgugaaguggagcuagaagcugggggccgaggugaaaggggaugaggggcccgggcccggcgggagggcgccggggcucaggagagcggcuucaaggccggguaggaggcgugggggccgaggcgggcgugggggccgaggcgggcgugggcagcucucagccgaccgcccggguccgagcagcgggggcgcuuucagcggcggcaggcgcgggugcgggggagaggagcagaaaagagagcaguuugaggggccgagggagccgcguccgaggccggcgcgguggggaccgcgggcccaccaccagccaagcccagcuacuuaacuauuuguagagcugcugcaggcacagguccaggcuuucgcccuccaccuccucgcgggugaugcgcucugacagcggucgcgggagcgggggcaaaggcggcagcuggggcggcggcggcggcacggccgagugccccggggcugccgccgccgucgccgcgcccuccuccuccuccucacccucaaccgccgccuccuccucgggcuccgggucuugcuccuggucccccuccuccgucgcggcuaccguggccgccuccuccccggguuccucuaccgaagccucggccgccucagcuucuaccaguucagguucgggcucgggcucggacucggguucggguucggguucggguucggguuccggcuccggcucgccgccgccgcacgguccgcgaaacucgcccaggaauagcuccaggaagcgccgguaaguuuucuccucagggaugcagccggccaucgcugcucaugccccagggcagaccgggaaagggguugggggaagcccaggaaggguaaggggcugcuuuugagccuagggcuccggcaagggcgguuaacggccgcaccggcacgagcgaucagcacuagguugccuggagagggcucccgcaggcgugcgcgccgccgagcaccgacgugcgcggcccgggggcggagcgcgccgccccucucggaucuggagggaaaguugguggcgggcgcgcgcaggguccagcggcggcccacccuuuauuccuacggagagcucagcccacgcugccuagagacugucgccauggcaaccgguucuaauuaagcauugcagggucccucccgucgaguccgcggagucuaaaggacacuccacucgcccgcucuccaacucugaaugucuuuauugguuggauacccuacccucacgugguuaagagugagcuaagacaucuccaagucuagcuguugguucccacuuggguugcuuggaucccaauuggauguacuuccauuuccuuaucuguuccuugccuuagcguauguuuugaaagauaccacacugugaacaccuuuuguugcagucuuugaaua

SEQ ID NO: 19928 - RNA, 2755 nt, Homo sapiens
uauucaaagacugcaacaaaagguguucacagugugguaucuuucaaaacauacgcuaaggcaaggaacagauaaggaaauggaaguacauccaauugggauccaagcaacccaagugggaaccaacagcuagacuuggagaugucuuagcucacucuuaaccacgugaggguaggguauccaaccaauaaagacauucagaguuggagagcgggcgaguggaguguccuuuagacuccgcggacucgacgggagggacccugcaaugcuuaauuagaaccgguugccauggcgacagucucuaggcagcgugggcugagcucuccguaggaauaaagggugggccgccgcuggacccugcgcgcgcccgccaccaacuuucccuccagauccgagaggggcggcgcgcuccgcccccgggccgcgcacgucggugcucggcggcgcgcacgccugcgggagcccucuccaggcaaccuagugcugaucgcucgugccggugcggccguuaaccgcccuugccggagcccuaggcucaaaagcagccccuuacccuuccugggcuucccccaaccccuuucccggucugcccuggggcaugagcagcgauggccggcugcaucccugaggagaaaacuuaccggcgcuuccuggagcuauuccugggcgaguuucgcggaccgugcggcggcggcgagccggagccggaacccgaacccgaacccgaacccgaacccgaguccgagcccgagcccgaaccugaacugguagaagcugaggcggccgaggcuucgguagaggaacccggggaggaggcggccacgguagccgcgacggaggagggggaccaggagcaagacccggagcccgaggaggaggcggcgguugagggugaggaggaggaggagggcgcggcgacggcggcggcagccccggggcacucggccgugccgccgccgccgccccagcugccgccuuugcccccgcucccgcgaccgcugucagagcgcaucacccgcgaggagguggagggcgaaagccuggaccugugccugcagcagcucuacaaauaguuaaguagcugggcuuggcugguggugggcccgcgguccccaccgcgccggccucggacgcggcucccucggccccucaaacugcucucuuuucugcuccucucccccgcacccgcgccugccgccgcugaaagcgcccccgcugcucggacccgggcggucggcugagagcugcccacgcccgccucggcccccacgcccgccucggcccccacgccuccuacccggccuugaagccgcucuccugagccccggcgcccucccgccgggcccgggccccucauccccuuucaccucggcccccagcuucuagcuccacuucacgcaaccuuucccuuuccugccuggaaagguccuuccucccaggcuugagcucccucuucuucccagaucccuucuuucuccgggagguuuccucccaccccagucugucuuuucccgggcugagugccuuguuguuuggcggcagagacgcgacuccuuucuagacugagcugcgaggugccuccugcguaacugcaacaaugaugguuauaccggccccguauccagaugagagaauggaguagauuuuccgucaggugcucaguguugaaagugaagggcuuuuuagauguuuucacacagggaagccuagucucuuaguuuagacauuugacauuccauaauugagggaagugggaaggaauugagagggaaggguaagcaaaauuuugcaagcaagccuucgggugaaagagccauaauucauuaaaguggaaaagucaggcuguuuugauuaaauugcaauuaggugcaguauuuucaguccauuaaguagaugggaugggguggggagaaagcagauggcuuagcuacacagaugaaagucuaaaauagaaaggucaaggcuuugccuuucaucccaguucugguuuuuauaggccugaaauagaaacgguuuacaauugcguuucucaauggaauuguuccgaaauaaugacagaggagaauacuaguaagucucugaaaacauugguaaaccugggaagucuuuugccauucagcugauaguuguaaugaaagguguuacucuggccacccaaaaaguuuacuacugcaagauucgcuguaauuaaguucaaacucacuuuugggauuuucucaaaagccuaaagaaaagaagggccuggaaaguaaaccuguuuugucuucauccaagcuaauagacaccugaucagaucauucuccuguuaaagcagcaguuuaucaauaggggaaaaucauuuaacaaaucuuccauagaaguggacuguguugguauuucauaauauaagcuaucuaaaauuuaauuuuaaaauacuguucaauuacaguauuaccgucaauuagcaagguaaugaugcuuuuugagaaacguaaaauauaaaauggcguguaauaccaccacccagagauaaacaguauuaacauuuuagaguauaucuggucuuugugaacuaucauagacaagggcuucugagauguaauuuuuuacaguauuuaaagauaaagcucccugcuuaaaauaaaauggaaauguuuauuaagggaauuuaucuuagcagcagacuggcucuaucuugacaguuaauucuuaccuuuacaaaugcaguuugcagaauuaaaccaauucaaacuuuagaaaguguccaaauaagguc

SEQ ID NO: 19929 - RNA, 2464 nt, Homo sapiens
uaagaagagaaacucgaaaauccuggaggguaacagaggcagccagggcggggcggagugcggaggcggcugccagggacuggggccgaggcggcggccaagguggccugaagcugugacacccagccuccuccuccuccuccucauggccgcgcucagccucaccuccccgcccgggccuccugccuccgcccccgggugccgggcugcggagcugacgcugggacgcccggcggcggcgaggacgcucaccuggccaagccuccuucuccuccucccccucccgcccccaccuguccuccuccucucugaguugggaagcguagggauccguaggcgaggaaauaacgaccccugcaguuguauugcggaaaaucucgacagcggcgcuaguugcgggcgauggaagccaggcaacuggggguucuggggaguucaggaaaauagcagaggagcaggaagggcgcgcgcgaccuggagagucugugugcccccaccgcgccccaguccccggggcccagcccuuccccucggcgcccuggacgcacugccggaacccggcugagaggcugcaggcugcgcgcggaccuggggagcagggagggucggcggaggcugccggcggcuggcgguuucgggcaauaaucccugccucucuuucucugugugucugcugugucugcuccuuccccgccccccggaagcaggagaagaacugccccggagcgcagcagccacccuccgaccaugccccggugaggggggcggacuucgagggcaacuugccgcggacugccugggcuuagccagcgagcuacgcgcucccgggagcccggaauugcacggcgcagcccggcggggggcuaucgucuaugucuucuuggggcgccagacgaaucggggucucguuuuugcuggaagagcccaguguugguggcuucagguggcugcugccgccgccgccgccgccgccgcugcuagugcgguuuccgccgcuggugcgaagagaagagacacgcgagcggggagaccuccaaggcagcgaggcaucggacaugugucagcacaucuggggcgcacauccgucgagcccgaggggagauuugccggaacaauucaaacugcgauauugaucuugggggugacugucccuggccggcugucgggugggagugcgagugugcacucgcucggaagugugugcgaguguguaugugugugugccgugucgggcuccccccuuccccccguuuucccgucgagugaugcacuuggaaugagaaucagaggauggaaauagucugggaggugcuuuuucuucuucaagccaauuucaucgucugcauaucagguacgggacgcgccgaagucacuggcugauuuggauuauguugugaugucugggguguaugggguuuuauuguauauagccgcggggcagagagagggguggcgagacccuuugaguucugcggguuugccgccuucagaaucaaaaaucuucucagcccaagggugugugaauguguguguuuugcgggggggggugguuaggaucugugugcaguccuagaagggugaaggaaaaaguggugggggaugagaaagaagaggcagauggguguugauuuucaacugcuuuccuggcugagaacucuggcgccgaaauccgagccuuggcaacaaccacccccauccccuggcuuucaaaguucccagacucggugguuccuggcuggcaaaauggacgcggggcccugcccggguaucuaaccacuuucaagagacugcgggaggaugcgggacuggagaguaccagcagggaucagagauauguccuccaugccuuacccaaacacaucaggacugauugugaugcuuugaaaccugcugacacacccuccucuacccccccaauuuucuuguuaaagcacuacagugucacaaauaccacuuucuuuacaucacgguguuuuuuaauucccaguagcaaggaugugcuggcucagaccucucagucuacuugggccugucugugcuuuuaagagcaaacgggauuucaggguguugaggugaaagagguugggcuuguggacaccugugccugaguguguuaggacgaguucugguuuuugagcacugucuuuguugaugcagggaauugggguugggaggaagcugggagggaaaggggaaagccccuggaccagcaguauuccccaguucaguggcuccucccauugaaggcacccaccccauuucccuucacaccugccacuuaagcacccaaggaaaagcccauuuguagugcucccuucugccugcauucuucugcagaaguggggacucggccaacuucccaugaagucaucagaagaggagagcaggauauugccccuuugagcagccacauuuaagcagcacugggguggagagacauguuuccugccucuuccuucagccc

SEQ ID NO: 19930 - RNA, 2464 nt, Homo sapiens
gggcugaaggaagaggcaggaaacaugucucuccaccccagugcugcuuaaauguggcugcucaaaggggcaauauccugcucuccucuucugaugacuucaugggaaguuggccgaguccccacuucugcagaagaaugcaggcagaagggagcacuacaaaugggcuuuuccuugggugcuuaaguggcaggugugaagggaaauggggugggugccuucaaugggaggagccacugaacuggggaauacugcugguccaggggcuuuccccuuucccucccagcuuccucccaaccccaauucccugcaucaacaaagacagugcucaaaaaccagaacucguccuaacacacucaggcacagguguccacaagcccaaccucuuucaccucaacacccugaaaucccguuugcucuuaaaagcacagacaggcccaaguagacugagaggucugagccagcacauccuugcuacugggaauuaaaaaacaccgugauguaaagaaagugguauuugugacacuguagugcuuuaacaagaaaauuggggggguagaggagggugugucagcagguuucaaagcaucacaaucaguccugauguguuuggguaaggcauggaggacauaucucugaucccugcugguacucuccagucccgcauccucccgcagucucuugaaagugguuagauacccgggcagggccccgcguccauuuugccagccaggaaccaccgagucugggaacuuugaaagccaggggaugggggugguuguugccaaggcucggauuucggcgccagaguucucagccaggaaagcaguugaaaaucaacacccaucugccucuucuuucucaucccccaccacuuuuuccuucacccuucuaggacugcacacagauccuaaccacccccccccgcaaaacacacacauucacacacccuugggcugagaagauuuuugauucugaaggcggcaaacccgcagaacucaaagggucucgccaccccucucucugccccgcggcuauauacaauaaaaccccauacaccccagacaucacaacauaauccaaaucagccagugacuucggcgcgucccguaccugauaugcagacgaugaaauuggcuugaagaagaaaaagcaccucccagacuauuuccauccucugauucucauuccaagugcaucacucgacgggaaaacggggggaaggggggagcccgacacggcacacacacauacacacucgcacacacuuccgagcgagugcacacucgcacucccacccgacagccggccagggacagucacccccaagaucaauaucgcaguuugaauuguuccggcaaaucuccccucgggcucgacggaugugcgccccagaugugcugacacauguccgaugccucgcugccuuggaggucuccccgcucgcgugucucuucucuucgcaccagcggcggaaaccgcacuagcagcggcggcggcggcggcggcggcagcagccaccugaagccaccaacacugggcucuuccagcaaaaacgagaccccgauucgucuggcgccccaagaagacauagacgauagccccccgccgggcugcgccgugcaauuccgggcucccgggagcgcguagcucgcuggcuaagcccaggcaguccgcggcaaguugcccucgaaguccgccccccucaccggggcauggucggaggguggcugcugcgcuccggggcaguucuucuccugcuuccggggggcggggaaggagcagacacagcagacacacagagaaagagaggcagggauuauugcccgaaaccgccagccgccggcagccuccgccgacccucccugcuccccagguccgcgcgcagccugcagccucucagccggguuccggcagugcguccagggcgccgaggggaagggcugggccccggggacuggggcgcggugggggcacacagacucuccaggucgcgcgcgcccuuccugcuccucugcuauuuuccugaacuccccagaacccccaguugccuggcuuccaucgcccgcaacuagcgccgcugucgagauuuuccgcaauacaacugcaggggucguuauuuccucgccuacggaucccuacgcuucccaacucagagaggaggaggacaggugggggcgggagggggaggaggagaaggaggcuuggccaggugagcguccucgccgccgccgggcgucccagcgucagcuccgcagcccggcacccgggggcggaggcaggaggcccgggcggggaggugaggcugagcgcggccaugaggaggaggaggaggaggcugggugucacagcuucaggccaccuuggccgccgccucggccccagucccuggcagccgccuccgcacuccgccccgcccuggcugccucuguuacccuccaggauuuucgaguuucucuucuua

SEQ ID NO: 19931 - RNA, 2456 nt, Homo sapiens
auucagcaagaacacagaccucugaggccugcaccucucuuucugcagcucagagagaaaggaagaaggggcaguggaugagaagaggaugugaugaggggagcuuccuaaagacccacaagguguagaggaugggggugggggggccacaagcucaucccugcuuugcgcacuagaggcagcagagcugcagagagugagggcggcaccaaccuuccaccccccuuccccaaagcagagucccugcuaggcucacaggggcuacaagggagaccuggggucucccacccugggucuauaagaaccucugagcuggaaggaaggagcccagagaagcuguccagaccugagauggcagcaacaccuccccuccaccuuuccuucccccgguggcaggacccgccagggagcuuggggccaggcgucugucaaguggcgcuuugagcuagggucugacugggcuggggucuccccuaccacuccagccugggcagacagggagcagugcuaaauccaucucccuggaauguggggcuugcauuccccaaaccuaucugcggagucuacgcuggggugguggacccgaguccuccuuagugaacacacugacaguauuacuguccccucaagacuuucgcgggccugcagucccccauaccuggucugcaggagcacucuuuauuugugaaaggggaggaguaaccuggaccagcuuaaccccaucccccacuugcuaaaaaagcucuugacacagucuuucccuccacaagaaaaauccagcauaaaacuccccaacccaaucuuaagcacccugcaucgaauggagaucggguaggaggcacccgcggcacugggcucuagcggaaaggggcuccacucccagcuccgggggcagacagcuccccuccaccacaucuuguucucauucugcgccccugacaucagccgccgccggaaucuccuuguugugccuccaacccgcgagguggggggugaggugggccaggaccugguccccgccccccaacaucuccuucuaggucaguaaaaaccucagccucaaggaccagguugggggaucagacccuagaauccgccgcaaacuuuggggcgggggaaggagggaaacccaggagauugcgguccccccuccuccguccccgcagcuuccuccccaccgcccccacccaccccccaccaaacucggaaaccaaacccagcucgcuaaccggcgcgggcagaguacagcucccaggcucccgaagcuucccacaucuggaggaugacgacccuccccugaccacaucuggagggcguccagcugcgagccagcggggcacagcucucuucuccuggccuggauccccacccccccaacccaggaagacugagguguguguacgcaggugggguaagcccggguuaccgacgagaccugcucgcgucuccgcucccacucuggugcccccuccccucccuggcagccccccccccauccgccuacccuccgggcucacuucgacucaccuggcggugggucuucuucccccccgacccccggcggugcggcccgucccccuucugaccccgcgccuggccgucgugccccgaaggauauggguuacagaccgugcggagacaccagcuccgcgggcggcuguccuggcucaaguagaagaaaaccaccggggccagcgccggguacggcagccccuccgccucggaguccgcgcugcccggguccuuuucugcugaccccggccccggccggcccccggcccccgacaggucguugagccgcaugaagcuccggggcugucccgacuccucggcgcccgcuccauccuccuccucguccauccucuggccagccggggccccgggcgauccggagaggggcaagcggcgccccucagaggagguguccucacgcaacccgggggccccggcgggggcacaucuggugggcucuagggcgcaagcugagcccccgggagggccaguucagcccagcucccccugcccgcaggggcaugcugcccgcggggcgccggggcgcagggaaaccccgcccggcgcgagucccgcuuccccugcgccccuggggcuucccgggccagccggccggcucccccucacuuuguuccggcuucuucgcuucgcgcccaggcuccgguugccggauucggcgcuaccuucggcgaagccgccccgagagggcgaacgaaaaggggggcagcggcggagggcggggguccggggaggggcgcccccucuucccgcggcgcagcuggagccggaucuaaggggucagcaucgucccggcuccgcgccaggcggcgggggaggggaggagggaucucuuuaggggugggcuuggagggggugggggcggcuccuucccccgccccgccgcgggcucacuguccgggaggggcggggagacaguggggggc

SEQ ID NO: 19932 - RNA, 2456 nt, Homo sapiens
gccccccacugucuccccgccccucccggacagugagcccgcggcggggcgggggaaggagccgcccccacccccuccaagcccaccccuaaagagaucccuccuccccucccccgccgccuggcgcggagccgggacgaugcugaccccuuagauccggcuccagcugcgccgcgggaagagggggcgccccuccccggacccccgcccuccgccgcugccccccuuuucguucgcccucucggggcggcuucgccgaagguagcgccgaauccggcaaccggagccugggcgcgaagcgaagaagccggaacaaagugagggggagccggccggcuggcccgggaagccccaggggcgcaggggaagcgggacucgcgccgggcgggguuucccugcgccccggcgccccgcgggcagcaugccccugcgggcagggggagcugggcugaacuggcccucccgggggcucagcuugcgcccuagagcccaccagaugugcccccgccggggcccccggguugcgugaggacaccuccucugaggggcgccgcuugccccucuccggaucgcccggggccccggcuggccagaggauggacgaggaggaggauggagcgggcgccgaggagucgggacagccccggagcuucaugcggcucaacgaccugucgggggccgggggccggccggggccggggucagcagaaaaggacccgggcagcgcggacuccgaggcggaggggcugccguacccggcgcuggccccggugguuuucuucuacuugagccaggacagccgcccgcggagcuggugucuccgcacggucuguaacccauauccuucggggcacgacggccaggcgcggggucagaagggggacgggccgcaccgccgggggucgggggggaagaagacccaccgccaggugagucgaagugagcccggaggguaggcggauggggggggggcugccagggaggggagggggcaccagagugggagcggagacgcgagcaggucucgucgguaacccgggcuuaccccaccugcguacacacaccucagucuuccuggguuggggggguggggauccaggccaggagaagagagcugugccccgcuggcucgcagcuggacgcccuccagauguggucaggggagggucgucauccuccagaugugggaagcuucgggagccugggagcuguacucugcccgcgccgguuagcgagcuggguuugguuuccgaguuugguggggggugggugggggcgguggggaggaagcugcggggacggaggaggggggaccgcaaucuccuggguuucccuccuucccccgccccaaaguuugcggcggauucuagggucugaucccccaaccugguccuugaggcugagguuuuuacugaccuagaaggagauguuggggggcggggaccagguccuggcccaccucaccccccaccucgcggguuggaggcacaacaaggagauuccggcggcggcugaugucaggggcgcagaaugagaacaagaugugguggaggggagcugucugcccccggagcugggaguggagccccuuuccgcuagagcccagugccgcgggugccuccuacccgaucuccauucgaugcagggugcuuaagauuggguuggggaguuuuaugcuggauuuuucuuguggagggaaagacugugucaagagcuuuuuuagcaagugggggaugggguuaagcugguccagguuacuccuccccuuucacaaauaaagagugcuccugcagaccagguaugggggacugcaggcccgcgaaagucuugaggggacaguaauacugucaguguguucacuaaggaggacucggguccaccaccccagcguagacuccgcagauagguuuggggaaugcaagccccacauuccagggagauggauuuagcacugcucccugucugcccaggcuggagugguaggggagaccccagcccagucagacccuagcucaaagcgccacuugacagacgccuggccccaagcucccuggcggguccugccaccgggggaaggaaagguggaggggagguguugcugccaucucaggucuggacagcuucucugggcuccuuccuuccagcucagagguucuuauagacccagggugggagaccccaggucucccuuguagccccugugagccuagcagggacucugcuuuggggaagggggguggaagguuggugccgcccucacucucugcagcucugcugccucuagugcgcaaagcagggaugagcuuguggcccccccacccccauccucuacaccuugugggucuuuaggaagcuccccucaucacauccucuucucauccacugccccuucuuccuuucucucugagcugcagaaagagaggugcaggccucagaggucuguguucuugcugaau

SEQ ID NO: 19933 - RNA, 2226 nt, Homo sapiens
ugcacaccugagccccucccuccucuuaauuuugugugugugcgcgcgcgcgcgugugugugugugugugugugugugugugggcggcggggugggcggcugguagaauaaagugcaagcccccugcaccuccccagcuucaauuuaucuuccccucuugcccucccacccccaacacccccuggcacuucccuacccuggcccgcaguuguagccaacacaucacauccucugggaaucccccagcccagcucccgccgcggccgccuggacccaggccgggccaggggugcgcucucccuuccggcaagaagugcccucuguuagcugggcccauggcgcccaggcucgugagggccuccccacucgucugagcccccgacuggcccacuggccuugagcgcaguuagggggcggggguucuguucaccgcuguccccuccagccucggcgccccggcugcucggcggacguuuguugaaugaaugaacuaaucgggagcccugauggacccggcagaggaggcggaagccccgugggucccguggcgggaccgccccggagccgcucccacccgcgcagacuccggugcgccgcgucucccgcgggcagagaaguagcugcaacuccgcuccccggccccagccgccuccuccccgccgcccucccccgcccccgcccccucgcucccucccgcucuuugucuccugggcgcccggcuucuccgccacgcgccccccaccccgacgccccuuccccggagacccccgcggaccccugccgacgcgacgccgcgcgaaucggcccugccaggcgggggccccgcguccggccaggccuggcgggcggcaggggcggggagggagguggcgcucgcucuucgcucuucucucucucucucucucugucacacacacacacacgcacacgcacacgcacacacacacggagcauccucccgucaggucuccugguccagccccgcccgcgccuccugcuuccagcgaaccuguucccucuccccacaucccccgcccuccaucucccccggcucugggacccuucccgccgaccucacccccacccccgggauggagcggcucgagcccgcccggagccccccgcggccggggugacgguccccccaccccucuccugcccggcccccgccucgagcaccaugggccugagggguucccggggcgccagacgcugaagaugaccgaugccggaggugaggggccgggcgcccugggguggaccgggaacuggggcuagggccacucgggcccgcggugggacccugagugggguugggcagggcuaagcgacaagggccuuucuuccccuaucccuagggggaccgcacggggcuggggugccgggcugucaggggagggggcggagauaggauuuauggcccuaauccccucccucccgcccgacgcccggagaaauuaauaaaaagcugguguggggggagggggagagggcuuaacucuuucuugcccggcggggaguugugcugaugguuuggagagaaacuagccaccgggcucugacuggggagaagggcucugagaguggaguaggugcccuguccccaaccucaccccaucuccaacagugcuuugagggggugcccgacuccugaggacuaccccaagccuggggccaguggacggccggcgauaugggaaggggggaccaccucucuggcuccacaacugccuccccgaccgcuagucuccuuucccauccaccucuucccggccucucccaguugcacuucucucugucgcuuucuccucuucaggggcccuuuccuaucgccugcccgaagggcuucucccuucucucccacccucgggcgucacuuagagcggcggaagcccuuguucccagugccaguucccguggccccacucucggugugaucucuuucuucucagcagcccuguggacucuccgccaguuugugugucugucucugcuucuuccuacuccucacuuccuuccgcucccgcucccgcucccuccccaggaauugugcgcccuuucuuccuuucuccuucuccugggucccaagaggcugugagcucaccugccucccuuucucccagagaagggucaaaggucauuggugcuccuucuccaggauuggaagccuuggggggaaggguauccagaggaaccgguucaaucccacccuugugcaguuaccug

SEQ ID NO: 19934 - RNA, 2226 nt, Homo sapiens
cagguaacugcacaagggugggauugaaccgguuccucuggauacccuuccccccaaggcuuccaauccuggagaaggagcaccaaugaccuuugacccuucucugggagaaagggaggcaggugagcucacagccucuugggacccaggagaaggagaaaggaagaaagggcgcacaauuccuggggagggagcgggagcgggagcggaaggaagugaggaguaggaagaagcagagacagacacacaaacuggcggagaguccacagggcugcugagaagaaagagaucacaccgagaguggggccacgggaacuggcacugggaacaagggcuuccgccgcucuaagugacgcccgagggugggagagaagggagaagcccuucgggcaggcgauaggaaagggccccugaagaggagaaagcgacagagagaagugcaacugggagaggccgggaagagguggaugggaaaggagacuagcggucggggaggcaguuguggagccagagaggugguccccccuucccauaucgccggccguccacuggccccaggcuugggguaguccucaggagucgggcacccccucaaagcacuguuggagauggggugagguuggggacagggcaccuacuccacucucagagcccuucuccccagucagagcccgguggcuaguuucucuccaaaccaucagcacaacuccccgccgggcaagaaagaguuaagcccucucccccuccccccacaccagcuuuuuauuaauuucuccgggcgucgggcgggagggaggggauuagggccauaaauccuaucuccgcccccuccccugacagcccggcaccccagccccgugcggucccccuagggauaggggaagaaaggcccuugucgcuuagcccugcccaaccccacucagggucccaccgcgggcccgaguggcccuagccccaguucccgguccaccccagggcgcccggccccucaccuccggcaucggucaucuucagcgucuggcgccccgggaaccccucaggcccauggugcucgaggcgggggccgggcaggagagggguggggggaccgucaccccggccgcggggggcuccgggcgggcucgagccgcuccaucccgggggugggggugaggucggcgggaagggucccagagccgggggagauggagggcgggggauguggggagagggaacagguucgcuggaagcaggaggcgcgggcggggcuggaccaggagaccugacgggaggaugcuccgugugugugugcgugugcgugugcgugugugugugugugacagagagagagagagagagaagagcgaagagcgagcgccaccucccuccccgccccugccgcccgccaggccuggccggacgcggggcccccgccuggcagggccgauucgcgcggcgucgcgucggcagggguccgcgggggucuccggggaaggggcgucgggguggggggcgcguggcggagaagccgggcgcccaggagacaaagagcgggagggagcgagggggcgggggcgggggagggcggcggggaggaggcggcuggggccggggagcggaguugcagcuacuucucugcccgcgggagacgcggcgcaccggagucugcgcgggugggagcggcuccggggcggucccgccacgggacccacggggcuuccgccuccucugccggguccaucagggcucccgauuaguucauucauucaacaaacguccgccgagcagccggggcgccgaggcuggaggggacagcggugaacagaacccccgcccccuaacugcgcucaaggccagugggccagucgggggcucagacgaguggggaggcccucacgagccugggcgccaugggcccagcuaacagagggcacuucuugccggaagggagagcgcaccccuggcccggccuggguccaggcggccgcggcgggagcugggcugggggauucccagaggaugugauguguuggcuacaacugcgggccaggguagggaagugccaggggguguugggggugggagggcaagaggggaagauaaauugaagcuggggaggugcagggggcuugcacuuuauucuaccagccgcccaccccgccgcccacacacacacacacacacacacacacacgcgcgcgcgcgcacacacacaaaauuaagaggagggaggggcucaggugugca

SEQ ID NO: 19935 - RNA, 2591 nt, Homo sapiens
auuuuaagagaaaccauuuucaggggcugugaguccucaccacuuuggguacauuugugugccugucauuugcacagugcgugcacacgugugcacacacacacaaccauaccccaccuuagaccaucucuuuccacaaacacacaaugggcaaacuccccuccuugcccaccucaccuaagcccaucucucaucccccagccagagaaacagacugacagauccugggggcuccacagagcaacccuuccccuccaccuccacgccccuccuucagagaacuuaucugggcuggagcuacaagaguagcgaggguguguguguguguguguguguguguguguguuuugaguaacaacaaagacuggggaaaaagaagagagaggagggaggagagaaggaaaagggagagagagagagagaggagagcauaggagcgagagagcaaaagcguguuuugccuggaaggcaagacuugcagccaaucagcgcguaggagccucccucggcgacuccacuauugagucuauaaccggcuggccgggcggagcuggcagcauuugauuguggcuugggacgcgaggagaggcgcgcagcgaccgccugacggcaggcaaugguguaagcgccucucggccucccccuccccccagacgcggccggguccucccuucgccuucuggacacacaccccugccucgucucuuccgccucucucgcacuccgguccguuccuguccucugcggaggccagcccuggggaggugcagcgcccgccaggaugaguggcuccuucgaucgcaagcucagcagcauccucaccgacaucuccagcucccuuagcugccaugcgggcuccaaggacucgccuacccugcccgagucuucugucacugaccugggcuacuacagcgcuccccagcacgauuacuacucgggccagcccuauggccagacggugaaccccuacaccuaccaccaccaauucaaucucaaugggcuugcaggcacgggcgcuuacucgcccaagucggaauauaccuacggagccuccuaccggcaauacggggcguaucgggagcagccgcugccagcccaggacccaggugagggccacggggucgcgaggacagugggagacacuggaagguucccgagggaggaaaaggcauggacuggaagccaaaaucuaggaaaacuucuaagaaaaguacugucuggaguuagagaaguuggccuagaugacccucagagggaccaggcgaccuuccagccccgggugugcaagcauuuggggcgcgaugugcgcagugcgccgcggucccggaugaggaucgggaugagcugagagaggaaggggaaggcuguggguuguuaggaaaccuccgaaucgaggugauuucgugggcauuucagcaggcgauccucgaucaagucgcagagggcuuggggguaggcggcaggggcuggaaacucuaggggcccuccuuuggauaagggauggggagacuaggagucgugagggggcaaugagaaggacccacggaaguugcgggaaagcggagggaagcagccaccgagaggcagagaagcugaaaaagggaaaagugaaggcagcaagagggaaguauggaaagacagugagagaaagggcagaagaaacaagaaaggaaggagagaaggaaggggggaagaagggggacagggaaagaaagaaagucugcacuauccuugcaacuuuucugaaaaucuaaagagauucuaaaaugaaacuuuuuuaaagggcggggggcggacgggaaggagcgagagaaacaaccgacggcgagaugggacugggaagggggcggcuagcagccgggcggcgaggagccccgaggcugggaggcgagccgggaaggcgucgugagcgaagccgaggcgguccuggcgcaggcggcggcuggcgccggggacagugcugcggcggccgggcgcggagcugggagcgccgcguugugggccgcggccaguucuggcucuggggccgcggcuccccccugggccgcgggcagcggagcgcgcggccgggaaucccgcggcgagucggugggcggaagcgaggggcguccggcggggcccuggagggucgcaggagucgcaggccgaggcugaaccgcccccucuuccgcccggugcguuccccgcagugucggugaaggaggagccggaagcagaggugcgcauggugaaugggaagcccaagaagguccgaaagccgcguacgaucuacuccagcuaccagcuggccgcccugcagcgccgcuuccagaaggcccaguaccuggcgcugcccgagcgcgccgagcuggccgcgcagcugggccucacgcagacacagguugguguuuggcuguccagggccgcgggggcgcgcgggaccccguaguuccccgcgcgcugccgagccuggcuggccacugaagggcccugcgggcuccuggaacucuugccuuugggaugggggccugcgagguucaacuucggugggaagguucugcguuagcacguguacaagugagcauaguugugaacccgugcaacuguguaug

SEQ ID NO: 19936 - RNA, 2591 nt, Homo sapiens
cauacacaguugcacggguucacaacuaugcucacuuguacacgugcuaacgcagaaccuucccaccgaaguugaaccucgcaggcccccaucccaaaggcaagaguuccaggagcccgcagggcccuucaguggccagccaggcucggcagcgcgcggggaacuacggggucccgcgcgcccccgcggcccuggacagccaaacaccaaccugugucugcgugaggcccagcugcgcggccagcucggcgcgcucgggcagcgccagguacugggccuucuggaagcggcgcugcagggcggccagcugguagcuggaguagaucguacgcggcuuucggaccuucuugggcuucccauucaccaugcgcaccucugcuuccggcuccuccuucaccgacacugcggggaacgcaccgggcggaagagggggcgguucagccucggccugcgacuccugcgacccuccagggccccgccggacgccccucgcuuccgcccaccgacucgccgcgggauucccggccgcgcgcuccgcugcccgcggcccaggggggagccgcggccccagagccagaacuggccgcggcccacaacgcggcgcucccagcuccgcgcccggccgccgcagcacuguccccggcgccagccgccgccugcgccaggaccgccucggcuucgcucacgacgccuucccggcucgccucccagccucggggcuccucgccgcccggcugcuagccgcccccuucccagucccaucucgccgucgguuguuucucucgcuccuucccguccgccccccgcccuuuaaaaaaguuucauuuuagaaucucuuuagauuuucagaaaaguugcaaggauagugcagacuuucuuucuuucccugucccccuucuuccccccuuccuucucuccuuccuuucuuguuucuucugcccuuucucucacugucuuuccauacuucccucuugcugccuucacuuuucccuuuuucagcuucucugccucucgguggcugcuucccuccgcuuucccgcaacuuccguggguccuucucauugcccccucacgacuccuagucuccccaucccuuauccaaaggagggccccuagaguuuccagccccugccgccuacccccaagcccucugcgacuugaucgaggaucgccugcugaaaugcccacgaaaucaccucgauucggagguuuccuaacaacccacagccuuccccuuccucucucagcucaucccgauccucauccgggaccgcggcgcacugcgcacaucgcgccccaaaugcuugcacacccggggcuggaaggucgccuggucccucugagggucaucuaggccaacuucucuaacuccagacaguacuuuucuuagaaguuuuccuagauuuuggcuuccaguccaugccuuuuccucccucgggaaccuuccagugucucccacuguccucgcgaccccguggcccucaccuggguccugggcuggcagcggcugcucccgauacgccccguauugccgguaggaggcuccguagguauauuccgacuugggcgaguaagcgcccgugccugcaagcccauugagauugaauugguggugguagguguagggguucaccgucuggccauagggcuggcccgaguaguaaucgugcuggggagcgcuguaguagcccaggucagugacagaagacucgggcaggguaggcgaguccuuggagcccgcauggcagcuaagggagcuggagaugucggugaggaugcugcugagcuugcgaucgaaggagccacucauccuggcgggcgcugcaccuccccagggcuggccuccgcagaggacaggaacggaccggagugcgagagaggcggaagagacgaggcagggguguguguccagaaggcgaagggaggacccggccgcgucuggggggagggggaggccgagaggcgcuuacaccauugccugccgucaggcggucgcugcgcgccucuccucgcgucccaagccacaaucaaaugcugccagcuccgcccggccagccgguuauagacucaauaguggagucgccgagggaggcuccuacgcgcugauuggcugcaagucuugccuuccaggcaaaacacgcuuuugcucucucgcuccuaugcucuccucucucucucucucucccuuuuccuucucuccucccuccucucucuucuuuuuccccagucuuuguuguuacucaaaacacacacacacacacacacacacacacacacccucgcuacucuuguagcuccagcccagauaaguucucugaaggaggggcguggagguggaggggaaggguugcucuguggagcccccaggaucugucagucuguuucucuggcugggggaugagagaugggcuuaggugaggugggcaaggaggggaguuugcccauuguguguuuguggaaagagauggucuaaggugggguaugguugugugugugugcacacgugugcacgcacugugcaaaugacaggcacacaaauguacccaaaguggugaggacucacagccccugaaaaugguuucucuuaaaau

SEQ ID NO: 19937 - RNA, 2523 nt, Homo sapiens
aauaaacaucuuuugucaaggggaaagagaagaggaaaugagggccugcgggguggagguguguguggggggacaggagcaccuccucuuccaguauccucucgggccucuauggcuucuccccgggcuggggcucucucccucccuccgcccuugcucucccucccuccccgacccgccuggggagagggcucuacagccugcgucccucccaaggcagcccgccgcuucccuccgccucuccuccgcccccgccgccccauguugagaacugccccccuuccugcagcgggagggggggaccgggcggccgguagcuggggcugagguuacguggccgccggagcccugacgugauagcacauugcaucagcauaaaacaauccauccucgauauggagugcggugcggacggaugacagcgagagcgcagcccccucgcccgauugauuuaugucggagcugacgcuuuaucaggcagucggaaaaacuuugaccaaucauuuugcaaggagagcugagacgggcugcuccacuguacuuuguuggcugagaaguugagcagggggugggggugggaggguggggggcugggggggucgcguccgaaagcccucacaccgguccgggugccaccucucccugcuugggcgccgccgcgcgagcgcuucccuucccccugcaagcgcccggauaaugucugagaauguccauuucugggacgcuuagcagcuauuaugucgacucgaucauaagucacgagagugaggacgcgccuccagccaaguuuccuucuggccaguacgcgagcucgcggcagccgggccacgcggagcaccuggaguuccccucgugcagcuuccagcccaaagcgccgguguucggcgccuccugggcgccgcugagcccgcacgcguccgggagccugccguccgucuaccacccuuacauccagccccagggcgucccgccggccgagagcagguaccuccgcaccuggcuggagccggcgccgcgcggcgaagcggccccggggcagggccaggcggcggugaaggcggagccgcugcugggcgcgccuggggagcugcucaaacagggcacgcccgaguacaguuuggaaacuucggcgggcagggaggccgugcugucuaaucaaagacccggcuacggggacaauaaaauuugcgaaggaagcgaggacaaagagaggccggaucaaaguaaguuauaaaaagugaggaaauacccaggccgaaggccaggaggggggcggggaggggaaaggcaauaaacugcggacaaugugaagggaaacugcggcgguggccggagagcgggccgggaggaggaggggagaggaaggaaagacggagggaaggggaaagcugcgugcucuagaaggggagacugaggccgccagaggagcgcugcccccacuucuccaaguccugcggggaacaggggcucggggaucgacuugcagcucucucggcccucuuucccccucucucccggaggccccagcugaaagcccggccagagaccggcgacggccgggagaggagcuggcgggggccggggccagcggccagcgaggccgagagccggcgagggcaagggccggagcgcacugggcugcccggggccgugcggcuggcagagcuccccgcgccacgcgcagaccguaaaagccggccaaggggaagggggagggagcucauuaggauuuuauuugcgaugcaacagcuuggcggaggauuguuccuagcagaucucgcgcuguagccgcgcagaguccgcaaccggcgacaggaggggcgggggaagcccaggacgcggugacugagcccccuccccggaugcgccggccccuccccgggagccuucccuccgguggccccucuccuccucggcguccucgcaggggcuaccgcuuccuuuucugcggucccccgcugcucucugcggggcucccgagccccagcccgggcuguccgccucuuggggagucggggaaucgcuuccgaauaucggggcaucucgaagggaccccggggagaggagggguggggggaagagagaguugcagagaggcggagaacuuuacccuuuguggguaguuucccgucaccucccacuccucaaaagcaccccggccagaacgccaagucuggcugauuuucaggaggugcuacuagaugagaagagaggguucuccuauuauuuauuuuuaagguugagaagggcucaucggugagggaacucagccucaaacaaugacucgcaggcugguggaucagguccucguuucuuacucuuuuugggaaguagggauguuuuagucucuccuugcccugcuagauuucccauugacggaguggccccagggcccuuuagagcauccuugccugcuggagaguaaagagcagccccauuccuugcaggguccugucaccuccaaccugccagguggaauccuaagagcuggcauuuagggaacacauucuuccccaacccucc

SEQ ID NO: 19938 - RNA, 2523 nt, Homo sapiens
ggaggguuggggaagaauguguucccuaaaugccagcucuuaggauuccaccuggcagguuggaggugacaggacccugcaaggaauggggcugcucuuuacucuccagcaggcaaggaugcucuaaagggcccuggggccacuccgucaaugggaaaucuagcagggcaaggagagacuaaaacaucccuacuucccaaaaagaguaagaaacgaggaccugauccaccagccugcgagucauuguuugaggcugaguucccucaccgaugagcccuucucaaccuuaaaaauaaauaauaggagaacccucucuucucaucuaguagcaccuccugaaaaucagccagacuuggcguucuggccggggugcuuuugaggagugggaggugacgggaaacuacccacaaaggguaaaguucuccgccucucugcaacucucucuuccccccaccccuccucuccccggggucccuucgagaugccccgauauucggaagcgauuccccgacuccccaagaggcggacagcccgggcuggggcucgggagccccgcagagagcagcgggggaccgcagaaaaggaagcgguagccccugcgaggacgccgaggaggagaggggccaccggagggaaggcucccggggaggggccggcgcauccggggagggggcucagucaccgcguccugggcuucccccgccccuccugucgccgguugcggacucugcgcggcuacagcgcgagaucugcuaggaacaauccuccgccaagcuguugcaucgcaaauaaaauccuaaugagcucccucccccuuccccuuggccggcuuuuacggucugcgcguggcgcggggagcucugccagccgcacggccccgggcagcccagugcgcuccggcccuugcccucgccggcucucggccucgcuggccgcuggccccggcccccgccagcuccucucccggccgucgccggucucuggccgggcuuucagcuggggccuccgggagagagggggaaagagggccgagagagcugcaagucgauccccgagccccuguuccccgcaggacuuggagaagugggggcagcgcuccucuggcggccucagucuccccuucuagagcacgcagcuuuccccuucccuccgucuuuccuuccucuccccuccuccucccggcccgcucuccggccaccgccgcaguuucccuucacauuguccgcaguuuauugccuuuccccuccccgccccccuccuggccuucggccuggguauuuccucacuuuuuauaacuuacuuugauccggccucucuuuguccucgcuuccuucgcaaauuuuauuguccccguagccgggucuuugauuagacagcacggccucccugcccgccgaaguuuccaaacuguacucgggcgugcccuguuugagcagcuccccaggcgcgcccagcagcggcuccgccuucaccgccgccuggcccugccccggggccgcuucgccgcgcggcgccggcuccagccaggugcggagguaccugcucucggccggcgggacgcccuggggcuggauguaagggugguagacggacggcaggcucccggacgcgugcgggcucagcggcgcccaggaggcgccgaacaccggcgcuuugggcuggaagcugcacgaggggaacuccaggugcuccgcguggcccggcugccgcgagcucgcguacuggccagaaggaaacuuggcuggaggcgcguccucacucucgugacuuaugaucgagucgacauaauagcugcuaagcgucccagaaauggacauucucagacauuauccgggcgcuugcagggggaagggaagcgcucgcgcggcggcgcccaagcagggagagguggcacccggaccggugugagggcuuucggacgcgacccccccagccccccacccucccacccccacccccugcucaacuucucagccaacaaaguacaguggagcagcccgucucagcucuccuugcaaaaugauuggucaaaguuuuuccgacugccugauaaagcgucagcuccgacauaaaucaaucgggcgagggggcugcgcucucgcugucauccguccgcaccgcacuccauaucgaggauggauuguuuuaugcugaugcaaugugcuaucacgucagggcuccggcggccacguaaccucagccccagcuaccggccgcccggucccccccucccgcugcaggaaggggggcaguucucaacauggggcggcgggggcggaggagaggcggagggaagcggcgggcugccuugggagggacgcaggcuguagagcccucuccccaggcgggucggggagggagggagagcaagggcggagggagggagagagccccagcccggggagaagccauagaggcccgagaggauacuggaagaggaggugcuccuguccccccacacacaccuccaccccgcaggcccucauuuccucuucucuuuccccuugacaaaagauguuuauu

SEQ ID NO: 19939 - RNA, 2485 nt, Homo sapiens
cagaaaguuucuucuucccucccguucccuccucaagaucucccagaucccuguuucacagaaaauuuuugcuuauuuguuuaaugagaggaaguuuugugacuggccagggcagggcagagagggcagggcagagaagggaccuuuugggggcuccagagaaggggugggggcaggugcuugccaggacggaaggaggugaaaaucucagaaaagucaccguuugugccaaaaaaaaauccccauaaucauucucauuucggcuucgucacccccaccgugcugcaaucgggcggcgggggcgaucgaagcugcaguuuuauagcuguagaggaaagaacucguaaaaugcuaacagcuuuuaugcgcugcggcauaaacaacaacagacuccggcuuuauugcguuuuauaguuucuuaaagaguuuacagccguuuuuuggggggccgguuauccagccaauucccuccacacgauaguuaaaccuuuaucaauaauaaggaaauugaucauuaaagcuuuaaauaugacuaccucguuuguuugaaaauacguuuaggagaggaagcuguaugauuugauaacuuguauuaaaauaccaauuacauuuauaggaccuuuuaaaacucggcgcaauuaaaccguguucuuuuacauuuuuccgaagcgacccugacauuuagaaagacuccaauugccucguuaaaaucgcgaaauuaacagcgugccuacgccuggcgcguuguguaugugugugugcguguuuuuuuccgugacucccccacaucagucuuuggggguggucugcgaagguauuugauuuguugugaggcgagagauaucucauuaauguagguaguuaaacagauuuaauccguauucauucucucucacccccucucccucucccccucucucucccccucucccccucucucucccuggguguuuuuuucuuccccuccuuuuuuuuuuuccgcucucuccucacucccuggcgcucucucgcucuagcucucucucucgcucgcucucucucgcucucacccucgcucugcguucuguccgggaggaguacgaagaagccaauaggaugcggggucucuaauggaugcaaaugaucaugaaaagacagugcaaaauaugaaacaacucauuugcagggaaguaaaucaccgaaaacuguuuaugaacuggcaucccuucuucgaaauguaaagcgaggaccucuuuaaguggugguauauuuuuguuuggggggugggggguggggggagggcgagcgagccgcggcugccaugcaagcuuagacuuuuggaggcuucucuguccuuuucuauuccuggaaaccacaaaaagugugucggcuucgagaucuucuucgccuuuucuuucuuuucuuuuuuucccuccucucuuucccucuccuuuccuggcgagggugacuaggagccggcgaauccgcguuuuuuucucucucucccucccuuucccccuccccacccccuccccaacagcccccaacuauagccuccgccgccgccgccgccucaaaauucaauaaaaugagcucuuauuucgucaacucacuguucuccaaauacaaaaccggggagucccugcgccccaauuauuaugacugcggcuucgcccaggaccugggcggccgacccaccgugguguacggucccagcagcggcggcagcuuccagcacccgucgcaaauccaggaguucuaccacgggccgucgucgcuguccacggcucccuaccagcagaacccgugcgccguggcgugccacggggaccccggcaauuucuacggcuacgacccgcugcaacgccagagccuauucggugcgcaggauccagaccuggugcaguacgcagacugcaagcuugccgccgccagcggccugggcgaggaggccgagggcuccgagcagagcccgucgcccacacagcucuuccccuggaugcgcccgcaaggugagcucgccucggggccgacaagggcaggagggggccggaagggcccaaggccuggcaggccggggcgcauuuccuccagcuucuggaagacuugccggcuccguuccgaucgccugccgcuuuuccccuuucuuucuuaucuuucuuucuucuuucuuuuuucuuucccuugaagggggucgcuuagaaacauuuccugaaucuauaaaccccucauccugccuuacuuuucuucuucuucuccuccuuuuuuuccccuuuuacuguuuuaugggggguagugaagagaggguggugggagugggggcgcucaacuuuugcacuucucaauugcuuuauaguuuaauuacccugaagaaacuuuucuucuggggcagaggcucugggggcuuuucaagguggguccauucguccccacccggcuuuuuuauucuuauuuuccccccuccuucacauccuuccuccuaaaguuuauggcacuucuaauagau

SEQ ID NO: 19940 - RNA, 2485 nt, Homo sapiens
aucuauuagaagugccauaaacuuuaggaggaaggaugugaaggaggggggaaaauaagaauaaaaaagccggguggggacgaauggacccaccuugaaaagcccccagagccucugccccagaagaaaaguuucuucaggguaauuaaacuauaaagcaauugagaagugcaaaaguugagcgcccccacucccaccacccucucuucacuaccccccauaaaacaguaaaaggggaaaaaaaggaggagaagaagaagaaaaguaaggcaggaugagggguuuauagauucaggaaauguuucuaagcgacccccuucaagggaaagaaaaaagaaagaagaaagaaagauaagaaagaaaggggaaaagcggcaggcgaucggaacggagccggcaagucuuccagaagcuggaggaaaugcgccccggccugccaggccuugggcccuuccggcccccuccugcccuugucggccccgaggcgagcucaccuugcgggcgcauccaggggaagagcugugugggcgacgggcucugcucggagcccucggccuccucgcccaggccgcuggcggcggcaagcuugcagucugcguacugcaccaggucuggauccugcgcaccgaauaggcucuggcguugcagcgggucguagccguagaaauugccgggguccccguggcacgccacggcgcacggguucugcugguagggagccguggacagcgacgacggcccgugguagaacuccuggauuugcgacgggugcuggaagcugccgccgcugcugggaccguacaccacggugggucggccgcccagguccugggcgaagccgcagucauaauaauuggggcgcagggacuccccgguuuuguauuuggagaacagugaguugacgaaauaagagcucauuuuauugaauuuugaggcggcggcggcggcggaggcuauaguugggggcuguuggggaggggguggggagggggaaagggagggagagagagaaaaaaacgcggauucgccggcuccuagucacccucgccaggaaaggagagggaaagagaggagggaaaaaaagaaaagaaagaaaaggcgaagaagaucucgaagccgacacacuuuuugugguuuccaggaauagaaaaggacagagaagccuccaaaagucuaagcuugcauggcagccgcggcucgcucgcccuccccccaccccccaccccccaaacaaaaauauaccaccacuuaaagagguccucgcuuuacauuucgaagaagggaugccaguucauaaacaguuuucggugauuuacuucccugcaaaugaguuguuucauauuuugcacugucuuuucaugaucauuugcauccauuagagaccccgcauccuauuggcuucuucguacuccucccggacagaacgcagagcgagggugagagcgagagagagcgagcgagagagagagcuagagcgagagagcgccagggagugaggagagagcggaaaaaaaaaaaggaggggaagaaaaaaacacccagggagagagagggggagagggggagagagagggggagagggagagggggugagagagaaugaauacggauuaaaucuguuuaacuaccuacauuaaugagauaucucucgccucacaacaaaucaaauaccuucgcagaccacccccaaagacugaugugggggagucacggaaaaaaacacgcacacacacauacacaacgcgccaggcguaggcacgcuguuaauuucgcgauuuuaacgaggcaauuggagucuuucuaaaugucagggucgcuucggaaaaauguaaaagaacacgguuuaauugcgccgaguuuuaaaagguccuauaaauguaauugguauuuuaauacaaguuaucaaaucauacagcuuccucuccuaaacguauuuucaaacaaacgagguagucauauuuaaagcuuuaaugaucaauuuccuuauuauugauaaagguuuaacuaucguguggagggaauuggcuggauaaccggccccccaaaaaacggcuguaaacucuuuaagaaacuauaaaacgcaauaaagccggagucuguuguuguuuaugccgcagcgcauaaaagcuguuagcauuuuacgaguucuuuccucuacagcuauaaaacugcagcuucgaucgcccccgccgcccgauugcagcacggugggggugacgaagccgaaaugagaaugauuauggggauuuuuuuuuggcacaaacggugacuuuucugagauuuucaccuccuuccguccuggcaagcaccugcccccaccccuucucuggagcccccaaaaggucccuucucugcccugcccucucugcccugcccuggccagucacaaaacuuccucucauuaaacaaauaagcaaaaauuuucugugaaacagggaucugggagaucuugaggagggaacgggagggaagaagaaacuuucug

SEQ ID NO: 19941 - RNA, 2567 nt, Homo sapiens
aucuccgcccgcauaucuggggcaccaagagagacagagucgugagccaggcucgccucauuccucgucuugggagaaccggaccaacuuccccaaaaggccuugccgugcagaauuggccugguuuaauaaagaacagaccugccccaagcacccacccacccaguugcgugcauucaaucccugcguuugucucucgcucgguaacgggcugaagaggauggguggagggugacacggaucgccccgagguuauuuauuuucccuuccacucaaucucuuccuccccaaaucucgccugcaagcggccuccagcccgcgggagucggcagcggcccuugagcccccagccccaauccacagggcucggcuuucccauucauuauugaucauauuuuauaaauccaacgccacacaauuuuuuccacauuaccgggagccguggggagacggcccggccauuggcggaggggacgucacgugggcggggucacgugguccggagaggaaaaaggggguccuuuuugguguaaaucuggacucuaauucuguaauauaucaaggaaucucguaaaaccgacacuaaaacgucccugccuacaaaucauccggccaaauuaugaguucauuguauuaugcgaauacuuuauuuucuaaauauccagccucaaguucgguuuucgcuaccggagccuucccagaacaaacuucuugugcguuugcuuccaacccccagcgcccgggcuauggagcggguucgggcgcuuccuucgccgccucgaugcagggcuuguaccccggcggggggggcauggcgggccagagcgcggccggcgucuacgcggccggcuaugggcucgagccgaguuccuucaacaugcacugcgcgcccuuugagcagaaccucuccggggugugucccggcgacuccgccaaggcggcgggcgccaaggagcagagggacucggacuuggcggccgagaguaacuuccggaucuaccccuggaugcgaagcucagguaacgccgcgcaccgagcuguccugagccccaggggccggggcacauuacccugaaggcgccuccuucccggcugggcgccccuuuccgcguccagagugcucccagccggaggucggcccuggaaggcugcacccacugggccgcgacccagcaggccauccccgcccccauauuugcucggugcucucaggcucgcucugcuucccggcggaucucucuucgccggcaccacggcgcugcgagcccccagcccgcccccacccuuccucucggccuuuuagcuuuaaauauuuaucagcagcgccggcacgggcuggagacgaggccguuugucuugcggaggaaggccgguguuugcagagaauagccauuagggucucccccuucuccccccuucccagcuaaggaucucagcccugggugugucccccugccccacucggauaagguaugggggagggggccauagcgcuaagcaauucuccccucccccuuccucuccagccaaccccgcucccccauuauucccaucaggacaauuagaggugggcucuagaggccuggcgggaggagaaaaggacccagccagggacacagagcuagagaggcagguggagggagggggcugaggccaaaggagaugauccuccugaucccagugaaccugggugggggaguggaacaggagaacuagaaaggggcagaggcuucaugggagugcagcuggcuuccugaggugcucuuccuagggcuccuaggaaccccuaaagaacuggccaaguuuggaggugucauuccagauaagugacccuuuucuugggggaggggcuaggacucucuggagccaauucaaaaauuagagagugcaguucaccuagccagcugcugcagaaccccaagaggcugagguuccauggggucccugccgagucugacccagacauccuuuucugcacuguuccaaagcagacgaacuuaggggcuagccccaaaguccagaagacccaagacucauggucagaggcacccaacccagcaauggucaggggccagaagcagcccagcucucauaccaucaguauuagugguuauaggucccauuaccugcuccauaguuuaacugccuuuccaguugauuuaucaaagccccauuuuuucugcucaucagcauuucagcuuggcuuuuaucugacuugaaacuagggccccuagccccuccucccuugucuccuucccaggagggcugacaucagcaccucuuuaaagucuccucagguucugguccuaaugcagaaguuccccucuacccuucaguccccaccacccagauacuccauguuccauccuaucccaggcugcugucucuccuuuuccccugugcauuccuggaggcccaaggauugcuuuagagagcugggcugucuaggcaagcaggcaagcaggacagccuggcccuggcugaagcuuagccacucacuggaaaagaaucaucagagggucacugcugucagaccaacucuuugcuccaaggaaaucugcaaauuc

SEQ ID NO: 19942 - RNA, 2567 nt, Homo sapiens
gaauuugcagauuuccuuggagcaaagaguuggucugacagcagugacccucugaugauucuuuuccagugaguggcuaagcuucagccagggccaggcuguccugcuugccugcuugccuagacagcccagcucucuaaagcaauccuugggccuccaggaaugcacaggggaaaaggagagacagcagccugggauaggauggaacauggaguaucugggugguggggacugaaggguagaggggaacuucugcauuaggaccagaaccugaggagacuuuaaagaggugcugaugucagcccuccugggaaggagacaagggaggaggggcuaggggcccuaguuucaagucagauaaaagccaagcugaaaugcugaugagcagaaaaaauggggcuuugauaaaucaacuggaaaggcaguuaaacuauggagcagguaaugggaccuauaaccacuaauacugaugguaugagagcugggcugcuucuggccccugaccauugcuggguugggugccucugaccaugagucuugggucuucuggacuuuggggcuagccccuaaguucgucugcuuuggaacagugcagaaaaggaugucugggucagacucggcagggaccccauggaaccucagccucuugggguucugcagcagcuggcuaggugaacugcacucucuaauuuuugaauuggcuccagagaguccuagccccucccccaagaaaagggucacuuaucuggaaugacaccuccaaacuuggccaguucuuuagggguuccuaggagcccuaggaagagcaccucaggaagccagcugcacucccaugaagccucugccccuuucuaguucuccuguuccacucccccacccagguucacugggaucaggaggaucaucuccuuuggccucagcccccucccuccaccugccucucuagcucugugucccuggcuggguccuuuucuccucccgccaggccucuagagcccaccucuaauuguccugaugggaauaaugggggagcgggguuggcuggagaggaagggggaggggagaauugcuuagcgcuauggcccccucccccauaccuuauccgaguggggcagggggacacacccagggcugagauccuuagcugggaaggggggagaagggggagacccuaauggcuauucucugcaaacaccggccuuccuccgcaagacaaacggccucgucuccagcccgugccggcgcugcugauaaauauuuaaagcuaaaaggccgagaggaagggugggggcgggcugggggcucgcagcgccguggugccggcgaagagagauccgccgggaagcagagcgagccugagagcaccgagcaaauaugggggcggggauggccugcugggucgcggcccagugggugcagccuuccagggccgaccuccggcugggagcacucuggacgcggaaaggggcgcccagccgggaaggaggcgccuucaggguaaugugccccggccccuggggcucaggacagcucggugcgcggcguuaccugagcuucgcauccagggguagauccggaaguuacucucggccgccaaguccgagucccucugcuccuuggcgcccgccgccuuggcggagucgccgggacacaccccggagagguucugcucaaagggcgcgcagugcauguugaaggaacucggcucgagcccauagccggccgcguagacgccggccgcgcucuggcccgccaugccccccccgccgggguacaagcccugcaucgaggcggcgaaggaagcgcccgaacccgcuccauagcccgggcgcuggggguuggaagcaaacgcacaagaaguuuguucugggaaggcuccgguagcgaaaaccgaacuugaggcuggauauuuagaaaauaaaguauucgcauaauacaaugaacucauaauuuggccggaugauuuguaggcagggacguuuuagugucgguuuuacgagauuccuugauauauuacagaauuagaguccagauuuacaccaaaaaggacccccuuuuuccucuccggaccacgugaccccgcccacgugacguccccuccgccaauggccgggccgucuccccacggcucccgguaauguggaaaaaauuguguggcguuggauuuauaaaauaugaucaauaaugaaugggaaagccgagcccuguggauuggggcugggggcucaagggccgcugccgacucccgcgggcuggaggccgcuugcaggcgagauuuggggaggaagagauugaguggaagggaaaauaaauaaccucggggcgauccgugucacccuccacccauccucuucagcccguuaccgagcgagagacaaacgcagggauugaaugcacgcaacugggugggugggugcuuggggcaggucuguucuuuauuaaaccaggccaauucugcacggcaaggccuuuuggggaaguugguccgguucucccaagacgaggaaugaggcgagccuggcucacgacucugucucucuuggugccccagauaugcgggcggagau

SEQ ID NO: 19943 - RNA, 2465 nt, Homo sapiens
uucugaaaacacaauuaacuuuuuccaauccugcguggggugggggagagacauauuuauuuaaucacccgggagugggguggucucaaucuaaacguucccuccucccucaaaggcacugagccuguuucacagauccuacguagguggaacaggacgcguuguguuguuggggggagagaggagaaaggcgaaggagaaggaggaaaaaaaaaaagguugauagguuugugcgcgggucccucgugcgggcugcgcuccuccugggugcuauuugacaauuccugccucugccauuggucaguguuggaucagaugguuguauuuccuucuggcccucacuggcaccucgccauccccccucagcuaaaacccaaucucggauauacuacuaauaggcgcggcgcucggacuauaaaacacaacaaaucauaaacccggcggagcagcagcggccgcgcgcgccuccccucccaaugaguuccuauuucgugaacuccaccuuccccgucacucuggccagcgggcaggaguccuuccugggccagcuaccgcucuauucgucgggcuaugcggacccgcugagacauuaccccgcgcccuacgggccagggccgggccaggacaagggcuuugccacuuccuccuauuacccgccggcgggcgguggcuacggccgagcggcgcccugcgacuacgggccggcgccggccuucuaccgcgagaaagagucggccugcgcacucuccggcgccgacgagcagcccccguuccaccccgagccgcggaagucggacugcgcgcaggacaagagcguguucggcgagacagaagagcagaagugcuccacuccggucuacccguggaugcagcggaugaauucgugcaacagugagugagacuucccgucgccgucgccccggcuccccugggcgcccaccccgggacacagaacuagugagcgcccccugccccaaucucccacagggugcugggugggcaucucaguuaggagauagaagaagauugggcgccggccgggggucucucgcuguguccccuauuaggcaggaguuacaaaguuugcaaagucccagccgcacugggagccauggggagcaagugugcucuccuggggcgccuggccagagccgggguuccaggacagggaagggagcaggagccugcagucacuggcuuggcuuuacuuugagcccccaaccccccucucccagcccugguaggguuccccaaccaaagacggcuccauuaaaaacggagugcgucaugcaaggggguagggggugacgcugaagagaaagaguugagucugucugggacuguguuucccuguggguggggagcuggggcaagaugaggcaccaggaaaggggugguagucagaggagggaggaggaauaaggggaaggaagagagagggagcaggcggagcgagagagggagaaacaggcgcggggucucagguuggauuauuuguuggccuuaagucccaacugauguccauuagccggacucgaaagugaggagccguuaauguggacuauggaucgaucuacgucauuacggauuaacggccuggauuuaucauuggguuggggggaugacggggggugggaacaagauggauggaaagggagggaaagacaagaugcaacuaggaagagacacaccugaccagccccuccccccaggcucaggugggaguucaaacugcuccuccccucccccaucuagagucuagacagacggcacaggccuaggagacuaggagggaaucuggagggggcgcuggaggagugcgaaacgggggaagggagccggcagaauagagggcaucccgguacuggcuggagucuguguucgagggucgacuaggggaggggguccugggcccggugaccgcaggccucagcaucuccacucugcguaacagguuccuccuuugggcccagcggccggcgaggccgccagacauacacacguuaccagacgcuggagcuggagaaggaguuucacuacaaucgcuaccugacgcggcggcggcgcaucgagaucgcgcacgcccugugccugacggagaggcagaucaagauaugguuccagaaccgacgcaugaaguggaaaaaggagagcaaacugcucagcgcgucucagcucagugccgaggaggaggaagaaaaacaggccgagugaaggugcuggaaagggagggaggacgcgaggggaaaggccuguggggagccgagggcgucagagagacccgggaaggaaggcucucgggugggggagccaggagaccugcucuccggcgcagacaggcggggcccagcgcucuccuggacgcccccgcccgcacagcucccggcgggugcucugaggccucacuacucgagcccacccagcaucccgcgcgcccuuccuucccgaggaacucgccucagccu

SEQ ID NO: 19944 - RNA, 2465 nt, Homo sapiens
aggcugaggcgaguuccucgggaaggaagggcgcgcgggaugcugggugggcucgaguagugaggccucagagcacccgccgggagcugugcgggcgggggcguccaggagagcgcugggccccgccugucugcgccggagagcaggucuccuggcucccccacccgagagccuuccuucccgggucucucugacgcccucggcuccccacaggccuuuccccucgcguccucccucccuuuccagcaccuucacucggccuguuuuucuuccuccuccucggcacugagcugagacgcgcugagcaguuugcucuccuuuuuccacuucaugcgucgguucuggaaccauaucuugaucugccucuccgucaggcacagggcgugcgcgaucucgaugcgccgccgccgcgucagguagcgauuguagugaaacuccuucuccagcuccagcgucugguaacguguguaugucuggcggccucgccggccgcugggcccaaaggaggaaccuguuacgcagaguggagaugcugaggccugcggucaccgggcccaggacccccuccccuagucgacccucgaacacagacuccagccaguaccgggaugcccucuauucugccggcucccuucccccguuucgcacuccuccagcgcccccuccagauucccuccuagucuccuaggccugugccgucugucuagacucuagaugggggaggggaggagcaguuugaacucccaccugagccuggggggaggggcuggucaggugugucucuuccuaguugcaucuugucuuucccucccuuuccauccaucuuguucccaccccccgucauccccccaacccaaugauaaauccaggccguuaauccguaaugacguagaucgauccauaguccacauuaacggcuccucacuuucgaguccggcuaauggacaucaguugggacuuaaggccaacaaauaauccaaccugagaccccgcgccuguuucucccucucucgcuccgccugcucccucucucuuccuuccccuuauuccuccucccuccucugacuaccaccccuuuccuggugccucaucuugccccagcuccccacccacagggaaacacagucccagacagacucaacucuuucucuucagcgucacccccuacccccuugcaugacgcacuccguuuuuaauggagccgucuuugguuggggaacccuaccagggcugggagagggggguugggggcucaaaguaaagccaagccagugacugcaggcuccugcucccuucccuguccuggaaccccggcucuggccaggcgccccaggagagcacacuugcuccccauggcucccagugcggcugggacuuugcaaacuuuguaacuccugccuaauaggggacacagcgagagacccccggccggcgcccaaucuucuucuaucuccuaacugagaugcccacccagcacccugugggagauuggggcagggggcgcucacuaguucugugucccggggugggcgcccaggggagccggggcgacggcgacgggaagucucacucacuguugcacgaauucauccgcugcauccacggguagaccggaguggagcacuucugcucuucugucucgccgaacacgcucuuguccugcgcgcaguccgacuuccgcggcucgggguggaacgggggcugcucgucggcgccggagagugcgcaggccgacucuuucucgcgguagaaggccggcgccggcccguagucgcagggcgccgcucggccguagccaccgcccgccggcggguaauaggaggaaguggcaaagcccuuguccuggcccggcccuggcccguagggcgcgggguaaugucucagcggguccgcauagcccgacgaauagagcgguagcuggcccaggaaggacuccugcccgcuggccagagugacggggaagguggaguucacgaaauaggaacucauugggaggggaggcgcgcgcggccgcugcugcuccgccggguuuaugauuuguuguguuuuauaguccgagcgccgcgccuauuaguaguauauccgagauuggguuuuagcugaggggggauggcgaggugccagugagggccagaaggaaauacaaccaucugauccaacacugaccaauggcagaggcaggaauugucaaauagcacccaggaggagcgcagcccgcacgagggacccgcgcacaaaccuaucaaccuuuuuuuuuuuccuccuucuccuucgccuuucuccucucuccccccaacaacacaacgcguccuguuccaccuacguaggaucugugaaacaggcucagugccuuugagggaggagggaacguuuagauugagaccaccccacucccgggugauuaaauaaauaugucucucccccaccccacgcaggauuggaaaaaguuaauuguguuuucagaa

SEQ ID NO: 19945 - RNA, 2449 nt, Homo sapiens
uucucauccaaaguuaaaauaauaacgacaaugaugauguagggagaaagaaccaaauagagaggcuaaccccacccacaagaaaguggguaaaaagcccaaccccugcucuaaaaggcucaacccuguggcugagccuuggccggguuucuuucucucccggcgacugcagggagccugcagggagccagcagggaggcagccgcccgccgccauggcggucucacgcccgcgcucccgucggucgccgggagguggcgcgcucugcucagaggccaaagccaaccuucucucuguuucucccccuucuccuuuuuucccccucucucggaggcucgcauugaaucggcccuaacgauucucggaucgucauuauuuguaaccauagagcaugaauuaccucuugaggucaucagcgagaauuuacgacuggucaacaaaagcacgugauucccuaacgccccccaccccccuuccaaccccccccccauauuuggccgcauacauagcaaaacgaaguacagugcaucgcuauaauucauuaauacaucauaaaucgugaagcacaggguuauaacgaccacgauccacaaaucaagcccuccaaaaucacccaaaugagcucguacuuuguaaacuccuucucggggcguuauccaaauggcccggacuaucaguugcuaaauuauggcaguggcagcucucugagcggcucuuacagggaucccgcugccaugcacaccggcucuuacggcuacaauuacaaugggauggaccucagcgucaaccgcuccucggccuccuccagccacuuuggggcggugggcgagagcucgcgcgccuuccccgcgcccgcccaggagccccgcuucaggcaagcggcuucgagcugcucccuguccucgcccgagucccugcccugcaccaacggcgacagccacggcgccaagcccucugcuucgucccccuccgaccaggcgaccucagccagcuccagcgccaauuucaccgaaauagacgaggccagcgcguccucggagccugaggaagcggcaagccagcuaagcagccccagccuagcucgggcgcagccagagcccauggccaccuccacagccgcgcccgaggggcagacuccgcaaauauuccccuggaugaggaagcuucacaucagccaugguaauucucucucucuuuuuugucuucucggcuuuccuucucugcguuuuggggugggaucggggggacaaggagagcuuggcuuuacccuaaauauagauucauuuuucuaagggggagaaguaucuaagaggggccucauagcuucguagacagagccaaaaagggucucucuguuaagagggggguauuuuuaauaauuuguuuccagcuucggcuuagguuuuuauuagcgcagcugaaccagcuuuaggauaaaggaugggguucauauaauguggggaaggguccugcuuaccccugaaauuuugagacugucgcuagcaaagaaggggugaacaguaaaaggagcuuuccggggcaaaagugcaaccgcucuccucccucccggggcgagcggccgccugagcccagccaagggugaggcacuaggagcgagcaagagacaaagccgggcgcacuggcugccugcagaagugggggaugcaguagaaaggggugcagaaaucgagcuugaaugugggcaucuggaguagagaggauuggagcuguggugagcugggugccgggacgccuggguccugcucccccgcccccucccacccagugcccccucccuuaaccggaauaauguugccuugcggcuuuccucuaucugcuccagauaugaccgggccggacgggaaaagggcccggaccgcguauacccgcuaccagacccuggagcuggaaaaggaguuccacuucaaccgcuaccugacccggcgacggcgcaucgagaucgcccacgcacucugccuguccgagcgccagaucaagaucugguuccagaaccggcgcaugaaguggaagaaggacaacaaauugaaaaguaugagccuggcuacagcuggcagcgccuuccagcccugagcccgcccagaggagcccagcggcccaagagcccgugccacccccagcccuggccccuccaauccuccccgcucugccgccgcccgcuggggaccgguucccacaagccugccucgccuuguguuacgauauuucguuuggucuuaggucuuccuguggcucccucucuccuggacugguuaucuuguuauuauuguuaauaauaauuauuauuauuauuuuccuuccaugcucccaacucccuucugcuugucccaaauccgccaguguuucugaauguuugugucugugguugcagucuuucccccaggaaaaaaaaaaaaagaaauucgcauguuuaaugugaacucuccccucc

SEQ ID NO: 19946 - RNA, 2449 nt, Homo sapiens
ggaggggagaguucacauuaaacaugcgaauuucuuuuuuuuuuuuuccugggggaaagacugcaaccacagacacaaacauucagaaacacuggcggauuugggacaagcagaagggaguugggagcauggaaggaaaauaauaauaauaauuauuauuaacaauaauaacaagauaaccaguccaggagagagggagccacaggaagaccuaagaccaaacgaaauaucguaacacaaggcgaggcaggcuugugggaaccgguccccagcgggcggcggcagagcggggaggauuggaggggccagggcuggggguggcacgggcucuugggccgcugggcuccucugggcgggcucagggcuggaaggcgcugccagcuguagccaggcucauacuuuucaauuuguuguccuucuuccacuucaugcgccgguucuggaaccagaucuugaucuggcgcucggacaggcagagugcgugggcgaucucgaugcgccgucgccgggucagguagcgguugaaguggaacuccuuuuccagcuccagggucugguagcggguauacgcgguccgggcccuuuucccguccggcccggucauaucuggagcagauagaggaaagccgcaaggcaacauuauuccgguuaagggagggggcacugggugggagggggcgggggagcaggacccaggcgucccggcacccagcucaccacagcuccaauccucucuacuccagaugcccacauucaagcucgauuucugcaccccuuucuacugcaucccccacuucugcaggcagccagugcgcccggcuuugucucuugcucgcuccuagugccucacccuuggcugggcucaggcggccgcucgccccgggagggaggagagcgguugcacuuuugccccggaaagcuccuuuuacuguucaccccuucuuugcuagcgacagucucaaaauuucagggguaagcaggacccuuccccacauuauaugaaccccauccuuuauccuaaagcugguucagcugcgcuaauaaaaaccuaagccgaagcuggaaacaaauuauuaaaaauaccccccucuuaacagagagacccuuuuuggcucugucuacgaagcuaugaggccccucuuagauacuucucccccuuagaaaaaugaaucuauauuuaggguaaagccaagcucuccuuguccccccgaucccaccccaaaacgcagagaaggaaagccgagaagacaaaaaagagagagagaauuaccauggcugaugugaagcuuccucauccaggggaauauuugcggagucugccccucgggcgcggcuguggagguggccaugggcucuggcugcgcccgagcuaggcuggggcugcuuagcuggcuugccgcuuccucaggcuccgaggacgcgcuggccucgucuauuucggugaaauuggcgcuggagcuggcugaggucgccuggucggagggggacgaagcagagggcuuggcgccguggcugucgccguuggugcagggcagggacucgggcgaggacagggagcagcucgaagccgcuugccugaagcggggcuccugggcgggcgcggggaaggcgcgcgagcucucgcccaccgccccaaaguggcuggaggaggccgaggagcgguugacgcugagguccaucccauuguaauuguagccguaagagccggugugcauggcagcgggaucccuguaagagccgcucagagagcugccacugccauaauuuagcaacugauaguccgggccauuuggauaacgccccgagaaggaguuuacaaaguacgagcucauuugggugauuuuggagggcuugauuuguggaucguggucguuauaacccugugcuucacgauuuaugauguauuaaugaauuauagcgaugcacuguacuucguuuugcuauguaugcggccaaauaugggggggggguuggaagggggguggggggcguuagggaaucacgugcuuuuguugaccagucguaaauucucgcugaugaccucaagagguaauucaugcucuaugguuacaaauaaugacgauccgagaaucguuagggccgauucaaugcgagccuccgagagagggggaaaaaaggagaagggggagaaacagagagaagguuggcuuuggccucugagcagagcgcgccaccucccggcgaccgacgggagcgcgggcgugagaccgccauggcggcgggcggcugccucccugcuggcucccugcaggcucccugcagucgccgggagagaaagaaacccggccaaggcucagccacaggguugagccuuuuagagcagggguugggcuuuuuacccacuuucuugugggugggguuagccucucuauuugguucuuucucccuacaucaucauugucguuauuauuuuaacuuuggaugagaa

SEQ ID NO: 19947 - RNA, 2480 nt, Homo sapiens
acaugguuugggaguucugggcaaaguauggaagcuggauuccccaccuccagguccacagacuuagggggaagguuucucugaggggugggaagagugaggggcagcuggcuugaauuuguccaaaucuaauaacccaggagccuauugaaggccuuggggguugggagggaaggaaagucuugaauauucuccuaacuuuuucccccucucccucuggucccuucuuuccaaaagucuuugaagaaagauguuuuugacgcuuccaugucgcucucagauggaugggcugcgggugauugaagugucuuugucaugcuaaugcuuggggggugauggaugggcgcuggggcugccaaacucuggcccgcuuagcccauuggccugggagagaucacaugugcccccucacccccacucccuacccccuuccuagggaagcgcuugcccaggcgagcgggucaggccauggauucgagccccagcgcugugacauacugccgaaagguuguagggcaagagggugucucccccaaacgggccgacccuccugcggccuugacgcauggacuauaauaggaugaacuccuucuuagaguacccacucuguaaccggggacccagcgccuacagcgcccacagcgccccaaccuccuuucccccaagcucggcucaggcgguugacagcuaugcaagcgagggccgcuacgguggggggcuguccagcccugcguuucagcagaacuccggcuaucccgcccagcagccgccuucgacccugggggugcccuuccccagcuccgcgcccucgggguaugcuccugccgccugcagccccagcuacgggccuucucaguacuacccucugggucaaucagaaggagacggaggcuauuuucaucccucgagcuacggggcccagcuagggggcuuguccgauggcuacggagcagguggagccgguccggggccauauccuccgcagcaucccccuuaugggaacgagcagaccgcgagcuuugcaccggccuaugcugaucuccucuccgaggacaaggaaacacccugcccuucagaaccuaacacccccacggcccggaccuucgacuggaugaagguuaagagaaacccacccaagacagguagggcucagauguggccaccccuucuccggggcccaaagcaucucugcuuccccugcagugacauguccugggucugggcuggguucuucucuuucagcggcucugguagacacagguaagagcacaaccuacgucucaggucaggugaggucuccccacccaguauguaaccggucaccccaggaguaaguuuccauacacaccccacuuccugaucugugcacccagcacagacccaggaccuggugugcaugggggauggaaguauggggaaggcugcuccagacuuggugaucaccauggggguaccugguggucccugggaacuuugacaacuguacuugggcagaauggcaaauggagguccagagccagccccgggaggagggaagcggaaggagaaagaggugagagaauugaccuggccuuucucccugccccgccccuagcgaaggugucagagccaggccugggcucgcccaguggccuccgcaccaacuucaccacaaggcagcugacagaacuggaaaaggaguuccauuucaacaaguaccugagccgggcccggaggguggagauugccgccacccuggagcucaaugaaacacaggucaagauuugguuccagaaccgacgaaugaagcagaagaagcgcgagcgagaggaaggucggguccccccagccccaccaggcugccccaaggaggcagcuggagaugccucagaccagucgacaugcaccuccccggaagccucacccagcucugucaccuccugaacugaaccuagccaccaauggggcuuccaggcacuggagcgccccaguccagcccuaucccaggcucuccccaaccccaggccugggcuucacuggccuggggauccucucuagggcugaaaugccaguuuagagcugccugggggugggaggggggauggggaaacauuuuucucagaccuggguggcugggggcccuacaggaccagaggccugggaggcauggaaccugucaaauguagagggaagggcuucugccuuugaucuggggaucagcucagugucaacauguggugggggugggggccagccucauccuccuggauucauccuccuuucccuuccaacuuggguuuauucgguucagugccuucgagcuuugaggagucuccucacgcacucuuauccuaacucccccuucuaggccugacacagaaccuuaaauuuucuugugugggagguguuugggugcagccauauuauuaucaaugcuuaauccagucaccacagaccuuacaauagcaccagcugccuugugacagaccaaaaagcccccc

SEQ ID NO: 19948 - RNA, 2480 nt, Homo sapiens
ggggggcuuuuuggucugucacaaggcagcuggugcuauuguaaggucuguggugacuggauuaagcauugauaauaauauggcugcacccaaacaccucccacacaagaaaauuuaagguucugugucaggccuagaagggggaguuaggauaagagugcgugaggagacuccucaaagcucgaaggcacugaaccgaauaaacccaaguuggaagggaaaggaggaugaauccaggaggaugaggcuggcccccacccccaccacauguugacacugagcugauccccagaucaaaggcagaagcccuucccucuacauuugacagguuccaugccucccaggccucugguccuguagggcccccagccacccaggucugagaaaaauguuuccccauccccccucccacccccaggcagcucuaaacuggcauuucagcccuagagaggauccccaggccagugaagcccaggccugggguuggggagagccugggauagggcuggacuggggcgcuccagugccuggaagccccauugguggcuagguucaguucaggaggugacagagcugggugaggcuuccggggaggugcaugucgacuggucugaggcaucuccagcugccuccuuggggcagccugguggggcuggggggacccgaccuuccucucgcucgcgcuucuucugcuucauucgucgguucuggaaccaaaucuugaccuguguuucauugagcuccaggguggcggcaaucuccacccuccgggcccggcucagguacuuguugaaauggaacuccuuuuccaguucugucagcugccuuguggugaaguuggugcggaggccacugggcgagcccaggccuggcucugacaccuucgcuaggggcggggcagggagaaaggccaggucaauucucucaccucuuucuccuuccgcuucccuccucccggggcuggcucuggaccuccauuugccauucugcccaaguacaguugucaaaguucccagggaccaccagguacccccauggugaucaccaagucuggagcagccuuccccauacuuccaucccccaugcacaccagguccugggucugugcugggugcacagaucaggaagugggguguguauggaaacuuacuccuggggugaccgguuacauacuggguggggagaccucaccugaccugagacguagguugugcucuuaccugugucuaccagagccgcugaaagagaagaacccagcccagacccaggacaugucacugcaggggaagcagagaugcuuugggccccggagaagggguggccacaucugagcccuaccugucuuggguggguuucucuuaaccuucauccagucgaagguccgggccguggggguguuagguucugaagggcaggguguuuccuuguccucggagaggagaucagcauaggccggugcaaagcucgcggucugcucguucccauaagggggaugcugcggaggauauggccccggaccggcuccaccugcuccguagccaucggacaagcccccuagcugggccccguagcucgagggaugaaaauagccuccgucuccuucugauugacccagaggguaguacugagaaggcccguagcuggggcugcaggcggcaggagcauaccccgagggcgcggagcuggggaagggcacccccagggucgaaggcggcugcugggcgggauagccggaguucugcugaaacgcagggcuggacagccccccaccguagcggcccucgcuugcauagcugucaaccgccugagccgagcuugggggaaaggagguuggggcgcugugggcgcuguaggcgcuggguccccgguuacagaguggguacucuaagaaggaguucauccuauuauaguccaugcgucaaggccgcaggagggucggcccguuugggggagacacccucuugcccuacaaccuuucggcaguaugucacagcgcuggggcucgaauccauggccugacccgcucgccugggcaagcgcuucccuaggaaggggguagggagugggggugagggggcacaugugaucucucccaggccaaugggcuaagcgggccagaguuuggcagccccagcgcccauccaucaccccccaagcauuagcaugacaaagacacuucaaucacccgcagcccauccaucugagagcgacauggaagcgucaaaaacaucuuucuucaaagacuuuuggaaagaagggaccagagggagagggggaaaaaguuaggagaauauucaagacuuuccuucccucccaacccccaaggccuucaauaggcuccuggguuauuagauuuggacaaauucaagccagcugccccucacucuucccaccccucagagaaaccuucccccuaagucuguggaccuggagguggggaauccagcuuccauacuuugcccagaacucccaaaccaugu

SEQ ID NO: 19949 - RNA, 2524 nt, Homo sapiens
gccguggaagcggccggcaccgucggcgccuugcuccgugaggaaguugcgagaguugagcugcagacagccggccaccagauugguggugggcugcgacagacccuugcacagagucugcacguaggacacuaggucuggccgcuugccggagcgcaggaucuccgagagcgcccagauauaguucuuggcuaggcgcagcgucucgaucuuggacagcuucugcgucuuggaguagcagggcaccaccuugcgcagguuguccagggcugcguucaggucgugcaugcgguugcgcucccgcgcguucgccuucugccgccgaagcuuggagcgcuccaagcgcgccuuggucaucuugcgcuucuugggcccgcgcuucuugggccgcucgcccuccgccucguccaguccuucuuccuccuccucuuccuccuccuccucuccccccagcucgccuuccuccuugaccucggccaacguggccuccguccccucuucuccacggagagggacuggcuuggccgcccgggcuggccccggagccccuggcccgggcgcaggcgguggcgguggcggcgcgucgcccuugucgcuccucggcucgucgucuucgccgucgccccagcuggcgaacuugggcacguccgagagaaggccgggcucgcugaacaggcgggucagcauggugccugagggcgccccgcgggcgggaaggggagacagacagcacaaagugaggggcgcgcugggguaccgacgcccccccacaacccuccuccacccccgagucucgugcgggcuccugccuaggcuacccuggaugcccaccuccgccgccugccccgcccagagccggcccagcccuacccggcugccggccugggaucucggcccaggcccucuccccggcgcugggccccggcuccgccccucgcuugaauggggggcugcuccccgcgccugcuucuucucagggucagggcagggaccggguggggguuuuagggaccagauaucuuugccaggggaggcggcgcgcucgcccugaaagcccguucucuccuggcgguggagagaggcuggucggccgccgguggggacagcugccccgcuccgcgcucucgcggcccgggccccccggcccagcucccucaccccucccguggcucucacccccacgcucccuaauccaauuugcaacuuggcugcgcgccgccccuugcucggcccccacccccgcacccccaauuccagaggcgggaggaucgucuccucuagccgaugcguccccagcucccggagccggcucugggcggcgaggacugaagcagcggggcguggggaggagacugagagaagcgagcccaguccguccccucugcggucagggacccccuucccccuucaagcugacucccucccacaaggcucuucagaucucguuguauuuugggauugaugggggaaaaauccaaauuuguuuguuugcuucccuuuuuucggugguggggaaagguggcaggcuuuuugggacaaccauggagggguccuccgucucggccucuucgcauaucccccuccgugauccugccuuccccccccaccgagcccaucgcaggcagagacaccuccucugcagcccccugggcugcagccccuaagggagagagaaccuggggccccuccgaugcccacccaaugaggggggcaucaucccaggaaggagguauuugaggacccuccugucggccgaagcugccgccccuccucccaaccggcgggucagaucucgcucccuuucggacaacuuaccucggagaggagucaaggggagaggggaggggagggggggagggggcaagagagagaggggggagaagagggaucuucucgcuuauuucauuguucccccaucuucagggagcgggggcagcggcuccucaaggcggcgggcgccggcgucuucagagcgccaugcgaaccgcggagcgaguguggcaucucuaccaggcgggguaccagccucuaugccaggccauaugggcuuggcacgucacgggcagcagcuaucacaugagagacggugauuggcaugcgucugcacugggggagagccggcucccccgggacccgccgccaucugucacucucuacuccaaaaaaaaaaaaaaaaauuaaauaaauaaaggaaauaaauaaauauuucugccgcccuccccuccccgcccaacgcagggaaagcagggauugagaggaaggugggaggaguugcccccuguauauagagacccccucacgggaacaaugggguggcaaggcuggacacugggggcucgugguggccaauucuaugcucccucagggucccgcucuguccauuuccuccccugcaggcccccaaggugggucagggaccagaccccggguuggggagaaaggaccucugugcuugcccccacuccccaggaggguccccuuggccacaaagggacagcugagacccccucccaggauggcugua

SEQ ID NO: 19950 - RNA, 2524 nt, Homo sapiens
uacagccauccugggagggggucucagcugucccuuuguggccaaggggacccuccuggggagugggggcaagcacagagguccuuucuccccaacccggggucuggucccugacccaccuugggggccugcaggggaggaaauggacagagcgggacccugagggagcauagaauuggccaccacgagcccccaguguccagccuugccaccccauuguucccgugagggggucucuauauacagggggcaacuccucccaccuuccucucaaucccugcuuucccugcguugggcggggaggggagggcggcagaaauauuuauuuauuuccuuuauuuauuuaauuuuuuuuuuuuuuuuuggaguagagagugacagauggcggcgggucccgggggagccggcucucccccagugcagacgcaugccaaucaccgucucucaugugauagcugcugcccgugacgugccaagcccauauggccuggcauagaggcugguaccccgccugguagagaugccacacucgcuccgcgguucgcauggcgcucugaagacgccggcgcccgccgccuugaggagccgcugcccccgcucccugaagaugggggaacaaugaaauaagcgagaagaucccucuucuccccccucucucucuugcccccucccccccuccccuccccucuccccuugacuccucuccgagguaaguuguccgaaagggagcgagaucugacccgccgguugggaggaggggcggcagcuucggccgacaggaggguccucaaauaccuccuuccugggaugaugccccccucauugggugggcaucggaggggccccagguucucucucccuuaggggcugcagcccagggggcugcagaggaggugucucugccugcgaugggcucgguggggggggaaggcaggaucacggagggggauaugcgaagaggccgagacggaggaccccuccaugguugucccaaaaagccugccaccuuuccccaccaccgaaaaaagggaagcaaacaaacaaauuuggauuuuucccccaucaaucccaaaauacaacgagaucugaagagccuugugggagggagucagcuugaagggggaagggggucccugaccgcagaggggacggacugggcucgcuucucucagucuccuccccacgccccgcugcuucaguccucgccgcccagagccggcuccgggagcuggggacgcaucggcuagaggagacgauccucccgccucuggaauugggggugcgggggugggggccgagcaaggggcggcgcgcagccaaguugcaaauuggauuagggagcgugggggugagagccacgggaggggugagggagcugggccggggggcccgggccgcgagagcgcggagcggggcagcuguccccaccggcggccgaccagccucucuccaccgccaggagagaacgggcuuucagggcgagcgcgccgccuccccuggcaaagauaucuggucccuaaaacccccacccggucccugcccugacccugagaagaagcaggcgcggggagcagccccccauucaagcgaggggcggagccggggcccagcgccggggagagggccugggccgagaucccaggccggcagccggguagggcugggccggcucugggcggggcaggcggcggaggugggcauccaggguagccuaggcaggagcccgcacgagacucggggguggaggaggguugugggggggcgucgguaccccagcgcgccccucacuuugugcugucugucuccccuucccgcccgcggggcgcccucaggcaccaugcugacccgccuguucagcgagcccggccuucucucggacgugcccaaguucgccagcuggggcgacggcgaagacgacgagccgaggagcgacaagggcgacgcgccgccaccgccaccgccugcgcccgggccaggggcuccggggccagcccgggcggccaagccagucccucuccguggagaagaggggacggaggccacguuggccgaggucaaggaggaaggcgagcuggggggagaggaggaggaggaagaggaggaggaagaaggacuggacgaggcggagggcgagcggcccaagaagcgcgggcccaagaagcgcaagaugaccaaggcgcgcuuggagcgcuccaagcuucggcggcagaaggcgaacgcgcgggagcgcaaccgcaugcacgaccugaacgcagcccuggacaaccugcgcaagguggugcccugcuacuccaagacgcagaagcuguccaagaucgagacgcugcgccuagccaagaacuauaucugggcgcucucggagauccugcgcuccggcaagcggccagaccuaguguccuacgugcagacucugugcaagggucugucgcagcccaccaccaaucugguggccggcugucugcagcucaacucucgcaacuuccucacggagcaaggcgccgacggugccggccgcuuccacggc

SEQ ID NO: 19951 - RNA, 2915 nt, Homo sapiens
uggcuaugggcaccacagggccccggcacaccccugcacacucucccugccacgaugacugacacguguccucccacacacaacucggucacacucgcucccuuuccaggacacccccauucacagcgugacaggcugguacucuccccacgaccucgcaggccucucugaaacucccaguaccaggaccacgaagggguuaaagccagaguccugccuccccgcugccccucucccccucccucccccuuuauccucucugcuggacuccaucaauaaugcagcuucaaguucuggggagaccgcagggggccccccagcuggcuccccaggccuuggcucuaacucccacccuccucccagccccaggagaacacgauucuccaugcucauuggccaguuuccccuaaacccucccuccgagcacccgggcgccagucccaggcggaggggacgggcuggggaccccaaagcugggaccggagggugagcccggcagaggcagagacacacgcggagaggaggagaggcugagggagggagguggagaaggacgggagaggcagagagaggagacacgcagagacacucaggaggggagagacaccgagacgcagagacacucaggaggggagagacaccgagacgcagagacacccaggccggggagcgcgagggagcgaggcacagaccuggcucagcgagcgcggggggcgagccccgagucccgagagccugggggcgcgcccagcccgggcgccgacccuccucccgcucccgcgcccuccccucggcgggcacgguauuuuuauccgugcgcgaacagcccuccuccuccucucgccgcacagcccgccgccugcgcgggggagcccagcacagaccgccgccgggaccccgagucgcgcaccccagccccaccgcccaccccgcgcgccauggaccccaaggaccgcaagaagauccaguucucggugcccgcgcccccuagccagcucgacccccgccagguggagaugguaaggggcccgugccccaccccggcagcguacccgacacaccccgcggggcuucuucgcccucccaaggcgcugccccggccggacuggccugggggugggggcgcaaggagagccgggcucugccucggucaggacggggcgcggggccgcgugugaaguuagcuggagacucgugcaacuuuuccccgcggcuuugguccugaucccggggcaagagaguuccuggcagugaggcugggggugcggggguggggggacaggccgauuccagaccgcccaggaguggggugggggcguccuuuggucccagcacaguccccaaaggguagucagucuccuaggcuaccaccgggaccgcuccgccuggcucugucccagagcuggucagaugugagcagcgguggacacugaccuugucacccagggcaggaguaugaggcugccaccgggugaauccacuacccugccccucucuaaucccgcgugugugccugggcuggggucuccagaaccuggcucuggccuccugcugucaggccccagagccccaaccccaaggagggagagguggggagucaucacaaagccagaccucuucccacagacuacugaguccuccugagggccuucuuggggguugaggggcuuccaaaggcuggcgggugcugugacagagagcuccacuucccaucccuaguggagcaggggucacuuguugcugagcugagaugcagcuggcuccccacugagcagugaugagggggccaagucauuauggggggagauagagggcaggggguacaguccugggccuaagcagcuuugggucaugagggugucauggggagcuuggcuggggagguggcaguuucagcuuaacucaccugguucucuuugugcauuucccuggagcucaacagggaccuaauuaacugacaguuggucugauugccaagcugaggggcggggcggggaggggggcggucaguugcugcuuggcucacguagcaaggagggcaacuuuucauuucucacaaggacugggugaagaguucugcagccuuacagagacuggaaaagaagcccaaaccaaggcccccagagaggucccccaggccccuuugggucccugagccucagcuggagguggggggugccugcagugcgcuggcucagucuccuucugaaaagcuggauccagcuuguuugaagcccuugagcugaucuuaggugggcagggccacaugggugccauggcccguggggcaucuuccccagagggcccagccguggcagcuggagcuguagccagcuuuggcuuccgaggucugauguuuucagaaacuggagagaggaagggccuuggugggagaagauaggaagggagaugucuguucuggaguagccauggagugggacaggcaugggcugggagucagugacugggguuuuucucguccuuuggacuuguugugcuguguggccuuaagcacauugccaaaucucucugagcccugcuuuuucaccucuguaaaaugaggggguuaggugagcuacagaguuccuuuuggcucugacagacuuugauucaaagguucccuggggacuccaaagcacuguuuguucccugcugccugggggugggggagggcugcagguguccauccagucaccccucccuccaucuccuuagauccggcgcaggagaccaacgccugccaugcuguuccggcucucagagcacuccucaccagguaggccccucccugcccacuuagcccuggccccacccuagcucugaugccuuccuaggggcccugccaaagucccaugaacaggagucaaagcuggagacuggggaguggauaaggucugggaacccaacucuauugg

SEQ ID NO: 19952 - RNA, 2915 nt, Homo sapiens
ccaauagaguuggguucccagaccuuauccacuccccagucuccagcuuugacuccuguucaugggacuuuggcagggccccuaggaaggcaucagagcuaggguggggccagggcuaagugggcagggaggggccuaccuggugaggagugcucugagagccggaacagcauggcaggcguuggucuccugcgccggaucuaaggagauggagggaggggugacuggauggacaccugcagcccucccccacccccaggcagcagggaacaaacagugcuuuggaguccccagggaaccuuugaaucaaagucugucagagccaaaaggaacucuguagcucaccuaacccccucauuuuacagaggugaaaaagcagggcucagagagauuuggcaaugugcuuaaggccacacagcacaacaaguccaaaggacgagaaaaaccccagucacugacucccagcccaugccugucccacuccauggcuacuccagaacagacaucucccuuccuaucuucucccaccaaggcccuuccucucuccaguuucugaaaacaucagaccucggaagccaaagcuggcuacagcuccagcugccacggcugggcccucuggggaagaugccccacgggccauggcacccauguggcccugcccaccuaagaucagcucaagggcuucaaacaagcuggauccagcuuuucagaaggagacugagccagcgcacugcaggcaccccccaccuccagcugaggcucagggacccaaaggggccugggggaccucucugggggccuugguuugggcuucuuuuccagucucuguaaggcugcagaacucuucacccaguccuugugagaaaugaaaaguugcccuccuugcuacgugagccaagcagcaacugaccgccccccuccccgccccgccccucagcuuggcaaucagaccaacugucaguuaauuaggucccuguugagcuccagggaaaugcacaaagagaaccaggugaguuaagcugaaacugccaccuccccagccaagcuccccaugacacccucaugacccaaagcugcuuaggcccaggacuguacccccugcccucuaucuccccccauaaugacuuggcccccucaucacugcucaguggggagccagcugcaucucagcucagcaacaagugaccccugcuccacuagggaugggaaguggagcucucugucacagcacccgccagccuuuggaagccccucaacccccaagaaggcccucaggaggacucaguagucugugggaagaggucuggcuuugugaugacuccccaccucucccuccuugggguuggggcucuggggccugacagcaggaggccagagccagguucuggagaccccagcccaggcacacacgcgggauuagagaggggcaggguaguggauucacccgguggcagccucauacuccugcccugggugacaaggucaguguccaccgcugcucacaucugaccagcucugggacagagccaggcggagcggucccggugguagccuaggagacugacuacccuuuggggacugugcugggaccaaaggacgcccccaccccacuccugggcggucuggaaucggccuguccccccacccccgcacccccagccucacugccaggaacucucuugccccgggaucaggaccaaagccgcggggaaaaguugcacgagucuccagcuaacuucacacgcggccccgcgccccguccugaccgaggcagagcccggcucuccuugcgcccccacccccaggccaguccggccggggcagcgccuugggagggcgaagaagccccgcggggugugucggguacgcugccgggguggggcacgggccccuuaccaucuccaccuggcgggggucgagcuggcuagggggcgcgggcaccgagaacuggaucuucuugcgguccuugggguccauggcgcgcggggugggcgguggggcuggggugcgcgacucggggucccggcggcggucugugcugggcucccccgcgcaggcggcgggcugugcggcgagaggaggaggagggcuguucgcgcacggauaaaaauaccgugcccgccgaggggagggcgcgggagcgggaggagggucggcgcccgggcugggcgcgcccccaggcucucgggacucggggcucgccccccgcgcucgcugagccaggucugugccucgcucccucgcgcuccccggccugggugucucugcgucucggugucucuccccuccugagugucucugcgucucggugucucuccccuccugagugucucugcgugucuccucucucugccucucccguccuucuccaccucccucccucagccucuccuccucuccgcgugugucucugccucugccgggcucacccuccggucccagcuuugggguccccagcccguccccuccgccugggacuggcgcccgggugcucggagggaggguuuaggggaaacuggccaaugagcauggagaaucguguucuccuggggcugggaggagggugggaguuagagccaaggccuggggagccagcuggggggcccccugcggucuccccagaacuugaagcugcauuauugauggaguccagcagagaggauaaagggggagggagggggagaggggcagcggggaggcaggacucuggcuuuaaccccuucgugguccugguacugggaguuucagagaggccugcgaggucguggggagaguaccagccugucacgcugugaauggggguguccuggaaagggagcgagugugaccgaguugugugugggaggacacgugucagucaucguggcagggagagugugcaggggugugccggggcccuguggugcccauagcca

SEQ ID NO: 19953 - RNA, 2509 nt, Homo sapiens
ccucaggaggcuuggucuccagcgguugaggcuggaagcaccggggugcgguggaaagggcucuguccaggaagaccggauccgcagagccgggaguccgggcuaggaagucccuuucucggugggagacugaggccgccuuggcggggcgggacgagacuccuccgaggucgggaaagggggccccgcagcagccccuuggcuucccuucucccuugccuccccuccggggcuccgguucagaggcacucugggcgccugcuacagcuuccaaacugcgccgcuuccuucuucggcagaaaaggacuuucagaugcggcggcggcggcggcggcgacucaggacagcgcccccucccccuaacggccgccucucccucucccccucgcccgccccggcucccccaccucugggaaggcgcuggggguguggccagggaccgguauaaaguccgggggagccggucccgggcagccgcucagcccccugccccucgccgcccgccgccugccugggccgggccgaggaugcggcgcagcgccucggcggccaggcuugcuccccuccggcacgccugcuaacuucccccgcuacguccccguucgcccgccgggccgccccgucuccccgcgcccuccgggucggguccuccaggagcgccaggcgcugccgccgugugcccuccgccgcucgcccgcgcgcccgcgcuccccgccugcgcccagcgccccgcgcccgcgcccaguccucgggcggucaugcugccccucugccucguggccgcccugcugcuggccgccgggcccgggccgagccugggcgacgaagccauccacugcccgcccugcuccgaggagaagcuggcgcgcugccgcccccccgugggcugcgaggagcuggugcgagagccgggcugcggcuguugcgccacuugcgcccugggcuuggggaugcccugcgggguguacaccccccguugcggcucgggccugcgcugcuacccgccccgagggguggagaagccccugcacacacugaugcacgggcaaggcgugugcauggagcuggcggagaucgaggccauccaggaaagccugcagcccucugguaagguaccccuggccucccaauucccuccugagugcgcucccuucccagcggcuucuuccccauuccagccgcccuggaaggcccuuaaaaauccccuaugaguugaagagaaggcagguacguggcagggcccgacuggcaugggacaggcucaucaaggaaacugcuaccgagucccuagcagccuguugccaccaccaagggagacugucccaucgcuccaucucaaaccuccaaggguugucuguuugauaagggggucccagugggaggccuggcugcuggugcaggaguggcagauuaagguccaguuaagucagcugucuagggccagagaacuggaggaugguggugggguguguguuggggaggaugagggaguggggaaagcuuucuguuccugauccaggccgagggugaaaucccaguggucuggggagccagggccugaacuuuuuuuuuacaugguccagugguggagugggacauacaaauuagagggacuuuggcguugaggggcauuagacuugcccuuccccaaagcccagagccaggucaccuuguuguuugagaggcagugggaagacaggggucccucugccaggccuggacaccucugccugcccugguauacaggcccccuguucuuuucuccaggcagguaggauuugaggugguagaaaagucuuggcuccuagccgagagcugcaggagccucaugugugugggauagggaauagagaaggggccagggcgccaggggagagaaacagagagagagagagagagagagagaaacacacacacacacacacacacacacacacacacacacacacagagacagagagagagagagagagagagagagagagagagagagagagagagagagagacucugagaaggcccuugcccuaaccucauucuuacacuuucuuuuuuuguuucucaguuucuccuuagacucucagucucuuuuccuucuuucucuugcucuuuuguucuuccugauuugucucucaaccucuaguuucacuagucaugcucucgaguucuguuuuccucagugucuucugcccaucgugcguuucuuucuccaccuuauucuguguuucuguuucaguugcucugcuucucucccucucuuucuguugcuguuucucugugucucugucacuguuggucuuucccuguuacuuugggaaucucucugucugucuuucuguaucuaugccucuguuucucauuccaucuccgacccuguuuugcucuccugugccucugucugucucugucucuuuuccuggugcuugaagcuuccauuguugcaguccggaugcugggacuccagccccaagcuuccuguccugggacccaaacccuccacuuccucaau

SEQ ID NO: 19954 - RNA, 2509 nt, Homo sapiens
auugaggaaguggaggguuugggucccaggacaggaagcuuggggcuggagucccagcauccggacugcaacaauggaagcuucaagcaccaggaaaagagacagagacagacagaggcacaggagagcaaaacagggucggagauggaaugagaaacagaggcauagauacagaaagacagacagagagauucccaaaguaacagggaaagaccaacagugacagagacacagagaaacagcaacagaaagagagggagagaagcagagcaacugaaacagaaacacagaauaagguggagaaagaaacgcacgaugggcagaagacacugaggaaaacagaacucgagagcaugacuagugaaacuagagguugagagacaaaucaggaagaacaaaagagcaagagaaagaaggaaaagagacugagagucuaaggagaaacugagaaacaaaaaaagaaaguguaagaaugagguuagggcaagggccuucucagagucucucucucucucucucucucucucucucucucucucucucucucucucucugucucuguguguguguguguguguguguguguguguguguguguguguuucucucucucucucucucucucucuguuucucuccccuggcgcccuggccccuucucuauucccuaucccacacacaugaggcuccugcagcucucggcuaggagccaagacuuuucuaccaccucaaauccuaccugccuggagaaaagaacagggggccuguauaccagggcaggcagagguguccaggccuggcagagggaccccugucuucccacugccucucaaacaacaaggugaccuggcucugggcuuuggggaagggcaagucuaaugccccucaacgccaaagucccucuaauuuguaugucccacuccaccacuggaccauguaaaaaaaaaguucaggcccuggcuccccagaccacugggauuucacccucggccuggaucaggaacagaaagcuuuccccacucccucauccuccccaacacacaccccaccaccauccuccaguucucuggcccuagacagcugacuuaacuggaccuuaaucugccacuccugcaccagcagccaggccucccacugggacccccuuaucaaacagacaacccuuggagguuugagauggagcgaugggacagucucccuuggugguggcaacaggcugcuagggacucgguagcaguuuccuugaugagccugucccaugccagucgggcccugccacguaccugccuucucuucaacucauaggggauuuuuaagggccuuccagggcggcuggaauggggaagaagccgcugggaagggagcgcacucaggagggaauugggaggccagggguaccuuaccagagggcugcaggcuuuccuggauggccucgaucuccgccagcuccaugcacacgccuugcccgugcaucagugugugcaggggcuucuccaccccucggggcggguagcagcgcaggcccgagccgcaacgggggguguacaccccgcagggcauccccaagcccagggcgcaaguggcgcaacagccgcagcccggcucucgcaccagcuccucgcagcccacgggggggcggcagcgcgccagcuucuccucggagcagggcgggcaguggauggcuucgucgcccaggcucggcccgggcccggcggccagcagcagggcggccacgaggcagaggggcagcaugaccgcccgaggacugggcgcgggcgcggggcgcugggcgcaggcggggagcgcgggcgcgcgggcgagcggcggagggcacacggcggcagcgccuggcgcuccuggaggacccgacccggagggcgcggggagacggggcggcccggcgggcgaacggggacguagcgggggaaguuagcaggcgugccggaggggagcaagccuggccgccgaggcgcugcgccgcauccucggcccggcccaggcaggcggcgggcggcgaggggcagggggcugagcggcugcccgggaccggcucccccggacuuuauaccggucccuggccacacccccagcgccuucccagaggugggggagccggggcgggcgagggggagagggagaggcggccguuagggggagggggcgcuguccugagucgccgccgccgccgccgccgcaucugaaaguccuuuucugccgaagaaggaagcggcgcaguuuggaagcuguagcaggcgcccagagugccucugaaccggagccccggaggggaggcaagggagaagggaagccaaggggcugcugcggggcccccuuucccgaccucggaggagucucgucccgccccgccaaggcggccucagucucccaccgagaaagggacuuccuagcccggacucccggcucugcggauccggucuuccuggacagagcccuuuccaccgcaccccggugcuuccagccucaaccgcuggagaccaagccuccugagg

SEQ ID NO: 19955 - RNA, 2638 nt, Homo sapiens
ggagucugucauccguggguaaggguggggagggggacaagugccacuucugccucugucccaccaccucagauagguaccagcugacccaccuuucugucucuacucuucccagauacuuguccugauuugcaucuaucuuaacuccuccuggggaaaccaagccaaggacccccucgccucaccccagauggucacucagaacccggcucgaccaggccccagagcagucagcagagccacaacucccggaaaggggucuucuaacuuggagggugugggaaauccagccuucccuuucuuuccauucccuucagcagggagaggaaggggagaggggagcauagacuaaccccccugccccacacgaucccgccucccugggguuaggagcaucagcaggccuuugggaggcggggaggagccaggcuggaacacuugccgcccagcccaaaaucucauccccgauggcacugcggaagcggcguggagaggagcagcauagaaacccgagacucccagguuuauuggggguuaugauccaaaagcuacauuuuuauccaagugugaagaauggggagagcugcaaagaaagcaacaaguggccccgggcggagccggggggugggggcgccagccuccucccgccggcugcgcugcugcgccuggcccccgcccccgcaggcaugcggggugauucaccucgcccagacugcgcccagaccgccggaccccgcaggggcuguccacccacuccaccagccccucuugcacuccugacgcccacucuuccccgcccagccccgcccgcuuccaggaggcccagggugccagcgcgccgcgggugaggguguccucaagggccugaaaaugccugguggccaggagcagagagcagcgaggggacaggggugggccgccgaggccgaugugggggcgcgggggcgcagggucuggggaggagguuggcggucgcguuccccgcuuggcacagcccccgcuggugcgugccugagcccugaaucacccgcuauaucaggcccgcaggcgcagaggccccaggcccgggccccgcagccaguguccgcuuacagcggaccccaacgaucgcgagggaccccugacuuuccuagaaacuucccccaaguaggaagaaguuugacagagccaauuagggagggagcggucugcgaggggcagcguccucgaguccacccgcuaauucgguucugcuacaaguuugggacccgagggaaggaucugaguggggaggugcgaggugcagagcgcgccccucuacgcgccccaggaguccgccgcucccuccaccccauccuaccccacccaaccccaccccagccgcgcucaccggaaggaggguggaucugccgggcgcccgggccaggcugggaggggagcagcgccacgggcaggucuccccaccccaacucccaggcaggggacgcgggccgggcgcgggagcucugggcgccuuccgcccugugggcucaccugguagaucaugacuuuaaaguugcggcgccgcagcagcucggccucguugaccuccagcuucuugaucugccccgccuggcgcuccaggcugccgcgcacggucuucacguugacgcugaccuugcgcaccuucuccagcagcuugcucaccguauugcucgugguggcgugcgccuugcccagcuugcucagcucgcccuggaugcucugcacugcgcccuccaucuccgccugccgcuccuccagcugugcuugagucagcuggaucuggucuacggccccgaugauuuuguccaggaggcucagcaccagcacgccguucaccugguccgacuugaucagcucuucugagccggcccccgacggcuccuccgcugccugagccccagcggaggaaggcuccggggccucggcgucgggguacccgggaagcggccgcucgacaauauagagcgugggguccuccauggcuacccggagccgugcgggaccggccggguggggcuggagcuggagcgggagacccggagagaagcaggagcggaagggaggagagcuagcgggcgagagcggagagcagaggaaacucgagccacguccgugcgcaccgggacagcggccagaacugcugggcgggggaucggugagcuccccagcucccgggccaaacuccggagucugaucgcugauuggcuggccccaccccagaaagggagggaccggggcagaaggggagaucgacgaggcggggcggcggagggggacccaagagccgagcgccccacccuucccgggaugguuggaauaguuggagcgggagacuagggccuccgcuggcggcgggagcgggacgggcggaggaaugcgagcugaggaacggaaucagguucuaagaguguugcucucuguuucccucucacuugaauugcucauccgaaaauccucaagaucugggagccggguggaccaggagauucugaaauuauaggcaaaaucuuguauuugccuuuaccuagauuuugagcacaaaaggacccuugcccuuuacaauauuuucuaagaggccucucggauuuccucaucaccaaccccaaccagguuacuaacucagggguaagcuuag

SEQ ID NO: 19956 - RNA, 2638 nt, Homo sapiens
cuaagcuuaccccugaguuaguaaccugguugggguuggugaugaggaaauccgagaggccucuuagaaaauauuguaaagggcaaggguccuuuugugcucaaaaucuagguaaaggcaaauacaagauuuugccuauaauuucagaaucuccugguccacccggcucccagaucuugaggauuuucggaugagcaauucaagugagagggaaacagagagcaacacucuuagaaccugauuccguuccucagcucgcauuccuccgcccgucccgcucccgccgccagcggaggcccuagucucccgcuccaacuauuccaaccaucccgggaaggguggggcgcucggcucuugggucccccuccgccgccccgccucgucgaucuccccuucugccccggucccucccuuucugggguggggccagccaaucagcgaucagacuccggaguuuggcccgggagcuggggagcucaccgaucccccgcccagcaguucuggccgcugucccggugcgcacggacguggcucgaguuuccucugcucuccgcucucgcccgcuagcucuccucccuuccgcuccugcuucucuccgggucucccgcuccagcuccagccccacccggccggucccgcacggcuccggguagccauggaggaccccacgcucuauauugucgagcggccgcuucccggguaccccgacgccgaggccccggagccuuccuccgcuggggcucaggcagcggaggagccgucgggggccggcucagaagagcugaucaagucggaccaggugaacggcgugcuggugcugagccuccuggacaaaaucaucggggccguagaccagauccagcugacucaagcacagcuggaggagcggcaggcggagauggagggcgcagugcagagcauccagggcgagcugagcaagcugggcaaggcgcacgccaccacgagcaauacggugagcaagcugcuggagaaggugcgcaaggucagcgucaacgugaagaccgugcgcggcagccuggagcgccaggcggggcagaucaagaagcuggaggucaacgaggccgagcugcugcggcgccgcaacuuuaaagucaugaucuaccaggugagcccacagggcggaaggcgcccagagcucccgcgcccggcccgcguccccugccugggaguugggguggggagaccugcccguggcgcugcuccccucccagccuggcccgggcgcccggcagauccacccuccuuccggugagcgcggcuggggugggguugggugggguaggaugggguggagggagcggcggacuccuggggcgcguagaggggcgcgcucugcaccucgcaccuccccacucagauccuucccucgggucccaaacuuguagcagaaccgaauuagcggguggacucgaggacgcugccccucgcagaccgcucccucccuaauuggcucugucaaacuucuuccuacuugggggaaguuucuaggaaagucaggggucccucgcgaucguugggguccgcuguaagcggacacuggcugcggggcccgggccuggggccucugcgccugcgggccugauauagcgggugauucagggcucaggcacgcaccagcgggggcugugccaagcggggaacgcgaccgccaaccuccuccccagacccugcgcccccgcgcccccacaucggccucggcggcccaccccuguccccucgcugcucucugcuccuggccaccaggcauuuucaggcccuugaggacacccucacccgcggcgcgcuggcacccugggccuccuggaagcgggcggggcugggcggggaagagugggcgucaggagugcaagaggggcugguggaguggguggacagccccugcgggguccggcggucugggcgcagucugggcgaggugaaucaccccgcaugccugcgggggcgggggccaggcgcagcagcgcagccggcgggaggaggcuggcgcccccaccccccggcuccgcccggggccacuuguugcuuucuuugcagcucuccccauucuucacacuuggauaaaaauguagcuuuuggaucauaacccccaauaaaccugggagucucggguuucuaugcugcuccucuccacgccgcuuccgcagugccaucggggaugagauuuugggcugggcggcaaguguuccagccuggcuccuccccgccucccaaaggccugcugaugcuccuaaccccagggaggcgggaucguguggggcagggggguuagucuaugcuccccucuccccuuccucucccugcugaagggaauggaaagaaagggaaggcuggauuucccacacccuccaaguuagaagaccccuuuccgggaguuguggcucugcugacugcucuggggccuggucgagccggguucugagugaccaucuggggugaggcgaggggguccuuggcuugguuuccccaggaggaguuaagauagaugcaaaucaggacaaguaucugggaagaguagagacagaaaggugggucagcugguaccuaucugagguggugggacagaggcagaaguggcacuugucccccuccccacccuuacccacggaugacagacucc

SEQ ID NO: 19957 - RNA, 8325 nt, Homo sapiens
cugcuuguaaagccuccccucccucugaccagaaacgaggacaguuuguuguuccaagcagugggcucaugucuguuuuggcucagaacaggguggggagagcgggccagggacccgcaggagggcuuauccuugagauugcgugggagacacaacaaggggugggggcccgcaggcggggcggggcgaagcaggugauauccagcccagagccccagccucuccccacagucucaccauggccugcaccguggugcucaucaccggcuguuccucagguauuggccugcacuuggcaauacaucuggcuuuggacccaucccagagcuucaaagguauagauagguagggacagggagggagagaagggaaaagcccuuggaggccagaagagaagucagaucuuccuccucucccaaaaccuccaguguaugccacguugagggaccugaaaacacagggccggcugugggaggcggcccgggcccuggcaugcccucagggaucccuggagagguugcagcuggauguaaggaacucaagcucccuggccgcugcccgggaacgcgugaccgagggccguguggaugugcugggugagccuccuggaagcauaugggcuccuaggagccuucuccgcccugcguugaaaccaacauguccccaggccccuggagcaugaggggacaggccgugcugagggugaugcugaggcgggcugguugggccucuguccccgcagugugugacacaggccugggccugcuggggccgcugggggaggacgcuguggccucuguacuggaugugaauguaguagguacugugcgggugcugcaggacuuccugccagacaugaagcggccggguucgggacgcguguuggugacugggagcaugggaggauugaugggugaguggcagggaccgggcccggagcuccagauucuuugugugcagagcugagccuugaaggcaggcuccuuaggggguggggugcaaucagcuuggaggggcacugccugccgggggaugacccccuggccgcugcgccucaggaaccucaucuucccacccaagggcugccuuucaaugacguuuauugcgccagcaaguucgcgcucgaaggcuuaugcgagagucuggcgguucugcugcugcccuuugggguccagugagucaacacccccgucuccucaacccucuuaacucugaccuagagaugccgagcacccuguccugcggaagccgcucuggucucugcccggcuuacauuugcugcgugccaggcacuuaggcuggagcauuggcacgcauugugccacuugcugaccuggcugcugaaguguugguauuguuauggggaagcuccagccaagagagguuaggugacuggcccaaggucaugcagcggccggggaucccgccagguucgaauucugacaccagggcuaccuggcagccucagauggguuugggagggcugucgagcaauaacccgcuauucaaauguucugguuauccccagcgcucuuuccaccuucgggacgcagcggugcuguucugggucguggccagggccggggucggggccggugcuggggcaggagaugggacuuggcgccugggucgccuccgucccugcccacuugcggcucucgggccagcagcgugagccugaucgagugcggcccuguggacaccgccuucaugcagaagguguugggcggucccgaccaggugauggaccgcacgaacacccggaccuuccgccucuugcacuaauaccuccaccacagcaaggagaucuaccgcgaggaggcgcagcacccugaggagguggugaaggugagcggggggcgggacuccgggagcgggggcggugcgucguccugcgcgcagcccgggccagagcuccucucccgccgccgcaggucuuccucaccgcuaugcgcgccccgaagccgacccugcgcuacuucacaaccaggcgcuuccugcaccagcugcugaugcgccuggacgaccccuuuggcuucgacuacgccgccgccaugcaccgggacguguucgccgacgaucccgcagaggccgaggcuggggccggggcuggggccgaggccgggggcggggccggugggaugggagacccugagcucagcgauccucuggccgccccgcaagaaaggcuccgucagccacugucucccgcgcccuccuuugucuccugggccugugcggucccuggggaugggacggcggugacggcuguggauggcuaauuaagacagaucacguuagcccguuauaucugcgcggcuaggcgcgauggcugucgccuauaaucccagagcuuuggaaggccgaggcaggaggaucgcuccaggccaggaguuccagaccagccugagcaacauagugagacaccccaucucuaaaauaaaaaaauuagcacaguggcaccauuccuugagcucaggaguuggaggcugcagugggcaugaucgagcuacugcucuccagcuugggcgauagagugagacacugucaauuaauuaaucuaaucaaccaaccaacccaacaacccagaaaccaagguccagaaagaagccagcccaggaucaugccucaaguccacaguaaagcccagacacagucacuggauacccaaggggcaucugcaggacgaguuaggugggacuuggguugggguagagucagguugugaccugcacuccauuagccaugagaccucaggcaaguuccuugcuuucucugagugcuuuccuuuccuuucccuuuucuuuucuuuuuuguuuuucuuuuguuuugagacggaguuucacucuuguugcccagccuggagugcaauagcgcggucucaguucaccacaaccucugccucccggguucaaguguagcuaggauugcaggcaugugccaccacgcccagcuaauuuuguauuuuuaguagagacgagguuucuccauguuggucagacuggucuuggacucccgaccucaggugauccgcccgcccuggccucucagagugcugggauuacaggcaugacccaccccauccggcccucugagucuuucuuaucuguaaaauggguauaauaauaccuaucuaaucgguuuuaguaaugguggagauaaugccugaaagugcuaguauagagguuuaauacccagcaaggacuguuauuagaaugaauaguaauaugacuacugucacauuuugcaaauguguaaagaagaaagagggcuaagugaaucaaagggagacagccccacucacccuguucugccccagaggacugagcgauccccaccaucugggaagcugccucaccaggagguccagcuggggcuacaggacuggcuacuuugcuacaauggcccaucuuuccugagcccaguggagggucccaggggggcagaagucauugauaggggccaguaggguuguagagccacugucugaacuucuguggaggucuggugcaggggaggugugaacagauaggaggcuaggugaggaugcagcagaggaagggggcaggagugccccaggagggggcgguaccgaggcagggauucagcugggucugagagggagggaaggcugagggggauggcccuuuggagugggcagggacaugaccacagaaagccugggaaguggaaacagacaggagccugcuggagcucuuggagcuuuguguggggcacuaggggaaggaggcaggcacuccacccugaccugccccuaccucuggaugagggucuucucugccuguuggaugaugugcugccccugcucuuggaggaagaggccucccagccacccccuccugccagucgccuugcccugcugacccagacagaucugcuaucccuacagcauccaggaaggccacagggagggggcccagguggcauggguuucugaggccugggaucugcucucagucccgcucucgccaacccccuuugccccucugugacaguguguguacauaugcgugcauguguguaccugugugguguggcucacaaggucaccccugggggugggauaauaagagguaaagugugacccccucucuuccguacauucauuuuuucaagcuugugaauauucacauuguuaauauaaucuucugcagucccaugacuucgaauagcacuuagaugccgaugacccccccaccaaagaaaccccacugucucccacagacuccaggucuguaucuccaacugccuacucaauacaacacguccaccugauacaaugaacuuaaugugucuaaaccccaauuccacauuuccaguccuccuaccggcuccucccccagucuucucuacuuuacuauaugacaacuccauuuuucccaauacugguuuuaaaaacccuggaguaguccuugacuccagucucucucaccuuucaaccaauucagcagcaaauacugacagcucuaccuuugcucaucaaagcauauccccaaaucacccuauuccagacugcacacugucaucucucccuucaauuacagcaguagccuccuaacuaguuuucuugauuccacuccugcccaucagcagugaaauuaccccagagcaguuaaaaugaucuuuuaggaugggcacaguggcucacgccuguaauaccagcacuuugggagguggaggcuggcugauccccuuagguugggaguucaagaccauccucaccaacagggagaaaccccaucucuacuaaaaauacaaaaauuagccggauguggugggacgugucuguaaucccaacuacuugggaggcugagacaggagaacugcuugaacccgggagguggagguugcagugagccagaaucgugccacagcacuccagccugggcaagaagcgcgaaacuccgucucaaaauaaaauaaucuucuaaaaaugacagggccaggugggguggcacuuuuuuauaauccgagcacuuugggaggcugaggugggcagaucgcuugacaucagggguuugagaccagccuggccaacauggugaaacuccgucucuacuaaaaauacuaaaaauuagcugggcgugguggcgggugccuguaaucccagcuacucgggaggcugaugcaggagaaucgccugaaccaggcagaugcaggaugcagugagccaagauuaagacacugcacuccaaccuaagcaauacuuugucucaaaaauaaaaaaaagccugggaaacaaagugagaccccgucucuacaaaaaagucaaaaaauuagcuggguaugguggcagugauggcacacaccuguagucccggcuacuugggaagcuuuuuaauauuuuuugcagagaccgggucucacucuguuaccuggccuggucuugaacuccugggcuccaacaauccccuuuccugggccucccaaagugcugggauuacaggcaugagccaccgugcccagccucaaagcauauuuuaaaggauagaaauaaacagccauaugaagagauacagacagggcggucuggaaggguccagagcaggagcuucuaucuccauagaguugggguuacgucacccucugggcacauucugucagccuccacacguucagcccucagaagcucccgaacccuguccuuugggccuuuuauggagaacuccauuggcuguccaugacugaagcauggacaacugugauaaugugauugggcaaaaagggucugaucuaagcccagcaaggccaguccagauucuuugggccuuugugcagcauuccuuucuccaggguauggggcaaggacccacucuggaaugaggauccuacaacccacaaucagauuagaguccugccuugggcagcugaaaagaggacaggagaaggucagagagacgaaaggcuguuuuuugaggccugaggcaccccaacaugacaacguaagacuguaaccauggucaugugaguuaugagcuaggaacccuggacgaaaccagcacauauacaaucaucucccaccucccaacgccuuuacuuucacagccucugcagcaaacugcggucacuauaaucgcuccuguggcacagaggcauacccaggggaaucugcccagggggccacucugugcccacgugggaacccacaccugcuuguaaagccuccccucccucugaccagcaaccaggacaguuuguuguuccaagcagugggcucaugucuguuuuggcucagaacaggguggggagagcgggccagggacccgcaggaaggcuuauccuugagauugcgugggagacacaacaaggggugggggcccgcaggcggggcggggcgaagcaggugauaucaagcccagagccccagccucuccccacagucucaccauggcccgcaccguggugcucaucaccggcuguuccucgggcaucggccugcacuuggccguacgucuggcuucagauccaucccagagcuucaaagguauagauaggcagggacagggagggagagaagggaggagcccuuggaggccagaagggaagucagaucuuccuccucucccaaaaccuccaguguaugccacguugagggaccugaaaacacagggccggcugugggaggcggcccgggcccuggcaugcccuccgggaucccuggagacguugcagcuggacguaagggacucaaaauccguggccgcugcccgggaacgcgugacugagggccgcguggacgugcugggugagccuccuggaagcauaugggcuccuaggagccuucuccgcccugcguugaaaccaacauguucccaggcccagggagcacgaggggacaggccgugcugagggugaugcugaggcgggcuggucgggccucuugucuccgcaguguguaacgcaggccugggccugcuggggccgcuggaggcgcugggggaggacgccguggccucugugcuggacgugaauguaguagggacugugcggaugcugcaggccuuccugccagacaugaagaggcgcgguucgggacgcguguuggugaccgggagcgugggaggauugaugggugagugguagggaguggccucggcagcuccagauucuuugugugcggagcugagccuugaaggcagguuccgcgggggggguggaguggggugccgucagcuuggaggggcaccgucugcccggggaugacccccuggccgcugcgccucaggaaccucgucuccccaccuaagggcugccuuucaaugacguuuauugcgccagcaaguucgcgcucgaaggcuuaugcgagagucuggcgguucugcugcugcccuuugggguccagugagucaacacccccguuccccgaacccucuuaacucugaccuagagacgccgagcacccuguccugcgggagccgcucuggggcgaucucccuggcccucucugcccggcucacauuagcugugugccaggcacuugggcugggcgcauggcacgcauugugccaccugcugaccuagcugcugaaguguugguauuguuauggggaagcuccagcccagagagguuaggugacuggcccaaggucacacagcggccagggaccccgcuagauucgaauccugacaccagggcucccuuguagccucagauggauuugggagggcugcuccggcaggaacccgcguuucaaauguucugguuauccccagcgcccuuuccgccucacuucccagcgcagcggugcugcucgcggucgggggccgggacgugguuggggcugggacugggguuggggcugggacuggggccuggcuggcguccgcccccucccacucguugcucuccggccagcagcuugagccugaucgagugcggcccagugcacaccgccuucauggagaagguguugggcagcccagaggaggugcuggaccgcacggacauccacaccuuccaccgcuucuaccaauaccucgcccacagcaagcaagucuuucgcgaggcggcgcagaacccugaggagguggcggaggugagcgccgggcuggacuccaggagugggggcggugcguccuccggcgcgcagcgguggccacagcucuccucccgccgccgcaggucuuccucaccgcuuugcgcgccccgaagccgacccugcgcuacuucaccaccgagcgcuuccugccccugcugcggaugcgccuggacgaccccagcggcuccaacuacgucaccgccaugcaccgggaaguguucggcgacguuccggcaaaggccgaggcuggggccgaggcuggggg

SEQ ID NO: 19958 - RNA, 8325 nt, Homo sapiens
cccccagccucggccccagccucggccuuugccggaacgucgccgaacacuucccggugcauggcggugacguaguuggagccgcuggggucguccaggcgcauccgcagcaggggcaggaagcgcucgguggugaaguagcgcagggucggcuucggggcgcgcaaagcggugaggaagaccugcggcggcgggaggagagcuguggccaccgcugcgcgccggaggacgcaccgcccccacuccuggaguccagcccggcgcucaccuccgccaccuccucaggguucugcgccgccucgcgaaagacuugcuugcugugggcgagguauugguagaagcgguggaagguguggauguccgugcgguccagcaccuccucugggcugcccaacaccuucuccaugaaggcggugugcacugggccgcacucgaucaggcucaagcugcuggccggagagcaacgagugggagggggcggacgccagccaggccccagucccagccccaaccccagucccagccccaaccacgucccggcccccgaccgcgagcagcaccgcugcgcugggaagugaggcggaaagggcgcuggggauaaccagaacauuugaaacgcggguuccugccggagcagcccucccaaauccaucugaggcuacaagggagcccuggugucaggauucgaaucuagcggggucccuggccgcugugugaccuugggccagucaccuaaccucucugggcuggagcuuccccauaacaauaccaacacuucagcagcuaggucagcagguggcacaaugcgugccaugcgcccagcccaagugccuggcacacagcuaaugugagccgggcagagagggccagggagaucgccccagagcggcucccgcaggacagggugcucggcgucucuaggucagaguuaagaggguucggggaacggggguguugacucacuggaccccaaagggcagcagcagaaccgccagacucucgcauaagccuucgagcgcgaacuugcuggcgcaauaaacgucauugaaaggcagcccuuagguggggagacgagguuccugaggcgcagcggccagggggucauccccgggcagacggugccccuccaagcugacggcaccccacuccaccccccccgcggaaccugccuucaaggcucagcuccgcacacaaagaaucuggagcugccgaggccacucccuaccacucacccaucaauccucccacgcucccggucaccaacacgcgucccgaaccgcgccucuucaugucuggcaggaaggccugcagcauccgcacagucccuacuacauucacguccagcacagaggccacggcguccucccccagcgccuccagcggccccagcaggcccaggccugcguuacacacugcggagacaagaggcccgaccagcccgccucagcaucacccucagcacggccuguccccucgugcucccugggccugggaacauguugguuucaacgcagggcggagaaggcuccuaggagcccauaugcuuccaggaggcucacccagcacguccacgcggcccucagucacgcguucccgggcagcggccacggauuuugagucccuuacguccagcugcaacgucuccagggaucccggagggcaugccagggcccgggccgccucccacagccggcccuguguuuucaggucccucaacguggcauacacuggagguuuugggagaggaggaagaucugacuucccuucuggccuccaagggcuccucccuucucucccucccugucccugccuaucuauaccuuugaagcucugggauggaucugaagccagacguacggccaagugcaggccgaugcccgaggaacagccggugaugagcaccacggugcgggccauggugagacuguggggagaggcuggggcucugggcuugauaucaccugcuucgccccgccccgccugcgggcccccaccccuuguugugucucccacgcaaucucaaggauaagccuuccugcgggucccuggcccgcucuccccacccuguucugagccaaaacagacaugagcccacugcuuggaacaacaaacuguccugguugcuggucagagggaggggaggcuuuacaagcagguguggguucccacgugggcacagaguggcccccugggcagauuccccuggguaugccucugugccacaggagcgauuauagugaccgcaguuugcugcagaggcugugaaaguaaaggcguugggaggugggagaugauuguauaugugcugguuucguccaggguuccuagcucauaacucacaugaccaugguuacagucuuacguugucauguuggggugccucaggccucaaaaaacagccuuucgucucucugaccuucuccuguccucuuuucagcugcccaaggcaggacucuaaucugauuguggguuguaggauccucauuccagaguggguccuugccccauacccuggagaaaggaaugcugcacaaaggcccaaagaaucuggacuggccuugcugggcuuagaucagacccuuuuugcccaaucacauuaucacaguuguccaugcuucagucauggacagccaauggaguucuccauaaaaggcccaaaggacaggguucgggagcuucugagggcugaacguguggaggcugacagaaugugcccagagggugacguaaccccaacucuauggagauagaagcuccugcucuggacccuuccagaccgcccugucuguaucucuucauauggcuguuuauuucuauccuuuaaaauaugcuuugaggcugggcacgguggcucaugccuguaaucccagcacuuugggaggcccaggaaaggggauuguuggagcccaggaguucaagaccaggccagguaacagagugagacccggucucugcaaaaaauauuaaaaagcuucccaaguagccgggacuacaggugugugccaucacugccaccauacccagcuaauuuuuugacuuuuuuguagagacggggucucacuuuguuucccaggcuuuuuuuuauuuuugagacaaaguauugcuuagguuggagugcagugucuuaaucuuggcucacugcauccugcaucugccugguucaggcgauucuccugcaucagccucccgaguagcugggauuacaggcacccgccaccacgcccagcuaauuuuuaguauuuuuaguagagacggaguuucaccauguuggccaggcuggucucaaaccccugaugucaagcgaucugcccaccucagccucccaaagugcucggauuauaaaaaagugccaccccaccuggcccugucauuuuuagaagauuauuuuauuuugagacggaguuucgcgcuucuugcccaggcuggagugcuguggcacgauucuggcucacugcaaccuccaccucccggguucaagcaguucuccugucucagccucccaaguaguugggauuacagacacgucccaccacauccggcuaauuuuuguauuuuuaguagagaugggguuucucccuguuggugaggauggucuugaacucccaaccuaaggggaucagccagccuccaccucccaaagugcugguauuacaggcgugagccacugugcccauccuaaaagaucauuuuaacugcucugggguaauuucacugcugaugggcaggaguggaaucaagaaaacuaguuaggaggcuacugcuguaauugaagggagagaugacagugugcagucuggaauagggugauuuggggauaugcuuugaugagcaaagguagagcugucaguauuugcugcugaauugguugaaaggugagagagacuggagucaaggacuacuccaggguuuuuaaaaccaguauugggaaaaauggaguugucauauaguaaaguagagaagacugggggaggagccgguaggaggacuggaaauguggaauugggguuuagacacauuaaguucauuguaucagguggacguguuguauugaguaggcaguuggagauacagaccuggagucugugggagacagugggguuucuuuggugggggggucaucggcaucuaagugcuauucgaagucaugggacugcagaagauuauauuaacaaugugaauauucacaagcuugaaaaaaugaauguacggaagagagggggucacacuuuaccucuuauuaucccacccccaggggugaccuugugagccacaccacacagguacacacaugcacgcauauguacacacacugucacagaggggcaaaggggguuggcgagagcgggacugagagcagaucccaggccucagaaacccaugccaccugggcccccucccuguggccuuccuggaugcuguagggauagcagaucugucugggucagcagggcaaggcgacuggcaggaggggguggcugggaggccucuuccuccaagagcaggggcagcacaucauccaacaggcagagaagacccucauccagagguaggggcaggucaggguggagugccugccuccuuccccuagugccccacacaaagcuccaagagcuccagcaggcuccugucuguuuccacuucccaggcuuucuguggucaugucccugcccacuccaaagggccaucccccucagccuucccucccucucagacccagcugaaucccugccucgguaccgcccccuccuggggcacuccugcccccuuccucugcugcauccucaccuagccuccuaucuguucacaccuccccugcaccagaccuccacagaaguucagacaguggcucuacaacccuacuggccccuaucaaugacuucugccccccugggacccuccacugggcucaggaaagaugggccauuguagcaaaguagccaguccuguagccccagcuggaccuccuggugaggcagcuucccagaugguggggaucgcucaguccucuggggcagaacagggugaguggggcugucucccuuugauucacuuagcccucuuucuucuuuacacauuugcaaaaugugacaguagucauauuacuauucauucuaauaacaguccuugcuggguauuaaaccucuauacuagcacuuucaggcauuaucuccaccauuacuaaaaccgauuagauagguauuauuauacccauuuuacagauaagaaagacucagagggccggauggggugggucaugccuguaaucccagcacucugagaggccagggcgggcggaucaccugaggucgggaguccaagaccagucugaccaacauggagaaaccucgucucuacuaaaaauacaaaauuagcugggcgugguggcacaugccugcaauccuagcuacacuugaacccgggaggcagagguuguggugaacugagaccgcgcuauugcacuccaggcugggcaacaagagugaaacuccgucucaaaacaaaagaaaaacaaaaaagaaaagaaaagggaaaggaaaggaaagcacucagagaaagcaaggaacuugccugaggucucauggcuaauggagugcaggucacaaccugacucuaccccaacccaagucccaccuaacucguccugcagaugccccuuggguauccagugacugugucugggcuuuacuguggacuugaggcaugauccugggcuggcuucuuucuggaccuugguuucuggguuguuggguugguugguugauuagauuaauuaauugacagugucucacucuaucgcccaagcuggagagcaguagcucgaucaugcccacugcagccuccaacuccugagcucaaggaauggugccacugugcuaauuuuuuuauuuuagagauggggugucucacuauguugcucaggcuggucuggaacuccuggccuggagcgauccuccugccucggccuuccaaagcucugggauuauaggcgacagccaucgcgccuagccgcgcagauauaacgggcuaacgugaucugucuuaauuagccauccacagccgucaccgccgucccauccccagggaccgcacaggcccaggagacaaaggagggcgcgggagacaguggcugacggagccuuucuugcggggcggccagaggaucgcugagcucagggucucccaucccaccggccccgcccccggccucggccccagccccggccccagccucggccucugcgggaucgucggcgaacacgucccggugcauggcggcggcguagucgaagccaaaggggucguccaggcgcaucagcagcuggugcaggaagcgccugguugugaaguagcgcagggucggcuucggggcgcgcauagcggugaggaagaccugcggcggcgggagaggagcucuggcccgggcugcgcgcaggacgacgcaccgcccccgcucccggagucccgccccccgcucaccuucaccaccuccucagggugcugcgccuccucgcgguagaucuccuugcugugguggagguauuagugcaagaggcggaagguccggguguucgugcgguccaucaccuggucgggaccgcccaacaccuucugcaugaaggcgguguccacagggccgcacucgaucaggcucacgcugcuggcccgagagccgcaagugggcagggacggaggcgacccaggcgccaagucccaucuccugccccagcaccggccccgaccccggcccuggccacgacccagaacagcaccgcugcgucccgaagguggaaagagcgcuggggauaaccagaacauuugaauagcggguuauugcucgacagcccucccaaacccaucugaggcugccagguagcccuggugucagaauucgaaccuggcgggauccccggccgcugcaugaccuugggccagucaccuaaccucucuuggcuggagcuuccccauaacaauaccaacacuucagcagccaggucagcaaguggcacaaugcgugccaaugcuccagccuaagugccuggcacgcagcaaauguaagccgggcagagaccagagcggcuuccgcaggacagggugcucggcaucucuaggucagaguuaagaggguugaggagacggggguguugacucacuggaccccaaagggcagcagcagaaccgccagacucucgcauaagccuucgagcgcgaacuugcuggcgcaauaaacgucauugaaaggcagcccuugggugggaagaugagguuccugaggcgcagcggccagggggucaucccccggcaggcagugccccuccaagcugauugcaccccacccccuaaggagccugccuucaaggcucagcucugcacacaaagaaucuggagcuccgggcccggucccugccacucacccaucaauccucccaugcucccagucaccaacacgcgucccgaacccggccgcuucaugucuggcaggaaguccugcagcacccgcacaguaccuacuacauucacauccaguacagaggccacagcguccucccccagcggccccagcaggcccaggccugugucacacacugcggggacagaggcccaaccagcccgccucagcaucacccucagcacggccuguccccucaugcuccaggggccuggggacauguugguuucaacgcagggcggagaaggcuccuaggagcccauaugcuuccaggaggcucacccagcacauccacacggcccucggucacgcguucccgggcagcggccagggagcuugaguuccuuacauccagcugcaaccucuccagggaucccugagggcaugccagggcccgggccgccucccacagccggcccuguguuuucaggucccucaacguggcauacacuggagguuuugggagaggaggaagaucugacuucucuucuggccuccaagggcuuuucccuucucucccucccugucccuaccuaucuauaccuuugaagcucugggauggguccaaagccagauguauugccaagugcaggccaauaccugaggaacagccggugaugagcaccacggugcaggccauggugagacuguggggagaggcuggggcucugggcuggauaucaccugcuucgccccgccccgccugcgggcccccaccccuuguugugucucccacgcaaucucaaggauaagcccuccugcgggucccuggcccgcucuccccacccuguucugagccaaaacagacaugagcccacugcuuggaacaacaaacuguccucguuucuggucagagggaggggaggcuuuacaagcag

SEQ ID NO: 19959 - RNA, 2512 nt, Homo sapiens
cacuccugagacucaauggugagcagagacccugccccuuugcuggggcuuaggaagggcgggccagacugaggaauggcacacccucuggaggcagguguaguucaggguuuugcccucccccucccccuccuccucccuucccccuguccuggaacuucaacuguagacuggggucugagagaggccacaaacccaacccggaggccagucaggcgggaaccgugccauccucauauugcucccagacugcuagagccaagagggggaggugggggagggggccagggacaccuguccccaggcucagggaaggggggaguugagguggagcaugagggaggcaauggccugguaaagccgacccugcccaagcuggaagcuuggggacgccuggguccugcacccuuccuacgugaaccuccaccuauuuucuggaaggucugaguggggcugucagccacaccacauguggcagguacugaccacccucuuaggcuaacuccccuaaucgcagugcccugcuucccucccuccccccuccucuauauuuauccacccuccgccuccgccaggugcuggcgccggccccggcggcgcagcccgccccacccgggcaccgagccacugggccugcuggggaccccugcgcgggggaugggagccugacccgggccacagcacacgggagucuggccgccagugugcaggagggaugggggaggagacgucaagggauggaggucucccacaccaaucgugccuccguuuccccacggggagauucgacaaaaccaggcagcagcccagugucccucaccauccauccccucagggguuucccaggagccucacccgggaaagccgagaguucuguccugaguggcaggguaaugaggagggguccucaaagagcucccaccucccucuccuugggguccccgccacagaccccaauccugggaugacuucucccccucguccaggucuccgcagcgggagcucucgcaucuggccuccgcacuugcgaacugggagcggagggggacccaggcguucgagccgcccagccggccucgccacauuccucggcgcuggcggaggcggaaggagacgggaugggacgcgggcccagcggggaagggagaggcagggccaggucgggccacgcgugacgccuccccugccucagggcccccagcagguggauagcgcccagccugcagcgggaggcccacaggcacaucccgaguagggcugcugcuccgagagcucccgggggcuuuggcccccaggcaaaaaacucucccucaucccuaguucgccaagcgcgcagcguguggcuggaggcuggagcggaucagcgugacggccgguuacagcgagagugauugagacgaggcuccgaacccccgggacuuacccucccgccgcccgcuggacucgggguccgcagcucaaagguuuccucguccucguccucguccccguccccgcuaagcucgccguccccguagucccggugcagaagagugaagccucgacggcagcagagaagccaccauagucccccggggagaggcauccgggcgaggagcugcggaugggggcgcgggcagccgcggccgagcaguagggggucggaggaacuggcggggcuccgacccgagcaggggaaagaugaggugggaggagcagaagggagaagaggacagggaggaggcaguguccugggcuggggugcaaggggacgcuagccagacgcugaggggggcucagugucugggcccccggaggggggagggggaaaagcguccagggccccgggagaggagggagcaauguccggagcugggaaguaguguccguuggaguguccagcccuguggggggcaguguccggugcagcguccgaggugggcaguuguccaagcuccagggagggucguguccgguagggcguccgguggccggggcccgggccgcgcgcgcugcgcucccugcagccccgggacuggcgcgcugggggcgcgagcacagagcugggaccccgcccccccggcccccucccucccggggggcccccccucucucuucuuucucuccucccuucuuuacuaggcaggguccagguuucgucacagucuccucuguccaaucccugugccuggcgccgggcgcggcuaccaaucagacggcugaaaccgcguuggguugcaucaugugccccuggcuuggugacagcggggaggggcggggaaacagggagggaggggacgaggcuauguuagccacgccccagucucugaggucggacgcggggugcuagugacgucacggaagcccgccuucaggcucuuguuuuaacucuuggcucaccaaccaauuaaaaacccuguugaggaguuuuggcacaggacagaggaaaacccaacugccgcucucugaaccccugucucgucucagggucccugagaaagggaaacgccuuggcuacuaagaggauguccag

SEQ ID NO: 19960 - RNA, 2512 nt, Homo sapiens
cuggacauccucuuaguagccaaggcguuucccuuucucagggacccugagacgagacagggguucagagagcggcaguuggguuuuccucuguccugugccaaaacuccucaacaggguuuuuaauugguuggugagccaagaguuaaaacaagagccugaaggcgggcuuccgugacgucacuagcaccccgcguccgaccucagagacuggggcguggcuaacauagccucguccccucccucccuguuuccccgccccuccccgcugucaccaagccaggggcacaugaugcaacccaacgcgguuucagccgucugauugguagccgcgcccggcgccaggcacagggauuggacagaggagacugugacgaaaccuggacccugccuaguaaagaagggaggagagaaagaagagagagggggggccccccgggagggagggggccgggggggcggggucccagcucugugcucgcgcccccagcgcgccagucccggggcugcagggagcgcagcgcgcgcggcccgggccccggccaccggacgcccuaccggacacgacccucccuggagcuuggacaacugcccaccucggacgcugcaccggacacugccccccacagggcuggacacuccaacggacacuacuucccagcuccggacauugcucccuccucucccggggcccuggacgcuuuucccccuccccccuccgggggcccagacacugagccccccucagcgucuggcuagcguccccuugcaccccagcccaggacacugccuccucccuguccucuucucccuucugcuccucccaccucaucuuuccccugcucgggucggagccccgccaguuccuccgacccccuacugcucggccgcggcugcccgcgcccccauccgcagcuccucgcccggaugccucuccccgggggacuaugguggcuucucugcugccgucgaggcuucacucuucugcaccgggacuacggggacggcgagcuuagcggggacggggacgaggacgaggacgaggaaaccuuugagcugcggaccccgaguccagcgggcggcgggaggguaagucccggggguucggagccucgucucaaucacucucgcuguaaccggccgucacgcugauccgcuccagccuccagccacacgcugcgcgcuuggcgaacuagggaugagggagaguuuuuugccugggggccaaagcccccgggagcucucggagcagcagcccuacucgggaugugccugugggccucccgcugcaggcugggcgcuauccaccugcugggggcccugaggcaggggaggcgucacgcguggcccgaccuggcccugccucucccuuccccgcugggcccgcgucccaucccgucuccuuccgccuccgccagcgccgaggaauguggcgaggccggcugggcggcucgaacgccugggucccccuccgcucccaguucgcaagugcggaggccagaugcgagagcucccgcugcggagaccuggacgagggggagaagucaucccaggauuggggucuguggcggggaccccaaggagagggaggugggagcucuuugaggaccccuccucauuacccugccacucaggacagaacucucggcuuucccgggugaggcuccugggaaaccccugaggggauggauggugagggacacugggcugcugccugguuuugucgaaucuccccguggggaaacggaggcacgauuggugugggagaccuccaucccuugacgucuccucccccaucccuccugcacacuggcggccagacucccgugugcuguggcccgggucaggcucccaucccccgcgcagggguccccagcaggcccaguggcucggugcccggguggggcgggcugcgccgccggggccggcgccagcaccuggcggaggcggaggguggauaaauauagaggaggggggagggagggaagcagggcacugcgauuaggggaguuagccuaagaggguggucaguaccugccacaugugguguggcugacagccccacucagaccuuccagaaaauagguggagguucacguaggaagggugcaggacccaggcguccccaagcuuccagcuugggcagggucggcuuuaccaggccauugccucccucaugcuccaccucaacuccccccuucccugagccuggggacaggugucccuggcccccucccccaccucccccucuuggcucuagcagucugggagcaauaugaggauggcacgguucccgccugacuggccuccggguuggguuuguggccucucucagaccccagucuacaguugaaguuccaggacagggggaagggaggaggagggggagggggagggcaaaacccugaacuacaccugccuccagagggugugccauuccucagucuggcccgcccuuccuaagccccagcaaaggggcagggucucugcucaccauugagucucaggagug

SEQ ID NO: 19961 - RNA, 2857 nt, Homo sapiens
gucguuuuuccccucucugggucacagguuuugaagucaaccugauuuccccccucaucuccuagugcccugcuucagauuugggcaggucuugcugaacuggagucccagaagagagcccacagauacaggaggcugugucccaggaaggagacauaggcccuuccuucuugaggccccaggagggagacaggacacagagacauagaacucucagugaacagagcagaggcccugagagcugggcaguuagagagggcaggaagagugcaauugggcaaucaaggcaagcuucuuggaggaaaggggcagggaaggguggaugucaggggagaucagucugcaggcaggcucuggaauagguacagaguggugagggauucgaguuggauuccaguuuaaacauccacagagccuuuaggcuucaguagcuaguccaggggagggggguacauggagggugucccuauggccuugucacuaagaaagaacaguucgugacuuauccacugcgugugaauucagcgagauuggggagggagguuucuuagggauagggcagccuccacacucccauugcuccucuacucagggaaagggggacgguagaaauggccugccucuccggccagcacacguacagccaucucacccccacacggcucuuccuccacagccccauuuuggauuacacuucaccuccagccacuccagcccugggcgcuaguacuacagcuccuggggaaacgccccgggguguuggugcccgacucgucccccagccgucuucggcuucacggggugggggagggacagcccugaccccaucugcucuccuaggcugccuagcaggcuccugucgccgcuccccgccccuucuuccagaguuccauccacuccugcccccacucgaccagaguuccuuccacagcaguuccuggccugggcgcuguccagcuccaggcuggguggucgagucuucccugggcuccgagcagagggaacuccgcagcccgccccagccuuguccuggggcgccucuguccaagucgguuuucucuucccuggcccccacgccuccacccuccacuucuacgggaugccaccuccacgaaggagaaaggaaaggaaauacaaaggcauacauuccguuucuguggaauuugcucuuuauuuugggaccagggaaggaccacacacagcccuccagcccagggggcgggggcaccgagacgcgggcggagggccgcacccgaacccugcccagacgccgccgucgggaggcagaauccggguuucuggggucgggagugcguaugcaaaugacgugggcgugguuggcagaucucccaggaggccucagggguccucaccacaggucugggcccuccgaccugcggaagcgaaggggaaggaauuggaucuggggaggcgagccugggagacgucguuaagugauguugccaggguagggccaggccgcgcucucggaugcaggaugugugguaacgggcgcuuuuaccgcgaccugacggggcgguccucgccgucggggaagaacguuuuggaaagaagcguguccgggccgucucuuuucccauaccugggggcggggaagggaagagcguggucagaucuggccacgcccccagguggagcggggccgcagggugagagccccaggggucccgcuccgcgccugcgcucaccgcugccgggugaccagguugagguaguggcgcagggaggcguaguagcgguucagcuccuccggcgaggcgucuucgcggggagccucggguuugaugggguaggcgucgaccagcgccccuaggcagacgagcagggccagaagcacuguggucaaggcgggccacggccugcgcacgaacaccaucugggaaggcgacauugggacgugggucauuccaagccucgacccuacacggcgggaggcugcggcugccgucggggccgcgcuccgacgcucucccuggggcugguaccggaccaaggcucagccaccgggcuugcuguguguucuugggcacugcaccgucuccugacucaguuuccucaugucagaggagcauaagcccugccugccuccccacccccacccccgcugcuggccuccuucccaccuccgauggcccccuccaauccaguuuccuaccacucacccccagcuuccaccaucccagccucaguuuccccacaaaacagccuggguuuccccaggcuugagcccccagccacucacagcgauagcuugugaagcagacgagcaggagguggaaggcgagggaagucccaagggcugcacugccgcaggucaagcugaggccuccucugcucagcgcuuuccuuguggggcuuauauccccgccuggaaagggagggggagucccagggggagggggagccagcagggggugggcccuucuuccucccuccuuccacccucgccagaucgcugagcuuauacccagccagugcgugaugucuccaccucgcaggagcugagggggcaguugccaugcucagauucguggucucacuggaugggguacccagccugaaccccauguucaccccacagccccccaguggcaggucuagccuccugaggaagugaagcgguuggaucuagacuccuggggcagccccuaggaccaggguugagauucugucuucccuagccuguccguggaugggaguugggggugggaggguggacacauucccuccaguccgugggaugugugaccacucuuuccaaaagacaacccuuuucagccucuguucaguaauaccuuggagaagggcugaggaaugacaggaccuuuuggggaaa

SEQ ID NO: 19962 - RNA, 2857 nt, Homo sapiens
uuuccccaaaagguccugucauuccucagcccuucuccaagguauuacugaacagaggcugaaaaggguugucuuuuggaaagaguggucacacaucccacggacuggagggaauguguccacccucccacccccaacucccauccacggacaggcuagggaagacagaaucucaacccugguccuaggggcugccccaggagucuagauccaaccgcuucacuuccucaggaggcuagaccugccacuggggggcuguggggugaacaugggguucaggcuggguaccccauccagugagaccacgaaucugagcauggcaacugcccccucagcuccugcgagguggagacaucacgcacuggcuggguauaagcucagcgaucuggcgaggguggaaggagggaggaagaagggcccacccccugcuggcucccccucccccugggacucccccucccuuuccaggcggggauauaagccccacaaggaaagcgcugagcagaggaggccucagcuugaccugcggcagugcagcccuugggacuucccucgccuuccaccuccugcucgucugcuucacaagcuaucgcugugaguggcugggggcucaagccuggggaaacccaggcuguuuuguggggaaacugaggcugggaugguggaagcugggggugagugguaggaaacuggauuggagggggccaucggaggugggaaggaggccagcagcggggguggggguggggaggcaggcagggcuuaugcuccucugacaugaggaaacugagucaggagacggugcagugcccaagaacacacagcaagcccgguggcugagccuugguccgguaccagccccagggagagcgucggagcgcggccccgacggcagccgcagccucccgccguguagggucgaggcuuggaaugacccacgucccaaugucgccuucccagaugguguucgugcgcaggccguggcccgccuugaccacagugcuucuggcccugcucgucugccuaggggcgcuggucgacgccuaccccaucaaacccgaggcuccccgcgaagacgccucgccggaggagcugaaccgcuacuacgccucccugcgccacuaccucaaccuggucacccggcagcggugagcgcaggcgcggagcgggaccccuggggcucucacccugcggccccgcuccaccugggggcguggccagaucugaccacgcucuucccuuccccgcccccagguaugggaaaagagacggcccggacacgcuucuuuccaaaacguucuuccccgacggcgaggaccgccccgucaggucgcgguaaaagcgcccguuaccacacauccugcauccgagagcgcggccuggcccuacccuggcaacaucacuuaacgacgucucccaggcucgccuccccagauccaauuccuuccccuucgcuuccgcaggucggagggcccagaccuguggugaggaccccugaggccuccugggagaucugccaaccacgcccacgucauuugcauacgcacucccgaccccagaaacccggauucugccucccgacggcggcgucugggcaggguucgggugcggcccuccgcccgcgucucggugcccccgcccccugggcuggagggcugugugugguccuucccuggucccaaaauaaagagcaaauuccacagaaacggaauguaugccuuuguauuuccuuuccuuucuccuucguggagguggcaucccguagaaguggaggguggaggcgugggggccagggaagagaaaaccgacuuggacagaggcgccccaggacaaggcuggggcgggcugcggaguucccucugcucggagcccagggaagacucgaccacccagccuggagcuggacagcgcccaggccaggaacugcuguggaaggaacucuggucgagugggggcaggaguggauggaacucuggaagaaggggcggggagcggcgacaggagccugcuaggcagccuaggagagcagauggggucagggcugucccucccccaccccgugaagccgaagacggcugggggacgagucgggcaccaacaccccggggcguuuccccaggagcuguaguacuagcgcccagggcuggaguggcuggaggugaaguguaauccaaaauggggcuguggaggaagagccgugugggggugagauggcuguacgugugcuggccggagaggcaggccauuucuaccgucccccuuucccugaguagaggagcaaugggaguguggaggcugcccuaucccuaagaaaccucccuccccaaucucgcugaauucacacgcaguggauaagucacgaacuguucuuucuuagugacaaggccauagggacacccuccauguaccccccuccccuggacuagcuacugaagccuaaaggcucuguggauguuuaaacuggaauccaacucgaaucccucaccacucuguaccuauuccagagccugccugcagacugaucuccccugacauccacccuucccugccccuuuccuccaagaagcuugccuugauugcccaauugcacucuuccugcccucucuaacugcccagcucucagggccucugcucuguucacugagaguucuaugucucuguguccugucucccuccuggggccucaagaaggaagggccuaugucuccuuccugggacacagccuccuguaucugugggcucucuucugggacuccaguucagcaagaccugcccaaaucugaagcagggcacuaggagaugaggggggaaaucagguugacuucaaaaccugugacccagagaggggaaaaacgac

SEQ ID NO: 19963 - RNA, 2928 nt, Homo sapiens
gccccgaccagguccagccccgcccaacggcaaguuaagagccccccagugccagacgcuccagacagacugccacucuuggggggcaagaguugguugucgucauggcgacggcgcugauggcugugguucugcgggcagcugcuguagccccgaggcugagaggccggggaggcacugggggcgcccgaaggcugagcuguggcgcgcggcggcgggcggcgaggggcaccagcccggggcgccggcucagcaccgccuggucgcagccccagcccccgcccgaggaguacgcgggcgcggacgacgucucccagucgcccgucgccgaggagccgucgugggugccgagucccaggcccccggugccccacgaguccccagagccuccuucgggccgcucgcuggugcagcgggacauccaggccuuccugaaccagugcggggccagcccuggggaggcgcgccacuggcucacgcaguuccagaccugccaucacuccgcggacaagcccuucgccgucaucgaggugagcggagcccggcgugggccgugacgcagcgaggggaugggguugugcggccaccuguccucaggcauggcaggauacgcugcgggcucugcgcagcggaagcgggaaggagcccggcagggcccagaccagcgccgccgggaaugggagaggccguaagcuccuccggaagccucccgcccagcccgagugaggauccugggggaccccacccgccaggugugaugcucugaagaaggcccccaacaugggcgcaguuagggguucagaaggaccuggacaggagccgcuugcacugccccucccccaaagaugucccggaguccaaggucggagggaggagggcgggagguaccccagcgugagacaagggaguggcaagacccaacggggcaaagggcggagcaggugggcacugguggccagaacuggguccugacagcuucuggaaggguagggucaccgagacggcccugcaggccaggcugugggagccagcggcucagguccgugucacgcuccuugaaagcccacuccuccgcagguggacgaggaggugcucaagugccagcagggcguauccagucuggccuuugcccuggccuucuugcagcgcauggacaugaagccgcuggugguccuggggcugccggccccuacggcucccucgggcugucuuuccuucugggaggccaaggcgcagcuggccaagagcugcaaggugcugguagacgcgcuucgacacaacgccgccgcugcugugccauuuuuuggcggcgggucugugcuacgcgcugccgagccggcuccccaugccaggugagugcccgcccugcccgcccaggcguccucagagcgugcuacucugcccgcccugccccguccggcaggccuggagggggcccucucgagcaccacgucuggcccacagcuacggcggcaucgucucgguggagacagaccugcugcaguggugccuggagucgggcagcauccccauccugugccccaucggggagacggccgcgcgccgcuccgugcuucucgacucccuggaggugaccgcgucgcuggccaaggcgcugcggcccaccaaaaucaucuuccucaauaacacaggcggccugcgcgacagcagucauaaggugcggcccuuucuuucaccuucccccacgccggcgauccgggccuucucuugcgccccucgcacuucuccccgacgggccgcagacucacuagcaagccggguggguagaaaagccuaagggaguauaggggaggaguucagcccugggugcccagaucugcgcccucccuggcuaaggacuccgggcggaaguaaggauaaaggggucagagaaaagagagguccguggggguaggggggcaguccgugccggcugugggccaggcucacccgcugacuccggacacagguccugaguaacgugaaccugcccgccgaccuggaccuggugugcaacgccgagugggugagcacaaaagaacggcagcagaugcggcucaucguggacgugcucagccgccugccccaccacuccucggccgucaucaccgccgcuagcacgcugcucacugagcucuuuagcaacaagggugagggcggugggcgggccggggacugggucccgggagugaguacuggccggggcugggugucugcggucaggaggagcggcuucuccuccuguccaggagccguagggggaggcggggggugucacagcaauggcuccugcugcugccgaaacccgggggaggugagagaggaggagacccaguguacuggaagggaacuccgaaggaauuaaaggaaugggcgggacuaggggggagaaggaggggccccccggugggcggggccaggggcgggaccauaagggagguguucgaccgggagagaugggcggggcuuaggugggugggccgggucagcggcgggagacagacuucaaggagcgaggcaagacuaacggaaguggguggggcuccaggcgacaggaggaacuuggggcacaaucucugccuggggaaagcaucuccuugaaugaaaaucacagacaaaucuaugcagaccacugaaaucauuucacuguggaggucucccaaagacggaaauugucccaccagcgccuguccuaccugcaguccccaccaggcugcgcaaacggcccuccagccagacuagccccuccccauccuccuccaggguccgggacccuguucaagaacgccgagcgaaugcuacgggugcgcagccuggacaagcuggaccagggccgucuaguggaccuggucaacgccagcuucggcaagaagcucagggacgacuaccuggccucgcugcgcccgcggcugcacuccaucuacgucu

SEQ ID NO: 19964 - RNA, 2928 nt, Homo sapiens
agacguagauggagugcagccgcgggcgcagcgaggccagguagucgucccugagcuucuugccgaagcuggcguugaccagguccacuagacggcccugguccagcuuguccaggcugcgcacccguagcauucgcucggcguucuugaacagggucccggacccuggaggaggauggggaggggcuagucuggcuggagggccguuugcgcagccugguggggacugcagguaggacaggcgcuggugggacaauuuccgucuuugggagaccuccacagugaaaugauuucaguggucugcauagauuugucugugauuuucauucaaggagaugcuuuccccaggcagagauugugccccaaguuccuccugucgccuggagccccacccacuuccguuagucuugccucgcuccuugaagucugucucccgccgcugacccggcccacccaccuaagccccgcccaucucucccggucgaacaccucccuuauggucccgccccuggccccgcccaccggggggccccuccuucuccccccuagucccgcccauuccuuuaauuccuucggaguucccuuccaguacacugggucuccuccucucucaccucccccggguuucggcagcagcaggagccauugcugugacaccccccgccucccccuacggcuccuggacaggaggagaagccgcuccuccugaccgcagacacccagccccggccaguacucacucccgggacccaguccccggcccgcccaccgcccucacccuuguugcuaaagagcucagugagcagcgugcuagcggcggugaugacggccgaggagugguggggcaggcggcugagcacguccacgaugagccgcaucugcugccguucuuuugugcucacccacucggcguugcacaccagguccaggucggcgggcagguucacguuacucaggaccuguguccggagucagcgggugagccuggcccacagccggcacggacugccccccuacccccacggaccucucuuuucucugaccccuuuauccuuacuuccgcccggaguccuuagccagggagggcgcagaucugggcacccagggcugaacuccuccccuauacucccuuaggcuuuucuacccacccggcuugcuagugagucugcggcccgucggggagaagugcgaggggcgcaagagaaggcccggaucgccggcgugggggaaggugaaagaaagggccgcaccuuaugacugcugucgcgcaggccgccuguguuauugaggaagaugauuuuggugggccgcagcgccuuggccagcgacgcggucaccuccagggagucgagaagcacggagcggcgcgcggccgucuccccgauggggcacaggauggggaugcugcccgacuccaggcaccacugcagcaggucugucuccaccgagacgaugccgccguagcugugggccagacguggugcucgagagggcccccuccaggccugccggacggggcagggcgggcagaguagcacgcucugaggacgccugggcgggcagggcgggcacucaccuggcauggggagccggcucggcagcgcguagcacagacccgccgccaaaaaauggcacagcagcggcggcguugugucgaagcgcgucuaccagcaccuugcagcucuuggccagcugcgccuuggccucccagaaggaaagacagcccgagggagccguaggggccggcagccccaggaccaccagcggcuucauguccaugcgcugcaagaaggccagggcaaaggccagacuggauacgcccugcuggcacuugagcaccuccucguccaccugcggaggagugggcuuucaaggagcgugacacggaccugagccgcuggcucccacagccuggccugcagggccgucucggugacccuacccuuccagaagcugucaggacccaguucuggccaccagugcccaccugcuccgcccuuugccccguugggucuugccacucccuugucucacgcugggguaccucccgcccuccucccuccgaccuuggacuccgggacaucuuugggggaggggcagugcaagcggcuccuguccagguccuucugaaccccuaacugcgcccauguugggggccuucuucagagcaucacaccuggcggguggggucccccaggauccucacucgggcugggcgggaggcuuccggaggagcuuacggccucucccauucccggcggcgcuggucugggcccugccgggcuccuucccgcuuccgcugcgcagagcccgcagcguauccugccaugccugaggacagguggccgcacaaccccauccccucgcugcgucacggcccacgccgggcuccgcucaccucgaugacggcgaagggcuuguccgcggagugauggcaggucuggaacugcgugagccaguggcgcgccuccccagggcuggccccgcacugguucaggaaggccuggaugucccgcugcaccagcgagcggcccgaaggaggcucuggggacucguggggcaccgggggccugggacucggcacccacgacggcuccucggcgacgggcgacugggagacgucguccgcgcccgcguacuccucgggcgggggcuggggcugcgaccaggcggugcugagccggcgccccgggcuggugccccucgccgcccgccgccgcgcgccacagcucagccuucgggcgcccccagugccuccccggccucucagccucggggcuacagcagcugcccgcagaaccacagccaucagcgccgucgccaugacgacaaccaacucuugccccccaagaguggcagucugucuggagcgucuggcacuggggggcucuuaacuugccguugggcggggcuggaccuggucggggc

SEQ ID NO: 19965 - RNA, 2766 nt, Homo sapiens
cuucuuugggaaaggaagacauuccauugaugaaggugacauugcugcaucccuuauuggugauuaauagggggaaucauggggcugucugcagaaugagccuuugcuggauacuggggccucccauuuggucaggaaccaaggacaaagaggagagacacggggaugucugauagacacacgugggaaagagagacauacaaggaauagagaagagugggguuagauccggggaggagaggccagaaacccagggagagauggaaaaggcagacacaggagagagauggacaagaaacagcaaaauagaagaaagaggcaggggagaggcagaaaccagagaaaagguguuggcggggcagcagccaggcagaggaaagagaagaagggcugacuuauaagcaccuggcaggcuaucugcucacuuucccugccugccccugucucugccccuaagacuugcagacccgcaggcuggcagagccucagggcagugcugcugugggaaggguuccaacaaggucuuguaucuuaaucgugagagauuccuucucaacuuccacuagcucagcuuuaguucugaccagugguccccuucuucgaagagaaugcucagccugaccacacccccaggucacaggccaccacgagugagagcacugggaagggaggugguaucaagagagcuggcuaaaauugucaccccagggcggggcuggguggaggcugguccuggggucggccauuccaaggagagcuacacgcacaugcgagucccgguaccagaguccccgacacacucagugcuuuccagcugcagcgucugagauggggacggagaauggagaggaccccacacacuccagagucaggaggggcuggagcugggagaccaagaggagggggaguuuccaucucuuccaccaccccccaccccccacccccuccccgccucaggaggaaaaacucccccgccccccagacugccuucuuuuuggggaagcucugcuacagugggaaacagcuccccaacucccggauuuugcaaagggugucagauucgcccaauggucccuucuccagggcaggggaggcacugcagccagggcuguaagcaccgggcucccuuugccuuugugccccaaacauuuccugcagccagccuucuccgcucgcgcccauggccacgcgccuaggcgcccgcgggcgcggaugcugcuucucccuguuccauacgccagagcccauccuugcccuccccuuaucgcccacugcugucggcccgaauccacuucccaaggggcaagcccccaagggcaaguccgugcaccugggagcccugcgcucugacuaguuggguucauuucccgcauuuccaguagcguuccagacggugcccagcagcgucugucuuggagcgggaacccaggaacugaggaucggcgauguccgcuggcuccgaccauccccacacgugaugaccaagcggggccgcuguggggugggaucuccaccugcguccgccuggcgcccccgccaacuccgaucagguacccauuugccccgggcucccugggugcccugggcccagcccagccccaugcccccgccuggcccaccuggccauucuugcagaggucugcccacauacuggugccgucgccgccgcgcaugaggacaugguaggugaaaaaguaggugccgggaauguugcacguaaacuugccgcuggccgcgucguaguuguugccuagguuggugaccacgucgucaaacuugaguaccucguaacccucguggggguucuugaggccggcguagaaggccacgcgcggcaccgugguguagguggcagugcugauggcgccgcugccccccgcgcccggcagccccggagggcccggcuugccuggcucacccuucucccccggcggccccacagggccgggaggaccuggguccccgggaggccccggagggccgggcuugccggugcggcccggcuuccccugggggcccugcaccagcguggaaggcgggggcgcgccgcucugcucgcucagggcgucgccgccgucgguccgcgcgccggcgccggggccccgcgcgggguaggggucgcacaccaugcggcaggugcccagcaucucauaguggccuuccgggccgcccgagcucaccagcacggggaugagcaccaccagcaccagcagcaucaccacacccgcggcggccgcuagcagcgucuuucggcccgcgcggagccuggggagcgccgggccgcccggccgcgccgucggggcaauggugccggcgggcagggggcgcgggcuaggcgcccgcgcucaaggacgguccggcggggcugcgggcauggggccgggcccggggcgccgcgcugcgcuggcugcgcugcggagcccagccgccggcuccugccucgcgccucccuccugcugcgcugccggacugagcgccgcggccgccgccucccgccucccgccucccgccugcagccucccgccugacuccucccgccuccuugagccgggccaccgcccccucggccgggccccgccccgccagcuccgcgcggcucugggcucucuagggguggggcugcgggcggggccggcgccuaauugggccgcgggcgccucgaggugggcggggcauaagggggcggggccgcggagaccccgggcgggagcagggagaggaaagaagagacugaguacgcggagaccgagauucggaaauggggug

SEQ ID NO: 19966 - RNA, 2766 nt, Homo sapiens
caccccauuuccgaaucucggucuccgcguacucagucucuucuuuccucucccugcucccgcccggggucuccgcggccccgcccccuuaugccccgcccaccucgaggcgcccgcggcccaauuaggcgccggccccgcccgcagccccaccccuagagagcccagagccgcgcggagcuggcggggcggggcccggccgagggggcgguggcccggcucaaggaggcgggaggagucaggcgggaggcugcaggcgggaggcgggaggcgggaggcggcggccgcggcgcucaguccggcagcgcagcaggagggaggcgcgaggcaggagccggcggcugggcuccgcagcgcagccagcgcagcgcggcgccccgggcccggccccaugcccgcagccccgccggaccguccuugagcgcgggcgccuagcccgcgcccccugcccgccggcaccauugccccgacggcgcggccgggcggcccggcgcuccccaggcuccgcgcgggccgaaagacgcugcuagcggccgccgcggguguggugaugcugcuggugcugguggugcucauccccgugcuggugagcucgggcggcccggaaggccacuaugagaugcugggcaccugccgcauggugugcgaccccuaccccgcgcggggccccggcgccggcgcgcggaccgacggcggcgacgcccugagcgagcagagcggcgcgcccccgccuuccacgcuggugcagggcccccaggggaagccgggccgcaccggcaagcccggcccuccggggccucccggggacccagguccucccggcccuguggggccgccgggggagaagggugagccaggcaagccgggcccuccggggcugccgggcgcggggggcagcggcgccaucagcacugccaccuacaccacggugccgcgcguggccuucuacgccggccucaagaacccccacgaggguuacgagguacucaaguuugacgacguggucaccaaccuaggcaacaacuacgacgcggccagcggcaaguuuacgugcaacauucccggcaccuacuuuuucaccuaccauguccucaugcgcggcggcgacggcaccaguaugugggcagaccucugcaagaauggccaggugggccaggcgggggcauggggcugggcugggcccagggcacccagggagcccggggcaaauggguaccugaucggaguuggcgggggcgccaggcggacgcagguggagaucccaccccacagcggccccgcuuggucaucacguguggggauggucggagccagcggacaucgccgauccucaguuccuggguucccgcuccaagacagacgcugcugggcaccgucuggaacgcuacuggaaaugcgggaaaugaacccaacuagucagagcgcagggcucccaggugcacggacuugcccuugggggcuugccccuugggaaguggauucgggccgacagcagugggcgauaaggggagggcaaggaugggcucuggcguauggaacagggagaagcagcauccgcgcccgcgggcgccuaggcgcguggccaugggcgcgagcggagaaggcuggcugcaggaaauguuuggggcacaaaggcaaagggagcccggugcuuacagcccuggcugcagugccuccccugcccuggagaagggaccauugggcgaaucugacacccuuugcaaaauccgggaguuggggagcuguuucccacuguagcagagcuuccccaaaaagaaggcagucuggggggcgggggaguuuuuccuccugaggcggggagggggugggggguggggggugguggaagagauggaaacucccccuccucuuggucucccagcuccagccccuccugacucuggagugugugggguccucuccauucuccguccccaucucagacgcugcagcuggaaagcacugagugugucggggacucugguaccgggacucgcaugugcguguagcucuccuuggaauggccgaccccaggaccagccuccacccagccccgcccuggggugacaauuuuagccagcucucuugauaccaccucccuucccagugcucucacucgugguggccugugaccuggggguguggucaggcugagcauucucuucgaagaaggggaccacuggucagaacuaaagcugagcuaguggaaguugagaaggaaucucucacgauuaagauacaagaccuuguuggaacccuucccacagcagcacugcccugaggcucugccagccugcgggucugcaagucuuaggggcagagacaggggcaggcagggaaagugagcagauagccugccaggugcuuauaagucagcccuucuucucuuuccucugccuggcugcugccccgccaacaccuuuucucugguuucugccucuccccugccucuuucuucuauuuugcuguuucuuguccaucucucuccugugucugccuuuuccaucucucccuggguuucuggccucuccuccccggaucuaaccccacucuucucuauuccuuguaugucucucuuucccacgugugucuaucagacauccccgugucucuccucuuuguccuugguuccugaccaaaugggaggccccaguauccagcaaaggcucauucugcagacagccccaugauucccccuauuaaucaccaauaagggaugcagcaaugucaccuucaucaauggaaugucuuccuuucccaaagaag

SEQ ID NO: 19967 - RNA, 3415 nt, Homo sapiens
cucuucauggaccuaucacugcuuacgcaagcuugggauguggucuugcccucaacagguagguagucuaccggaaaaccaaacuaaggcaagaaaaaaauuagugaauaauaaaggacugaaccgguucagagaaggcauucagcagauguuugccagucaaaugaauuaaagugugaaugaaugaaacucgagguagugggugaaugugucccaagaauccagcgaaacagggucucccaggaggcgggacuggaaggguccggagaggggccacaggcuccuggccuuucuaagcacaccaagugcccagucgcggacccccgggaccaggaugcgcugacgacccggcuggcaggcggguccucgugggcgaggcgagggaggcggcgagagaggagcaauaguuucccaccgcucccucucaggcgcagggucuagagaagcgcgaggggaucuagagaagccggaggggaggaagcgcgaguccgcggcccgccccguugcgucccacccaccgcguccccuccccuccccucccgcugcgggaaaagcggccgcgggcggcggcgcccacuguggggcgggcggagcgccgcgggaggcggacgagaugcgagcgcggccgcggccccggccgcucugggcgacugugcuggcgcugggggcgcuggcgggcguuggcguaggaggugagugaggcuccggcucggcagcgucgcagcugccccaggaucugcgccccggucaaguugcggacuuggagccggcaaacgcggagggcuggucccgcgcgucugcgcugggaaugcgcguguccuggcuggcgcggucggagccgggagcuggggaccuuccuggcccggcgguggcggggcugagaggugccuggugccugggagcggguccuccgagacgccgaagccaucagccaggcugagcgccuucccggccgccgcggcgcgcacggugcggugggcgcaucucugagccccgcgcucacccggggcugcgcgcgucgcgggugguccuggucgggccaaggacgacuggcccaggagccaaggcgagguggggcuuccggggguuguucccgcgccuuggcagagggaugccgcuguagcuuccugggugagagcgugcgcgcgcgcggguuugccaguuuccccacauuuccaauuucuccuguuacgcuuucuccagaagguuuuuucuuuuccuuuuuucuuucuuucuuucuuuuuuuuaccuucaacuuggcuuccugcgggguuguuuuggagcaggaugagggcuuugccuccuccaguguccccagguggcagcggugccucugcucccagggcagacccugcacccgaaaaaucucuaguguauucggggagccaugaaaaggcucccuugggccggugggauccuuggcuuugucucuggcugcugcgcacaccgucagccgucagggcaauuggcauucggccucuuugguacuggggacacagguggagggauggagcgggcacagcccgggguugcugcccgugguccucucugaguccuuggugauuuugccugggcuggagagaaacccuggcuccuggucugcuggggccgccucugccucagaggaugacacaagagugcauguaaguauuuuuaauaaaaacuguaguacucguaaaacaaucuacacccugcagaagggauuuguuauuuuauuuuauuauuuauuuauuuauuuauuuauuuuugagacggagucuugcucugucgcccaggcuggagugcagugguggguucucggcucacugcaacuucugccuccuggguuuaagcgauucuucuggcucagccucccgaguagcugggauuacaggcgccugccaccacggccggcuaauuuuuguauuuuuaguagagacgcgguuucaccauguuggccaggcuggucuggagcuccuggccucaagugauccgcccaccucagccucccaaagugcugggaauacaggcgugagccaccgcaccuggccaggauuuauuuuaaaaagggaagauuuguugauaaauucacuucaaagauaaacuauucgaaaauacuuuagugauucccgucaagacucuucuguguauguauagacguauaacucauucuggacagggcaaggauaucuuuuuuuguuuguuuguuuguuuugagauggacucucgcugucgccaggcuagagugcaguggcgcgauuucagcucacugcaaccuccgcuucccggguucaagggauucuccugccucagccucccgaguagcugggauuacaggcacgcaccaccacgcccuacuaauuuuuguauuuuuaguagagacgggauuuccccauguuggccaggaugaucucgaucucuugaccccgugaucagccugccuuggccucccaaagugcugggauuacaggcgugagccaccgcacccggccaaggguaucuugaaggagggauuacaguugauauguagaggaauauugcagugguuauugcugcauuuccuaugugacugggacuaaaacagaucagcugauaguguuagcgugcagugagcagucugaugacuaugacacagaaauaagaaucuccagcauucugcccugggacauguggagccuugggucagaugcugcuggcuauugaugccgggaauggagaaauccaccagggcaacucaguaaaaauaaauaaauaaauaaauaaauaaauacauaauuaaaaaaaggguauccuuguccuguccaggaugagaugcuugcuuccaugcacuuacgacaauuuuugcugucauuaaaaaauuuucacauucacagucuucuaaauucacuuuggaguguauuggauuccacugcauugacauacguaaguuugcauuaaaagauccuuuaagauaucuggucaggcacgguggcucacgccuguaaucccagcacuuugggaaguggagguagaaggauugcuugagcccaggaguucgagaccagcuugggcaacauagugagaccuaaucucuacuaaaaauuaaaaaaaaauccuuaggcgaucuguucacagauuaaucuugugauuggggcgauuccagaagugguaauggguugugcugagcuagccccacacucucucugagaagcaguguacaguaguguuuaagggcaggggcucuaaagucagacuuccagaguaauacccccccccccaaccucacaaaucaguuucuacuauauuuauaucugccaucccaguguuggugguagggucuucagaucccuggggaagcagauggugggaugagaguaggagaguuguguugggacuccaaguguugaaggggcacagaaagagcugaguggcacagagagguugucccagaguagcg

SEQ ID NO: 19968 - RNA, 3415 nt, Homo sapiens
cgcuacucugggacaaccucucugugccacucagcucuuucugugccccuucaacacuuggagucccaacacaacucuccuacucucaucccaccaucugcuuccccagggaucugaagacccuaccaccaacacugggauggcagauauaaauauaguagaaacugauuugugagguuggggggggggguauuacucuggaagucugacuuuagagccccugcccuuaaacacuacuguacacugcuucucagagagaguguggggcuagcucagcacaacccauuaccacuucuggaaucgccccaaucacaagauuaaucugugaacagaucgccuaaggauuuuuuuuuaauuuuuaguagagauuaggucucacuauguugcccaagcuggucucgaacuccugggcucaagcaauccuucuaccuccacuucccaaagugcugggauuacaggcgugagccaccgugccugaccagauaucuuaaaggaucuuuuaaugcaaacuuacguaugucaaugcaguggaauccaauacacuccaaagugaauuuagaagacugugaaugugaaaauuuuuuaaugacagcaaaaauugucguaagugcauggaagcaagcaucucauccuggacaggacaaggauacccuuuuuuuaauuauguauuuauuuauuuauuuauuuauuuauuuuuacugaguugcccugguggauuucuccauucccggcaucaauagccagcagcaucugacccaaggcuccacaugucccagggcagaaugcuggagauucuuauuucugugucauagucaucagacugcucacugcacgcuaacacuaucagcugaucuguuuuagucccagucacauaggaaaugcagcaauaaccacugcaauauuccucuacauaucaacuguaaucccuccuucaagauacccuuggccgggugcgguggcucacgccuguaaucccagcacuuugggaggccaaggcaggcugaucacggggucaagagaucgagaucauccuggccaacauggggaaaucccgucucuacuaaaaauacaaaaauuaguagggcgugguggugcgugccuguaaucccagcuacucgggaggcugaggcaggagaaucccuugaacccgggaagcggagguugcagugagcugaaaucgcgccacugcacucuagccuggcgacagcgagaguccaucucaaaacaaacaaacaaacaaaaaaagauauccuugcccuguccagaaugaguuauacgucuauacauacacagaagagucuugacgggaaucacuaaaguauuuucgaauaguuuaucuuugaagugaauuuaucaacaaaucuucccuuuuuaaaauaaauccuggccaggugcgguggcucacgccuguauucccagcacuuugggaggcugaggugggcggaucacuugaggccaggagcuccagaccagccuggccaacauggugaaaccgcgucucuacuaaaaauacaaaaauuagccggccgugguggcaggcgccuguaaucccagcuacucgggaggcugagccagaagaaucgcuuaaacccaggaggcagaaguugcagugagccgagaacccaccacugcacuccagccugggcgacagagcaagacuccgucucaaaaauaaauaaauaaauaaauaaauaauaaaauaaaauaacaaaucccuucugcaggguguagauuguuuuacgaguacuacaguuuuuauuaaaaauacuuacaugcacucuugugucauccucugaggcagaggcggccccagcagaccaggagccaggguuucucuccagcccaggcaaaaucaccaaggacucagagaggaccacgggcagcaaccccgggcugugcccgcuccaucccuccaccuguguccccaguaccaaagaggccgaaugccaauugcccugacggcugacggugugcgcagcagccagagacaaagccaaggaucccaccggcccaagggagccuuuucauggcuccccgaauacacuagagauuuuucgggugcagggucugcccugggagcagaggcaccgcugccaccuggggacacuggaggaggcaaagcccucauccugcuccaaaacaaccccgcaggaagccaaguugaagguaaaaaaaagaaagaaagaaagaaaaaaggaaaagaaaaaaccuucuggagaaagcguaacaggagaaauuggaaauguggggaaacuggcaaacccgcgcgcgcgcacgcucucacccaggaagcuacagcggcaucccucugccaaggcgcgggaacaacccccggaagccccaccucgccuuggcuccugggccagucguccuuggcccgaccaggaccacccgcgacgcgcgcagccccgggugagcgcggggcucagagaugcgcccaccgcaccgugcgcgccgcggcggccgggaaggcgcucagccuggcugauggcuucggcgucucggaggacccgcucccaggcaccaggcaccucucagccccgccaccgccgggccaggaagguccccagcucccggcuccgaccgcgccagccaggacacgcgcauucccagcgcagacgcgcgggaccagcccuccgcguuugccggcuccaaguccgcaacuugaccggggcgcagauccuggggcagcugcgacgcugccgagccggagccucacucaccuccuacgccaacgcccgccagcgcccccagcgccagcacagucgcccagagcggccggggccgcggccgcgcucgcaucucguccgccucccgcggcgcuccgcccgccccacagugggcgccgccgcccgcggccgcuuuucccgcagcgggaggggaggggaggggacgcggugggugggacgcaacggggcgggccgcggacucgcgcuuccuccccuccggcuucucuagauccccucgcgcuucucuagacccugcgccugagagggagcggugggaaacuauugcuccucucucgccgccucccucgccucgcccacgaggacccgccugccagccgggucgucagcgcauccuggucccggggguccgcgacugggcacuuggugugcuuagaaaggccaggagccuguggccccucuccggacccuuccagucccgccuccugggagacccuguuucgcuggauucuugggacacauucacccacuaccucgaguuucauucauucacacuuuaauucauuugacuggcaaacaucugcugaaugccuucucugaaccgguucaguccuuuauuauucacuaauuuuuuucuugccuuaguuugguuuuccgguagacuaccuaccuguugagggcaagaccacaucccaagcuugcguaagcagugauagguccaugaagag

SEQ ID NO: 19969 - RNA, 2453 nt, Homo sapiens
cgcagaaagaggcgggauggcggggcggaugcuggcggcccgggucuggccaccugggucagcugcacgcccccgccccgggcuggccggaccucguagcccaggucccaccacgccgugaaguuugcggaaaguuuugcaguugcuuccccgcccgcgccagcgggggaguugugacgcagcgucuggggauccuggccgggacagaagagagggaaggcgaggcggggagagacugggaaacagagcagcaagagaaagggcgcacgcugggguccuccuggacccggcguguccuccucuccgccaccccuuucucucccucccgacgcucuagccccagacccgcgccuccuccccuuccccucccacgcugcccacuucccuuccccucuaccccucgaacccuccuccccgguucugcgcuccucccuccgcccucccuccgcccgggcugccuccucccuccuccuccccgggaggcaucacuucgucccgacccggaggaggacgcgagccccuugcgggcggucaucacagcccagccucggggcugccacagcgcguugcgccugugcgcccucgguccccgcguccacugagcgccgcgcucggggauggggcccggccggccggcccccgcgcccuggccucgucaccugcugcgcugcguccugcuccucgggugccugcaccucggccgucccggcgccccuggggacgccgcccucccggguaaggcgcugccaacuuggccaacuucagggcccgggcggggggagcgccgaggcgcgggccgcucucgacuuuucccuccuuuuccccccucuuuucuccagaagcgugugugcgugugugugugacuggguuuuuaaaacucgucuccgcuuuucugaaagcgggggaggagaggggaggaggagcgcgccuagaggugggggaggaccugaguggaaccagauguggcgggcggcgggggaggggagcccgggggacuccagcagccuaggaggaagcgggugggcucuugaggacccccgcgcaccgcgcucccggaccacccggcgccggcccguccucggcaggggaccugcagggcgcgcccggggagccagggcucucuguccgggaguucccgggcccagucuccucgcucugccccaggacugaugcguuaggacggcuuuccaacuauccgcgaggguucguuucccccaccuuccccccgcccccugcaucucgugggcguugauauuuucuuuuccacacuuagucuucaaggaggcuuguggcgcgcggcauccgccccgcgugagcucggcagcccugugaggaggcuccugccacugggacgcagcaacaggcugggcgccgccgugcugugauguugcguagcgugggcagcucugggcacacuaguggcccuccagaggggacagaccuugagcggcaaaagagcugcuaaagauuuuaaaacccaacgaacaggaaacaaaacaaaaaucagaaaaccccaaaacugugccauucucuuccugcuccuuauucagggguaacagugaaguguggggacagacagaucccucgccaagaaucuaagaguugaaaggaaagauccacuuccugggggagugggggugggggugucuggagugaccgggggaaucgcccggcccagcuugguccugcuggcuguuuaauugggggauggggacaguccgugcagugucugcaguuuugugcaaggaccagacagcccccuggagagucuggggccuccagccuggcccgugcuugcuggguuggccuggcgugacguaggcacaagacacauaucugccagaugggaaaggugggggccacggugacccacauucacaccaaccggagacccccggggcaauucugggcccaccuggcauugaaugugggacagacacaaaccaggccggguaacccccuaacccacugcagggcggccucacaggcaguuccccuaccuccucgcacuccugccuuccucugcuccucugcgcagggccucaggaggcaggcggugggaagggguggggaggauggccauucccagagcuccagagcacacuuuaaagccaggcccugggagagaguuguggccagagugcugacucggccuuucccccuggagcuuuucauagagggggcuggaagugccuggugagaggcccggucagggaggacaaggacgccuggagugucccuccuccuccuggucucugugccuggcccucccuggggcuguguccagggaugaauagccucagaggguccccuucccguuggcacugcauugaccacacccugaggaggcuuggaucuggguggcaggcagugugaggucuuccagcagcagcugagcaggaggaggauggagcugcugcagguuccuucccucggaaccgugcccucugcac

SEQ ID NO: 19970 - RNA, 2453 nt, Homo sapiens
gugcagagggcacgguuccgagggaaggaaccugcagcagcuccauccuccuccugcucagcugcugcuggaagaccucacacugccugccacccagauccaagccuccucaggguguggucaaugcagugccaacgggaaggggacccucugaggcuauucaucccuggacacagccccagggagggccaggcacagagaccaggaggaggagggacacuccaggcguccuuguccucccugaccgggccucucaccaggcacuuccagcccccucuaugaaaagcuccagggggaaaggccgagucagcacucuggccacaacucucucccagggccuggcuuuaaagugugcucuggagcucugggaauggccauccuccccaccccuucccaccgccugccuccugaggcccugcgcagaggagcagaggaaggcaggagugcgaggagguaggggaacugccugugaggccgcccugcaguggguuaggggguuacccggccugguuugugucugucccacauucaaugccaggugggcccagaauugccccgggggucuccgguuggugugaaugugggucaccguggcccccaccuuucccaucuggcagauaugugucuugugccuacgucacgccaggccaacccagcaagcacgggccaggcuggaggccccagacucuccagggggcugucugguccuugcacaaaacugcagacacugcacggacuguccccaucccccaauuaaacagccagcaggaccaagcugggccgggcgauucccccggucacuccagacacccccacccccacucccccaggaaguggaucuuuccuuucaacucuuagauucuuggcgagggaucugucuguccccacacuucacuguuaccccugaauaaggagcaggaagagaauggcacaguuuugggguuuucugauuuuuguuuuguuuccuguucguuggguuuuaaaaucuuuagcagcucuuuugccgcucaaggucuguccccucuggagggccacuagugugcccagagcugcccacgcuacgcaacaucacagcacggcggcgcccagccuguugcugcgucccaguggcaggagccuccucacagggcugccgagcucacgcggggcggaugccgcgcgccacaagccuccuugaagacuaaguguggaaaagaaaauaucaacgcccacgagaugcagggggcggggggaaggugggggaaacgaacccucgcggauaguuggaaagccguccuaacgcaucaguccuggggcagagcgaggagacugggcccgggaacucccggacagagagcccuggcuccccgggcgcgcccugcagguccccugccgaggacgggccggcgccgggugguccgggagcgcggugcgcggggguccucaagagcccacccgcuuccuccuaggcugcuggagucccccgggcuccccucccccgccgcccgccacaucugguuccacucagguccucccccaccucuaggcgcgcuccuccuccccucuccucccccgcuuucagaaaagcggagacgaguuuuaaaaacccagucacacacacacgcacacacgcuucuggagaaaagaggggggaaaaggagggaaaagucgagagcggcccgcgccucggcgcuccccccgcccgggcccugaaguuggccaaguuggcagcgccuuacccgggagggcggcguccccaggggcgccgggacggccgaggugcaggcacccgaggagcaggacgcagcgcagcaggugacgaggccagggcgcgggggccggccggccgggccccauccccgagcgcggcgcucaguggacgcggggaccgagggcgcacaggcgcaacgcgcuguggcagccccgaggcugggcugugaugaccgcccgcaaggggcucgcguccuccuccgggucgggacgaagugaugccucccggggaggaggagggaggaggcagcccgggcggagggagggcggagggaggagcgcagaaccggggaggaggguucgagggguagaggggaagggaagugggcagcgugggaggggaaggggaggaggcgcgggucuggggcuagagcgucgggagggagagaaagggguggcggagaggaggacacgccggguccaggaggaccccagcgugcgcccuuucucuugcugcucuguuucccagucucuccccgccucgccuucccucucuucugucccggccaggauccccagacgcugcgucacaacucccccgcuggcgcgggcggggaagcaacugcaaaacuuuccgcaaacuucacggcguggugggaccugggcuacgagguccggccagcccggggcgggggcgugcagcugacccagguggccagacccgggccgccagcauccgccccgccaucccgccucuuucugcg

SEQ ID NO: 19971 - RNA, 2718 nt, Homo sapiens
uuccacugggaaacuggaaggcccuggguccacacaugccuucgggucgugccaguagcaugacuuaugacuuacugugccaggcaguuggcaccugauggaacuugcuugugagguggaauauggggcauugcagccccugcucuguauccagcucaggugcuguggcagguagugacguggguacauucuccagaggagaggaguagguguucgugaucugagcaauugcacacuaaaaaugauguuuuucaaaagaaaagaggagggugugaucaugagcccacuggcucuuuuguguggcuguguuucucgaacuacugauugcacauuucuguuaccugcagacuccacucagcccugccauuaggcuccaaauugcaaagggcaaagcagccucuuuugggagugggggugggagacagaggugggcaggauccccgaugagaugagaacaagcauggucuggaggggaaaagggggccaaguugacuucacuaagcagauccagcuucacaaagccucuuuucagaugacuucaaaugcggccagaaaagggcuaugguuuuaagagcuccuugccaaccuccaccaagaaacaaccgcggcugaacucugugcagggguuggaacugcaguaaggaaggcuaggugugugggagaacuucccgaacaaccgaggggcggaguuaacacgcggggaaagguuaccgaaaaagaaggaauucuguccaaggguuuuugaaaaaucaaaggaaagcccccaccaacucccuccacccgguccccgaucugagcgccacgcuuaagcagcaaaccugugcccaaccuugcugggaccagguggccccuccccagccaccuguuaguucaaguuccgcagccgggcagaagggcgcccggaaggcgccgaagccgagcgcauuuuggcguuggaggcauccaggccccuccccaguagggagcuguccccacggucccggggcugaaauccugguccccuagcauuccagccucaugacaccuacuacucagccuccagucgcauuugggggucgcagcgcccagcuccgacgagaugaccacgccccucccagucuguucccgguccgcagaucgguccugcacacccuaguuuccuacugaggucuccgcagccucccugcugaggggccgcgaccgaggucgcugucuccguugggggagacucggugucgcuccccuuaccaccccaccgcacagcgaggagcgggccggugacuccgugggagacgaggcgggcgucgggcugggccuacccagcuacccuagauccgcuaggaacucagccccuaccccggcuccgaccgcgcccccgccccuacuucugccccuacuucugcccccaccccucagcccgagccuguagaaagcgcccagcggcaccgacgcgccccgcccccggccggccccgccccaggauggccaguucccauagcaauagcacagacaccgguugccaagcaaccccucccccccucccguccgcuccccccaaccccagccuccucccgcccccucgccagccuccaccucccccgggggugccggcgcggccccuggggaucgcucgggucccgggcuacgcgcgcgugcuugaguuucgguguguuucauugugucugugggcgagggggugugcgcguggagaguuugugggaucggugugcuggggagguccccagccgagagggaccagagcugauguacagcuggccgcgaagggacccgcccgccagcuccggcuccuuugugucucgcgcggagccagcgccgcgcccacccucuccccggcccgcgcgccgggcagugugugcgcgugugugugugugcgcgcgcgcgcgcgcgcguguguauauguguguguguguguguguguguguggggcggcgaggggucggggcuggccguaccuucgaugcagcacacccgccacagaccagagugggugaggucgccgcgggcgcggcggggcgggggcccgucguccauggucagguuggugccguugcagaugugcgcgcuggaguacagccaguagucggugccgauggcgauggccaugagcgagaaggcggcgaaggcuccggccguggucagcagcaucugcagcccgcggucgcaucgcaccauggugggcgccucauaguccgccgcccgccggcccggcccgccgcgcccgcccgcccuccucccuccgcgcgccgcuccgggggcgccgggguuggggggccgagggccggggggcggcgccgcgcugcgcgcuccgaccccgcgccccgggcgugccugcgcuccggcagcgcuggggcucaaacuccgaggcgcggcgacgagugcgggcugcgcggccgccgggcgggcuggcggcggcggccgggggcuccucccucuccgcucgcccuccccccucggcccgcgccuccgcccugcgcccuccgcgccucccccgccgccgccgcgcuccggguccgcgccccguuucucucggcgccgccccucgagccucggcccccgcccggcugugcgcuccucugagcuccccucucuccccagccaggauuuucucccccucgccucccuuccccucgccuccccuccccucccuuccccuccccuccccgcgcccgcgcgcgcucucucucucucccagaguucauucacauuauuggagugaag

SEQ ID NO: 19972 - RNA, 2718 nt, Homo sapiens
cuucacuccaauaaugugaaugaacucugggagagagagagagcgcgcgcgggcgcggggaggggaggggaagggaggggaggggaggcgaggggaagggaggcgagggggagaaaauccuggcuggggagagaggggagcucagaggagcgcacagccgggcgggggccgaggcucgaggggcggcgccgagagaaacggggcgcggacccggagcgcggcggcggcgggggaggcgcggagggcgcagggcggaggcgcgggccgaggggggagggcgagcggagagggaggagcccccggccgccgccgccagcccgcccggcggccgcgcagcccgcacucgucgccgcgccucggaguuugagccccagcgcugccggagcgcaggcacgcccggggcgcggggucggagcgcgcagcgcggcgccgccccccggcccucggccccccaaccccggcgcccccggagcggcgcgcggagggaggagggcgggcgggcgcggcgggccgggccggcgggcggcggacuaugaggcgcccaccauggugcgaugcgaccgcgggcugcagaugcugcugaccacggccggagccuucgccgccuucucgcucauggccaucgccaucggcaccgacuacuggcuguacuccagcgcgcacaucugcaacggcaccaaccugaccauggacgacgggcccccgccccgccgcgcccgcggcgaccucacccacucuggucuguggcgggugugcugcaucgaagguacggccagccccgaccccucgccgccccacacacacacacacacacacacacauauacacacgcgcgcgcgcgcgcgcgcacacacacacacgcgcacacacugcccggcgcgcgggccggggagagggugggcgcggcgcuggcuccgcgcgagacacaaaggagccggagcuggcgggcgggucccuucgcggccagcuguacaucagcucuggucccucucggcuggggaccuccccagcacaccgaucccacaaacucuccacgcgcacacccccucgcccacagacacaaugaaacacaccgaaacucaagcacgcgcgcguagcccgggacccgagcgauccccaggggccgcgccggcacccccgggggagguggaggcuggcgagggggcgggaggaggcugggguuggggggagcggacgggagggggggagggguugcuuggcaaccggugucugugcuauugcuaugggaacuggccauccuggggcggggccggccgggggcggggcgcgucggugccgcugggcgcuuucuacaggcucgggcugaggggugggggcagaaguaggggcagaaguaggggcgggggcgcggucggagccgggguaggggcugaguuccuagcggaucuaggguagcuggguaggcccagcccgacgcccgccucgucucccacggagucaccggcccgcuccucgcugugcgguggggugguaaggggagcgacaccgagucucccccaacggagacagcgaccucggucgcggccccucagcagggaggcugcggagaccucaguaggaaacuagggugugcaggaccgaucugcggaccgggaacagacugggaggggcguggucaucucgucggagcugggcgcugcgacccccaaaugcgacuggaggcugaguaguaggugucaugaggcuggaaugcuaggggaccaggauuucagccccgggaccguggggacagcucccuacuggggaggggccuggaugccuccaacgccaaaaugcgcucggcuucggcgccuuccgggcgcccuucugcccggcugcggaacuugaacuaacagguggcuggggaggggccaccuggucccagcaagguugggcacagguuugcugcuuaagcguggcgcucagaucggggaccggguggagggaguuggugggggcuuuccuuugauuuuucaaaaacccuuggacagaauuccuucuuuuucgguaaccuuuccccgcguguuaacuccgccccucgguuguucgggaaguucucccacacaccuagccuuccuuacugcaguuccaaccccugcacagaguucagccgcgguuguuucuugguggagguuggcaaggagcucuuaaaaccauagcccuuuucuggccgcauuugaagucaucugaaaagaggcuuugugaagcuggaucugcuuagugaagucaacuuggcccccuuuuccccuccagaccaugcuuguucucaucucaucggggauccugcccaccucugucucccacccccacucccaaaagaggcugcuuugcccuuugcaauuuggagccuaauggcagggcugaguggagucugcagguaacagaaaugugcaaucaguaguucgagaaacacagccacacaaaagagccagugggcucaugaucacacccuccucuuuucuuuugaaaaacaucauuuuuagugugcaauugcucagaucacgaacaccuacuccucuccucuggagaauguacccacgucacuaccugccacagcaccugagcuggauacagagcaggggcugcaaugccccauauuccaccucacaagcaaguuccaucaggugccaacugccuggcacaguaagucauaagucaugcuacuggcacgacccgaaggcauguguggacccagggccuuccaguuucccaguggaa

SEQ ID NO: 19973 - RNA, 2376 nt, Homo sapiens
cugcagcaccgccucgcucugguuacuuagcagcuccaggaacagcucacugugcagucccagcagcaggcggugggcguggaauacccggaccucaucggugcccgcagccugcacccgcagaaccacaucgcuggcguugcccugccgcagcagcuccugcaagcgcuggagcaccgccugggagugguugauggaggugccagcugccuccccgccaacaucggcucucugugcugcagcaggaaggaacacagcauagccugagaaggugcccgggcccagaaccucagucagggguggagagggaccagcuggagacauaugcaugggugugagcagagggcaaggugggccuaggcggguuguaugugcauaccuguuugugcccacgaggcgcguggaugcaucggugcacauacaaacgcacccugggugggaaggucaugccaaugcaaaccccaagaggaugcucuuggaagggggugcauucaggcagggggagguugugcucagguuuaggacaacaugcccagaacucaucuccaugcugccagccccccaggcaaggguugaggaaacucguggucccacccuucucacuuccuaaagaauuauccaucuaaccccuuggagcaguagucagaaguggugcauucacuaacaaauauuuauugagcacuuacuauaugcuagacauucuccuaagagcuugggauguggcaguggacaaagcaagccaaguucuuaugcucauaaaagcacgaauugacauaucaaacggguaagacacacacaaauaagcacuccaguuuuaaaggagccagccagggaaccagugucaaggcaggcuccagccccgcaaaggcccuugaacggaaugggccugggguacugggagcagagagagcauuagggaggccacagcaguagcaggagagaggggcgggugugagacgaggcugcggguguggaagggaagcuguuuuccaggcccagcccugcccucuuggguccugaucucugagacagaagccgauuuucugggguggccagcaggggacaggagaaagugcgaagggccagcuggugcuggaauagaacuuccuggguaacugagcauugaggcuggccaggccggcccuuugcuuaugcuccaggaugccccgacagucagauggggauaugcacucaguuauagaaacugucagcagcuuucccaagccgagaacagcgaggggagccucgcagagggaggcgggcgggggccugauugcagcagaugggccgcagccacaugugcacgcacagcacaugcaggcccguggugcacacaggagagaaggcucacacaggagcagagcaucugugcaugagagagggaggccgagggacaaagggagggugaaagagaagcggguaguauguuucccagcacggccuuccccagcugucacuuugaaggaccugaaugcugauggcguccccauucagccucugcccaggacaaugggcaauggaggguccucuuguccuuaagagcccugcccaccugccugccaggccccuccuuccuucagacagaugaguccguggagcuguccgguccaccccgugcucuccccagcagcuggacaccgcccccuccuggccggccgcgugcagccagggcugggacgaccugccgcuccacccugccccgcaccuggcccacugcccgcucaccugcaugggugaccaggcccaccaaggucagcauggcccagaagcugccccaggacccaggcuuggaguagccucuccuaggcaucuuuaugcucagcccccaaguccacuggagggacggugaagcccagaccacucugcucacaucccucuuccuuauauaggauccggcacaaggggacggcaccccccuuccugcuuggccucccucccccacucagccuccuccauggauugguggaaacuggccccagcuguugcccaggcaaccacuuaagccagagagcggcagccccgggggcuauugugcugccugugggcccccaaggggaacagauccggaacccuccucccccaaucuccuuaccacccagcagggcuagccgugccucucccuggaaaguuucaggcucucugcagaauaggcgaggggcuccaggaccacuggcagccauuggccugaggguccccaguucccucccccaaccccaggccucggcccuggcacagagcacacuuggcagcgucgugccuggagcaccauggugagccggcugcaaaggaagggccuggaagaggaaaggagaggcggcugaggcucccaccccucccccacucccauuuugggguggggcagcuccucagagagaa

SEQ ID NO: 19974 - RNA, 2376 nt, Homo sapiens
uucucucugaggagcugccccaccccaaaaugggagugggggaggggugggagccucagccgccucuccuuuccucuuccaggcccuuccuuugcagccggcucaccauggugcuccaggcacgacgcugccaagugugcucugugccagggccgaggccugggguugggggagggaacuggggacccucaggccaauggcugccagugguccuggagccccucgccuauucugcagagagccugaaacuuuccagggagaggcacggcuagcccugcugggugguaaggagauugggggaggaggguuccggaucuguuccccuugggggcccacaggcagcacaauagcccccggggcugccgcucucuggcuuaagugguugccugggcaacagcuggggccaguuuccaccaauccauggaggaggcugagugggggagggaggccaagcaggaaggggggugccguccccuugugccggauccuauauaaggaagagggaugugagcagaguggucugggcuucaccgucccuccaguggacuugggggcugagcauaaagaugccuaggagaggcuacuccaagccuggguccuggggcagcuucugggccaugcugaccuuggugggccuggucacccaugcaggugagcgggcagugggccaggugcggggcaggguggagcggcaggucgucccagcccuggcugcacgcggccggccaggagggggcgguguccagcugcuggggagagcacgggguggaccggacagcuccacggacucaucugucugaaggaaggaggggccuggcaggcaggugggcagggcucuuaaggacaagaggacccuccauugcccauuguccugggcagaggcugaauggggacgccaucagcauucagguccuucaaagugacagcuggggaaggccgugcugggaaacauacuacccgcuucucuuucacccucccuuugucccucggccucccucucucaugcacagaugcucugcuccugugugagccuucucuccugugugcaccacgggccugcaugugcugugcgugcacauguggcugcggcccaucugcugcaaucaggcccccgcccgccucccucugcgaggcuccccucgcuguucucggcuugggaaagcugcugacaguuucuauaacugagugcauauccccaucugacugucggggcauccuggagcauaagcaaagggccggccuggccagccucaaugcucaguuacccaggaaguucuauuccagcaccagcuggcccuucgcacuuucuccuguccccugcuggccaccccagaaaaucggcuucugucucagagaucaggacccaagagggcagggcugggccuggaaaacagcuucccuuccacacccgcagccucgucucacacccgccccucucuccugcuacugcuguggccucccuaaugcucucucugcucccaguaccccaggcccauuccguucaagggccuuugcggggcuggagccugccuugacacugguucccuggcuggcuccuuuaaaacuggagugcuuauuugugugugucuuacccguuugauaugucaauucgugcuuuuaugagcauaagaacuuggcuugcuuuguccacugccacaucccaagcucuuaggagaaugucuagcauauaguaagugcucaauaaauauuuguuagugaaugcaccacuucugacuacugcuccaagggguuagauggauaauucuuuaggaagugagaagggugggaccacgaguuuccucaacccuugccuggggggcuggcagcauggagaugaguucugggcauguuguccuaaaccugagcacaaccucccccugccugaaugcacccccuuccaagagcauccucuugggguuugcauuggcaugaccuucccacccagggugcguuuguaugugcaccgaugcauccacgcgccucgugggcacaaacagguaugcacauacaacccgccuaggcccaccuugcccucugcucacacccaugcauaugucuccagcuggucccucuccaccccugacugagguucugggcccgggcaccuucucaggcuaugcuguguuccuuccugcugcagcacagagagccgauguuggcggggaggcagcuggcaccuccaucaaccacucccaggcggugcuccagcgcuugcaggagcugcugcggcagggcaacgccagcgaugugguucugcgggugcaggcugcgggcaccgaugagguccggguauuccacgcccaccgccugcugcugggacugcacagugagcuguuccuggagcugcuaaguaaccagagcgaggcggugcugcag

SEQ ID NO: 19975 - RNA, 2783 nt, Homo sapiens
cgcugagcaugaaggaggcgggaggcacgcacugcagcccuccacccucugccauccuggauccacaccccacgcagaaacagcucccagcucaguggccgccuuaacuuaugccaagcaaggacagaguggcugccuggacauucucccacacagcugaggaguguguguguggggcggggugggggggggggcgggagggggaggggucccaaggcccaacuccuacaaauccaacucccagguccuuuuauccacagccuccuucugggccuuggcuacauccugccccagcacgugcuggugagccaaggagccuggacaggccugcacuccucguggacccccagagaaaggcccauuauggcucccucaucaaaggaaccucuccuucacccacaaaucuugcugagcaccaaggcuaaacuggagaaaagaccucauuucccccaaacuggguuuuguggaaacugacacaggcacacaccaagccuuccgcccagguggccugagccaccugagaccugugaucucaauagauuggugcaacugaaaacuuccccagcugggcacgcagcuccuagggcuaaccgggguggggcaagaagccgugggcgggguaugggaagggcguggcugacagcaggagaaacagaaagucccaccuccacucugggcaggugagggggcccccgccuugcuccaucugcccuggacaggucacucgacugagacucagacauaagaaggaaggagggcagggggcuccgagaccaccugccguguagccagacuugccccaggaaaaccaugcugaccagcaccagggcugcagaggcuugaggugcaggaccaggguggaaacuucgagccagcggguuccucccauuucugcugguccucccccuccauggaucagaacaaauaacugggccccuccugccucccuccauggcgccugucuuuugggggcuaggaguccggaggucauggguauuugcuggggaaucugagcagcagcacagucccacgugccggguccggucaccaaagucuccagcuuuuguggacgucccgaaaaagcggaacauucgggggucccggucccugcccagccaguuugcagggccuccugggcagggcgcaagcaaggagccacgccaggagacgccaccggcuuuuucaccugccccucugggccuguggaaccugccucggguagggcgggcuuccaucccacccuggcuugaucggggagcccccaaauggggcuggugggagaagccccagcagagaagcccuuccccacccagccccaagcccagagaagcccaacucccaccuuaucugcgaaaguuucuuccugggguccccaguccuccagccccccgcccccacgccgugucccccacgcuccccgcccccagcgcuggcaucccagggcgcgccgccugccaaaagccaaacuggcucccuuuccuggggcuggagcugcggcggaauuucgguggaauuuugagguugagacgcaucucggcaaagagagggaaagaaagggagaggagggaggggggaaagaaagucggcucugggcguccacuugcaggauucgagaaggcgccgagggaccaggaggcgggcgcuggggucccucggccagcggcgggcgggcggggcgucugcgaacccucggggucgcgggggagguggggccccgcgcgggggcuggggucgccgcuccuuaccuacaucugcauugcaaaacgccuguugcgggugcaccggggagcagcugcaggcgucggccgggcgaagcagcgucgccagcagcaggaggccgagcgccagccgcagggugcgggccgcggcgcccauggcgggccggggggcugggcgggcgggggccgccgcugggggguccgggcgcugcucgcggcggcgggcugggggcgcgggcgggggcugagccggggccgaggcgggccccucccgcgcggcucacccuccucaccugccccgcucggccgcgcaaacuuucucuccucuuugucucgggggcgcgaggggaggggcgcggggcgcaauucgccgggcggggcggcgggguggggggcggcgggcgagcggcgcugcgguucucggcggccgcgcugccuucuacggauguguuugcugcgggcuugggccgggccgcaguuuuauugcgcucggaggauuuucugcuccuccucccgguggcuggcggccaaugcaggcucugggcgcucccagcagcccccuccucccccuccgcccgcgccuccccccagcccgcgcuuuuguugugcccggccuggcacgucgggggcuucccgcaccaccuggcgcccgcgacccgcacccgcgcggggguccccggacgcccccagccccccgaccccgguccccgcugcguggccuucugcgcccggggucccugacucagcgcgggggacucgcgccccguucuuccaggacaccaggcgacccacccgcuacccuuuccccuucagcucgacucuggagggcuacgcugcuccgucccccgccaccccggggucccuucgagcccagccucggggcgagccaagggguguccuuuggagcaggggccguucccugucgccaccuccccguuucugugggcggguggccuauugagaaacugacaggaucccuuuuucaaauggaggccuuagaauuuuaagugcgccuggccaguuuaguugggggguggggggugugguuacugugaacaaaacagg

SEQ ID NO: 19976 - RNA, 2783 nt, Homo sapiens
ccuguuuuguucacaguaaccacaccccccaccccccaacuaaacuggccaggcgcacuuaaaauucuaaggccuccauuugaaaaagggauccugucaguuucucaauaggccacccgcccacagaaacggggagguggcgacagggaacggccccugcuccaaaggacaccccuuggcucgccccgaggcugggcucgaagggaccccgggguggcgggggacggagcagcguagcccuccagagucgagcugaaggggaaaggguagcgggugggucgccugguguccuggaagaacggggcgcgagucccccgcgcugagucagggaccccgggcgcagaaggccacgcagcggggaccggggucggggggcugggggcguccggggacccccgcgcgggugcgggucgcgggcgccagguggugcgggaagcccccgacgugccaggccgggcacaacaaaagcgcgggcuggggggaggcgcgggcggagggggaggagggggcugcugggagcgcccagagccugcauuggccgccagccaccgggaggaggagcagaaaauccuccgagcgcaauaaaacugcggcccggcccaagcccgcagcaaacacauccguagaaggcagcgcggccgccgagaaccgcagcgccgcucgcccgccgccccccaccccgccgccccgcccggcgaauugcgccccgcgccccuccccucgcgcccccgagacaaagaggagagaaaguuugcgcggccgagcggggcaggugaggagggugagccgcgcgggaggggcccgccucggccccggcucagcccccgcccgcgcccccagcccgccgccgcgagcagcgcccggaccccccagcggcggcccccgcccgcccagccccccggcccgccaugggcgccgcggcccgcacccugcggcuggcgcucggccuccugcugcuggcgacgcugcuucgcccggccgacgccugcagcugcuccccggugcacccgcaacaggcguuuugcaaugcagauguagguaaggagcggcgaccccagcccccgcgcggggccccaccucccccgcgaccccgaggguucgcagacgccccgcccgcccgccgcuggccgagggaccccagcgcccgccuccuggucccucggcgccuucucgaauccugcaaguggacgcccagagccgacuuucuuuccccccucccuccucucccuuucuuucccucucuuugccgagaugcgucucaaccucaaaauuccaccgaaauuccgccgcagcuccagccccaggaaagggagccaguuuggcuuuuggcaggcggcgcgcccugggaugccagcgcugggggcggggagcgugggggacacggcgugggggcggggggcuggaggacuggggaccccaggaagaaacuuucgcagauaaggugggaguugggcuucucugggcuuggggcuggguggggaagggcuucucugcuggggcuucucccaccagccccauuugggggcuccccgaucaagccagggugggauggaagcccgcccuacccgaggcagguuccacaggcccagaggggcaggugaaaaagccgguggcgucuccuggcguggcuccuugcuugcgcccugcccaggaggcccugcaaacuggcugggcagggaccgggacccccgaauguuccgcuuuuucgggacguccacaaaagcuggagacuuuggugaccggacccggcacgugggacugugcugcugcucagauuccccagcaaauacccaugaccuccggacuccuagcccccaaaagacaggcgccauggagggaggcaggaggggcccaguuauuuguucugauccauggagggggaggaccagcagaaaugggaggaacccgcuggcucgaaguuuccacccugguccugcaccucaagccucugcagcccuggugcuggucagcaugguuuuccuggggcaagucuggcuacacggcagguggucucggagcccccugcccuccuuccuucuuaugucugagucucagucgagugaccuguccagggcagauggagcaaggcgggggcccccucaccugcccagaguggaggugggacuuucuguuucuccugcugucagccacgcccuucccauaccccgcccacggcuucuugccccaccccgguuagcccuaggagcugcgugcccagcuggggaaguuuucaguugcaccaaucuauugagaucacaggucucagguggcucaggccaccugggcggaaggcuuggugugugccugugucaguuuccacaaaacccaguuugggggaaaugaggucuuuucuccaguuuagccuuggugcucagcaagauuugugggugaaggagagguuccuuugaugagggagccauaaugggccuuucucuggggguccacgaggagugcaggccuguccaggcuccuuggcucaccagcacgugcuggggcaggauguagccaaggcccagaaggaggcuguggauaaaaggaccugggaguuggauuuguaggaguugggccuugggaccccucccccucccgcccccccccccaccccgccccacacacacacuccucagcugugugggagaauguccaggcagccacucuguccuugcuuggcauaaguuaaggcggccacugagcugggagcuguuucugcgugggguguggauccaggauggcagaggguggagggcugcagugcgugccucccgccuccuucaugcucagcg

SEQ ID NO: 19977 - RNA, 2733 nt, Homo sapiens
ccugagccaugucggacccgggugccauugggaucuagggcacccuggccuuuggccuccaggaaggcagcccugugcuuuaucacccuggccgggaagguguccacagccaguuugcccguggccucagcugagcuagggcuggucacaccacacugcaccagguccgaguccugucuucgggccagcuggaucacacuguggccggcuggaaacuuuccugccccggaaggggugucguccagcuuccugcccuugagguacucuccgaggccggcgcuggguucgccuaagggccucugugagggguccgggagcuccuuccggggcuuggggccucgcuucuucgagcugucccccggugagcugggcuugucauccacucugcugguaccccgcucucguucccucucacguucccgcucccucucucgcucccucucccuuucucgaucccgcucccggucccuaucccggucucggucccggucccgaggggccucugcgcggcaggugcugcuggugcuggugcugcucgcuggcggggacaaacccauguuucgaaggcccucccgggcccgggaaguggaggccagguccuggggcgagcggccaggguaggggauccggaugccccuggcugagucacuucgaaacucguaaguuuuggccuuugccuuggccugcgccugcaggagagaagauggucucaagaguggggcagggcccuguccacccccacaggacuccuccucuaucccugaccuccuaucuuuacccuaugaugccugggaauuucuacauggaugcauggauggguggguggguggguggguggauggcuggaugaaugggugggauggcuguuggagcugagagguagaaggaugagagaagagguagaagauuuggcuggaaguagucauuugcaaaaaguacacuuuuugcauuugauuauuguguccauuugggagggggagcguaaaggaauucuaguguggccaagcccguccccccagacacaguuggugcugcuacugacuuggugacaucuugucagggaacucccuccuacauuacaaauaggcaacauguguggacaccccauuggcucacagcccucagagcccccuucccacaaaucacuccauaacaugguccuccaccauuggacacugccaaccuacuuugaggaggaagguuuugggcuuggguccacgcuuuuuggggccauagagcuccaucucucuuucccuggagaaagaagaaaaggagaaagggugcgugaguaaagaaagcaagugggacucuaguccaggcuggaaagaagccacucuacuuguuucuaagugagcggcugggacuuggaagggucuguaccuuuccucaaaggcugcgagcaagcgagcauccaggauguuuuccuccgguucccaugugcuguaccuaaagggaaucaggaagaagugggcaucagucccaggagcagggugagagcagaggggguguguguguguguaacuuuucucauugcauuguauuguauuucaauguaaaggcaaaaagaggaagaaagaaaccucccgaauaacagucugggguugagaauugcauauaaccuacuuacuucugcgaccaucccuuccauuucacgagguauuccaugcgucccugcgggugcaaaggcgauaaugugugugcauggggagaaacgcaugacgaggauacaagaaaugcaugcgaaaaugcaugcaccagaugaaugcucgaaaccccgccgcaaaaggcacgcgcccgcugcaucaccccugcaccuaaugcugcacaaagugcaugcaccggcauucauuccccaccccgccccccacccaugcaauccgugcaucgcugcaagucuaaggaaagcgccugggcucagagcugccgccgccgccgccgccacggccgcggccgcugcugggaccugggggaagggaagcugggcugcagcagggggagggaacccgggccgggaggggagggcccggccgcacggaggcccuaggcccgggggcaccuacuuuccguaugcgccgcuucaggagggcuucggccgcgaacacccgcucccccaccgcugaaagcuccauguugacucgccgcuuccccccuuggccgcuuccaggagcagaaaagcagcagccagcgcacgacagaccauaauacucucccgcugacgucaguucuccucccccucccggcgcucucgcucccucccgcggccccccucccgcgcuccuccgcucggcccccuccccuccgcccagugcuuccucccgccccacguguugcuaacgacguugcuaaagccgagcggccggaggccugcgcccccgcacgcugauuggacgagcuccgagccacgccccucugccuuucucccccgcguugcuacgugaccagcguuccaaucgccagggggcggaguccgaggcgacuccagagaccgagcgcgcgagugggagggggcgccgccggaagugacgccaggggaaggcgggcccggccgcugucagucugcggggcuggcgaggggggcaggccgcccucuguccucgccggggccccccucccccgccaccaaguugucccuccggcguucggcgucccccacagcucucgcugggauccccgcggcgaugucagcccggcuccgccccucggcagaccccggcccgccgccccacccccacc

SEQ ID NO: 19978 - RNA, 2733 nt, Homo sapiens
gguggggguggggcggcgggccggggucugccgaggggcggagccgggcugacaucgccgcggggaucccagcgagagcugugggggacgccgaacgccggagggacaacuugguggcgggggaggggggccccggcgaggacagagggcggccugccccccucgccagccccgcagacugacagcggccgggcccgccuuccccuggcgucacuuccggcggcgcccccucccacucgcgcgcucggucucuggagucgccucggacuccgcccccuggcgauuggaacgcuggucacguagcaacgcgggggagaaaggcagaggggcguggcucggagcucguccaaucagcgugcgggggcgcaggccuccggccgcucggcuuuagcaacgucguuagcaacacguggggcgggaggaagcacugggcggaggggagggggccgagcggaggagcgcgggaggggggccgcgggagggagcgagagcgccgggagggggaggagaacugacgucagcgggagaguauuauggucugucgugcgcuggcugcugcuuuucugcuccuggaagcggccaaggggggaagcggcgagucaacauggagcuuucagcggugggggagcggguguucgcggccgaagcccuccugaagcggcgcauacggaaaguaggugcccccgggccuagggccuccgugcggccgggcccuccccucccggcccggguucccucccccugcugcagcccagcuucccuucccccaggucccagcagcggccgcggccguggcggcggcggcggcggcagcucugagcccaggcgcuuuccuuagacuugcagcgaugcacggauugcauggguggggggcgggguggggaaugaaugccggugcaugcacuuugugcagcauuaggugcaggggugaugcagcgggcgcgugccuuuugcggcgggguuucgagcauucaucuggugcaugcauuuucgcaugcauuucuuguauccucgucaugcguuucuccccaugcacacacauuaucgccuuugcacccgcagggacgcauggaauaccucgugaaauggaagggauggucgcagaaguaaguagguuauaugcaauucucaaccccagacuguuauucgggagguuucuuucuuccucuuuuugccuuuacauugaaauacaauacaaugcaaugagaaaaguuacacacacacacacccccucugcucucacccugcuccugggacugaugcccacuucuuccugauucccuuuagguacagcacaugggaaccggaggaaaacauccuggaugcucgcuugcucgcagccuuugaggaaagguacagacccuuccaagucccagccgcucacuuagaaacaaguagaguggcuucuuuccagccuggacuagagucccacuugcuuucuuuacucacgcacccuuucuccuuuucuucuuucuccagggaaagagagauggagcucuauggccccaaaaagcguggacccaagcccaaaaccuuccuccucaaaguagguuggcaguguccaaugguggaggaccauguuauggagugauuugugggaagggggcucugagggcugugagccaaugggguguccacacauguugccuauuuguaauguaggagggaguucccugacaagaugucaccaagucaguagcagcaccaacugugucuggggggacgggcuuggccacacuagaauuccuuuacgcucccccucccaaauggacacaauaaucaaaugcaaaaaguguacuuuuugcaaaugacuacuuccagccaaaucuucuaccucuucucucauccuucuaccucucagcuccaacagccaucccacccauucauccagccauccacccacccacccacccacccauccaugcauccauguagaaauucccaggcaucauaggguaaagauaggaggucagggauagaggaggaguccuguggggguggacagggcccugccccacucuugagaccaucuucucuccugcaggcgcaggccaaggcaaaggccaaaacuuacgaguuucgaagugacucagccaggggcauccggauccccuacccuggccgcucgccccaggaccuggccuccacuucccgggcccgggagggccuucgaaacauggguuuguccccgccagcgagcagcaccagcaccagcagcaccugccgcgcagaggccccucgggaccgggaccgagaccgggauagggaccgggagcgggaucgagaaagggagagggagcgagagagggagcgggaacgugagagggaacgagagcgggguaccagcagaguggaugacaagcccagcucaccgggggacagcucgaagaagcgaggccccaagccccggaaggagcucccggaccccucacagaggcccuuaggcgaacccagcgccggccucggagaguaccucaagggcaggaagcuggacgacaccccuuccggggcaggaaaguuuccagccggccacagugugauccagcuggcccgaagacaggacucggaccuggugcaguguggugugaccagcccuagcucagcugaggccacgggcaaacuggcuguggacaccuucccggccagggugauaaagcacagggcugccuuccuggaggccaaaggccagggugcccuagaucccaauggcacccggguccgacauggcucagg

SEQ ID NO: 19979 - RNA, 2498 nt, Homo sapiens
ggcugucuggaacacagauuuuucuauagaggaguaguggcggugaggcugcgaaggcggaagauggagaggcuuucacacaaggaaggcgguggaggaggagcgagggggcucccgggugcuugugcggacauaaggugcgagagaaucagcuggaaggugggcuccagcagagagaagaggaaggccagaaguagaccgggacagggggaggaaaggacagagucaaggaacauuuaggaguucgguucccggaggccuggcgacacccugacggggaggggugacgcgcacccauuugcaggcagaaaggcaggagcagggggguguccgaggaugguggcucggagggaccaggcauagguggugcaagcucagcagucacucaagggguggcaugcggaugagggaggcgccucccggacugggggaccgggaaaggcauuagcaaccugccagaacccgguuaacaaaggcaggacuacaauucccggcaugcucgggcucgguggggugacggcgggcgguggcugcgcugcacccgacuggugggcgcaggaccugggucggcaccggagccugucaucccggagcggucggcgggggugcagagacggcgaugcgccccugucccccgcacccgggccgcuccgggcucgcgccucccgccccgcggccccgcccccugccccaccccagucgggaggcuuagcuggggccgcagcgcggcggcaacaucacucucgcugccgcugcuccgccccauccccuucuguuuuucucucucauucuccaguggcggcggcggggaaggcggaggcagaggcagcagcagccgcgcuggcugcaaugaaugaucccccagcuuggggggaggacuccaggugagccucugcccucgggaggcccgggacccccggccgcccacgaccggcagcccacgcuauggaucccuagaggaaggaggagaagacagcucgccgcccacccccaucccauuuuccucuuccuuuaucucauuguugccgaagcuguuuacggcagcgcucccucugcuccugcauggggcgggcuccgggcacggcugcucggcaggcgcugcucccgcggcgacugggggauucugccuaauucaccucccagccggugcagagaggaccggagagcgguggaggcccggacugcagcagcguuggggccaccucccagcguccccacccuaggaggcugcaugcggauugaagagcugcgccugggggcugggccggccccgcugaucccgaccuagcgagcaggauagcaggaccgcccaggcugcggaggggcucgggggcaggaaggucagagcagcaagauggccaguaagaccaaggccagcgaggcccucaaggugguggcccggugccgcccccucagcaggaaggaggaggcugcuggucacgagcagauccugaccauggacgugaaacugggccaggugacccugcggaacccccgcgccgccccgggggagcugcccaagaccuucaccuuugacgccguguaugaugccagcuccaagcaggccgaccuguaugacgaaaccgugaggccccugauagacuccgugcuccaggguuucaauggcacgguguuugccuauggccagacgggcacuggcaagaccuauaccaugcaggggaccuggguggagcccgagcugcgcggggucaucccgaaugccuuugagcacaucuucacccacaucucccgcucccagaaccaacaguaccugguccgggccuccuauuuggagaucuaccaggaagagauucgagaccugcucuccaaggagccgggcaagaggcuagagcugaaagagaaccccgagacuggcgucuacaucaaggaccucuccuccuucgucaccaagaaugucaaggagauugagcaugugaugaaccuggggaaccagacccgggcugugggcagcacccacaugaaugaggucagcucccgcucccaugccaucuucaucaucacuguggagugcagcgaacguggcucugauggccaggaccacauccgagugggcaagcucaaccucguggaccuggcuggcagcgagaggcagaacaaggcaggccccaacacagcgggaggggcagccacaccauccucggguggcggugguggcgguggaggcaguggugguggugcugguggagagaggccuaaggaagccuccaaaaucaaccucucauuaucugcccugggcaacgugauugcugcccuggcgggcaacaggagcacccacauucccuaccgggacuccaagcugacccggcugcuccaggacucccugggggggaaugccaagaccaucaugguagccacacuggggccagcuucucacagcuacgaugagagccucuccaccuugcgcuuugccaaccgagccaagaacaucaagaacaagccccaggugaacgaggaccccaaggacacacugcugcggg

SEQ ID NO: 19980 - RNA, 2498 nt, Homo sapiens
cccgcagcaguguguccuugggguccucguucaccuggggcuuguucuugauguucuuggcucgguuggcaaagcgcaagguggagaggcucucaucguagcugugagaagcuggccccaguguggcuaccaugauggucuuggcauucccccccagggaguccuggagcagccgggucagcuuggagucccgguagggaaugugggugcuccuguugcccgccagggcagcaaucacguugcccagggcagauaaugagagguugauuuuggaggcuuccuuaggccucucuccaccagcaccaccaccacugccuccaccgccaccaccgccacccgaggaugguguggcugccccucccgcuguguuggggccugccuuguucugccucucgcugccagccagguccacgagguugagcuugcccacucggaugugguccuggccaucagagccacguucgcugcacuccacagugaugaugaagauggcaugggagcgggagcugaccucauucaugugggugcugcccacagcccgggucugguuccccagguucaucacaugcucaaucuccuugacauucuuggugacgaaggaggagagguccuugauguagacgccagucucgggguucucuuucagcucuagccucuugcccggcuccuuggagagcaggucucgaaucucuuccugguagaucuccaaauaggaggcccggaccagguacuguugguucugggagcgggagaugugggugaagaugugcucaaaggcauucgggaugaccccgcgcagcucgggcuccacccagguccccugcaugguauaggucuugccagugcccgucuggccauaggcaaacaccgugccauugaaacccuggagcacggagucuaucaggggccucacgguuucgucauacaggucggccugcuuggagcuggcaucauacacggcgucaaaggugaaggucuugggcagcucccccggggcggcgcggggguuccgcagggucaccuggcccaguuucacguccauggucaggaucugcucgugaccagcagccuccuccuuccugcugagggggcggcaccgggccaccaccuugagggccucgcuggccuuggucuuacuggccaucuugcugcucugaccuuccugcccccgagccccuccgcagccugggcgguccugcuauccugcucgcuaggucgggaucagcggggccggcccagcccccaggcgcagcucuucaauccgcaugcagccuccuaggguggggacgcugggagguggccccaacgcugcugcaguccgggccuccaccgcucuccgguccucucugcaccggcugggaggugaauuaggcagaaucccccagucgccgcgggagcagcgccugccgagcagccgugcccggagcccgccccaugcaggagcagagggagcgcugccguaaacagcuucggcaacaaugagauaaaggaagaggaaaaugggaugggggugggcggcgagcugucuucuccuccuuccucuagggauccauagcgugggcugccggucgugggcggccgggggucccgggccucccgagggcagaggcucaccuggaguccuccccccaagcugggggaucauucauugcagccagcgcggcugcugcugccucugccuccgccuuccccgccgccgccacuggagaaugagagagaaaaacagaaggggauggggcggagcagcggcagcgagagugauguugccgccgcgcugcggccccagcuaagccucccgacugggguggggcagggggcggggccgcggggcgggaggcgcgagcccggagcggcccgggugcgggggacaggggcgcaucgccgucucugcacccccgccgaccgcuccgggaugacaggcuccggugccgacccagguccugcgcccaccagucgggugcagcgcagccaccgcccgccgucaccccaccgagcccgagcaugccgggaauuguaguccugccuuuguuaaccggguucuggcagguugcuaaugccuuucccggucccccaguccgggaggcgccucccucauccgcaugccaccccuugagugacugcugagcuugcaccaccuaugccuggucccuccgagccaccauccucggacaccccccugcuccugccuuucugccugcaaaugggugcgcgucaccccuccccgucagggugucgccaggccuccgggaaccgaacuccuaaauguuccuugacucuguccuuuccucccccugucccggucuacuucuggccuuccucuucucucugcuggagcccaccuuccagcugauucucucgcaccuuauguccgcacaagcacccgggagcccccucgcuccuccuccaccgccuuccuugugugaaagccucuccaucuuccgccuucgcagccucaccgccacuacuccucuauagaaaaaucuguguuccagacagcc

SEQ ID NO: 19981 - RNA, 2631 nt, Homo sapiens
uugccccuaaacucggagagacuaugcagaauccccccaccacuggggauuugcucaccagccacgaaggucaggcccucaugccugaggucccgguucuaucccuaucaauggcuucuggggaccucaagcagcccuguuccaaguugagacucaggguggagagggaggccggagaggcacacuggggcugcacgaggagcacuuucucugagauucccugcagauccucugccucucccugcucaccagcccugccacucuguuucccccaagagggaggagggagaggaggccucucaggcucagccagccaagcugagcuccccagaaaggauuuaucuccugucugagaccaugguagaacuagcucaaccuuaagaagacucuggugccugugcccacuuagagcccagcacaccccccuucuccugcagccugggacccuucagucccugucccugugcaccagaacuagggcguccuauaaguaucccagcauccagcccaggggccaugucaggccgucagagaaggcuugauaguucuaaccgaaccacagggccauuuggggauuggguaccaagauuuccagguaccaaaaauaaggcagucugugcuaggcacugggcaugugcuggcagggauggaugaccuggucacuugcaaggccucugccugccuucccaggcuaggaccugagguaugcugacugucaguggcucccaagcagggcugccucagccccacccgcucacuucccagcccuauucgccuuucuuucccuccugcccuccaugcugggucucuggcuggauagaauuaaggccgaaauuacuugcauuuccgccugaaauuagguaaauuuucucuaucugucugcuuuaaugauuucaauggagauuaauaaaauccagaugacauacagcagccacaccacagccucaccuacaucuuaccuuuggaaggcccagggcagaacaagguggggugcuuagucuaagagaggccugcauuccugcaggguccccagcaggccucuccuccccacaccaccaggauccuugaccucuggcucucccaggggcccagcaccagacacaggcacccauagcugcacaugucacacacacacaaaccaccaccacccagaccaaccugcugagcagggcacuccucauaccugguuaugccaccagccucuccagggccauuuacuuuagucugauaccugccucugcccuaguuuucccugggcuucccccaauuuguguggcccgcaggagacugggagcugcagaaauugcugcaaggaaggagccaucacccucaccaccgugcagucccucucgccgugacucccgggaacacagcucuugcccuccuuucuucucugagggcuccgaggccacuccagaccauuccccaagaagcgaaucuuggccuccgccugccuccucgaggggaccagccggccugcaaggccagggagaccugggagagggaccagucagcccucugggacugggccccgggagcugccgcgacucucgccacaguccaggugcagcgggcuggagaguguuggccucggcgaaguuucuuucuaucaccugagggugggccgcauggggccgcggcuccaaauguaacggagcugcggcacggcuccggggcuggucucagcccaggaccugacgggaugggcgggcacagaagaggcguaaguaccuugggucgccuggucugugaagccggugaucguguccgcgcgaccauggcccgaggcggagacagcggcugccccggccggagcccucccggccaggcuccgguaaagcgacaucaugaaguggugcggcaccaccgagccguuccugaagccggagcccgcggcgcggcgcgcggcgcgggcccggggaaccgcggcggccgggacagccgcggcgcccgcagccugggcaagaguccgcccgccgccgccgccgccgccgccgcccccugggcuccggaccggcccagcccccgccgcucgcagcacggcggccgcuuccagcccgucgcgggggcggcaggcgcucagcagccaaaggcacagcgcggcggcggcgcucagguccaugggcuccgugggccgggcgggcgggcggcgcgggcuccguggcuccgggaagucccccggcgccuuuugaacauaguguuuaauaaugggggaagugugcgcggccagcccgcggcccccccuccuggcccaccccacccccgcccaacgcccggagcagcgcccccugcugaaagcuccggcggccgcuaugcgccccccaccccggccuagaguggagaccagggccggagccgccuccucccaccgcagcgcuacgcccccacccucgccaagcgacugccacuggccccagccucccgacacgccuccccgcggcagugcgacacccccuccauccgcccaagaccaacgcgcccuccgugguuccaggcucggggcaccgcgcgcacccgcccagcuuccuccccacucccccgcagagaaacacccgcccccucccugcccugguucccaaugccgggaacggggcggcagaguuggggccgcggaagggcucgcccuccaga

SEQ ID NO: 19982 - RNA, 2631 nt, Homo sapiens
ucuggagggcgagcccuuccgcggccccaacucugccgccccguucccggcauugggaaccagggcagggagggggcggguguuucucugcgggggaguggggaggaagcugggcgggugcgcgcggugccccgagccuggaaccacggagggcgcguuggucuugggcggauggagggggugucgcacugccgcggggaggcgugucgggaggcuggggccaguggcagucgcuuggcgagggugggggcguagcgcugcggugggaggaggcggcuccggcccuggucuccacucuaggccgggguggggggcgcauagcggccgccggagcuuucagcagggggcgcugcuccgggcguugggcggggguggggugggccaggagggggggccgcgggcuggccgcgcacacuucccccauuauuaaacacuauguucaaaaggcgccgggggacuucccggagccacggagcccgcgccgcccgcccgcccggcccacggagcccauggaccugagcgccgccgccgcgcugugccuuuggcugcugagcgccugccgcccccgcgacgggcuggaagcggccgccgugcugcgagcggcgggggcugggccgguccggagcccagggggcggcggcggcggcggcggcggcgggcggacucuugcccaggcugcgggcgccgcggcugucccggccgccgcgguuccccgggcccgcgccgcgcgccgcgccgcgggcuccggcuucaggaacggcucgguggugccgcaccacuucaugaugucgcuuuaccggagccuggccgggagggcuccggccggggcagccgcugucuccgccucgggccauggucgcgcggacacgaucaccggcuucacagaccaggcgacccaagguacuuacgccucuucugugcccgcccaucccgucagguccugggcugagaccagccccggagccgugccgcagcuccguuacauuuggagccgcggccccaugcggcccacccucaggugauagaaagaaacuucgccgaggccaacacucuccagcccgcugcaccuggacuguggcgagagucgcggcagcucccggggcccagucccagagggcugacuggucccucucccaggucucccuggccuugcaggccggcugguccccucgaggaggcaggcggaggccaagauucgcuucuuggggaauggucuggaguggccucggagcccucagagaagaaaggagggcaagagcuguguucccgggagucacggcgagagggacugcacgguggugagggugauggcuccuuccuugcagcaauuucugcagcucccagucuccugcgggccacacaaauugggggaagcccagggaaaacuagggcagaggcagguaucagacuaaaguaaauggcccuggagaggcugguggcauaaccagguaugaggagugcccugcucagcagguuggucugggugguggugguuugugugugugugacaugugcagcuaugggugccugugucuggugcugggccccugggagagccagaggucaaggauccuggugguguggggaggagaggccugcuggggacccugcaggaaugcaggccucucuuagacuaagcaccccaccuuguucugcccugggccuuccaaagguaagauguaggugaggcugugguguggcugcuguaugucaucuggauuuuauuaaucuccauugaaaucauuaaagcagacagauagagaaaauuuaccuaauuucaggcggaaaugcaaguaauuucggccuuaauucuauccagccagagacccagcauggagggcaggagggaaagaaaggcgaauagggcugggaagugagcggguggggcugaggcagcccugcuugggagccacugacagucagcauaccucagguccuagccugggaaggcaggcagaggccuugcaagugaccaggucauccaucccugccagcacaugcccagugccuagcacagacugccuuauuuuugguaccuggaaaucuugguacccaauccccaaauggcccugugguucgguuagaacuaucaagccuucucugacggccugacauggccccugggcuggaugcugggauacuuauaggacgcccuaguucuggugcacagggacagggacugaagggucccaggcugcaggagaaggggggugugcugggcucuaagugggcacaggcaccagagucuucuuaagguugagcuaguucuaccauggucucagacaggagauaaauccuuucuggggagcucagcuuggcuggcugagccugagaggccuccucucccuccucccucuugggggaaacagaguggcagggcuggugagcagggagaggcagaggaucugcagggaaucucagagaaagugcuccucgugcagccccagugugccucuccggccucccucuccacccugagucucaacuuggaacagggcugcuugagguccccagaagccauugauagggauagaaccgggaccucaggcaugagggccugaccuucguggcuggugagcaaauccccagugguggggggauucugcauagucucuccgaguuuaggggcaa

SEQ ID NO: 19983 - RNA, 2478 nt, Homo sapiens
gggggauucccuaauccuuguuggaaggggagggggcuagacacaggaagaaaucccccccgggcagcgggacccggccucgcgcagagagcuccuggagccuucggugcacgcguguccguggcccccgcgcagucccgccgcccucuccuccccgggcucuccccgaaacgcccccacugccgcccgccccauugucugaaacggucuaaaaacuucgcaacuuaccgaaccugagcaaauaaauaaauaaacccauuuaauaaggccacgguaauuaucccgcgaaucucccucucccagacucgagggccuggcgcccucccgcucccucgggccccuuccaaagacaaaaagcaacccacuggcccuuuaccuugcacaccagcuccucuccgcugugcagaugcacggcacgaaaaacguggucucccuccagagguuccaacaauaaguauuucccgauacaagaaacgcaaugcgacaaguucggagucucgggcgggcucggggagccgagguucgggcugaaacucuggcugggcuccgcggaccuuauagacgacaacucuucgaaauccuggguuuuguuccgcgaucucccauaucucgcuauugugauggggguagaccuguguauguucaugagugugaggaucgcacacgacaaacaaaaaaaaacccgcuggagagaugagucgcuggcgagugcggcugcaggcgccucggugccacugauuuuaaaagggagcgagaggggaggggacagaagaggggcugcguggagaaagaguuagaagcccccaaaugggcgccgccggauaccucgucugcuccgagcccggcucccggggguccucggucggcaggcaacucgggucuuuuuguuaccccaaagcagucggcgaugugcagaaucgccgcacuuuuaguuacucuguguguguguccccggcguggaucuggaugaguacccgggcugcuaaggugcggagcugcagcgccagggcucccgacgcgacccccaggccggcuuccgaaucgcagacggggcggaggagcccgcgguaguuugugcagucuucggggagcucacggcggcgacucagucccaacgcguuagaagccaaacaaaaagagaaaggaaacaagcacgggucuaccggcuggcgacgcacggcagccagaauccgcgcugcacccccuuuuuuugguggaaaggguggggggcguguaaggggggggugcgggagagggcaguuaccuacguuuuaacuguagauggcgucugaggcuuuuccaagaucgcgagcucuccaaaaauuaaacaaacaaacaaaaaaaagaaaaauugcaagggagcauuuaacuuggugcggucagcgcugccaacaaaagauugcaaaagcugggcacagaguugcggcgcgggcugggcgcagguaccgcgacaaagcccugggcucggcccgccgcgcggaggucagcacaggcucaugcugucgccgcucgcucgcgccccaggucuuccuccgaaugcagccagacgugcaggagagaacgaggacagaucggcggucuccgauuucgccggcacgagcuugcggggguccugcgggcgcugcaaggggagcugcgucccuggcccuuccaacgcgcggcguuccuuugccccuuucccgcuggagaacuggaucucguccuggaauaauuugcaaucaccccgucucccccuaccccgagaccaaauugcccggugggguuuguuuuggagaaaauugacggcuugucuccuccuucuuugauuucuugcuugccccccccagagaaaagaggggaccguguauuuaaaaauuaaaggggacggccgacggugcccgaggccaauccccgcgcucagcacgcccgcaucccccggcgaggcgguauuaauaguuacuuacguggccggggaucucggagcgagcggggccgugagugcgcgugugcgcgcgcgcgccucgcucgcgcucggucuccccauucaaugucaccgacacauuuccacggagccuccgccccccccccgccgcccccgcgacuggcucagcccagagccggccccgccccgcccccgcccgggccccccucauugcgccgggcgcccaucaaucagccccgccgcugccaguccucgggcggcuccccgcgccgcugccauugcagcuccgugccgggggcgccagcaccggccucgcagcucccucgcccggccggggagguaaacaaagugaaauauccuuccgcggcccggggccccgggcgcagcacccugggugucggcugcgagccggcugcgagcccagcugcgggcggcugggccgggguuaccagcagcgacucccgagccguuccccacacgcugcucccgcagcgcccgcuccagcucuucguagcucguucauguuccuggcgcuuuuccccagaaagccaggcacg

SEQ ID NO: 19984 - RNA, 2478 nt, Homo sapiens
cgugccuggcuuucuggggaaaagcgccaggaacaugaacgagcuacgaagagcuggagcgggcgcugcgggagcagcguguggggaacggcucgggagucgcugcugguaaccccggcccagccgcccgcagcugggcucgcagccggcucgcagccgacacccagggugcugcgcccggggccccgggccgcggaaggauauuucacuuuguuuaccuccccggccgggcgagggagcugcgaggccggugcuggcgcccccggcacggagcugcaauggcagcggcgcggggagccgcccgaggacuggcagcggcggggcugauugaugggcgcccggcgcaaugaggggggcccgggcgggggcggggcggggccggcucugggcugagccagucgcgggggcggcggggggggggcggaggcuccguggaaaugugucggugacauugaauggggagaccgagcgcgagcgaggcgcgcgcgcgcacacgcgcacucacggccccgcucgcuccgagauccccggccacguaaguaacuauuaauaccgccucgccgggggaugcgggcgugcugagcgcggggauuggccucgggcaccgucggccguccccuuuaauuuuuaaauacacgguccccucuuuucucuggggggggcaagcaagaaaucaaagaaggaggagacaagccgucaauuuucuccaaaacaaaccccaccgggcaauuuggucucgggguagggggagacggggugauugcaaauuauuccaggacgagauccaguucuccagcgggaaaggggcaaaggaacgccgcgcguuggaagggccagggacgcagcuccccuugcagcgcccgcaggacccccgcaagcucgugccggcgaaaucggagaccgccgaucuguccucguucucuccugcacgucuggcugcauucggaggaagaccuggggcgcgagcgagcggcgacagcaugagccugugcugaccuccgcgcggcgggccgagcccagggcuuugucgcgguaccugcgcccagcccgcgccgcaacucugugcccagcuuuugcaaucuuuuguuggcagcgcugaccgcaccaaguuaaaugcucccuugcaauuuuucuuuuuuuuguuuguuuguuuaauuuuuggagagcucgcgaucuuggaaaagccucagacgccaucuacaguuaaaacguagguaacugcccucucccgcaccccccccuuacacgccccccacccuuuccaccaaaaaaagggggugcagcgcggauucuggcugccgugcgucgccagccgguagacccgugcuuguuuccuuucucuuuuuguuuggcuucuaacgcguugggacugagucgccgccgugagcuccccgaagacugcacaaacuaccgcgggcuccuccgccccgucugcgauucggaagccggccugggggucgcgucgggagcccuggcgcugcagcuccgcaccuuagcagcccggguacucauccagauccacgccggggacacacacacagaguaacuaaaagugcggcgauucugcacaucgccgacugcuuugggguaacaaaaagacccgaguugccugccgaccgaggacccccgggagccgggcucggagcagacgagguauccggcggcgcccauuugggggcuucuaacucuuucuccacgcagccccucuucuguccccuccccucucgcucccuuuuaaaaucaguggcaccgaggcgccugcagccgcacucgccagcgacucaucucuccagcggguuuuuuuuuguuugucgugugcgauccucacacucaugaacauacacaggucuacccccaucacaauagcgagauaugggagaucgcggaacaaaacccaggauuucgaagaguugucgucuauaagguccgcggagcccagccagaguuucagcccgaaccucggcuccccgagcccgcccgagacuccgaacuugucgcauugcguuucuuguaucgggaaauacuuauuguuggaaccucuggagggagaccacguuuuucgugccgugcaucugcacagcggagaggagcuggugugcaagguaaagggccaguggguugcuuuuugucuuuggaaggggcccgagggagcgggagggcgccaggcccucgagucugggagagggagauucgcgggauaauuaccguggccuuauuaaauggguuuauuuauuuauuugcucagguucgguaaguugcgaaguuuuuagaccguuucagacaauggggcgggcggcagugggggcguuucggggagagcccggggaggagagggcggcgggacugcgcgggggccacggacacgcgugcaccgaaggcuccaggagcucucugcgcgaggccgggucccgcugcccgggggggauuucuuccugugucuagcccccuccccuuccaacaaggauuagggaauccccc

SEQ ID NO: 19985 - RNA, 2522 nt, Homo sapiens
uugggccucaguuuccucaaaaggaaugaggggcuuuuuuggaacguuaaauaauuuccuacgugguugcggguagggagaaggagaaagagaggagcgcgccugcgcgccuggaaucgugcccggaucagagcaagcgcucuaaaaguguuacaaacauuaaggcgccaacuaaaaaacccguagugagcgcaggcagaaaccacggguaagagaaguggagaagcuucgcguaggccccagggucccgagccccgagucucgagcgcagaaucaggggugccaaugcucuccuccgcgcccccgagcgcucgccuuggccaugcgggccgccccaccgggaugagggcgcucaggccggacgcuggggccccggguucucgccccgccccgcccucggggauucagaggggccgggaggagccucgcgcaugugcacagcuggcgccccccgccccccgcgcacagcugggacgugggccgcggccgggcgggcgcagucgggagccggccgugguggcuccgugcguccgagcguccguccgcgccgucggccauggccaagcgcuccaggggccccgggcgccgcugccuguuggcgcucgugcuguucugcgccugggggacgcuggccgugguggcccagaagccgggcgcaggguguccgagccgcugccugugcuuccgcaccaccgugcgcugcaugcaucugcugcuggaggccgugcccgccguggcgccgcagaccuccauccugugagugccgcgggggacgccgggggcgcgggguccggggcuucguggagauccgggagcgcaggggugaucggagguggggggcgcggaggguggagggggcaucgggcgcgcggggggccuggggacuugggacgcagaagggaaccuccgaagggggacguggggggaccugggcgcggggacccgcugggccuuuguucgcccugcgggagacgccgaggggcggaacagagcgcugugcgcgcggccuucguagccgccuuuguucggaacucggaauccccgcaggacugggaaguuguuggagccuccggggcuccccccgcucgccucccgccgcccccucucaugcuccgccggccucccgcuucccccugguucgcggccccuccuccgcucaccuuucccccgcucaggaccccucggucccccuccgcuccccgagcgcggcgcagcccccuccguccucccagcccccuccgccccguuccucguccuguucgcuccccuccuccgcuccucuuccuccuccccuuccuccuccuccuccccuuccuccuccuccuccccuuccuccuccuccucccuuccccuccuccucccccccuuccuucuccucccccagccuccgcccucucccccucccccgccccuuggagcgcagugcccaccccauccccccgcgccggggaagccuccccagaggagccucaguucccgcagccgcggcgcccccgcucccagugcccccgcaucugcccggagcguccucuccugggguguccugggggccccgcgcuucucaggggcuuuuccugcgcccggagcgagccgggcggccgggguucccgagaggggccgcgcgguagucucggggcagcccgggucuagauggagccgggacucagagcggguuucugccucgggcauuucucuucuuucgcuucuaauccacgcgagcguguucgcaguugcgcuauacguuuaaccggaugcguugcguugggguugacacccuguccugcgggccgucccgcgucacggucuccacagcaggaauccccaucccuccgccccgcggcuccagguaccgagaugccgccagaguucgcugcaggccuccuguguucugaagcgagucggauucaacauuuucgggaucugugaacgcgggcugcguuucaggcgccgacucuaauuuaguccuguagcgacuuuucugcaugccaaaaauaguuuucacguuucuuagcugagccagaggacuuuuuggcaccagcaaagagucugcaaaaguuguaaaaaaauugagugaacaauucaggaagugggcggccagugcgccuaccuccgaaacaaagugcugggacagaccacggcucccaggggucgccgaguuugcaggcugcuuccuggaggcccuggggcggggcgggggcccgaguuccucuccuccuccgcagagagaccaaggcuuucuuuccagagcccgugaauggucagcccaggccggacgacucgggggcaucucacucaacagcaguggacuuuuagaauggagccgggugagguuucccugggucuggauaauguaauucuugcugagccaguggaaaaauggcaccucaaagauuuuucccaucuggucaguuucauaaagcuugcgguauguuuugccccggaauauuaauugcuuguugaaaauaacauguuaaaauaagugucguaggacacacaugggguccucugcuccgcuuugcaug

SEQ ID NO: 19986 - RNA, 2522 nt, Homo sapiens
caugcaaagcggagcagaggaccccauguguguccuacgacacuuauuuuaacauguuauuuucaacaagcaauuaauauuccggggcaaaacauaccgcaagcuuuaugaaacugaccagaugggaaaaaucuuugaggugccauuuuuccacuggcucagcaagaauuacauuauccagacccagggaaaccucacccggcuccauucuaaaaguccacugcuguugagugagaugcccccgagucguccggccugggcugaccauucacgggcucuggaaagaaagccuuggucucucugcggaggaggagaggaacucgggcccccgccccgccccagggccuccaggaagcagccugcaaacucggcgaccccugggagccguggucugucccagcacuuuguuucggagguaggcgcacuggccgcccacuuccugaauuguucacucaauuuuuuuacaacuuuugcagacucuuugcuggugccaaaaaguccucuggcucagcuaagaaacgugaaaacuauuuuuggcaugcagaaaagucgcuacaggacuaaauuagagucggcgccugaaacgcagcccgcguucacagaucccgaaaauguugaauccgacucgcuucagaacacaggaggccugcagcgaacucuggcggcaucucgguaccuggagccgcggggcggagggauggggauuccugcuguggagaccgugacgcgggacggcccgcaggacagggugucaaccccaacgcaacgcauccgguuaaacguauagcgcaacugcgaacacgcucgcguggauuagaagcgaaagaagagaaaugcccgaggcagaaacccgcucugagucccggcuccaucuagacccgggcugccccgagacuaccgcgcggccccucucgggaaccccggccgcccggcucgcuccgggcgcaggaaaagccccugagaagcgcggggcccccaggacaccccaggagaggacgcuccgggcagaugcgggggcacugggagcgggggcgccgcggcugcgggaacugaggcuccucuggggaggcuuccccggcgcggggggauggggugggcacugcgcuccaaggggcgggggagggggagagggcggaggcugggggaggagaaggaagggggggaggaggaggggaagggaggaggaggaggaaggggaggaggaggaggaaggggaggaggaggaggaaggggaggaggaagaggagcggaggaggggagcgaacaggacgaggaacggggcggagggggcugggaggacggagggggcugcgccgcgcucggggagcggagggggaccgagggguccugagcgggggaaaggugagcggaggaggggccgcgaaccagggggaagcgggaggccggcggagcaugagagggggcggcgggaggcgagcggggggagccccggaggcuccaacaacuucccaguccugcggggauuccgaguuccgaacaaaggcggcuacgaaggccgcgcgcacagcgcucuguuccgccccucggcgucucccgcagggcgaacaaaggcccagcggguccccgcgcccagguccccccacgucccccuucggagguucccuucugcgucccaaguccccaggccccccgcgcgcccgaugcccccuccacccuccgcgccccccaccuccgaucaccccugcgcucccggaucuccacgaagccccggaccccgcgcccccggcgucccccgcggcacucacaggauggaggucugcggcgccacggcgggcacggccuccagcagcagaugcaugcagcgcacgguggugcggaagcacaggcagcggcucggacacccugcgcccggcuucugggccaccacggccagcgucccccaggcgcagaacagcacgagcgccaacaggcagcggcgcccggggccccuggagcgcuuggccauggccgacggcgcggacggacgcucggacgcacggagccaccacggccggcucccgacugcgcccgcccggccgcggcccacgucccagcugugcgcggggggcggggggcgccagcugugcacaugcgcgaggcuccucccggccccucugaauccccgagggcggggcggggcgagaacccggggccccagcguccggccugagcgcccucaucccgguggggcggcccgcauggccaaggcgagcgcucgggggcgcggaggagagcauuggcaccccugauucugcgcucgagacucggggcucgggacccuggggccuacgcgaagcuucuccacuucucuuacccgugguuucugccugcgcucacuacggguuuuuuaguuggcgccuuaauguuuguaacacuuuuagagcgcuugcucugauccgggcacgauuccaggcgcgcaggcgcgcuccucucuuucuccuucucccuacccgcaaccacguaggaaauuauuuaacguuccaaaaaagccccucauuccuuuugaggaaacugaggcccaa

SEQ ID NO: 19987 - RNA, 2565 nt, Homo sapiens
ggggcggagaggaagugucacuuucuaaagaacaaacacgacaggucgacccuguuucuaaaggguuaacccgccuuccccgagcgcaccgcacgagaguuuuagccgugggcacguuuggugauucacuucuugcgaacguaaaugcgcgaguccgcgguaggucccgccggcccccuggcugggcaaccugaaaacccaccucggagacgcccccacgcauccgccccccucgcuggacggccccgccgcgcgccguucugggacgcgcaccccggggcggacccgcccugggaccuggaagcgccccagccccgcagcgaucgcagauucggcuuucaaacaaaagaggcgccccggggggugggaccgggaccucacccgguccucgcagaguugcggccgcccgccccuucagccccggcucuccguaugcgcaugagcagaggcgccucccucuguuccucccaaggcuaaacuuucuaauucccuucuuugggcucgggggcucccggagcagggcgagagcucgcgucgccgggugaggagaacaaaguggcugcacgauuuuccccacuuuccagcccaccccccgcuuccgugggagcgacaggaaauggaagggcgccucuucucucuuugaacauuugccuuuuuuccccuccuuuccaccucuccagaaaggaagacgggaagaaagggcaggcggcucggcgggcgucuucuccacuccucugccgcguccccguggcugcagggagccggcauggggcuucuccaguugcuagcuuucaguuucuuagguaauuccguggaaacggugcggggaggcggacggacuugggcauggggaaggaaaacccaaaagcugcuugcucaccuucgugggauccugggggcuugggagagggacuggauggaaaugacgccccugggauuaaacgccaccgcccuugcuucggugguggcuggagacagcgcacgcggagcgccgcggacccucaucccccgggcucugcgcccaagccccggccccugcggccucccgcggcccccgcucaggguuuugcacccucggccgguucacccuggguuuccccaccgcagagggcagguucccugggguuggcggugcugaccgaggagggcucuccaaaaauccauugcccaggagagugccugagcugagcggaggcuucauucugggaacagaugggggccauguggcuuuaauuaaccaucucuguuugucuccggauggcaccagaaacagcaggaccuggcgcuucccuggaauggagaagccuugaaaccacuccagagccccagggacuguccaugggcuccccuagcuccggaaagcggcguccaccgcgagccccggcgccucguccccagcgaagcgccggugacccucgcgcgugcacgcacacgcacucucgcuucccaagcucacagaucuccacgcgcacacucacaccgaggaugcgcgggcugccgcgugcacgcggguucacgugcguggguguguggcccuuugggggucagccucccugcgccgggcuccggacacgucgaaguggagggucuacacauccacccuuuguugggggagcugcuccccggggcugaucagggugggcgcgagcgucgguggguuucccgggagggaggcucucgcugcuggacagaccugaugacguguguggguuucuuuccguguccuucuccuuucggagucccugccuucccagccucuccugcgcucaucucuccauugucuuuucugugcauuuugcuuucuuccgaauggacuguccucucuccgcacccacucccccgcccccgcuuguucguuuuuuucgggcuccacucccugcuuguguccccccaacucuguugccuguccuucccgcagcccugugcagagcccgagugcgcgcucaggaacccgaguucagcuacggcugcgcagaaggcagcugcuaucccgccacgggcgaccuucucaucggccgagcacagaagcuuucggugaccucgacgugcgggcugcacaagcccgaacccuacuguaucgucagccacuugcaggugagggcugagagcgggguucgaggcucugcuagcgccuccucccguccagaccuaaggggcaggcccuggggacuccgcauccuuccagcaauccagauaggaagcgcagccagccggggagucccgggauuaggcuuguagcucaaccuuucgccccaucucaguuugcacaguugcauccgccacacauuuccugccggcgcggugaguauggaaaggcaggacugccgacagcccuggcugcccugacccagagccuccaaaaggccugauuguguguguguuuuuuaaaacuuuaguuuuggaagugugcauuaaaggugauuuauccucuuuuuaaaacccuuggguuuccccaccccccucuaccgcaucuucacuuggguaaagaggauuccagcaaugacaggcgucuugcaaggugauuccaaucacugaacgaacccguuuuccucuccucauuuggug

SEQ ID NO: 19988 - RNA, 2565 nt, Homo sapiens
caccaaaugaggagaggaaaacggguucguucagugauuggaaucaccuugcaagacgccugucauugcuggaauccucuuuacccaagugaagaugcgguagagggggguggggaaacccaaggguuuuaaaaagaggauaaaucaccuuuaaugcacacuuccaaaacuaaaguuuuaaaaaacacacacacaaucaggccuuuuggaggcucugggucagggcagccagggcugucggcaguccugccuuuccauacucaccgcgccggcaggaaauguguggcggaugcaacugugcaaacugagauggggcgaaagguugagcuacaagccuaaucccgggacuccccggcuggcugcgcuuccuaucuggauugcuggaaggaugcggaguccccagggccugccccuuaggucuggacgggaggaggcgcuagcagagccucgaaccccgcucucagcccucaccugcaaguggcugacgauacaguaggguucgggcuugugcagcccgcacgucgaggucaccgaaagcuucugugcucggccgaugagaaggucgcccguggcgggauagcagcugccuucugcgcagccguagcugaacucggguuccugagcgcgcacucgggcucugcacagggcugcgggaaggacaggcaacagaguuggggggacacaagcagggaguggagcccgaaaaaaacgaacaagcgggggcgggggagugggugcggagagaggacaguccauucggaagaaagcaaaaugcacagaaaagacaauggagagaugagcgcaggagaggcugggaaggcagggacuccgaaaggagaaggacacggaaagaaacccacacacgucaucaggucuguccagcagcgagagccucccucccgggaaacccaccgacgcucgcgcccacccugaucagccccggggagcagcucccccaacaaaggguggauguguagacccuccacuucgacguguccggagcccggcgcagggaggcugacccccaaagggccacacacccacgcacgugaacccgcgugcacgcggcagcccgcgcauccucggugugagugugcgcguggagaucugugagcuugggaagcgagagugcgugugcgugcacgcgcgagggucaccggcgcuucgcuggggacgaggcgccggggcucgcgguggacgccgcuuuccggagcuaggggagcccauggacagucccuggggcucuggagugguuucaaggcuucuccauuccagggaagcgccagguccugcuguuucuggugccauccggagacaaacagagaugguuaauuaaagccacauggcccccaucuguucccagaaugaagccuccgcucagcucaggcacucuccugggcaauggauuuuuggagagcccuccucggucagcaccgccaaccccagggaaccugcccucugcgguggggaaacccagggugaaccggccgagggugcaaaacccugagcgggggccgcgggaggccgcaggggccggggcuugggcgcagagcccgggggaugaggguccgcggcgcuccgcgugcgcugucuccagccaccaccgaagcaagggcgguggcguuuaaucccaggggcgucauuuccauccagucccucucccaagcccccaggaucccacgaaggugagcaagcagcuuuuggguuuuccuuccccaugcccaaguccguccgccuccccgcaccguuuccacggaauuaccuaagaaacugaaagcuagcaacuggagaagccccaugccggcucccugcagccacggggacgcggcagaggaguggagaagacgcccgccgagccgccugcccuuucuucccgucuuccuuucuggagagguggaaaggaggggaaaaaaggcaaauguucaaagagagaagaggcgcccuuccauuuccugucgcucccacggaagcggggggugggcuggaaaguggggaaaaucgugcagccacuuuguucuccucacccggcgacgcgagcucucgcccugcuccgggagcccccgagcccaaagaagggaauuagaaaguuuagccuugggaggaacagagggaggcgccucugcucaugcgcauacggagagccggggcugaaggggcgggcggccgcaacucugcgaggaccgggugaggucccggucccaccccccggggcgccucuuuuguuugaaagccgaaucugcgaucgcugcggggcuggggcgcuuccaggucccagggcggguccgccccggggugcgcgucccagaacggcgcgcggcggggccguccagcgaggggggcggaugcgugggggcgucuccgagguggguuuucagguugcccagccagggggccggcgggaccuaccgcggacucgcgcauuuacguucgcaagaagugaaucaccaaacgugcccacggcuaaaacucucgugcggugcgcucggggaaggcggguuaacccuuuagaaacagggucgaccugucguguuuguucuuuagaaagugacacuuccucuccgcccc

SEQ ID NO: 19989 - RNA, 2502 nt, Homo sapiens
ccaaaucggccccacggaccuagagggcucuugggcgagaugagacaucacccacuguguagaagcuguugccauugcugcugucacagccacuccggauggggcugccaccgcggccaggacagucuccuccgaccgcuuccugggcugcgcuaggguucgggggcgcugcccgcacgcuccggcggggaaggaaaucgccccgcgcccgccggaggaaggcgacggggagggaagggggagggcggcuaggaggcggguggaggggccggccgcccgggccaggucguuuuugaaugguuugggaggacgaauuguuagaccccgaggaagggaggugggacgggggagggggacuggaaagcggaaacuuuccuauaaaacuucgaaaagucccuccuccucacgucaggccaaugacacugcugcccccaaacuuuccgccugcacggagguauaagagccuccaagucugcagcucucgcccaacucccagacaccucgcgggcucugcagcaccggcaccguuuccaggaggccuggcggggugugcguccagccguugggcgcuuucuuuuuggaccucggggccauccacaccguccccucccccucccgccucccuccccgccucccccgcgcgcccuccccgcggaggucccucccguccguccuccugcucucuccuccgcgggccgcaucgcccgggccggcgccgcgcgcgggggaagcuggcgggcugaggcgccccgcucuucuccucugccccgggcccgcgaggccacgcgucgccgcucgagagaugaugcaggacguguccagcucgccagucucgccggccgacgacagccugagcaacagcgaggaagagccagaccggcagcagccgccgagcggcaagcgcgggggacgcaagcggcgcagcagcaggcgcagcgcgggcggcggcgcggggcccggcggagccgcgggugggggcgucggaggcggcgacgagccgggcagcccggcccagggcaagcgcggcaagaagucugcgggcuguggcggcggcggcggcgcgggcggcggcggcggcagcagcagcggcggcgggaguccgcagucuuacgaggagcugcagacgcagcgggucauggccaacgugcgggagcgccagcgcacccagucgcugaacgaggcguucgccgcgcugcggaagaucauccccacgcugcccucggacaagcugagcaagauucagacccucaagcuggcggccagguacaucgacuuccucuaccagguccuccagagcgacgagcuggacuccaagauggcaagcugcagcuauguggcucacgagcggcucagcuacgccuucucggucuggaggauggagggggccugguccauguccgcgucccacuagcaggcggagccccccacccccucagcagggccggagaccuagguaaggaccgcgccgcugcaccccuucgccucucagguggcagacggcaggccggccaggccgcgguucccaguccaccucgauuuccuccccucucccacucuccgcucagccuucccaccucacuuggcaccguugccucgcgcccccagcguccccggaaggccggucugaccccgcuagggagagcagucuccagggggaugcgcccuggugaggggugugugugcgcgugagugugcgugacaggaggggagacagagacacccagggucacggguaaggaccguuuugucagcgccacccuuucuuucggcuuucaauuuuuguucuccuuaaaacaaauguuuuaaaacaaauuccaccuccuccuccuuuccacccacccacuuccucuugcccuugggcugaaauccuuccagguuguucagcuuaauuucucagugguggugauaagaacagugcucacuagucuuagaaaacagccgcagagaccuaaacaauaaccgacuccccccccccccucuggguuuuugcagaugucauuguuuccagagaaggagaaaauggacagucuagagacucuggagcuggauaacuaaaaauaaaaauauaugccaaagauuuucuuggaaauuagaagagcaaaauccaaauucaaagaaacagggcguggggcgcacuuuuaaaagagaaagcgagacaggcccguggacagugauucccagacgggcagcggcaccauccucacaccucugcauucugauagaagucugaacaguuguuuguguuuuuuuuuuuuuuuuuuuugacgaagaauguuuuuauuuuuauuuuuuucaugcaugcauucucaagaggucgugccaaucagccacugaaaggaaaggcaucacuauggacuuucucuauuuuaaaaugguaacaaucagaggaacuauaagaacaccuuuagaaauaaaaauacugggaucaaacuggccugcaaaaccauagucaguuaauucuuuuuuucauccuuccucugaggggaaaaacaaaaaaaaacu

SEQ ID NO: 19990 - RNA, 2502 nt, Homo sapiens
aguuuuuuuuuguuuuuccccucagaggaaggaugaaaaaaagaauuaacugacuaugguuuugcaggccaguuugaucccaguauuuuuauuucuaaagguguucuuauaguuccucugauuguuaccauuuuaaaauagagaaaguccauagugaugccuuuccuuucaguggcugauuggcacgaccucuugagaaugcaugcaugaaaaaaauaaaaauaaaaacauucuucgucaaaaaaaaaaaaaaaaaaaacacaaacaacuguucagacuucuaucagaaugcagaggugugaggauggugccgcugcccgucugggaaucacuguccacgggccugucucgcuuucucuuuuaaaagugcgccccacgcccuguuucuuugaauuuggauuuugcucuucuaauuuccaagaaaaucuuuggcauauauuuuuauuuuuaguuauccagcuccagagucucuagacuguccauuuucuccuucucuggaaacaaugacaucugcaaaaacccagaggggggggggggagucgguuauuguuuaggucucugcggcuguuuucuaagacuagugagcacuguucuuaucaccaccacugagaaauuaagcugaacaaccuggaaggauuucagcccaagggcaagaggaaguggguggguggaaaggaggaggagguggaauuuguuuuaaaacauuuguuuuaaggagaacaaaaauugaaagccgaaagaaaggguggcgcugacaaaacgguccuuacccgugacccugggugucucugucuccccuccugucacgcacacucacgcgcacacacaccccucaccagggcgcaucccccuggagacugcucucccuagcggggucagaccggccuuccggggacgcugggggcgcgaggcaacggugccaagugaggugggaaggcugagcggagagugggagaggggaggaaaucgagguggacugggaaccgcggccuggccggccugccgucugccaccugagaggcgaaggggugcagcggcgcgguccuuaccuaggucuccggcccugcugaggggguggggggcuccgccugcuagugggacgcggacauggaccaggcccccuccauccuccagaccgagaaggcguagcugagccgcucgugagccacauagcugcagcuugccaucuuggaguccagcucgucgcucuggaggaccugguagaggaagucgauguaccuggccgccagcuugagggucugaaucuugcucagcuuguccgagggcagcguggggaugaucuuccgcagcgcggcgaacgccucguucagcgacugggugcgcuggcgcucccgcacguuggccaugacccgcugcgucugcagcuccucguaagacugcggacucccgccgccgcugcugcugccgccgccgccgcccgcgccgccgccgccgccacagcccgcagacuucuugccgcgcuugcccugggccgggcugcccggcucgucgccgccuccgacgcccccacccgcggcuccgccgggccccgcgccgccgcccgcgcugcgccugcugcugcgccgcuugcgucccccgcgcuugccgcucggcggcugcugccggucuggcucuuccucgcuguugcucaggcugucgucggccggcgagacuggcgagcuggacacguccugcaucaucucucgagcggcgacgcguggccucgcgggcccggggcagaggagaagagcggggcgccucagcccgccagcuucccccgcgcgcggcgccggcccgggcgaugcggcccgcggaggagagagcaggaggacggacgggagggaccuccgcggggagggcgcgcgggggaggcggggagggaggcgggagggggaggggacgguguggauggccccgagguccaaaaagaaagcgcccaacggcuggacgcacaccccgccaggccuccuggaaacggugccggugcugcagagcccgcgaggugucugggaguugggcgagagcugcagacuuggaggcucuuauaccuccgugcaggcggaaaguuugggggcagcagugucauuggccugacgugaggaggagggacuuuucgaaguuuuauaggaaaguuuccgcuuuccagucccccucccccgucccaccucccuuccucggggucuaacaauucguccucccaaaccauucaaaaacgaccuggcccgggcggccggccccuccacccgccuccuagccgcccucccccuucccuccccgucgccuuccuccggcgggcgcggggcgauuuccuuccccgccggagcgugcgggcagcgcccccgaacccuagcgcagcccaggaagcggucggaggagacuguccuggccgcgguggcagccccauccggaguggcugugacagcagcaauggcaacagcuucuacacagugggugaugucucaucucgcccaagagcccucuagguccguggggccgauuugg

SEQ ID NO: 19991 - RNA, 2446 nt, Homo sapiens
ccgcuguuggcggugccgccuggcccugccuguacgccgccagcggagccccgaggccgccgcccuccaugcccacuuucuuguagcuuuccuccaggggacucaagaugucagacacugagaacggagucgugugcuuuggacucaucgacaugauucggcggcggcuggaggaggaaggaagaggaggaaaaaaaagggagagggggaaggcgaagccucgcugcuuuuuuuuucucccuuugccaaauauucugguguuaccuuaacgccgaucuuguuggauguacacguaacggaguggaccgaguccuccuuaauuggcuugaguggaggcucgggggcugccucgcguuuguuuuagcccggcgccagguuuuaggcagccaccagaggcggggcguaagcgcuaaagcaacaagacaauagaagccuacaucuugcccgagauaauuagcuuacaugcugaugacaagguaaacaccuuuaaguuucacuugucaggauuuuuaggucucaaagagagagagagagaggcagagacgagacccaaagcauuuccccccucccuuggacacccccacccccauuuuuugugggguaccagcggagcgcggggaggagguggaggggaggggaaggaggagggaaccgagagcggggagggcaggagguggggugggggaguaacagaggaggagagaugguugagaggaaggaaggugaaugcugcuuugcaaccaacuugcggaguuacaaaguggaaccacuuuccaauucggucgggguuccccgggcacggacaggucuuuaggaggagggggcugagggacaggguggggguuucaccugagccugccggggcugcuccucccucccgccgcggccucccagccccgcgccuucccacugccuccggaccacaucgggcuucgcugcgcugagccccagucgccaacaaaugagcgagcgagucuggggacgaacccuggggccgcacuguuggucuacgugucugucagucugucugccucucuucugccgccgucagagggacaccucugcuccccgcccccuuucccccuaccggagagaauccgagcgggcggagggggcgcugaguaggggaucgacugccucccggaggcugucccggauccccgagccacaacccgcccccgcagcucagggguuuuucagugggccacccccgcuaacacgccucccccaaggucuuccccccccccccccacccccggccgagcaaacacagcacuggcccccagagcugggaggaugggaaggggucucacgggaggguccgucacugaaguugccccaccucgaacaaaccuggugucccugacccucgcccaucucccagacacgcggggaucuggggcuggagcugacuuuccgaggacaucacagccccagcacccgagcccagagccacgcuguuuuccccucugaugcuucagggagcgcgcgagcagggagcggcgugagugcccgucugucuguugccgggcggaacugagccugaaccccggcggcuggagcgcuggccaggagggggcgaaugccgaggugcgggcagcucagcgggcgggaggcugggccgaggcucgccuccgcccgcagcucagccaugcaaaagugcucuugcuucccgggaauaaccaaauaucuuuguuuaaagugguggcguaaauggccagucgcuuuguggccacgcuggauauuaguagaugaggaucauucugcuucaauugggcgccucucauccgacgagcaagaaacugcuuaggaggaagaggguuuccugucugcgcguucccaggcuucaagugugggccccgcgccuugaggguccuugggcgccuggcgagggggagcugugggcugcgcuccccagcggaaucgggggugucccccgcguugcuccggccaggccggggccugcagccgagucgacuaccgaguggagcacugaacggcgcggauuuugagaccgacuccgguuuuuguccuuggauuuuaaacguuuuuaucauuguuuuuguuuugcuuucuccuuagcuguuuuagucuccucugcgcgccaggggcugggagggcggagcgcuccccggccggccccggcaggugccuccaagacacccgcgcuggucaaggagcuucuugaauuuaguuuuuguuuucacauuuucuuuccccuccuuguagagaaggagcuccugaucaugacgaacaggcaguuuugagcuacuuaauucauccgggcucccuuuuuuuauuaauagcaauuacaguagagaaaguuuuauuuauuuuuaaagauuucagcccucuccuugaagagagcucuuacucccucaauacaaagccaacuucuauaauaacauucgcuuuucucaccgccuaccuucuuuaccaggguaaa

SEQ ID NO: 19992 - RNA, 2446 nt, Homo sapiens
uuuacccugguaaagaagguaggcggugagaaaagcgaauguuauuauagaaguuggcuuuguauugagggaguaagagcucucuucaaggagagggcugaaaucuuuaaaaauaaauaaaacuuucucuacuguaauugcuauuaauaaaaaaagggagcccggaugaauuaaguagcucaaaacugccuguucgucaugaucaggagcuccuucucuacaaggaggggaaagaaaaugugaaaacaaaaacuaaauucaagaagcuccuugaccagcgcgggugucuuggaggcaccugccggggccggccggggagcgcuccgcccucccagccccuggcgcgcagaggagacuaaaacagcuaaggagaaagcaaaacaaaaacaaugauaaaaacguuuaaaauccaaggacaaaaaccggagucggucucaaaauccgcgccguucagugcuccacucgguagucgacucggcugcaggccccggccuggccggagcaacgcgggggacacccccgauuccgcuggggagcgcagcccacagcucccccucgccaggcgcccaaggacccucaaggcgcggggcccacacuugaagccugggaacgcgcagacaggaaacccucuuccuccuaagcaguuucuugcucgucggaugagaggcgcccaauugaagcagaaugauccucaucuacuaauauccagcguggccacaaagcgacuggccauuuacgccaccacuuuaaacaaagauauuugguuauucccgggaagcaagagcacuuuugcauggcugagcugcgggcggaggcgagccucggcccagccucccgcccgcugagcugcccgcaccucggcauucgcccccuccuggccagcgcuccagccgccgggguucaggcucaguuccgcccggcaacagacagacgggcacucacgccgcucccugcucgcgcgcucccugaagcaucagaggggaaaacagcguggcucugggcucgggugcuggggcugugauguccucggaaagucagcuccagccccagauccccgcgugucugggagaugggcgagggucagggacaccagguuuguucgagguggggcaacuucagugacggacccucccgugagaccccuucccauccucccagcucugggggccagugcuguguuugcucggccggggguggggggggggggggaagaccuugggggaggcguguuagcggggguggcccacugaaaaaccccugagcugcgggggcggguuguggcucggggauccgggacagccuccgggaggcagucgauccccuacucagcgcccccuccgcccgcucggauucucuccgguagggggaaagggggcggggagcagaggugucccucugacggcggcagaagagaggcagacagacugacagacacguagaccaacagugcggccccaggguucguccccagacucgcucgcucauuuguuggcgacuggggcucagcgcagcgaagcccgaugugguccggaggcagugggaaggcgcggggcugggaggccgcggcgggagggaggagcagccccggcaggcucaggugaaacccccacccugucccucagcccccuccuccuaaagaccuguccgugcccggggaaccccgaccgaauuggaaagugguuccacuuuguaacuccgcaaguugguugcaaagcagcauucaccuuccuuccucucaaccaucucuccuccucuguuacucccccaccccaccuccugcccuccccgcucucgguucccuccuccuuccccuccccuccaccuccuccccgcgcuccgcugguaccccacaaaaaauggggguggggguguccaagggaggggggaaaugcuuugggucucgucucugccucucucucucucucuuugagaccuaaaaauccugacaagugaaacuuaaagguguuuaccuugucaucagcauguaagcuaauuaucucgggcaagauguaggcuucuauugucuuguugcuuuagcgcuuacgccccgccucugguggcugccuaaaaccuggcgccgggcuaaaacaaacgcgaggcagcccccgagccuccacucaagccaauuaaggaggacucgguccacuccguuacguguacauccaacaagaucggcguuaagguaacaccagaauauuuggcaaagggagaaaaaaaaagcagcgaggcuucgccuucccccucucccuuuuuuuuccuccucuuccuuccuccuccagccgccgccgaaucaugucgaugaguccaaagcacacgacuccguucucagugucugacaucuugaguccccuggaggaaagcuacaagaaagugggcauggagggcggcggccucggggcuccgcuggcggcguacaggcagggccaggcggcaccgccaacagcgg

SEQ ID NO: 19993 - RNA, 2517 nt, Homo sapiens
auaaaacuaaaaguagauccauaacagaaagggcugggagggggugcuauaauaaucucaaagugcuauaugcauuuuauuuuaacaugacuuuacauguacaccuuugcaagcuauuuagaaacucgcauuaauuuugucaccacuuuacaguccccuguuugaaaaauuuggugacacaguuugucaaaauaaaucuuuuuuuuuuuucacaugcugauguugcugccgaugauuucaacgccuggcuuugagauuccgugaguagucuugaauaauuuaaaauucgaaaaucaaauucuacuuauuuucucuuaaugcuauuguauuuccuaauucucagcuuuaacauguaagaaaguacuuucgcuaggggucuuaauugaaugguggggucgagaugacugcgucagaauuaaaucucuggaagaccucugagcuccuuuuaaaaucaucaacaagcgaaaauccuuaucaauagcgaugugggaaugcauuagguacaguauuuuaaacauacaaaaccuaggcauauuaaaaagcacuccucugguaauuuaauaaggaauaaugauguccuuaaguuuauuuuaaucagcaaguaugacucaauuugaaaauaugagaacaaauagauuuaaauaggaacacccaguaaacuaugguaugcaaauaaacucagagguaaacuugugaauacauaaaucuaaauaagucaguuaccaucaaaauauuacgugauccuauauuuuucuguccacgucuuaaaaguauuuuuuaccuuggggcuuuauuuucuuucccucuucccaagauuauccaaggcaguuccaauacgcguuuucaauaaugguaauuaaacuuuuggaggguaaucgccagcuguuuccagaaaaauacuuuuaauaggugguaguccucccuguaacugguuuucccuguaauccuuuugugcacauuguaaaaauaacccccaugaacgugccaccaaggggacaaugaagagaaacagguucucggcccagaguugugaagaagauuuuggucgcacuagcgccacccagcgguuuuagagaaggagcacacuucuccccaaauagggcuuuugaagaacaaguuuuacaaaauuuagaaaucguuucauuauugagacacccaacuuggcggcagagcgcuuuaaucagaagacgucugcgaauuaaacggugggacgaagaggucgccuuguggguaugcuccggcuuucucagaguugcuuccaacucgcaccggcgcucgcccgcccgcugcaccccgggcccggcuccugcucccgcucgcugcugggaagaggcaagcgcuuccuagagccgcuguuuucaaagcccggaguuuccuaaaacucccucuccggcugcgagagucgggacagagcagggcagcaggucccgcuuccaggcccggccaaggcccggccggggccacaccggcgggcgggcagcgguggcaccgagaaggcgcccccggcccgccugccugccuugccuggcgcccaccgcuccccggccucccccggcacgggcuccagcggcgccccaccggccgcccgccucgccuugccucucaccuccugcgugucugcguaguagcuguuccagucgcugguuucaugcccuuccaucuucacaguuccuaacauccuggagccacccugcccaauacaaccauccagcccugugcgaagcgacgggcggccgcgcggcgcggggcgggggaggggagcugagcagcugcagucacccgagcgcccgcgcgggcccaacgccacccgggcgaagaggaagcccagagcugcggggcgcggcgugcgcggcggcggcggcggcgcggcgggcgggggcagcgccgggggcaggcggcugccgcggagcgcggcgccggggagcgccuccgcgggaagugagcgggcugccucugcgaggcaagugcaguugagcugauguggaucuuacgucgcuugagugcccaccuccucguccucuccccauuuguccgccgcacaaagacgcucgcaccuacaaagcccgaggugcaccugcaaggcggccgcccgccaguccggccgccgcgccucccgccccgccgcuucaccgcugcgcgcgaccccucccccgcgaccccucccccaagcggggcccucacuuuguuugcaaagcaguguaauugguuuaggcccggaggcuagggaaagagggaaauggggagggaggggguguaacccccuuuggaaaaagaaaaaauaggcggggccaggcgggcgggcgggcuagggcucuggaucggaaccucgcagccggagaaggccgggggcgguggcgucggagacugggcuuagagaccuugugggauaacugaccccggggucccuccccagagguacacgccaccuuccgagcgcgggcugcggcccagucucgcgccccuccugcucuuugcuuccucccuccugauuccugacccaaaguucaaccccgggag

SEQ ID NO: 19994 - RNA, 2517 nt, Homo sapiens
cucccgggguugaacuuugggucaggaaucaggagggaggaagcaaagagcaggaggggcgcgagacugggccgcagcccgcgcucggaagguggcguguaccucuggggagggaccccggggucaguuaucccacaaggucucuaagcccagucuccgacgccaccgcccccggccuucuccggcugcgagguuccgauccagagcccuagcccgcccgcccgccuggccccgccuauuuuuucuuuuuccaaaggggguuacacccccucccuccccauuucccucuuucccuagccuccgggccuaaaccaauuacacugcuuugcaaacaaagugagggccccgcuugggggaggggucgcgggggaggggucgcgcgcagcggugaagcggcggggcgggaggcgcggcggccggacuggcgggcggccgccuugcaggugcaccucgggcuuuguaggugcgagcgucuuugugcggcggacaaauggggagaggacgaggaggugggcacucaagcgacguaagauccacaucagcucaacugcacuugccucgcagaggcagcccgcucacuucccgcggaggcgcuccccggcgccgcgcuccgcggcagccgccugcccccggcgcugcccccgcccgccgcgccgccgccgccgccgcgcacgccgcgccccgcagcucugggcuuccucuucgcccggguggcguugggcccgcgcgggcgcucgggugacugcagcugcucagcuccccucccccgccccgcgccgcgcggccgcccgucgcuucgcacagggcuggaugguuguauugggcaggguggcuccaggauguuaggaacugugaagauggaagggcaugaaaccagcgacuggaacagcuacuacgcagacacgcaggaggugagaggcaaggcgaggcgggcggccgguggggcgccgcuggagcccgugccgggggaggccggggagcggugggcgccaggcaaggcaggcaggcgggccgggggcgccuucucggugccaccgcugcccgcccgccgguguggccccggccgggccuuggccgggccuggaagcgggaccugcugcccugcucugucccgacucucgcagccggagagggaguuuuaggaaacuccgggcuuugaaaacagcggcucuaggaagcgcuugccucuucccagcagcgagcgggagcaggagccgggcccggggugcagcgggcgggcgagcgccggugcgaguuggaagcaacucugagaaagccggagcauacccacaaggcgaccucuucgucccaccguuuaauucgcagacgucuucugauuaaagcgcucugccgccaaguugggugucucaauaaugaaacgauuucuaaauuuuguaaaacuuguucuucaaaagcccuauuuggggagaagugugcuccuucucuaaaaccgcuggguggcgcuagugcgaccaaaaucuucuucacaacucugggccgagaaccuguuucucuucauuguccccuugguggcacguucauggggguuauuuuuacaaugugcacaaaaggauuacagggaaaaccaguuacagggaggacuaccaccuauuaaaaguauuuuucuggaaacagcuggcgauuacccuccaaaaguuuaauuaccauuauugaaaacgcguauuggaacugccuuggauaaucuugggaagagggaaagaaaauaaagccccaagguaaaaaauacuuuuaagacguggacagaaaaauauaggaucacguaauauuuugaugguaacugacuuauuuagauuuauguauucacaaguuuaccucugaguuuauuugcauaccauaguuuacuggguguuccuauuuaaaucuauuuguucucauauuuucaaauugagucauacuugcugauuaaaauaaacuuaaggacaucauuauuccuuauuaaauuaccagaggagugcuuuuuaauaugccuagguuuuguauguuuaaaauacuguaccuaaugcauucccacaucgcuauugauaaggauuuucgcuuguugaugauuuuaaaaggagcucagaggucuuccagagauuuaauucugacgcagucaucucgaccccaccauucaauuaagaccccuagcgaaaguacuuucuuacauguuaaagcugagaauuaggaaauacaauagcauuaagagaaaauaaguagaauuugauuuucgaauuuuaaauuauucaagacuacucacggaaucucaaagccaggcguugaaaucaucggcagcaacaucagcaugugaaaaaaaaaaaagauuuauuuugacaaacugugucaccaaauuuuucaaacaggggacuguaaaguggugacaaaauuaaugcgaguuucuaaauagcuugcaaagguguacauguaaagucauguuaaaauaaaaugcauauagcacuuugagauuauuauagcacccccucccagcccuuucuguuauggaucuacuuuuaguuuuau

SEQ ID NO: 19995 - RNA, 2507 nt, Homo sapiens
ucuuuaauccccguccaagggauccgcccucaccccccaccccagccaccccaauucccuauucccuccccuuggacggcgccggggaaaacaagcugcucgagcuuuauuucuucggugcaaccaacucagaaugaauuccuccgccccugcgugcucagugagucggcacccuagcagugaacugcauuuaaaaccucaggaauugagcgaacucucccaguggcucuccucaccgggauccccuuccacgccuccuccccgugccgcgccucaguccgcacugcucauuggccgcgugcccugccaauccgaugcacgucggcuagggcaaagaccgcgaaaaagcgcguacaccuggcucugggagcgcgcgccuaacgccagccagcagcaggaggcgcgcgaggcaccacggccuggcggccgagagucagggaggaaccucauuuacauaacggccgccccucugucuccuggcgggggccggagucccgccccucguccaacuugaaaucuguugggucacgggccagucacuccgaccuaggcaagccugugguggagcuggaagaguuugugagggcggucccgggagcggauugggucugggaguucccagaggcggcuauaagaaccgggaacugggcgcggggagcugaguugcugguagugcccguggugcuugguucgagguggccguuaguugacuccgcggaguucaucucccugguuuucccguccuaacgucgcucgccuuucagucaggaugucugcccguggcccggcuaucggcaucgaccugggcaccaccuauucgugcgucggggucuuccaacauggcaagguggagaucaucgccaacgaccagggcaaucgcaccacccccagcuacguggccuucacggacaccgagcgccucaucggcgacgccgccaagaaccagguggccaugaaccccaccaacaccaucuucgacgccaagaggcugauuggacggaaauucgaggaugccacagugcagucggauaugaaacacuggccguuccggguggugagcgagggaggcaagcccaaagugcaaguagaguacaagggggagaccaagaccuucuucccagaggagauauccuccaugguccucacgaagaugaaggagaucgcggaagccuaccuggggggcaaggugcacagcgcggucauaacggucccggccuauuucaacgacucgcagcgccaggccaccaaggacgcaggcaccaucacggggcucaaugugcugcgcaucaucaacgagcccacggcggcggccaucgccuacggccuggacaagaagggcugcgcgggcggcgagaagaacgugcucaucuuugaccugggcgguggcacuuucgacguguccauccugaccaucgaggauggcaucuucgaggugaaguccacggccggcgacacccaccugggcggugaggacuucgacaaccgcauggugagccaccuggcggaggaguucaagcgcaagcacaagaaggacauugggcccaacaagcgcgccgugaggcggcugcgcaccgcuugcgagcgcgccaagcgcacccugagcucguccacgcaggcgagcaucgagaucgacucgcucuacgagggcguggacuucuauacguccaucacgcgcgcccgcuucgaggagcucaaugccgaccucuuucgcgggacccuggagccgguggagaaggcgcugcgcgacgccaagcuggacaagggccagauccaggagaucgugcuggugggcggcuccacucguauccccaagauccagaagcugcugcaggauuucuucaacggcaaggagcugaacaagagcaucaaccccgacgaggcgguggccuauggcgccgcggugcaggcggccauccucaucggcgacaaaucagagaaugugcaggaccugcugcuacucgacgugaccccguugucgcugggcaucgagacagcuggcggugucaugaccccacucaucaagaggaacaccacgauccccaccaagcagacgcagaccuucaccaccuacucggacaaccagagcagcguacuggugcagguauacgagggcgaacgggccaugaccaaggacaauaaccugcugggcaaguucgaccugaccgggauucccccugcgccucgcggggucccccaaaucgagguuaccuucgacauugacgccaauggcauccuuaacguuaccgccgccgacaagagcaccgguaaggaaaacaaaaucaccaucaccaaugacaaaggucgucugagcaaggacgacauugaccggauggugcaggaggcggagcgguacaaaucggaagaugaggcgaaucgcgaccgagucgcggccaaaaacgcccuggaguccuauaccuacaacaucaagcagacgguggaagacgagaaacugaggggcaagauuagcgagcaggacaaaaacaagauccucgacaagugucaggagg

SEQ ID NO: 19996 - RNA, 2507 nt, Homo sapiens
ccuccugacacuugucgaggaucuuguuuuuguccugcucgcuaaucuugccccucaguuucucgucuuccaccgucugcuugauguuguagguauaggacuccagggcguuuuuggccgcgacucggucgcgauucgccucaucuuccgauuuguaccgcuccgccuccugcaccauccggucaaugucguccuugcucagacgaccuuugucauuggugauggugauuuuguuuuccuuaccggugcucuugucggcggcgguaacguuaaggaugccauuggcgucaaugucgaagguaaccucgauuugggggaccccgcgaggcgcagggggaaucccggucaggucgaacuugcccagcagguuauuguccuuggucauggcccguucgcccucguauaccugcaccaguacgcugcucugguuguccgaguagguggugaaggucugcgucugcuugguggggaucgugguguuccucuugaugaguggggucaugacaccgccagcugucucgaugcccagcgacaacggggucacgucgaguagcagcagguccugcacauucucugauuugucgccgaugaggauggccgccugcaccgcggcgccauaggccaccgccucgucgggguugaugcucuuguucagcuccuugccguugaagaaauccugcagcagcuucuggaucuuggggauacgaguggagccgcccaccagcacgaucuccuggaucuggcccuuguccagcuuggcgucgcgcagcgccuucuccaccggcuccagggucccgcgaaagaggucggcauugagcuccucgaagcgggcgcgcgugauggacguauagaaguccacgcccucguagagcgagucgaucucgaugcucgccugcguggacgagcucagggugcgcuuggcgcgcucgcaagcggugcgcagccgccucacggcgcgcuuguugggcccaauguccuucuugugcuugcgcuugaacuccuccgccagguggcucaccaugcgguugucgaaguccucaccgcccaggugggugucgccggccguggacuucaccucgaagaugccauccucgauggucaggauggacacgucgaaagugccaccgcccaggucaaagaugagcacguucuucucgccgcccgcgcagcccuucuuguccaggccguaggcgauggccgccgccgugggcucguugaugaugcgcagcacauugagccccgugauggugccugcguccuugguggccuggcgcugcgagucguugaaauaggccgggaccguuaugaccgcgcugugcaccuugccccccagguaggcuuccgcgaucuccuucaucuucgugaggaccauggaggauaucuccucugggaagaaggucuuggucucccccuuguacucuacuugcacuuugggcuugccucccucgcucaccacccggaacggccaguguuucauauccgacugcacuguggcauccucgaauuuccguccaaucagccucuuggcgucgaagaugguguuggugggguucauggccaccugguucuuggcggcgucgccgaugaggcgcucgguguccgugaaggccacguagcuggggguggugcgauugcccuggucguuggcgaugaucuccaccuugccauguuggaagaccccgacgcacgaauagguggugcccaggucgaugccgauagccgggccacgggcagacauccugacugaaaggcgagcgacguuaggacgggaaaaccagggagaugaacuccgcggagucaacuaacggccaccucgaaccaagcaccacgggcacuaccagcaacucagcuccccgcgcccaguucccgguucuuauagccgccucugggaacucccagacccaauccgcucccgggaccgcccucacaaacucuuccagcuccaccacaggcuugccuaggucggagugacuggcccgugacccaacagauuucaaguuggacgaggggcgggacuccggcccccgccaggagacagaggggcggccguuauguaaaugagguuccucccugacucucggccgccaggccguggugccucgcgcgccuccugcugcuggcuggcguuaggcgcgcgcucccagagccagguguacgcgcuuuuucgcggucuuugcccuagccgacgugcaucggauuggcagggcacgcggccaaugagcagugcggacugaggcgcggcacggggaggaggcguggaaggggaucccggugaggagagccacugggagaguucgcucaauuccugagguuuuaaaugcaguucacugcuagggugccgacucacugagcacgcaggggcggaggaauucauucugaguugguugcaccgaagaaauaaagcucgagcagcuuguuuuccccggcgccguccaaggggagggaauagggaauugggguggcugggguggggggugagggcggaucccuuggacggggauuaaaga

SEQ ID NO: 19997 - RNA, 2828 nt, Homo sapiens
ccuggccgaggcccgaggcggccagcgcagcucccucaagcuuuccccacuguaggaugacgacgaugcgcccgacucggagcugagggcgcccucacgccggcgggacagugaguccagcgaauggcucuuccugccuguucgagaacccgcuggcggagguuggguccgggcggaggagggacuaggggaagccuugcgggccgcacgcggcgcgggcgaggccgggaggcuggcgcugcugcagcugcugcugcugcccgcgcucggggccgaggccgcggcggcggcggcggcggcggcggccgcggggcucaaaggcgugaaaagacgccgcuucuccucgcgcaugaugcgcucgcgcucggcccggcauugcugcagcuuggcgcgccgcuccgccucguaggccucauacaggccgguggccacccgcauggagcggcccggagccucucgcaccaggucggccagggcccguggcagcagcuccaccggcuugaccgcacagcgggcgcaggccucuagcgagcgggggcuggucagcacguagcggcugcccuccgccucugggcagucgaaguugaagaggucgaggugcagcagcggggacugcucccgccgcccgccuucugcggcugcacaugggacuucugccuugcggggcaccgccgcggaggccgaggccgaggccgaggaagcugcgggcuccugugcgcccugggaaucagggggcacggacgccacggccucguccccuccagagucgccggguuccgcuccugccuucucuucuucaggcacuggguccaccauggcugagccccguccuuuguuggaaucucugcagaucacaaggagggacaucgaggaauacgucugagagcucuuccccccuccucauccauagucaccccaucccaacuuaauccgcuuucggauuaggcucagaggcuuugguggaacguaaaucauaaaaccgaugucggaaagcccaggcugagcgccagaacggggauggggguggggcggacacucguguucagagagcagccugggucucccucagccccggaaugcgggguggaggccuguggcgaggcuccucugggcgccuagcccgcuagaugcauccccuuucugcugcaaguuaagaugaaaagauccaggugcaggcaggagcuagagagggaggcgcuggaggauucccgggaggauuagcguauuuguuuguagcuuaggcgggcuacuggggaugcagcuuugcaggaacaaaaaagcaagaggccuguucaucccaagggaccccauuugccuaagggaagaaguuuaugguugauuuccccugccaaaggagacucggucgcaaggcccccgggugauuaaagggcugggagaaguccccaaaggccucuccgggaggggugauggauucuugcuccagcagcucuggcagggcuuacugagggcucugcacgccgccuccgcccccaccuccacccccaccggguguuugcuggggauggagaaggugccuggauacucucagacgcaccggaucuccuccaagucugaaugugcuaaagauaccauccaccccagucgggguucagauacccgcccucgggugcccuccgaguucccccacagcaucccagugggugggcuccuggagugcaaagaaccuggccgcccagguucccgcagcucccgguacccgagccgguuuacucaccccgcguccugggcuucggccccgcgccaagggcuuuuguucgcagcucgccgcuguccccugcgcuucuucagucucugcgccggcggggucggguuacugccggcugcaaccgugaaaggagccccaucugccgccgccagcgucucuccauggggucugcgaacagggcgcacgcaccccagaugcuaccuacacgugggagggggagugcgacaaugucucccuaaaauaacgcggcucugcacccuucccucacauugauucuuuaaaaaagaagcccgguuccgucgcugcggcaucccucuacaccucuacaaccguggagguaccgcaggucccacgcugcccccugcgccuccuggcggacacucgagggugcugguuuguuugcuucgaggacgaaggagaaauuuuuguuuaaauguauauauguacauauauacacacauauaauauguauauauauacacuacacacauacagguagauguagguauagauauggauagauaucgauauauaaaucaccaagaaacccuagucuuucagcagccuaacuggguagaaugaaggaauugcucagcuuguuucuaaaggaaacccugaggagcaaacaaacuugauagcgaauaauuggguggaaauauggcgccugaugcaaauugugauuuuuuuuuuuucaaugaaaaacuaaaaacaggcugggcaagguggcuuacaccuguaaucccagcacuucgggaggucgaggccaguggauuacuugaguccaggaauuugagaccagccuggacaacauagcgaguccccaucucuaaaaaaauuuucaagaauuagcuggggugguguccugugccuguagucccagcuacuccagaggcugaagugggaggaucaccugagcccaggagguugaggcugcggugaaccaugacugcaccaccgcacugcagccugggugacagagugagacccugucucaaacaaaauaaaacaaaauaaaaacaaacaaaaacuaagaacacuuauggguuugacgcagguggaacauauguaacugguguuuaaugcaacauuuuaugacuuccug

SEQ ID NO: 19998 - RNA, 2828 nt, Homo sapiens
caggaagucauaaaauguugcauuaaacaccaguuacauauguuccaccugcgucaaacccauaaguguucuuaguuuuuguuuguuuuuauuuuguuuuauuuuguuugagacagggucucacucugucacccaggcugcagugcgguggugcagucaugguucaccgcagccucaaccuccugggcucaggugauccucccacuucagccucuggaguagcugggacuacaggcacaggacaccaccccagcuaauucuugaaaauuuuuuuagagauggggacucgcuauguuguccaggcuggucucaaauuccuggacucaaguaauccacuggccucgaccucccgaagugcugggauuacagguguaagccaccuugcccagccuguuuuuaguuuuucauugaaaaaaaaaaaaucacaauuugcaucaggcgccauauuuccacccaauuauucgcuaucaaguuuguuugcuccucaggguuuccuuuagaaacaagcugagcaauuccuucauucuacccaguuaggcugcugaaagacuaggguuucuuggugauuuauauaucgauaucuauccauaucuauaccuacaucuaccuguauguguguaguguauauauauacauauuauauguguguauauauguacauauauacauuuaaacaaaaauuucuccuucguccucgaagcaaacaaaccagcacccucgaguguccgccaggaggcgcagggggcagcgugggaccugcgguaccuccacgguuguagagguguagagggaugccgcagcgacggaaccgggcuucuuuuuuaaagaaucaaugugagggaagggugcagagccgcguuauuuuagggagacauugucgcacucccccucccacguguagguagcaucuggggugcgugcgcccuguucgcagaccccauggagagacgcuggcggcggcagauggggcuccuuucacgguugcagccggcaguaacccgaccccgccggcgcagagacugaagaagcgcaggggacagcggcgagcugcgaacaaaagcccuuggcgcggggccgaagcccaggacgcggggugaguaaaccggcucggguaccgggagcugcgggaaccugggcggccagguucuuugcacuccaggagcccacccacugggaugcugugggggaacucggagggcacccgagggcggguaucugaaccccgacugggguggaugguaucuuuagcacauucagacuuggaggagauccggugcgucugagaguauccaggcaccuucuccauccccagcaaacacccgguggggguggaggugggggcggaggcggcgugcagagcccucaguaagcccugccagagcugcuggagcaagaauccaucaccccucccggagaggccuuuggggacuucucccagcccuuuaaucacccgggggccuugcgaccgagucuccuuuggcaggggaaaucaaccauaaacuucuucccuuaggcaaauggggucccuugggaugaacaggccucuugcuuuuuuguuccugcaaagcugcauccccaguagcccgccuaagcuacaaacaaauacgcuaauccucccgggaauccuccagcgccucccucucuagcuccugccugcaccuggaucuuuucaucuuaacuugcagcagaaaggggaugcaucuagcgggcuaggcgcccagaggagccucgccacaggccuccaccccgcauuccggggcugagggagacccaggcugcucucugaacacgaguguccgccccacccccauccccguucuggcgcucagccugggcuuuccgacaucgguuuuaugauuuacguuccaccaaagccucugagccuaauccgaaagcggauuaaguugggauggggugacuauggaugaggaggggggaagagcucucagacguauuccucgaugucccuccuugugaucugcagagauuccaacaaaggacggggcucagccaugguggacccagugccugaagaagagaaggcaggagcggaacccggcgacucuggaggggacgaggccguggcguccgugcccccugauucccagggcgcacaggagcccgcagcuuccucggccucggccucggccuccgcggcggugccccgcaaggcagaagucccaugugcagccgcagaaggcgggcggcgggagcaguccccgcugcugcaccucgaccucuucaacuucgacugcccagaggcggagggcagccgcuacgugcugaccagcccccgcucgcuagaggccugcgcccgcugugcggucaagccgguggagcugcugccacgggcccuggccgaccuggugcgagaggcuccgggccgcuccaugcggguggccaccggccuguaugaggccuacgaggcggagcggcgcgccaagcugcagcaaugccgggccgagcgcgagcgcaucaugcgcgaggagaagcggcgucuuuucacgccuuugagccccgcggccgccgccgccgccgccgccgccgcggccucggccccgagcgcgggcagcagcagcagcugcagcagcgccagccucccggccucgcccgcgccgcgugcggcccgcaaggcuuccccuagucccuccuccgcccggacccaaccuccgccagcggguucucgaacaggcaggaagagccauucgcuggacucacugucccgccggcgugagggcgcccucagcuccgagucgggcgcaucgucgucauccuacaguggggaaagcuugagggagcugcgcuggccgccucgggccucggccagg

SEQ ID NO: 19999 - RNA, 3410 nt, Homo sapiens
gcaggccagcugggcaaaguccauagauuagcuaucacuuuuugcaccuccuucccugaaugcaccuggcaaccggcuugucugcuuugcauugcacuucuaggaagagagccauugccaaaaagacuguugcaccugaaccccaucaucaauugucuacuuaagagugauaggcuuccccgugcagccccuacccuuuccacacggcccuauucucuggugggcgaauccaucuguggguugggagugaguguggagcugcuuuuccuuaagcuuuugaggaagccagaagugggguaucacauacuuguaccuccuaccucuuuggggaagagaaaggaaugaaauuggguggagccggguggaacugggccugggaagaguagauagggugggacgaggaggguggggacagguggggacugugcaagaggaaguguggcauaucuggacguuguguuggaagguaucuggacacugcugcaugaauucaggcaagucgacucuaccuuuguggaccucaauuuccuuaucuguaaaauggccagguuugucuuaaaguccuaaaaauccauaaguuucuggauccauuggauaaugagaauuuuggaugauggaauuauagugcuuagaaagggagcuugagagucaggcugcuuagacuuuguagcuuuuaaaagcuguguggucuugcgaaagcuacuuaauguaaacccggaaccuccaggugugaacucggacuagggauccuguagauagcguaggugugauggaauuguaguucacauggaaggaaggugagaaccacauauaaacaaaauuaccacugaaaagccugaacuccaaaugcuugagggugaaaagcuggcagauacuuguuaacacuucagggaacaucaugcucuccucaggaaaucggcuaauugcguguaaggguauaaaaauauccacacagcuucaguauauuguucccucuuguuuuuccugagauuuugguugaauuaccuaguuaaaugcacauaggaagcagucaguaaaugguagcuauuuuccuaauuuuguuuacaaaguaucuagcagagcacucauuuguaugcaguuguaaaauagcauucaacaagugacauaaugcaagaaaaacaaaaacccaacgucuugcuuguugacaucauugucugccaaaaugaaaaagcuugucuguguguacacaguuuguucuucaggauuccuuuuuuaaaaauuguauaauguuaagugcugucuuuacuaaggacugauauggauuaucuccugaauccaaagaaaaguaauaguuuucuuuuuaaaguaaauauaaaaggcauaaaaguugacagauuaauaaaagccaacuucuagaguuaaaugauaugguacaaauagaaauauggugagagguuauaccagauuuguuauaauauacacauuuuaaagaaauccacagccuagaaauuuuguccaaaggugauucugauuaccagguuuuuuuuuuuuuuuuuuuuuuuuuaagacagucucacucugacacccgggcuggagugcaguggcauaaucucaguccccugaggcucagguuauccaccucagccuccugaguagcugggacuacaggcacaugcuacuaugcaggcuaauuuuuuuuuuuccguagagaugggguuauguuauguuguccaggcuggucucuaacuccuagggcucaagcuaucugcccacuucagccucccaaaguucugggauuacaggcaugagccacugcacuugggcugauuaccaauuuuuaaacgacuuuccuucuuugguuaucaaguaaaauucugguggcuguucccucaguacuuuuuuuuuugagacggagucucgcucuguuuccaggcuagaguacaguggugcgaucuuggcucacugcaaccuccgucucuuggguucaagugauucuccugccucagccucccgaguagcugggacuacaggcgcgggccaccaugcccagcuaauuauuuuuuuuuuguauuuuuaguagacacaggguuucaccauguuguccaggauggucuugaucucuugaccuugugauccgccugccucguccucccaaagugcugggauuacaggccugagccaccaccaugcccggccucaguacuuuuaauuuuuuuuauuuauguuuuauuuuuuauuuuugagauggagucucacucugucacccaggcuggagugcggugggcgaucucggcucacugcaaccucugcugcccagguucaaccaauucuucugccucggccucccgaguagcugggauaacaggcaccugccacugcaccuggcuaauuuuugcauuuuuaguagagaugggguuucaccaucuuggccaggcuggucaugaacuccugaucucgugauccaccugccucagccucccaaagugcugggauuacaggugugagccacugcgccccagcccuacuuuuaauuuuuuaaaacauuuuuacuaaauuacaauuugcauucauccacuccuuucaaauguagcuuuuuuguuuuguuuugcuuuuuggggacagucuccucuguugcucaggcugaaguccgguggcgugaucauagcucacuguaaccucgaacuaugcucaaguaaucuuccugccucagccucccaaagugcugggauuauaggcgugugccaccacgccuggccuuaagcguacaguuugaucugaaaaauguauauacccaaacaccauuuuuaaaccuaagggucaucuaaagcaauuuauugaacucugagaacaaguuuaauuugagaacaugaucugagaaaccagaaaggauaauggucccuccccuaauguaaaaagugucuaugaaggaauaccacucugcuuugcaacugaacaauaaaaacauaccaauaauugagaugauuaguuuuguguuaaaaggugguuaaugguuugaacaggagaugaaucacagacccuaaagagcaucuggggccaggcaugguggcucacgccuguaaucccagcacuuugggaggccaagguggguggaucaccugaggucaggaguuugagaccaugagaccacccugucggacauggugaaaccccaucucuacaacauaagcugggcgugguggcaugugccuacaguccuaguuacucuggagguugaggcaggagaaucgcuugaacccugggggcggagguuguagugagcaaagaaugagccacuguaccccagccugggugauagagugagauucugucucaaaaaaaaagaaaaaaaguguuugguuucaacuaacuuguauugugaccuugggcaaauuagguuaacuucaguugccucaguuuccucaccuguaaauuggggauaaugguaguac

SEQ ID NO: 20000 - RNA, 3410 nt, Homo sapiens
guacuaccauuauccccaauuuacaggugaggaaacugaggcaacugaaguuaaccuaauuugcccaaggucacaauacaaguuaguugaaaccaaacacuuuuuuucuuuuuuuuugagacagaaucucacucuaucacccaggcugggguacaguggcucauucuuugcucacuacaaccuccgcccccaggguucaagcgauucuccugccucaaccuccagaguaacuaggacuguaggcacaugccaccacgcccagcuuauguuguagagaugggguuucaccauguccgacaggguggucucauggucucaaacuccugaccucaggugauccacccaccuuggccucccaaagugcugggauuacaggcgugagccaccaugccuggccccagaugcucuuuagggucugugauucaucuccuguucaaaccauuaaccaccuuuuaacacaaaacuaaucaucucaauuauugguauguuuuuauuguucaguugcaaagcagagugguauuccuucauagacacuuuuuacauuaggggagggaccauuauccuuucugguuucucagaucauguucucaaauuaaacuuguucucagaguucaauaaauugcuuuagaugacccuuagguuuaaaaaugguguuuggguauauacauuuuucagaucaaacuguacgcuuaaggccaggcgugguggcacacgccuauaaucccagcacuuugggaggcugaggcaggaagauuacuugagcauaguucgagguuacagugagcuaugaucacgccaccggacuucagccugagcaacagaggagacuguccccaaaaagcaaaacaaaacaaaaaagcuacauuugaaaggaguggaugaaugcaaauuguaauuuaguaaaaauguuuuaaaaaauuaaaaguagggcuggggcgcaguggcucacaccuguaaucccagcacuuugggaggcugaggcagguggaucacgagaucaggaguucaugaccagccuggccaagauggugaaaccccaucucuacuaaaaaugcaaaaauuagccaggugcaguggcaggugccuguuaucccagcuacucgggaggccgaggcagaagaauugguugaaccugggcagcagagguugcagugagccgagaucgcccaccgcacuccagccugggugacagagugagacuccaucucaaaaauaaaaaauaaaacauaaauaaaaaaaauuaaaaguacugaggccgggcauggugguggcucaggccuguaaucccagcacuuugggaggacgaggcaggcggaucacaaggucaagagaucaagaccauccuggacaacauggugaaacccugugucuacuaaaaauacaaaaaaaaaauaauuagcugggcaugguggcccgcgccuguagucccagcuacucgggaggcugaggcaggagaaucacuugaacccaagagacggagguugcagugagccaagaucgcaccacuguacucuagccuggaaacagagcgagacuccgucucaaaaaaaaaaguacugagggaacagccaccagaauuuuacuugauaaccaaagaaggaaagucguuuaaaaauugguaaucagcccaagugcaguggcucaugccuguaaucccagaacuuugggaggcugaagugggcagauagcuugagcccuaggaguuagagaccagccuggacaacauaacauaaccccaucucuacggaaaaaaaaaaauuagccugcauaguagcaugugccuguagucccagcuacucaggaggcugagguggauaaccugagccucaggggacugagauuaugccacugcacuccagcccgggugucagagugagacugucuuaaaaaaaaaaaaaaaaaaaaaaaaaccugguaaucagaaucaccuuuggacaaaauuucuaggcuguggauuucuuuaaaauguguauauuauaacaaaucugguauaaccucucaccauauuucuauuuguaccauaucauuuaacucuagaaguuggcuuuuauuaaucugucaacuuuuaugccuuuuauauuuacuuuaaaaagaaaacuauuacuuuucuuuggauucaggagauaauccauaucaguccuuaguaaagacagcacuuaacauuauacaauuuuuaaaaaaggaauccugaagaacaaacuguguacacacagacaagcuuuuucauuuuggcagacaaugaugucaacaagcaagacguuggguuuuuguuuuucuugcauuaugucacuuguugaaugcuauuuuacaacugcauacaaaugagugcucugcuagauacuuuguaaacaaaauuaggaaaauagcuaccauuuacugacugcuuccuaugugcauuuaacuagguaauucaaccaaaaucucaggaaaaacaagagggaacaauauacugaagcuguguggauauuuuuauacccuuacacgcaauuagccgauuuccugaggagagcaugauguucccugaaguguuaacaaguaucugccagcuuuucacccucaagcauuuggaguucaggcuuuucagugguaauuuuguuuauaugugguucucaccuuccuuccaugugaacuacaauuccaucacaccuacgcuaucuacaggaucccuaguccgaguucacaccuggagguuccggguuuacauuaaguagcuuucgcaagaccacacagcuuuuaaaagcuacaaagucuaagcagccugacucucaagcucccuuucuaagcacuauaauuccaucauccaaaauucucauuauccaauggauccagaaacuuauggauuuuuaggacuuuaagacaaaccuggccauuuuacagauaaggaaauugagguccacaaagguagagucgacuugccugaauucaugcagcaguguccagauaccuuccaacacaacguccagauaugccacacuuccucuugcacaguccccaccuguccccacccuccucgucccacccuaucuacucuucccaggcccaguuccacccggcuccacccaauuucauuccuuucucuuccccaaagagguaggagguacaaguaugugauaccccacuucuggcuuccucaaaagcuuaaggaaaagcagcuccacacucacucccaacccacagauggauucgcccaccagagaauagggccguguggaaaggguaggggcugcacggggaagccuaucacucuuaaguagacaauugaugaugggguucaggugcaacagucuuuuuggcaauggcucucuuccuagaagugcaaugcaaagcagacaagccgguugccaggugcauucagggaaggaggugcaaaaagugauagcuaaucuauggacuuugcccagcuggccugc

SEQ ID NO: 20001 - RNA, 2775 nt, Homo sapiens
gacuuggcagugcaugggucuacucucugccugcuugaagcugggccuuccaugggcagcagggaguucauccacucauucaacagauaccuagagaauaccaaccagugcaggcacuauucuaggcacaagagacacagaaauggacacaacgaagucccuguuugcauagagcuugcauuagugugggcugggaggccaggccauaaacacauaaauaggaauagaacauaucagauagaauaaguacuaugaagaaacauaaagcagggugaaaggagaaagaggauggggcacggguggccaaaagucacucugagcagaaaucugaaagagacagagcucaauccugcugaaauaugagaagagcgcuccagccaaggaaaacagagcgccaaggaaaacagagcgccaaggcugcgaagugcaagguccuuggaguaggacucgggguacaagugucuuucaugcuguuccccaggacuaaacccaacuggcaaaucgggcccaggcaaagagaggcugccaaagcccuucccagacuucccgauggugcccccacccagccccucacugcccagggcucagugcccuccauuccagaggcaccugccauacccaggcaaggcggagcgugcccgcagccaugaugauccgauuggggauggggauuacuggggcaucuucucacucugcgacggcgcccgcggugggcaggggguggugcccagggggagcaaaaaaguaaauugcaggguugugcgguggcuuagcccugcaacgcgcccaagucacgcuuacaccuagaugcacaagagcacacugauccaauucuccacgcgcccacugugucgcagccucaucaggacacgcuucccgcccaaaguacccagagcucacgcccacgcccgcauccagcccucagcgugcgcaggccgacccacgccccacgacacuugucccgacgcaccagcuucgcugccggcuccccuccuggagacgcaucuaccuucucuccauggggcccccgacaccuccgccaacccgcgcucugagccagcucaaccuccccugggcgucaagagccuggagcgcccacccuccugcccucuccccgcugccucucagaucccggcagcgcugcaagagucuacaagagcucguuaguugcaggcaggaggaacgcgggcgaguggagaggcgccuugcgaaaggauuuaacgucggggcuccgggagaguugguaagaaaggaugaggaugaugaucuaucugccuucaacucuucgaaagcggaucaaaucuuccaaucccgauuuuggaaccucggggcuguuucccgaaguacuaaagacagagggacgaggguaugagagcggcgcccucuccucucgccugcacgccccuccacaaaugagcccuggcuccccucuguacccuccaaacuucccucucccaugcucaccccgugagccgcccucgcggcgggguugggggcgcagccccagaccgcugugggguccccaggcgugggagagccggcgcggcccggguccggggugcugguugcugcuggcccaggggagugcuucuccgggucugcgcagguggcuggacacgccgcgacugcugcgcgcgggacggccuccuggccuccgccucggugggccuccuggggcucccccagcccggcugggcccgcuccacgggcugcaagcccgcgacaggcgcguccugcucccggaacagacuguacaccuuggcugcagccgcugccggguagcugcccccagggcgccgcagucgauucgcgucuccaccagccggcucguaucucccuacggggucccuuugggcaugacccgcgcccacgaagagagccagggugagcggcaggaagccucuccagggguuccgcagggcgcgccccgggcugcgggcuuugguccgcggccucauggcgcggggcggcuggagaguggugcgcgcgggcaccgcgaagagcuuuguggucggcacgcuggacgcccgcgggcuguucucccggccccgcccggcggccagcuucucugagucuagggggcccugaagcggccgacugggggcccggcucucggcggaacgagggcugcgcgccccgagccucgaguccgcgcuccuacuccagcugggcucgcacggcugcugcaccuucgcgccuccucccugugccugcagccgucugaaggggacccggacgguuuuauuuuuggaaaccucccccggcuuuuucgucucuuuuauccacaccaggcccccuccucggagggacagcucagcccccucauuaccggagagggagcgaggaauuccagcaacacccacuuuggcaccgggaagccagcgggcggcgagcgggcggcgagggggauuaacccgugcggagcagggggcggcgcggggcugacccaggcgcuggucgggcagauggcgccugccacgaccgggacacugggccgccuuucuccugcucugggcaaguucgaacugcagaccugccccgaaucguucucccgccccucgccucagggaccgucuuuggaucgggggacccaggcugcagccuugcaggucugaaggaagccgggaggggcgccgaggcccgcguaggggaacagggccgccgcccccuccgcuugcgcccuggccgcugggggcgcccuccgcagggccggccggagcggggguggcgcggggcggggcgcggcgcgcggagcgcagggaggucccgggcgcg

SEQ ID NO: 20002 - RNA, 2775 nt, Homo sapiens
cgcgcccgggaccucccugcgcuccgcgcgccgcgccccgccccgcgccacccccgcuccggccggcccugcggagggcgcccccagcggccagggcgcaagcggagggggcggcggcccuguuccccuacgcgggccucggcgccccucccggcuuccuucagaccugcaaggcugcagccugggucccccgauccaaagacggucccugaggcgaggggcgggagaacgauucggggcaggucugcaguucgaacuugcccagagcaggagaaaggcggcccagugucccggucguggcaggcgccaucugcccgaccagcgccugggucagccccgcgccgcccccugcuccgcacggguuaaucccccucgccgcccgcucgccgcccgcuggcuucccggugccaaaguggguguugcuggaauuccucgcucccucuccgguaaugagggggcugagcugucccuccgaggagggggccugguguggauaaaagagacgaaaaagccgggggagguuuccaaaaauaaaaccguccggguccccuucagacggcugcaggcacagggaggaggcgcgaaggugcagcagccgugcgagcccagcuggaguaggagcgcggacucgaggcucggggcgcgcagcccucguuccgccgagagccgggcccccagucggccgcuucagggcccccuagacucagagaagcuggccgccgggcggggccgggagaacagcccgcgggcguccagcgugccgaccacaaagcucuucgcggugcccgcgcgcaccacucuccagccgccccgcgccaugaggccgcggaccaaagcccgcagcccggggcgcgcccugcggaaccccuggagaggcuuccugccgcucacccuggcucucuucgugggcgcgggucaugcccaaagggaccccguagggagauacgagccggcugguggagacgcgaaucgacugcggcgcccugggggcagcuacccggcagcggcugcagccaagguguacagucuguuccgggagcaggacgcgccugucgcgggcuugcagcccguggagcgggcccagccgggcugggggagccccaggaggcccaccgaggcggaggccaggaggccgucccgcgcgcagcagucgcggcguguccagccaccugcgcagacccggagaagcacuccccugggccagcagcaaccagcaccccggacccgggccgcgccggcucucccacgccuggggaccccacagcggucuggggcugcgcccccaaccccgccgcgagggcggcucacggggugagcaugggagagggaaguuuggaggguacagaggggagccagggcucauuuguggaggggcgugcaggcgagaggagagggcgccgcucucauacccucgucccucugucuuuaguacuucgggaaacagccccgagguuccaaaaucgggauuggaagauuugauccgcuuucgaagaguugaaggcagauagaucaucauccucauccuuucuuaccaacucucccggagccccgacguuaaauccuuucgcaaggcgccucuccacucgcccgcguuccuccugccugcaacuaacgagcucuuguagacucuugcagcgcugccgggaucugagaggcagcggggagagggcaggagggugggcgcuccaggcucuugacgcccaggggagguugagcuggcucagagcgcggguuggcggaggugucgggggccccauggagagaagguagaugcgucuccaggaggggagccggcagcgaagcuggugcgucgggacaagugucguggggcgugggucggccugcgcacgcugagggcuggaugcgggcgugggcgugagcucuggguacuuugggcgggaagcguguccugaugaggcugcgacacagugggcgcguggagaauuggaucagugugcucuugugcaucuagguguaagcgugacuugggcgcguugcagggcuaagccaccgcacaacccugcaauuuacuuuuuugcucccccugggcaccacccccugcccaccgcgggcgccgucgcagagugagaagaugccccaguaauccccauccccaaucggaucaucauggcugcgggcacgcuccgccuugccuggguauggcaggugccucuggaauggagggcacugagcccugggcagugaggggcugggugggggcaccaucgggaagucugggaagggcuuuggcagccucucuuugccugggcccgauuugccaguuggguuuaguccuggggaacagcaugaaagacacuuguaccccgaguccuacuccaaggaccuugcacuucgcagccuuggcgcucuguuuuccuuggcgcucuguuuuccuuggcuggagcgcucuucucauauuucagcaggauugagcucugucucuuucagauuucugcucagagugacuuuuggccacccgugccccauccucuuucuccuuucacccugcuuuauguuucuucauaguacuuauucuaucugauauguucuauuccuauuuauguguuuauggccuggccucccagcccacacuaaugcaagcucuaugcaaacagggacuucguuguguccauuucugugucucuugugccuagaauagugccugcacugguugguauucucuagguaucuguugaaugaguggaugaacucccugcugcccauggaaggcccagcuucaagcaggcagagaguagacccaugcacugccaaguc

SEQ ID NO: 20003 - RNA, 2684 nt, Homo sapiens
cauacaacaacauauauaguaauuucuauuacugugacacucaaaugaaugaaucuacaugaagcccuuagaauaguaccuggcauguagaaacugcuuaauaagugccagcuaucauugucuuuuauggaggcccugcaggccagcauagugccgugcucacucaguacaaauggacaggggacaagacagaugggugacaggaagagcccugcacuggcccuuccccacccaccccagcccugcccagccccgguccucaccguguaugccacggagcagcacguccacgccauucugauagugguugaaggccgccucauaguccucacuaacaucgcgcuccagggccagccggaucugcguggccgcauccaccagauagucacguuuugucaugucaggcacucccagagccacccuguugcgaaucugcuccagguacacgugagcuugggaccgugcucgugagcaaggcucaggcuccaggccggggcugggcaggcacucacaggccaccaggcucauggcugcccugcagcugggaccuggaaugggcaaaugcauuagggaggaccuagcugguagcaacaccccuauccgcaccccaguuuccuccacugaaugucagggagacucauauucaccuccaaagacugaaggggucagagcuaaaguggguaaggucuuuucauggauccagguccuuccuaaguggugguaaugauagaaucauaaccagcucaggauucuguuuucuuuucuuuuuuuuuuuuuuuuuugagucagagucucgcuaugucacccaggcuggauugcaguggugcgaucucggcucacugcaaccuccacuucccagguucaagcaauucuccugccucagcaucccaaguagcugggauuacaggcacuugccuaccacaccuggcuauguuuuguauuuguaguagagacgggguuuuaccauguuggccaggcuggucuugaacuccugaccucaagugauccgucugccucggccucccacagugcugggauuauagacgugagccaccgcgcaggccuggggcucuguuuuccuuuccagucaaauucaguucagcaaacauuucuggagcaucugguacuguguugagcucuggagagagcugaggauaucugugauccacagccaccuucacagggccuccguagagcaagcuugguauccaguacgcauucagcacauggaggccacacacgcugggcucaaaugcuguuccucaugcuguucccuccacccugccuguugucuccucccugcuccuccugugggaaucucauuuacccuuugggguuuagcacuucuccguggaccggauggauugccccugcuguguuuuguucccuugguccugaggucaguguggucagcgagugaggaccccuccuggagccagcagagagcagagcacagagcugggcuguaagaacuguuggcagacggaaugacugaguggcagacucggugccacguuggaugggggguagaagagggcagggugacccagccccagggagggucgcucuguccuccuggcuuuacuuuugagaaggucauguggccuccaaggaccugacagcagcuucuuccugagcaaugugugacccaggcggccaaagggaugacagccguggcugcgggaagggaaggggcucagagagaggcccacaaagcuaccccgccuuugcucucccaggucccacugggaaugggcaggacccggaacuuccaaccccaggucauuuggagagaaagaggagagagcaggaugggcgguggggcggggagggagacccacagccucagccggcggggagcugaaucccggccaggaugcggccaggaggcagagggaggccgcaccaucccugcucggccaagcccaggggaacuugaggcucugaggccuugcucuggggggugcccggguaggacuggcuucaggguccaccccgccgggcaggguccugccgggcagagccgccggccccgccuggacacagaaagcggcgcgugcaacccacggggccccagccgcaaggugcacggucccaggguggagggacggccgagggggccccucgccugggaggguggagaagggaccggacaaaacaccguaccugcccgagcugggagccggguccgcgggccaggccucccccucacguaccggcccuucacgccagagcgcgccgcgggccgcugcuuuccggcauccagcgugcggggccagccggugcagcgcggccauuggcugcggaugagcucauacuugagccuuagaauaaaccaccaaucaccgcccggcucggcuccugccggccuuaaagccgcaaggucugcacggcugggcugugaggggcggggggcgguuuagagaggggagggugggaugggaugugggguggguggggagagcaggucuagaaucauccagggaugcggaaggggcugcuucagaaaucuagacgugccacuucuaggacuuuucucauucauugcuucauucauuuauucaacgauucaaugcuauguauugagagucucccaugcaugaggagcuggauguugagauacagccgugaacuagacagcgcuguuuacauccgcauggggcuuacagucuagugagggcuac

SEQ ID NO: 20004 - RNA, 2684 nt, Homo sapiens
guagcccucacuagacuguaagccccaugcggauguaaacagcgcugucuaguucacggcuguaucucaacauccagcuccucaugcaugggagacucucaauacauagcauugaaucguugaauaaaugaaugaagcaaugaaugagaaaaguccuagaaguggcacgucuagauuucugaagcagccccuuccgcaucccuggaugauucuagaccugcucuccccacccaccccacaucccaucccacccuccccucucuaaaccgccccccgccccucacagcccagccgugcagaccuugcggcuuuaaggccggcaggagccgagccgggcggugauuggugguuuauucuaaggcucaaguaugagcucauccgcagccaauggccgcgcugcaccggcuggccccgcacgcuggaugccggaaagcagcggcccgcggcgcgcucuggcgugaagggccgguacgugagggggaggccuggcccgcggacccggcucccagcucgggcagguacgguguuuuguccggucccuucuccacccucccaggcgaggggcccccucggccgucccuccacccugggaccgugcaccuugcggcuggggccccguggguugcacgcgccgcuuucuguguccaggcggggccggcggcucugcccggcaggacccugcccggcgggguggacccugaagccaguccuacccgggcaccccccagagcaaggccucagagccucaaguuccccugggcuuggccgagcagggauggugcggccucccucugccuccuggccgcauccuggccgggauucagcuccccgccggcugaggcugugggucucccuccccgccccaccgcccauccugcucucuccucuuucucuccaaaugaccugggguuggaaguuccggguccugcccauucccagugggaccugggagagcaaaggcgggguagcuuugugggccucucucugagccccuucccuucccgcagccacggcugucaucccuuuggccgccugggucacacauugcucaggaagaagcugcugucagguccuuggaggccacaugaccuucucaaaaguaaagccaggaggacagagcgacccucccuggggcugggucacccugcccucuucuaccccccauccaacguggcaccgagucugccacucagucauuccgucugccaacaguucuuacagcccagcucugugcucugcucucugcuggcuccaggagggguccucacucgcugaccacacugaccucaggaccaagggaacaaaacacagcaggggcaauccauccgguccacggagaagugcuaaaccccaaaggguaaaugagauucccacaggaggagcagggaggagacaacaggcaggguggagggaacagcaugaggaacagcauuugagcccagcguguguggccuccaugugcugaaugcguacuggauaccaagcuugcucuacggaggcccugugaagguggcuguggaucacagauauccucagcucucuccagagcucaacacaguaccagaugcuccagaaauguuugcugaacugaauuugacuggaaaggaaaacagagccccaggccugcgcgguggcucacgucuauaaucccagcacugugggaggccgaggcagacggaucacuugaggucaggaguucaagaccagccuggccaacaugguaaaaccccgucucuacuacaaauacaaaacauagccaggugugguaggcaagugccuguaaucccagcuacuugggaugcugaggcaggagaauugcuugaaccugggaaguggagguugcagugagccgagaucgcaccacugcaauccagccugggugacauagcgagacucugacucaaaaaaaaaaaaaaaaaagaaaagaaaacagaauccugagcugguuaugauucuaucauuaccaccacuuaggaaggaccuggauccaugaaaagaccuuacccacuuuagcucugaccccuucagucuuuggaggugaauaugagucucccugacauucaguggaggaaacuggggugcggauagggguguugcuaccagcuagguccucccuaaugcauuugcccauuccaggucccagcugcagggcagccaugagccugguggccugugagugccugcccagccccggccuggagccugagccuugcucacgagcacggucccaagcucacguguaccuggagcagauucgcaacaggguggcucugggagugccugacaugacaaaacgugacuaucugguggaugcggccacgcagauccggcuggcccuggagcgcgauguuagugaggacuaugaggcggccuucaaccacuaucagaauggcguggacgugcugcuccguggcauacacggugaggaccggggcugggcagggcugggguggguggggaagggccagugcagggcucuuccugucacccaucugucuuguccccuguccauuuguacugagugagcacggcacuaugcuggccugcagggccuccauaaaagacaaugauagcuggcacuuauuaagcaguuucuacaugccagguacuauucuaagggcuucauguagauucauucauuugagugucacaguaauagaaauuacuauauauguuguuguaug

SEQ ID NO: 20005 - RNA, 2631 nt, Homo sapiens
uuuauaaucaauggaaacgcauggucagaucccggcaguuccaccagggcugggcugcuggggagggccccucacccauuccugauccucuugacugcccacugcauucagcucccagacccccauucuggccccuggcacucacuccccacccuguccuccaagaccccauccauacccuuaaaucaugcuggggaagggcucugagccagcuggaugaacccuggcuauacuggccccagccccacucuccgugugcuggugacuccagcccacaccucucuagucucugggucaccaugaggggaucucuuaggcccugccaaagucaucacccagcaugucuagcuuguaggcucuccccagcuuuuaucaaccugcacccacgcuucaugccacaccugggcuugggagaaaggaagagaggggcuuggggagcaugcguacccccagccuggccagcuuaccuuccaccucugacgagccguucccagcagacaaggcccacugcuauggacagaaaagugcagaggugagcuggggguaccuuggagcucugcacucuugggccaagugugauggcaagaagguaggggccccucuggguuccuucccacuugcugcacaugcucugcccugucucagagcagccugaguaccacuaaaaacucacuggacccuggguagguuaggucccaccccucucuggccucaguuuuccucauuuggaaaaggaugggaggcuagaagcuuuuggagacccuuggccugcugcaucccaaagaucuuccaauccugcgggucugccuucuacccagcccccaggccaacccugcugggcccugcacagcccgccuuggcugggugccagagcccagggggaggugaucagcuggugggagcugaggggcuggagcggguggcgccaugagcuggugcagccgguaacguuacaccucuggccagcccugcagcaggcaggcggguggcugggcugcucggacuccucagggacugcccagcccacuccuacucuugggcuggggcuggggacucccagggcagugggacaacgcagugggaaggcaguucauuggcuuugucaggauuucacugcccaagcuggcucccagccagacucacccggcuccugggaaaagggcccugcucacuuccccaggcccugcacucaggaccuccggccacccacccaggagaaaaggcacagcgagaccccuugucucguccccagcccacccaggagcccacggcucaguccugagcccuggugggggcagggccagccuccccaccaacagcuucuucagcuggcuccuccgccacccccaccaggccaggucagagguccuggggacgccugguuggccauggggccucgacccugaccacaaggccagggacccgccugggauuaguggacagaugcuuuuagcaaagccaccagggcuccaggggccagacaggaaaccucccucccucccucccucccuguggcuucccugcccccaccaagacagcccccaggaccugggggacagccagccugaggucucuucccaaacgaaagaaguccagccuggccuuuaggaaguguguggacauccuuggaguugcugcucccuggagugggucugugauuucagagucccaugcuuccagugcugggauggggaggucuggggagccaggcuagguggggguagcucuuaccugggggggcacagcaggcagcgccagcccggccaggagcugcaggaagcaagggaacagccucaugaccggcaucuucucagacgucccgagccagggggcuccgagggaaaaccaccaugcucaucccccggggagccccuggcacaggaggagaagagcugaguggggggcuggacgccucccucacugcugccccgaggccccggccggugguucgagcaucuucuggaagccuugcggagucaggagcccguagguaaggcuguggcuggggaacccgacggggagcggcccggcggggcggggcgccgaggggcaggcgggucccggggaugguccgucgggcgcccagugccacuccagguccucccguagcugggcggccguccgucgaugcaguuuccuccgcagacagcagcucccuucugagacugcagccgguccgcgccuggguuucagggacugagccggggcggggcuccgggccggccccgcccaccgcagacgagguucccgagccgaguucccggagcgcccggucagcccgcagcgcccggccagcccgcagcgccggagcccgcagugcgugcgaggggcucucggcagguccagacgccucgccgagcccagcccgcagcuccccgggccgcgccgcgcccgcccacagggcccacagcccugcuucggcucucagggcggucaccugggaugggggcauccaggaguccagcgucagccgucaaggcucaugaucuaaccgccucugcaggaagggccguccgggaugccugggaaggcagccaugcccacaccccuagggggccaagggauuccuagccagguuauauagaugaagaaaccgaggcuccgagagcaccccugccugcauaugucgaa

SEQ ID NO: 20006 - RNA, 2631 nt, Homo sapiens
uucgacauaugcaggcaggggugcucucggagccucgguuucuucaucuauauaaccuggcuaggaaucccuuggcccccuaggggugugggcauggcugccuucccaggcaucccggacggcccuuccugcagaggcgguuagaucaugagccuugacggcugacgcuggacuccuggaugcccccaucccaggugaccgcccugagagccgaagcagggcugugggcccugugggcgggcgcggcgcggcccggggagcugcgggcugggcucggcgaggcgucuggaccugccgagagccccucgcacgcacugcgggcuccggcgcugcgggcuggccgggcgcugcgggcugaccgggcgcuccgggaacucggcucgggaaccucgucugcggugggcggggccggcccggagccccgccccggcucagucccugaaacccaggcgcggaccggcugcagucucagaagggagcugcugucugcggaggaaacugcaucgacggacggccgcccagcuacgggaggaccuggaguggcacugggcgcccgacggaccauccccgggacccgccugccccucggcgccccgccccgccgggccgcuccccgucggguuccccagccacagccuuaccuacgggcuccugacuccgcaaggcuuccagaagaugcucgaaccaccggccggggccucggggcagcagugagggaggcguccagccccccacucagcucuucuccuccugugccaggggcuccccgggggaugagcauggugguuuucccucggagcccccuggcucgggacgucugagaagaugccggucaugaggcuguucccuugcuuccugcagcuccuggccgggcuggcgcugccugcugugcccccccagguaagagcuacccccaccuagccuggcuccccagaccuccccaucccagcacuggaagcaugggacucugaaaucacagacccacuccagggagcagcaacuccaaggauguccacacacuuccuaaaggccaggcuggacuucuuucguuugggaagagaccucaggcuggcugucccccagguccugggggcugucuuggugggggcagggaagccacagggagggagggagggagggagguuuccugucuggccccuggagcccugguggcuuugcuaaaagcaucuguccacuaaucccaggcgggucccuggccuuguggucagggucgaggccccauggccaaccaggcguccccaggaccucugaccuggccugguggggguggcggaggagccagcugaagaagcuguugguggggaggcuggcccugcccccaccagggcucaggacugagccgugggcuccugggugggcuggggacgagacaaggggucucgcugugccuuuucuccuggguggguggccggagguccugagugcagggccuggggaagugagcagggcccuuuucccaggagccgggugagucuggcugggagccagcuugggcagugaaauccugacaaagccaaugaacugccuucccacugcguugucccacugcccugggaguccccagccccagcccaagaguaggagugggcugggcagucccugaggaguccgagcagcccagccacccgccugccugcugcagggcuggccagagguguaacguuaccggcugcaccagcucauggcgccacccgcuccagccccucagcucccaccagcugaucaccucccccugggcucuggcacccagccaaggcgggcugugcagggcccagcaggguuggccugggggcuggguagaaggcagacccgcaggauuggaagaucuuugggaugcagcaggccaagggucuccaaaagcuucuagccucccauccuuuuccaaaugaggaaaacugaggccagagaggggugggaccuaaccuacccaggguccagugaguuuuuagugguacucaggcugcucugagacagggcagagcaugugcagcaagugggaaggaacccagaggggccccuaccuucuugccaucacacuuggcccaagagugcagagcuccaagguacccccagcucaccucugcacuuuucuguccauagcagugggccuugucugcugggaacggcucgucagagguggaagguaagcuggccaggcuggggguacgcaugcuccccaagccccucucuuccuuucucccaagcccagguguggcaugaagcgugggugcagguugauaaaagcuggggagagccuacaagcuagacaugcugggugaugacuuuggcagggccuaagagauccccucauggugacccagagacuagagaggugugggcuggagucaccagcacacggagaguggggcuggggccaguauagccaggguucauccagcuggcucagagcccuuccccagcaugauuuaaggguauggauggggucuuggaggacaggguggggagugagugccaggggccagaaugggggucugggagcugaaugcagugggcagucaagaggaucaggaaugggugaggggcccuccccagcagcccagcccugguggaacugccgggaucugaccaugcguuuccauugauuauaaa

SEQ ID NO: 20007 - RNA, 2535 nt, Homo sapiens
ucccccccgaccucgggaacaaggguccgcauugaaccaggugcgaauguucucucucauucugcgccguucccgccuccccucccccagccgcggcccccgccuccccccgcacugcacccucgguguuggcugcagcccgcgagcaguucccgucaaucccuccccccuuacacaggauguccauauuaggacaucugcgucagcagguuuccacggccuuucccuguagcccuggggggagccauccccgaaaccccucaucuuggggggcccacgagaccucugagacaggaacugcgaaaugcucacgagauuaggacacgcgccaaggcgggggcagggagcugcgagcgcuggggacgcagccgggcggccgcagaagcgcccaggcccgcgcgccaccccucuggcgccaccgugguugagcccgugacguuuacacucauucauaaaacgcuuguuauaaaagcaguggcugcggcgccucguacuccaaccgcaucugcagcgagcaucugagaagccaagacugagccggcggccgcggcgcagcgaacgagcagugaccgugcuccuacccagcucugcuccacagcgcccaccugucuccgccccucggccccucgcccggcuuugccuaaccgccacgaugauguucucgggcuucaacgcagacuacgaggcgucauccucccgcugcagcagcgcguccccggccggggauagccucucuuacuaccacucacccgcagacuccuucuccagcaugggcucgccugucaacgcgcagguaaggcuggcuucccgucgccgcggggccgggggcuuggggucgcggaggaggagacaccgggcgggacgcuccaguagaugaguagggggcucccuugugccuggagggaggcugccguggccggagcggugccggcucgggggcucgggacuugcucugagcgcacgcacgcuugccauaguaagaauugguucccccuucgggaggcagguucguucugagcaaccucuggucugcacuccaggacggaucucugacauuagcuggagcagacgugucccaagcacaaacucgcuaacuagagccuggcuucuccggggagguggcagaaagcggcaauccccccucccccggcagccuggagcacggaggagggaugagggaggagggugcagcgggcggguguguaaggcaguuucauugauaaaaagcgaguucauucuggagacuccggagcggcgccugcgucagcgcagacgucagggauauuuauaacaaacccccuuucaagcaagugaugcugaagggauaacgggaacgcagcggcaggauggaagagacaggcacugcgcugcggaaugccugggaggaaaagggggagaccuuucauccaggaugagggacauuuaagaugaaauguccguggcaggaucguuucucuucacugcugcaugcggcacugggaacucgccccaccuguguccggaaccugcucgcucacgucggcuuuccccuucuguuuuguucuaggacuucugcacggaccuggccgucuccagugccaacuucauucccacggucacugccaucucgaccaguccggaccugcaguggcuggugcagcccgcccucgucuccuccguggccccaucgcagaccagagccccucacccuuucggaguccccgcccccuccgcuggggcuuacuccagggcuggcguugugaagaccaugacaggaggccgagcgcagagcauuggcaggaggggcaagguggaacaggugaggaacucuagcguacucuuccugggaaugugggggcugggugggaagcagccccggagaugcaggagcccaguacagaggaugaagccacugauggggcuggcugcacauccguaacugggagcccuggcuccaagcccauuccaucccaacucagacucugagucucacccuaagaaguacucucauaguuucuucccuaaguuucuuaccgcaugcuuucagacugggcucuucuuuguucucuugcugaggaucuuauuuuaaaugcaagucacaccuagucugcaacugcaggucagaaaugguuucacaguggggugccaggaagcagggaagcugcaggagccaguucuacuggggugggugaauggaggugauggcagacacuuuuacugaaugucggucuuuuuuugugauuauucuaguuaucuccagaagaagaagagaaaaggagaauccgaagggaaaggaauaagauggcugcagccaaaugccgcaaccggaggagggagcugacugauacacuccaagcgguagguacucuguggguugcuccuuuuuaaaacuuaaggggaaaguuggagauugagcauaagggcccuugaguaagacugugucuuaugcuuuccuuuaucccucuguauacaggagacagaccaacuagaagaugagaagucugcuuugcagaccgagauugccaaccugcugaaggagaaggaaaaacuagaguu

SEQ ID NO: 20008 - RNA, 2535 nt, Homo sapiens
aacucuaguuuuuccuucuccuucagcagguuggcaaucucggucugcaaagcagacuucucaucuucuaguuggucugucuccuguauacagagggauaaaggaaagcauaagacacagucuuacucaagggcccuuaugcucaaucuccaacuuuccccuuaaguuuuaaaaaggagcaacccacagaguaccuaccgcuuggaguguaucagucagcucccuccuccgguugcggcauuuggcugcagccaucuuauuccuuucccuucggauucuccuuuucucuucuucuucuggagauaacuagaauaaucacaaaaaaagaccgacauucaguaaaagugucugccaucaccuccauucacccaccccaguagaacuggcuccugcagcuucccugcuuccuggcaccccacugugaaaccauuucugaccugcaguugcagacuaggugugacuugcauuuaaaauaagauccucagcaagagaacaaagaagagcccagucugaaagcaugcgguaagaaacuuagggaagaaacuaugagaguacuucuuagggugagacucagagucugaguugggauggaaugggcuuggagccagggcucccaguuacggaugugcagccagccccaucaguggcuucauccucuguacugggcuccugcaucuccggggcugcuucccacccagcccccacauucccaggaagaguacgcuagaguuccucaccuguuccaccuugccccuccugccaaugcucugcgcucggccuccugucauggucuucacaacgccagcccuggaguaagccccagcggagggggcggggacuccgaaagggugaggggcucuggucugcgauggggccacggaggagacgagggcgggcugcaccagccacugcagguccggacuggucgagauggcagugaccgugggaaugaaguuggcacuggagacggccagguccgugcagaaguccuagaacaaaacagaaggggaaagccgacgugagcgagcagguuccggacacagguggggcgaguucccagugccgcaugcagcagugaagagaaacgauccugccacggacauuucaucuuaaaugucccucauccuggaugaaaggucucccccuuuuccucccaggcauuccgcagcgcagugccugucucuuccauccugccgcugcguucccguuaucccuucagcaucacuugcuugaaaggggguuuguuauaaauaucccugacgucugcgcugacgcaggcgccgcuccggagucuccagaaugaacucgcuuuuuaucaaugaaacugccuuacacacccgcccgcugcacccuccucccucaucccuccuccgugcuccaggcugccgggggaggggggauugccgcuuucugccaccuccccggagaagccaggcucuaguuagcgaguuugugcuugggacacgucugcuccagcuaaugucagagauccguccuggagugcagaccagagguugcucagaacgaaccugccucccgaagggggaaccaauucuuacuauggcaagcgugcgugcgcucagagcaagucccgagcccccgagccggcaccgcuccggccacggcagccucccuccaggcacaagggagcccccuacucaucuacuggagcgucccgcccggugucuccuccuccgcgaccccaagcccccggccccgcggcgacgggaagccagccuuaccugcgcguugacaggcgagcccaugcuggagaaggagucugcgggugagugguaguaagagaggcuauccccggccggggacgcgcugcugcagcgggaggaugacgccucguagucugcguugaagcccgagaacaucaucguggcgguuaggcaaagccgggcgaggggccgaggggcggagacaggugggcgcuguggagcagagcuggguaggagcacggucacugcucguucgcugcgccgcggccgccggcucagucuuggcuucucagaugcucgcugcagaugcgguuggaguacgaggcgccgcagccacugcuuuuauaacaagcguuuuaugaaugaguguaaacgucacgggcucaaccacgguggcgccagagggguggcgcgcgggccugggcgcuucugcggccgcccggcugcguccccagcgcucgcagcucccugcccccgccuuggcgcguguccuaaucucgugagcauuucgcaguuccugucucagaggucucgugggccccccaagaugagggguuucggggauggcuccccccagggcuacagggaaaggccguggaaaccugcugacgcagauguccuaauauggacauccuguguaaggggggagggauugacgggaacugcucgcgggcugcagccaacaccgagggugcagugcggggggaggcgggggccgcggcugggggaggggaggcgggaacggcgcagaaugagagagaacauucgcaccugguucaaugcggacccuuguucccgaggucggggggga

SEQ ID NO: 20009 - RNA, 2835 nt, Homo sapiens
ccgggacugagguacaugguuaacacaggcugugcgugaaggggcuuuugacuuuucccccggcuccggccucucgcgucucucuccuagggcugcggcugcugcugccuggcgggcacaagccgggcggcggugcgcggggggugcgcuuacauaaccgcucgccgcguccugcuuucucgagcgcuccugcaccgugggguggcggagccgggggacugcauggaacccgggacgcccccgcggggagaggagcgcgagcggccgcgggaggagggcgcccaaggcggcgggggagguuaaggucagugggugugaagcgccggcuccacacccccuccuccccgguccccuccuucccuuccucuccgucccccucugacgucuggagcuggcagcucggccgguuccgcauucccgaccccuccccgccgcccaggggccgcuauauagccggggcugaugcaacccgucccgccgcccgccacagccugcgggagggacgcucggcggccgcgacggggggcgcuggcggcggcggacgcugcagcggcggcggggcuggcgccgcggcggcucccgggccgggacaggccugggcaccgggcggagcuccgcggccgggcggcagcggcgcggagcgggcacggcgccugcagccgggccccggccccgggggcgccgccuccccccgcaccuucugcacggugggugcgagggcgcgcgcugggggcgccgggacgggcggggcggggcagggcgcggcgcgggcaccugggacggccgcccccgcacgggcggagcgcgaggagccccagcccagccccgcggggaggcucccgcagcccagggaccucgagcuuuccccgcgccgggcgcugcagccgggccccucccgcgaggcgcccggcagccugaggcuuccuuuugguucccgccccgggacgggaggcuccguccgcucccuggacagccggggugcucccuccuucucccucccgcgcucuccucccccguccguuugcagggaggugcucuccucgggcggcggggaaggcggggugaguggggagaaaagugcccgcggagaugggcugugcggguggagguggagggugaagggccagggaggugcgggguuggggucgggguuagauuguggagggaugacaaggaccuccuggcagugaggaagcgcgacucccggaggacccggacccggaggagaguauugagaagggcucgggauuuccauccaaugaaggcagcuucucucauggccauugcuucggagcucugggcugggaggggaucuagggguggccgggguccccuuugggcucuccugucucccacgccagguuauauaaggaggcaagcaggcuccuguagguaaccagccucucccuugcccagcccagcuuagaaggcucuccucugcuccucccuucaaaggagguugucgagggguaggggugcaguggggggugggagaguguagggguggauugggccuuccaccuggaucccuggacccugggauggcagagccaggcuuugccugggucaguaggaggagcagggaagaugaggaggcuggggaagauggggagguccuggcucuuuugcagggauggagaggcugguggaaggagaaaucagccgacccccuugggucaucuccaguugcaagauggcguggcccuugcccagggugcugcccucccuguuggaauccagggcauggggcuauggcccgaccacgugugcucagggcaaaugugcucaggucuauaucucagaaagggcuugcagccugcuuaggcguguguacccaggcuuaaaucuugguggucucucccuagggucuuaauuggaggagcaucaggaauugggaagcuuugaaccauguuuggguacauuuguacccaaacguccuuuaagcccuugguagaaacugcauucgcguaucaucucccuuccccccaaccuuccuucccugaggguuuuaaaaaacacuucccauugcuuuuaccuuuccagcaaaucuggcugcagcuuggauggauagcuuaucuuccuuugcagguuucuaggggagaguuuaaccagguaucaggugugagcauggcucugauuuuguauaaaccugaggaucgaggaagagaagcaaaaucuauucucacaccucugggugguuaagguuuugccuuguuuagagcagggaggauggauuucucaaagacucuucuguucccuucuacuuuggcuuugguucagagcugcaggcagcuccagaaucuuccugaagagcugggugcugugugauuugaagggcugcaggaagucauggguguguagaccucuggcuuuucuccuaggugggcugcaggaagucauggguguguagaccucuggcuuuucuccuagguuggcugcagccaccuccaaggagauguguugcaaaguggugacaaugcccccuaggaaggguuuggauaagggucuccccacucauccacugccuaacuuuugcagcuaccagggaaugcuccuccugacucccuggguuuguugucaucucccuaccuguuuguaggaugugugggcauuuuuuuccaaccugcagaaucccuggcaggaauaggcucucugggccuuguuugucguggggcuacugguguugcaaugggcugucucucucgagugucuguuuccagcuccacucuggaaagaaaggggccaacgccgacucuaggccggccugcucuguauucauucagcuccagcucaacuugagcaaucagagccaggguugagggcaagcuacauucu

SEQ ID NO: 20010 - RNA, 2835 nt, Homo sapiens
agaauguagcuugcccucaacccuggcucugauugcucaaguugagcuggagcugaaugaauacagagcaggccggccuagagucggcguuggccccuuucuuuccagaguggagcuggaaacagacacucgagagagacagcccauugcaacaccaguagccccacgacaaacaaggcccagagagccuauuccugccagggauucugcagguuggaaaaaaaugcccacacauccuacaaacagguagggagaugacaacaaacccagggagucaggaggagcauucccugguagcugcaaaaguuaggcaguggaugaguggggagacccuuauccaaacccuuccuagggggcauugucaccacuuugcaacacaucuccuuggagguggcugcagccaaccuaggagaaaagccagaggucuacacacccaugacuuccugcagcccaccuaggagaaaagccagaggucuacacacccaugacuuccugcagcccuucaaaucacacagcacccagcucuucaggaagauucuggagcugccugcagcucugaaccaaagccaaaguagaagggaacagaagagucuuugagaaauccauccucccugcucuaaacaaggcaaaaccuuaaccacccagaggugugagaauagauuuugcuucucuuccucgauccucagguuuauacaaaaucagagccaugcucacaccugauaccugguuaaacucuccccuagaaaccugcaaaggaagauaagcuauccauccaagcugcagccagauuugcuggaaagguaaaagcaaugggaaguguuuuuuaaaacccucagggaaggaagguuggggggaagggagaugauacgcgaaugcaguuucuaccaagggcuuaaaggacguuuggguacaaauguacccaaacaugguucaaagcuucccaauuccugaugcuccuccaauuaagacccuagggagagaccaccaagauuuaagccuggguacacacgccuaagcaggcugcaagcccuuucugagauauagaccugagcacauuugcccugagcacacguggucgggccauagccccaugcccuggauuccaacagggagggcagcacccugggcaagggccacgccaucuugcaacuggagaugacccaagggggucggcugauuucuccuuccaccagccucuccaucccugcaaaagagccaggaccuccccaucuuccccagccuccucaucuucccugcuccuccuacugacccaggcaaagccuggcucugccaucccaggguccagggauccagguggaaggcccaauccaccccuacacucucccaccccccacugcaccccuaccccucgacaaccuccuuugaagggaggagcagaggagagccuucuaagcugggcugggcaagggagaggcugguuaccuacaggagccugcuugccuccuuauauaaccuggcgugggagacaggagagcccaaaggggaccccggccaccccuagauccccucccagcccagagcuccgaagcaauggccaugagagaagcugccuucauuggauggaaaucccgagcccuucucaauacucuccuccggguccggguccuccgggagucgcgcuuccucacugccaggagguccuugucaucccuccacaaucuaaccccgaccccaaccccgcaccucccuggcccuucacccuccaccuccacccgcacagcccaucuccgcgggcacuuuucuccccacucaccccgccuuccccgccgcccgaggagagcaccucccugcaaacggacgggggaggagagcgcgggagggagaaggagggagcaccccggcuguccagggagcggacggagccucccgucccggggcgggaaccaaaaggaagccucaggcugccgggcgccucgcgggaggggcccggcugcagcgcccggcgcggggaaagcucgaggucccugggcugcgggagccuccccgcggggcugggcuggggcuccucgcgcuccgcccgugcgggggcggccgucccaggugcccgcgccgcgcccugccccgccccgcccgucccggcgcccccagcgcgcgcccucgcacccaccgugcagaaggugcggggggaggcggcgcccccggggccggggcccggcugcaggcgccgugcccgcuccgcgccgcugccgcccggccgcggagcuccgcccggugcccaggccugucccggcccgggagccgccgcggcgccagccccgccgccgcugcagcguccgccgccgccagcgccccccgucgcggccgccgagcgucccucccgcaggcuguggcgggcggcgggacggguugcaucagccccggcuauauagcggccccugggcggcggggaggggucgggaaugcggaaccggccgagcugccagcuccagacgucagagggggacggagaggaagggaaggaggggaccggggaggaggggguguggagccggcgcuucacacccacugaccuuaaccucccccgccgccuugggcgcccuccucccgcggccgcucgcgcuccucuccccgcgggggcgucccggguuccaugcagucccccggcuccgccaccccacggugcaggagcgcucgagaaagcaggacgcggcgagcgguuauguaagcgcaccccccgcgcaccgccgcccggcuugugcccgccaggcagcagcagccgcagcccuaggagagagacgcgagaggccggagccgggggaaaagucaaaagccccuucacgcacagccuguguuaaccauguaccucagucccgg

SEQ ID NO: 20011 - RNA, 2502 nt, Homo sapiens
ugcgcgcugggagggacucugcgcucacucacugugaccaccucggcugggauauggggaaacugaggccuacagagggaagggaacugcugaacgucccaaagcaacacaggcacugaauccggucuagaaucccagucuuccaggccagugcucucgguccuaccggcucagggccccugcgaagaaucuuuuucaagaaauucccgaccgcaggaauuccuucugcgcuaggaaucuccauggaguuugcgcucccucuggcacguugaaaacguccuccgcagcuucgcaccggcuucgcggcgcccugacagcugggugaggagggagcgaaugcccaccggcguccuugggguaacuugggacagaggcaccgccgcggggggcggaggacugggcgcgaaggcgcuggcccuuuaagggggggacggagcgcaugcgcggcgcgggccguagucgagccuggugggcggcuggcuggcaggggacguggucggcggcagcggggcccaggggcggcggggcugcagcagcggcggccccagcuucgccgagcagcgaucggcuggugggcuucucguuggcgggcuccgcguuggcgggcugcuccccaggcaccagcgcagcgcgcgcucgcccggcuucgucacucgccuccagcuacauccgccggccgaggcugcgcgagccuccgggcuugcgguccccgccccgcgguccuuccuccacccucagccagggcagcugcagcccgagcgaacagccacggagcauccuccgcccgcccgggccgcgccaccgcccaugcugcagccagucccaggcagcgaccccgcggccgcagcccgccgcucagugaccucagccuggccccugcgcgccgcccgagccggucccgcugagccgcgggccccgugcccugcgauggcucggcuggugcagcgcggcgccaggugccagccguccucccgcugagacgcgcccgaguggggacccgcugggccucggggcucgcagccuucgccuccccgccgcgcccgcucccuuucuggggacuccgccgcuguuucuggggacgaggggacaggggacccagacaaagcccacuuugugcagggaguuggccgcaggcggggaaugugcgcgucggcgcgcgcccccuccccgcucccggccagcugcgagucuuggcucccggacuugucucgucgcgucggagaaaucgccccccagcgccgcucucccgcccgggggucuugguuccgagcucgcgcggccgggagucgccucggucuuccuuggggcgcgcgcagaugugagcgugcgagaguuguguaggggauuuuguucccuccgaaacugagacccagggcgcccagugggcacccgugccuugacucuguccuuucugcagccgcugguccgagcugucuggccucaguuucccuccgacuuuucuccgcucugccagcccucacugcugcccgucauuguucucgcaguuagaugggggugcuuugugacggcugccaaguugggguguguucucuuuauuccguuuuucaaacagaacaaggccuccaaggcugaccccagacaacccacccccucggacccuaauucaccuuauugcacugauuuuuuuuaucaagucguauuuuauuguacaggagccacgcccugauuucuuaaaggcgccuugcacucuggccauguguuaucucugcagccggugugugggaggccucuugugagccaguuguuuucccgccuccaccaccccccucgaagauuuagggaugccaggggggaagaagguggcuggggguggcagcagcggugccacuccaacguccgcugcggccaccgcccccucuggggucaggcguuuggagaccagcgaaggaaccucagcccagagagaugaggagccagaagaggaaggggaagaggaccugcgagacggaggcguccccuucuuugucaaccggggugggcuaccuguggaugaggccaccugggaaaggauguggaaacacguggccaagauccaccccgauggagagaagguggcgcaacggauccguggggccacagaccugcccaaggugagacacacgggucaggggggugauagcacagucuagguuuuagugaccuuggggccaagagugaagccacacucuccucccacggggcaggggaccacuggcucgguaagaucuuuaaaaugcagugauaucauaccugucuaggagaacuuucucucacugccauucuaggagggaggcucacauacauugucuccaggaggcccuccccgcugucuuuuaaaauguccacguuuuacaggaggggacagcagcagauggaacuaacaaacacaguaggauggcuugacgucucauuugcuugaugacacuugccaagccagagaacugugagcagacaaauguaaugaaugacuaaggagaugcagggcuucauauguugagaaaa

SEQ ID NO: 20012 - RNA, 2502 nt, Homo sapiens
uuuucucaacauaugaagcccugcaucuccuuagucauucauuacauuugucugcucacaguucucuggcuuggcaagugucaucaagcaaaugagacgucaagccauccuacuguguuuguuaguuccaucugcugcuguccccuccuguaaaacguggacauuuuaaaagacagcggggagggccuccuggagacaauguaugugagccucccuccuagaauggcagugagagaaaguucuccuagacagguaugauaucacugcauuuuaaagaucuuaccgagccagugguccccugccccgugggaggagaguguggcuucacucuuggccccaaggucacuaaaaccuagacugugcuaucaccccccugacccgugugucucaccuugggcaggucuguggccccacggauccguugcgccaccuucucuccaucgggguggaucuuggccacguguuuccacauccuuucccagguggccucauccacagguagcccaccccgguugacaaagaaggggacgccuccgucucgcagguccucuuccccuuccucuucuggcuccucaucucucugggcugagguuccuucgcuggucuccaaacgccugaccccagagggggcgguggccgcagcggacguuggaguggcaccgcugcugccacccccagccaccuucuuccccccuggcaucccuaaaucuucgaggggggugguggaggcgggaaaacaacuggcucacaagaggccucccacacaccggcugcagagauaacacauggccagagugcaaggcgccuuuaagaaaucagggcguggcuccuguacaauaaaauacgacuugauaaaaaaaaucagugcaauaaggugaauuaggguccgaggggguggguugucuggggucagccuuggaggccuuguucuguuugaaaaacggaauaaagagaacacaccccaacuuggcagccgucacaaagcacccccaucuaacugcgagaacaaugacgggcagcagugagggcuggcagagcggagaaaagucggagggaaacugaggccagacagcucggaccagcggcugcagaaaggacagagucaaggcacgggugcccacugggcgcccugggucucaguuucggagggaacaaaauccccuacacaacucucgcacgcucacaucugcgcgcgccccaaggaagaccgaggcgacucccggccgcgcgagcucggaaccaagacccccgggcgggagagcggcgcuggggggcgauuucuccgacgcgacgagacaaguccgggagccaagacucgcagcuggccgggagcggggagggggcgcgcgccgacgcgcacauuccccgccugcggccaacucccugcacaaagugggcuuugucuggguccccuguccccucguccccagaaacagcggcggaguccccagaaagggagcgggcgcggcggggaggcgaaggcugcgagccccgaggcccagcggguccccacucgggcgcgucucagcgggaggacggcuggcaccuggcgccgcgcugcaccagccgagccaucgcagggcacggggcccgcggcucagcgggaccggcucgggcggcgcgcaggggccaggcugaggucacugagcggcgggcugcggccgcggggucgcugccugggacuggcugcagcaugggcgguggcgcggcccgggcgggcggaggaugcuccguggcuguucgcucgggcugcagcugcccuggcugaggguggaggaaggaccgcggggcggggaccgcaagcccggaggcucgcgcagccucggccggcggauguagcuggaggcgagugacgaagccgggcgagcgcgcgcugcgcuggugccuggggagcagcccgccaacgcggagcccgccaacgagaagcccaccagccgaucgcugcucggcgaagcuggggccgccgcugcugcagccccgccgccccugggccccgcugccgccgaccacguccccugccagccagccgcccaccaggcucgacuacggcccgcgccgcgcaugcgcuccgucccccccuuaaagggccagcgccuucgcgcccaguccuccgccccccgcggcggugccucugucccaaguuaccccaaggacgccggugggcauucgcucccuccucacccagcugucagggcgccgcgaagccggugcgaagcugcggaggacguuuucaacgugccagagggagcgcaaacuccauggagauuccuagcgcagaaggaauuccugcggucgggaauuucuugaaaaagauucuucgcaggggcccugagccgguaggaccgagagcacuggccuggaagacugggauucuagaccggauucagugccuguguugcuuugggacguucagcaguucccuucccucuguaggccucaguuuccccauaucccagccgagguggucacagugagugagcgcagagucccucccagcgcgca

SEQ ID NO: 20013 - RNA, 2809 nt, Homo sapiens
aucagugcucccuaugcgagaguggaaguggggagccccaguggguccugggcugcaggagaauccgcugccccaggagcagagacugggaagaagcccacaguaagggcaaaggguggacugcggagacugcuccguccucccuccccaccccuacgccagguuucacuucucccugagaguccuggggcaacacccccuguucuuucccucgcacccccauuuuuaaaauguuacgugggagcuuucggggacgggcugcgggcauccguuucccuagcccagugggagguggaaccgaagcccaggaguccaggccucuggcccugcgccucccuggcuaaagagcgcccuguggggaggaagcagggccccaggcggaaccgggaaaacacaccggggcuuuaaacagaccgggccacucccaucgaauuuggaaagcgguuaaaagaggucgugccgcauucugcgccgcgucccucuuccuucagucccgccgaguguccccgaccagaggugaccuccuagaaggggagguccccaaacucgaggcccugcguguagggaaggggagcgcccgccccuucccugccgccgcgagcgccccgggaggggaccggggcugccgucccuccgccucuucccccgcggggcguagcgauggcccgggccagggccggggcgcugcuggcgcuuugggugcucggggccgccgcgcauccgcagugccuggacuucaggccgcccuuccggccgacgcagccgcugcgccucugcgcgcaguacucggacuucggcugcugcgaugaggggcgcgacgccgagcugacccgccgcuucugggcccuggcgagccgcguggacgccgccgagugggccgcgugcgccggcuacgcgagggaccugcugugccaggugagcgggcgcgcggccaccgggcggggcggggcgcgggaggccgaguccuggagcagagaucggaaccccgcgggggcgagggccaagagugggcggcggacucgggaacucuaagccccaacagggagucauuuggcacggggcggggagaccgcgcaucccaggacgacucuuggcuuugccauucauuaguuuugugacuugggccuucucggggccucaguuuccccuccugaagcaggaaggacggacggacggacagaugaugucaucauuuccucagagguugggggcucuucugccccaguccccuggagucgaccccucagcgucccaccccgagcagcugcacccuugucgggguaccaagguggagaggcaucugucccggucagugcuccuuuguguuguccccggggcagugaaagcagggggcccuggcgugggcguggucaacguguggcccggguuuguugaggggguuggggccacugucccccacgagcgucucacccccauccugaugcccuugccacuuccgccaccaccucugugggugcugugcccucuccuggggauggcgcccuggccugcagaagcucucucaagacugagcgacagcucuuuguugaagccccugggccccccaucuucccucugaggguggagccccugcuucugugcacaccugguggugccaccgcuauuuguuuuccucuugugggagucugaggccccagggccugaccacacccaagugggcaaauguugccuggcugaaugcagaaauggagcaggacgggcagccccaaggcauuccugccucagcaucugggcagugagaggccugggguggagaggccccaggggccagggccgugucccagccuucggccagcaggggcaggugguguggggaagggcaagaaggcugacuuggaguuggaguuugauccuggcucugucacuuccccagcuucgugaccugggcaggucacugcugcaccucacaauaucuuuaaaaugaagcugaguaugguggcuuaugccuguaaucccagcacuuugggaggccaaggugggcagaucacuugaggucaggaguucgagaccagccuggccaacauggcgaaacuccaucucuacaaaaauacaaaaauuaacugggcauguuggggagcuccuguaaucccagcuacucgggaggcugaggcaggagaagcacuugacucugggaggcagagguugcagugagccaagauugagccacugcaccccagccugggcaacagagcaagacuccgucucaaaaauauaauauaauauaauaugauaugauaugauaugauaugauaugauaugauaugauauaauauaauauaauauaauauaauaugauauaauaugauacauaaaauaaauaaaauaaaaccuuaaccaccccccuggguggccaugcagauuaaaugccacauacuaggggcucgguaaguguuugcaguuggauuucucgagggcuuccuuggcccucacuggcugcccagcccugggaaggguccaggugaggcuuggagcccgaaucaaggaagacucagaggcaggcagggacuugcccaguggucgcacagcccagcggugguugagguggggacauggaccacacucgcugaagcgagcucauaucuuaggugggaagcaguagacucugggaggaugaggagggggcccuggggagcuccagaaugcaacagagggugggcuggccaccuuuaggugggcucugcuggacucccaugcuguacaccucaagggcacgggaauggucuggccaagcgucugccucccucaccagccugggggcuccucaggaccagguccuuuggucucccua

SEQ ID NO: 20014 - RNA, 2809 nt, Homo sapiens
uagggagaccaaaggaccugguccugaggagcccccaggcuggugagggaggcagacgcuuggccagaccauucccgugcccuugagguguacagcaugggaguccagcagagcccaccuaaagguggccagcccacccucuguugcauucuggagcuccccagggcccccuccucauccucccagagucuacugcuucccaccuaagauaugagcucgcuucagcgagugugguccauguccccaccucaaccaccgcugggcugugcgaccacugggcaagucccugccugccucugagucuuccuugauucgggcuccaagccucaccuggacccuucccagggcugggcagccagugagggccaaggaagcccucgagaaauccaacugcaaacacuuaccgagccccuaguauguggcauuuaaucugcauggccacccaggggggugguuaagguuuuauuuuauuuauuuuauguaucauauuauaucauauuauauuauauuauauuauauuauaucauaucauaucauaucauaucauaucauaucauaucauauuauauuauauuauauuuuugagacggagucuugcucuguugcccaggcuggggugcaguggcucaaucuuggcucacugcaaccucugccucccagagucaagugcuucuccugccucagccucccgaguagcugggauuacaggagcuccccaacaugcccaguuaauuuuuguauuuuuguagagauggaguuucgccauguuggccaggcuggucucgaacuccugaccucaagugaucugcccaccuuggccucccaaagugcugggauuacaggcauaagccaccauacucagcuucauuuuaaagauauugugaggugcagcagugaccugcccaggucacgaagcuggggaagugacagagccaggaucaaacuccaacuccaagucagccuucuugcccuuccccacaccaccugccccugcuggccgaaggcugggacacggcccuggccccuggggccucuccaccccaggccucucacugcccagaugcugaggcaggaaugccuuggggcugcccguccugcuccauuucugcauucagccaggcaacauuugcccacuuggguguggucaggcccuggggccucagacucccacaagaggaaaacaaauagcgguggcaccaccaggugugcacagaagcaggggcuccacccucagagggaagauggggggcccaggggcuucaacaaagagcugucgcucagucuugagagagcuucugcaggccagggcgccauccccaggagagggcacagcacccacagaggugguggcggaaguggcaagggcaucaggaugggggugagacgcucgugggggacaguggccccaacccccucaacaaacccgggccacacguugaccacgcccacgccagggcccccugcuuucacugccccggggacaacacaaaggagcacugaccgggacagaugccucuccaccuugguaccccgacaagggugcagcugcucggggugggacgcugaggggucgacuccaggggacuggggcagaagagcccccaaccucugaggaaaugaugacaucaucuguccguccguccguccuuccugcuucaggaggggaaacugaggccccgagaaggcccaagucacaaaacuaaugaauggcaaagccaagagucguccugggaugcgcggucuccccgccccgugccaaaugacucccuguuggggcuuagaguucccgaguccgccgcccacucuuggcccucgcccccgcgggguuccgaucucugcuccaggacucggccucccgcgccccgccccgcccgguggccgcgcgcccgcucaccuggcacagcaggucccucgcguagccggcgcacgcggcccacucggcggcguccacgcggcucgccagggcccagaagcggcgggucagcucggcgucgcgccccucaucgcagcagccgaaguccgaguacugcgcgcagaggcgcagcggcugcgucggccggaagggcggccugaaguccaggcacugcggaugcgcggcggccccgagcacccaaagcgccagcagcgccccggcccuggcccgggccaucgcuacgccccgcgggggaagaggcggagggacggcagccccgguccccucccggggcgcucgcggcggcagggaaggggcgggcgcuccccuucccuacacgcagggccucgaguuuggggaccuccccuucuaggaggucaccucuggucggggacacucggcgggacugaaggaagagggacgcggcgcagaaugcggcacgaccucuuuuaaccgcuuuccaaauucgaugggaguggcccggucuguuuaaagccccgguguguuuucccgguuccgccuggggcccugcuuccuccccacagggcgcucuuuagccagggaggcgcagggccagaggccuggacuccugggcuucgguuccaccucccacugggcuagggaaacggaugcccgcagcccguccccgaaagcucccacguaacauuuuaaaaaugggggugcgagggaaagaacaggggguguugccccaggacucucagggagaagugaaaccuggcguagggguggggagggaggacggagcagucuccgcaguccacccuuugcccuuacugugggcuucuucccagucucugcuccuggggcagcggauucuccugcagcccaggacccacuggggcuccccacuuccacucucgcauagggagcacugau

SEQ ID NO: 20015 - RNA, 2882 nt, Homo sapiens
cgugccaccgcccuccacgcggcugcagccacgccgguccagcacgcgcgcccgcuccucggccgggaagucgcgcaaggugcgcaggaugcggcgcagaaugcccacgcgguuguagcgcacugccagcgccacgugcggcccgggagccgcgcagcagcggaagccggcacugggcggugcgagcgcgcgccgcgggaacguggccagcagguaaugcgcguacgcuugguggucgugcacgagcgcguagagcagcgccucagagggcgaguaggcggcggcgcgcccgcgcucgucccaguggaaggccucgcuggcgcgcauauccuccagcagccacacggguagcaggucgcgcaccgccugguagaaggcgaacgacgacuugcggcacugcuucugcgcucgcgagcgcgccgcgcccgaggccucgggcccgccguccgcgccacccccaggccgccgcgcgucccacggcaugcuggcggcggggcguuccugggccucaaggcauggaucccgcgaaggcacaccugcggggaaaggaagaggccacggugaggcgcggggaaacuggggaggcccggggacuccccucugccccucacacagccccuccgguccuggcccaccaggccuguaccuaccuccagccucggccaggcccuuccagucacccuacagcuccaucucuccgacgcccagaaccaccgccuccauccuugaucuagcuguaccuguucucccuccuugaaacugacuugcucucuggcaccucugcuggaaaugcccuugcugcccaugcccucaaaucuccccuccccucuccaacccagggacccacuggaagagcuucuguucccaccuaagccagguucauacgaccccaaauaaagaaaaggccagggaggggaugagaaagcuugggcccacaucucaagcugaggcaaauccacucuccagcccaagcgcaacccugacccugaucuccgaccccagaccacuuggaggccccuggagccucuuccugggcuguucagaggcaugauccagacucagaccuaccugguuccugcaccgcgaucaccuaguuccggggauguggguauaucacagucccuggccgagccucagcuuuaucuguaagaaaggggagggguggacgacggcugugcgggcggggugagccuggggcguggcaccagcccucuauccaaacauguuugcuuacacguuagcuccugggaggagauaggagggugaaaacaaccuggagaccggugugcaccgcacugcacagucugccauccucuucaggucccauaccucucuugaucuccccgacuacuagaugaagcggguacugccaucccacuuuccagcagggcacaagcuucuccaauucuccaaggucagcaagccacggcagagccaggccuagaacucagguccccugcgucucaguuugggcucauuccagaauugguggggacccccaacccacaggcaaucgagcuuaggcccugacccugcccucugaguccccagccccgaccugagccuaggcgucugaccucuggcuccgucccaaccucccuacugccuucuuucaaggguaagcccuuggucacaaggggccugggacagaaggcaggccgcguccacacacacugacugggucacuaucacuggcaguaacugaguuaaagagagcggcgcggugcggguaggcuguggcccgugggcaacaccgugacuggagccccuuccccaagccugggccuccgggccccagauaugcccugugccggcacgcguggggcgccgggcggguuacguaaaguucggccuccccacgucaccgggcagagucacggccgcggcucgugaauaaggggguugggccaucgaaggcagcgccgcgcccggggccacccgccaccuccuacccguccccucccggccugcacggccagacgucgggcggcggagggucgcggggccgagcggggcguccgcgcgcagguggccggcgcagcgagggcugcaccugcgugcgcgugugccggaggaggagggggcggcggccgcgggcgcggcgcgggggacggggacucaccauggggggcgcgggggccacaggccgggcguccccgccccugccgcggaccggagcgcgcgcugucccccgcgggcgagcgggcaaaggucccacgacggacgcacgggagggagccaccgccgcccgcgcccgccgcagccgcgcucugagccgccgcggccggaucgcagggcggcggugccgucgccggcggcgggcggcgggcggcgggcggcgggcggcgcagugcggccccggccaggcaggacagcgggaccguccgccgccgccauuggcccgcgccgccggcccccgccaccacccauuggccgccgcgcugcaccauuguuacgucacuggccggcgggcggggcgcaccgcuggacccgcggaaaacuucggagaaacuugagggagcgccggcggggagaacggagaggaggggcggggccguggcgaaaggggcggggcguugaugggcgggggcggggcucccggaacccgagcugcgggcgaagaaaggcuccgagcuccgagcugcccuagcccgggagggcgccgcugcucugcgaacucgggcgcgcgcguagguggcccgcccuccgccgugcgugacuuuccucgucgcguccagcuccccuuuucuuugaccuuacgugaccuugggaaaaaccuccaggcugcuaccccaucugcacaugggagggccggggguaggagccgcgaccccuaagggcuccaccgccuucugcccggccagggucgugccuggcgcgcc

SEQ ID NO: 20016 - RNA, 2882 nt, Homo sapiens
ggcgcgccaggcacgacccuggccgggcagaaggcgguggagcccuuaggggucgcggcuccuacccccggcccucccaugugcagaugggguagcagccuggagguuuuucccaaggucacguaaggucaaagaaaaggggagcuggacgcgacgaggaaagucacgcacggcggagggcgggccaccuacgcgcgcgcccgaguucgcagagcagcggcgcccucccgggcuagggcagcucggagcucggagccuuucuucgcccgcagcucggguuccgggagccccgcccccgcccaucaacgccccgccccuuucgccacggccccgccccuccucuccguucuccccgccggcgcucccucaaguuucuccgaaguuuuccgcggguccagcggugcgccccgcccgccggccagugacguaacaauggugcagcgcggcggccaaugggugguggcgggggccggcggcgcgggccaauggcggcggcggacggucccgcuguccugccuggccggggccgcacugcgccgcccgccgcccgccgcccgccgcccgccgccggcgacggcaccgccgcccugcgauccggccgcggcggcucagagcgcggcugcggcgggcgcgggcggcgguggcucccucccgugcguccgucgugggaccuuugcccgcucgcccgcgggggacagcgcgcgcuccgguccgcggcaggggcggggacgcccggccuguggcccccgcgccccccauggugaguccccgucccccgcgccgcgcccgcggccgccgcccccuccuccuccggcacacgcgcacgcaggugcagcccucgcugcgccggccaccugcgcgcggacgccccgcucggccccgcgacccuccgccgcccgacgucuggccgugcaggccgggaggggacggguaggagguggcggguggccccgggcgcggcgcugccuucgauggcccaacccccuuauucacgagccgcggccgugacucugcccggugacguggggaggccgaacuuuacguaacccgcccggcgccccacgcgugccggcacagggcauaucuggggcccggaggcccaggcuuggggaaggggcuccagucacgguguugcccacgggccacagccuacccgcaccgcgccgcucucuuuaacucaguuacugccagugauagugacccagucaguguguguggacgcggccugccuucugucccaggccccuugugaccaagggcuuacccuugaaagaaggcaguagggagguugggacggagccagaggucagacgccuaggcucaggucggggcuggggacucagagggcagggucagggccuaagcucgauugccuguggguuggggguccccaccaauucuggaaugagcccaaacugagacgcaggggaccugaguucuaggccuggcucugccguggcuugcugaccuuggagaauuggagaagcuugugcccugcuggaaagugggauggcaguacccgcuucaucuaguagucggggagaucaagagagguaugggaccugaagaggauggcagacugugcagugcggugcacaccggucuccagguuguuuucacccuccuaucuccucccaggagcuaacguguaagcaaacauguuuggauagagggcuggugccacgccccaggcucaccccgcccgcacagccgucguccaccccuccccuuucuuacagauaaagcugaggcucggccagggacugugauauacccacauccccggaacuaggugaucgcggugcaggaaccagguaggucugagucuggaucaugccucugaacagcccaggaagaggcuccaggggccuccaaguggucuggggucggagaucagggucaggguugcgcuugggcuggagaguggauuugccucagcuugagaugugggcccaagcuuucucauccccucccuggccuuuucuuuauuuggggucguaugaaccuggcuuaggugggaacagaagcucuuccagugggucccuggguuggagaggggaggggagauuugagggcaugggcagcaagggcauuuccagcagaggugccagagagcaagucaguuucaaggagggagaacagguacagcuagaucaaggauggaggcggugguucugggcgucggagagauggagcuguagggugacuggaagggccuggccgaggcuggagguagguacaggccuggugggccaggaccggaggggcugugugaggggcagaggggaguccccgggccuccccaguuuccccgcgccucaccguggccucuuccuuuccccgcaggugugccuucgcgggauccaugccuugaggcccaggaacgccccgccgccagcaugccgugggacgcgcggcggccuggggguggcgcggacggcgggcccgaggccucgggcgcggcgcgcucgcgagcgcagaagcagugccgcaagucgucguucgccuucuaccaggcggugcgcgaccugcuacccguguggcugcuggaggauaugcgcgccagcgaggccuuccacugggacgagcgcgggcgcgccgccgccuacucgcccucugaggcgcugcucuacgcgcucgugcacgaccaccaagcguacgcgcauuaccugcuggccacguucccgcggcgcgcgcucgcaccgcccagugccggcuuccgcugcugcgcggcucccgggccgcacguggcgcuggcagugcgcuacaaccgcgugggcauucugcgccgcauccugcgcaccuugcgcgacuucccggccgaggagcgggcgcgcgugcuggaccggcguggcugcagccgcguggagggcgguggcacg

SEQ ID NO: 20017 - RNA, 2737 nt, Homo sapiens
ggucuuauugucauugugccugcgggagggcuggucucagggcauacccagaaaaaagccccaggccgcccccagaccaaaggaacuucccaagucccugaggugcugcucccugccaugcccaggaguggaggcugcugccaagacuccacccgccaacacggggcgggcgggggaaccgggacgccucacagcaggagaaccccagcugccaucaugcgcuguggccugagguggggcggggccagggaccgccaggacagcccgacccgccccccacaguggggguaggagcccugccccuggagaagcuuuggcgucaccagccccugguagaaucccagcggcggaggagugagaaaagaaaacaaagagcuccagcucccagggccgucggggagaggcgccagagagccccgcccccaccucacgucucgggguggggagguguugcugaguccugagcccccacgggccggggcccagucccuuaacgcaccugcucggccaaggucaccggcgcaggaggaggcgcggcacggaacccagacccggagcgcggccggccccucccuccuccuccuccuccuccucgccgcgaggggccccacccccgcgaggggggcgagagggaaagcggagguagcggggagggaggacgccgcgagagggcgcagagggacacgcaccagauaccgcgggcgucgggccagucgcgggccaugcccgaggccagcagcaggggcgacacgggcuugucgaagaggaaguggucgucgaugagcugcugcugcuccgccuccgucaugcucuugagcgcguaguaucggcccgccaggucgccguccaggcuggacagggcugcgaggggugcgcucaggacgcucggcucccgcgcccgccccuccagcccgcagcgcggacccgcccgcccccgugccccaccucgggggacgucagagggccccacccgcccggaucugcgggcguccaguccucacggcccgggcgacggucccaggcggugaccccgcgccaggacccgcccucccugggccccaggccgcugugggcgcggggcugggccuccgucccucggucccuccgggaaacugaacccgggcgcgcgcagauaagagcgcgacggcggcugccgcucccgggcgacguaaacaaaagcgggcggggaccgcgccgggagggggacgcggccgccgccgccccucggcccgcccggccccuaccuuccaccgcgagcuucucgauggcgcggcgcuccccgcggcugcagugcggggggaggcagaagccacggaugcugcggcccgugcgcacccgcgagcucagcacguaguugggguccaggucgucgccgcccugggaggcgagacgggagugagcgcccgaagaccccggccccgcccgcccggcccgcccgcagccccgcaccugcagguugucgggguugaggucggucuugugcucaucgcugggcuuguagccgccgugccgguccucgaugauggggucgaagagauccuugaacacuucguaggacuccucgucgcccgccacgcagcccacggucaugauguacggguggccugggggagggggcgcgggacggggacagugacgucacugccgggcccgagcgcgcugcugaggacccugcggcugcgcggggggagggggggccgggaccccggccccgaggggucgcguacccggguuguccacgccugucuggaugacgucguccagcgugaagccgcucggcgugcucuuggcgcgcagcuccgcguacagcucgggggucagcaccuuggccaugugguuguugugggcgcucaggucggggaacucguccucggccgggaagcgcagcuucagugcguuguggcuguuggagaagggcauggcggcggcgggcugcggggagacgcggggucagaggggaccggcacgccgggguucccgggcucccgcguaccacucaggcccccgccgccgggccccccggcgccccccgggacgcggccaaggucagcgggguccgcagcgcgcgcggggagcgccaucaucgccggggacccccggccgguccggcgcgcgcuccaggcgacgcgcccccuuugcacgcagcgccccuagcccgggcgcggacgcccccggcccccgggcccacucaccgggcggccgggcgggggcgggggcgcuccguccgucggcagcucccggagcgacgcaggcgaacagcggccgcuccgcgcucccgcggcucuuaaggggcacaacgcgggccgcccauuggcggcuauuuauagcccauucauuccauuggcccgcgccgcgggguggugccgccgcuuuguccgccgcccgcagcccccaacacccuggccgcccacccgagcuguccccucgcugggaccccgcgcagccugcccagucccccgcccaagaccucgaggccgaaaccucagguccuuggauaucuggauccccucgcacgcccuugccucugggcgggaaacugaggcggagagccuccgggcacucgaggacgcuuggguucauccgcauccucgagccugcccgccuaguccagccagcccccgcggcggcggcgaggggccgggcgaaagcuuucggggcuuccgcagcagguacggcccccgccccacccccggccagugcgagcuggcccggagccgccgaccuuccucaaggugcc

SEQ ID NO: 20018 - RNA, 2737 nt, Homo sapiens
ggcaccuugaggaaggucggcggcuccgggccagcucgcacuggccggggguggggcgggggccguaccugcugcggaagccccgaaagcuuucgcccggccccucgccgccgccgcgggggcuggcuggacuaggcgggcaggcucgaggaugcggaugaacccaagcguccucgagugcccggaggcucuccgccucaguuucccgcccagaggcaagggcgugcgaggggauccagauauccaaggaccugagguuucggccucgaggucuugggcgggggacugggcaggcugcgcggggucccagcgaggggacagcucgggugggcggccaggguguugggggcugcgggcggcggacaaagcggcggcaccaccccgcggcgcgggccaauggaaugaaugggcuauaaauagccgccaaugggcggcccgcguugugccccuuaagagccgcgggagcgcggagcggccgcuguucgccugcgucgcuccgggagcugccgacggacggagcgcccccgcccccgcccggccgcccggugagugggcccgggggccgggggcguccgcgcccgggcuaggggcgcugcgugcaaagggggcgcgucgccuggagcgcgcgccggaccggccggggguccccggcgaugauggcgcuccccgcgcgcgcugcggaccccgcugaccuuggccgcgucccggggggcgccggggggcccggcggcgggggccugagugguacgcgggagcccgggaaccccggcgugccgguccccucugaccccgcgucuccccgcagcccgccgccgccaugcccuucuccaacagccacaacgcacugaagcugcgcuucccggccgaggacgaguuccccgaccugagcgcccacaacaaccacauggccaaggugcugacccccgagcuguacgcggagcugcgcgccaagagcacgccgagcggcuucacgcuggacgacgucauccagacaggcguggacaacccggguacgcgaccccucggggccggggucccggcccccccuccccccgcgcagccgcaggguccucagcagcgcgcucgggcccggcagugacgucacuguccccgucccgcgcccccucccccaggccacccguacaucaugaccgugggcugcguggcgggcgacgaggaguccuacgaaguguucaaggaucucuucgaccccaucaucgaggaccggcacggcggcuacaagcccagcgaugagcacaagaccgaccucaaccccgacaaccugcaggugcggggcugcgggcgggccgggcgggcggggccggggucuucgggcgcucacucccgucucgccucccagggcggcgacgaccuggaccccaacuacgugcugagcucgcgggugcgcacgggccgcagcauccguggcuucugccuccccccgcacugcagccgcggggagcgccgcgccaucgagaagcucgcgguggaagguaggggccgggcgggccgaggggcggcggcggccgcgucccccucccggcgcgguccccgcccgcuuuuguuuacgucgcccgggagcggcagccgccgucgcgcucuuaucugcgcgcgcccggguucaguuucccggagggaccgagggacggaggcccagccccgcgcccacagcggccuggggcccagggagggcggguccuggcgcggggucaccgccugggaccgucgcccgggccgugaggacuggacgcccgcagauccgggcggguggggcccucugacgucccccgagguggggcacgggggcgggcggguccgcgcugcgggcuggaggggcgggcgcgggagccgagcguccugagcgcaccccucgcagcccuguccagccuggacggcgaccuggcgggccgauacuacgcgcucaagagcaugacggaggcggagcagcagcagcucaucgacgaccacuuccucuucgacaagcccgugucgccccugcugcuggccucgggcauggcccgcgacuggcccgacgcccgcgguaucuggugcgugucccucugcgcccucucgcggcguccucccuccccgcuaccuccgcuuucccucucgccccccucgcggggguggggccccucgcggcgaggaggaggaggaggaggagggaggggccggccgcgcuccgggucuggguuccgugccgcgccuccuccugcgccggugaccuuggccgagcaggugcguuaagggacugggccccggcccgugggggcucaggacucagcaacaccuccccaccccgagacgugaggugggggcggggcucucuggcgccucuccccgacggcccugggagcuggagcucuuuguuuucuuuucucacuccuccgccgcugggauucuaccaggggcuggugacgccaaagcuucuccaggggcagggcuccuacccccacuguggggggcgggucgggcuguccuggcggucccuggccccgccccaccucaggccacagcgcaugauggcagcugggguucuccugcugugaggcgucccgguucccccgcccgccccguguuggcggguggagucuuggcagcagccuccacuccugggcauggcagggagcagcaccucagggacuugggaaguuccuuuggucugggggcggccuggggcuuuuuucuggguaugcccugagaccagcccucccgcaggcacaaugacaauaagacc

SEQ ID NO: 20019 - RNA, 2146 nt, Homo sapiens
ucaggagcuuuggcagccuuuuuguuauauaagggaaaccagcccaaggaaaaugacccuuggaaaaaaaguggagaagaaagccaauguccaauuaaagccaugcagaaaauccauccuucuucuagacuuuucauuuguaagagccacuaaaucuuuucuauuuucuaagccagucuauuaacugaaaguagaaguauacacuugauugaauccuuuguucuuucugggcuucuuuugguccccccggggcaaaugaauggcaaaagaguaacgagcgaaaaaaaacuuuaauagcuuuuaaucuuuaugcugcaacauauacucuuguauaugcacagaauguauauucuguauauaagacaccaaaauauauauuuuugggggaaaggugucaggggcuaaagugaaagauucacuuuuuacuaacucuccuccuauaaugguugaauauuuuuaaaaccaugugcacauauuacuuuuuaaaguuaaaauaacaaaaaauaagcugcuaaagauaucucaaaagaagcuuuuuccugagggacuuacuaauaugguaaguacaguagcacuguaaagccuuuuaacacuuuuggucacauaaaauuuuuguuguuaaaauuccugcugugcaacaaguaaguccuuacuugucaucuuucucuuuugucuuuuugugcaccaucucucggaaacuggcuaaaaucuuacuuucucucuuucgucucucuucuugguuaaaggaugcaagagcucucuucucaucagcacuguagaucugguucuccuuacgcagucguacagccuccauucugcgaugccugcuaccacucaugacauaaccugagcauucaaaagaaccgaucucuucacuugucaacccaauuucaccucuucgugggauucgcuuuccagcuuuuacauacucagccauagcugcaccuucaccgggaagcaaagcauggccauacuucaaagguuuuucaucuugagagguauguauuauaggugcuucuggcccuauuaaauccauaguaucugccacauuuggcugcuccauccagguagcuucugacaaguccucuucugagucuuuacagcuugagucacuggauucuuuuuugguuuucuuauucuucuuuuucuuuguuuuguguuucuuuuucuucuuuuucuucuuggcuuuaacucucuuuuuaucaucaucagagucagaauuugugucagacucugaguuacugucacuaucagaauauuuccuaugcuuucuuuuagacgacuuauucuuucuuuuuuucuuguuucuugaacgacuggucuucuuuuuccuauguucuuccgaguuggaaucugaacugcugcuuuucugaugcguuaccucuucuucauccucaacugggguauguucgucagaaucuagcugagggaacuuuggagacggcccccacacuucaggcgcucccaauuccccaauccucucucucuccuucagccuccucugccgauggcucucuuccuucucguagucuuccgcugacugccguucuucugcauagcagugacgaugguagcgauauccacuauacgaggucgaccaggaggacgcgaaggcguaguugcggaaucuugggagccgcccucgcgacccagagcgacuaaagggguaaagagcgcccacguccaacucacuccaaggaggccugaggcccucacggccgcgggagugagagcgggaacagccaucccaagaggaacaucugcucugcggggauggugggcuccccgaggagcugcgucgccuucuccgagagcccacgauguccucggaauagcuggaccgggauacugggggcaugagccgcgccucaacgcugggcgguugcuacagacccagaggcuggcuggugauucgcggccacgcaggcgcacuagaaucggccucccacgcacggcuuccgcuuccugucaguuaccaaacggaaaacgaauccgcgcgugugcuauguggggcgggccuuggcugcgugaaggcuucuugugggaaguagguaggauuagggugcgccuguuuuuaggacuuauauuccccaacuugagccgugugggaacauaaaaggacgaauuugcgucaaugauccccucu

SEQ ID NO: 20020 - RNA, 2146 nt, Homo sapiens
agaggggaucauugacgcaaauucguccuuuuauguucccacacggcucaaguuggggaauauaaguccuaaaaacaggcgcacccuaauccuaccuacuucccacaagaagccuucacgcagccaaggcccgccccacauagcacacgcgcggauucguuuuccguuugguaacugacaggaagcggaagccgugcgugggaggccgauucuagugcgccugcguggccgcgaaucaccagccagccucugggucuguagcaaccgcccagcguugaggcgcggcucaugcccccaguaucccgguccagcuauuccgaggacaucgugggcucucggagaaggcgacgcagcuccucggggagcccaccauccccgcagagcagauguuccucuugggauggcuguucccgcucucacucccgcggccgugagggccucaggccuccuuggagugaguuggacgugggcgcucuuuaccccuuuagucgcucugggucgcgagggcggcucccaagauuccgcaacuacgccuucgcguccuccuggucgaccucguauaguggauaucgcuaccaucgucacugcuaugcagaagaacggcagucagcggaagacuacgagaaggaagagagccaucggcagaggaggcugaaggagagagagaggauuggggaauugggagcgccugaagugugggggccgucuccaaaguucccucagcuagauucugacgaacauaccccaguugaggaugaagaagagguaacgcaucagaaaagcagcaguucagauuccaacucggaagaacauaggaaaaagaagaccagucguucaagaaacaagaaaaaaagaaagaauaagucgucuaaaagaaagcauaggaaauauucugauagugacaguaacucagagucugacacaaauucugacucugaugaugauaaaaagagaguuaaagccaagaagaaaaagaagaaaaagaaacacaaaacaaagaaaaagaagaauaagaaaaccaaaaaagaauccagugacucaagcuguaaagacucagaagaggacuugucagaagcuaccuggauggagcagccaaauguggcagauacuauggauuuaauagggccagaagcaccuauaauacauaccucucaagaugaaaaaccuuugaaguauggccaugcuuugcuucccggugaaggugcagcuauggcugaguauguaaaagcuggaaagcgaaucccacgaagaggugaaauuggguugacaagugaagagaucgguucuuuugaaugcucagguuaugucaugagugguagcaggcaucgcagaauggaggcuguacgacugcguaaggagaaccagaucuacagugcugaugagaagagagcucuugcauccuuuaaccaagaagagagacgaaagagagaaaguaagauuuuagccaguuuccgagagauggugcacaaaaagacaaaagagaaagaugacaaguaaggacuuacuuguugcacagcaggaauuuuaacaacaaaaauuuuaugugaccaaaaguguuaaaaggcuuuacagugcuacuguacuuaccauauuaguaagucccucaggaaaaagcuucuuuugagauaucuuuagcagcuuauuuuuuguuauuuuaacuuuaaaaaguaauaugugcacaugguuuuaaaaauauucaaccauuauaggaggagaguuaguaaaaagugaaucuuucacuuuagccccugacaccuuucccccaaaaauauauauuuuggugucuuauauacagaauauacauucugugcauauacaagaguauauguugcagcauaaagauuaaaagcuauuaaaguuuuuuuucgcucguuacucuuuugccauucauuugccccggggggaccaaaagaagcccagaaagaacaaaggauucaaucaaguguauacuucuacuuucaguuaauagacuggcuuagaaaauagaaaagauuuaguggcucuuacaaaugaaaagucuagaagaaggauggauuuucugcauggcuuuaauuggacauuggcuuucuucuccacuuuuuuuccaagggucauuuuccuugggcugguuucccuuauauaacaaaaaggcugccaaagcuccuga

SEQ ID NO: 20021 - RNA, 2469 nt, Homo sapiens
agggggcgcggaggggcggggcuggguccugggaugggacgcggggcuugcugcggggggcaaacagaaagaauauuucaugaagucagagguggucgaguuuugcgaggggugggggucgucccccuggcagaaccggagugagucugugaucccucaauuggaaagagggugagugagggaaaggggaggaggccgcgagaggaaugaagagcgaggagacccuggagagcggggagcgagauaagagagggaggcggccgccaggucgggagggggaggagugagcgcggcggcgcggagcgaggagggggcagggcgggguggggggggagggagggagggagggagcgaggagggcggccggggagggcgagggagggaggaaguccgagagacagagcgaggagcgcuccugaagggagacgucgggcucguccccgggguccaggccgcggucccacucgcgggcgcagucgcccggcgccggccgcucggccccgcggccugggaggccguugcgcaaggcagggcccgcggcucggggagggaugcgccgggcguugccucccgcccgccgccgccgccgccgccagaagccccagaggagcugagggaggcgacgccgaagcgcuggcccggaguggccacggcugcagcccgggcggcgggcuagggcgcucgcagggcuucugggccgaccccgcuccggcgccuccgcuucccgcccggggcccgcccucgcggcccggccucgcucccgggucccagaugaccaccgagggcgggccgccgccggccccgcuccgccgcgcgugcagcccgguccccggcgcgcuccaggccgcccugaugagcccgccgcccgccgccgccgccgccgccgccgccgccccggagaccaccuccuccuccucgucgucguccuccgccuccugcgccucguccucguccuccuccaauucggccagcgcccccucggcugccugcaagagcgcgggcggcggcggcgcgggcgccgggagcgggggcgccaagaaggcgagcucggggcugcggcggcccgagaagccgcccuacucguacaucgcgcucaucgucauggccauccagagcucgcccagcaagcgccugacgcucagcgagaucuaccaguuccugcaggcgcgcuuccccuucuuccgcggcgccuaccagggcuggaagaacucggugcgccacaaucucucgcucaacgagugcuucaucaagcugccuaagggccucgggcggcccggcaagggccacuacuggaccaucgacccggccagcgaguucauguucgaggagggcucguuccgccgccggccgcgcggcuucaggcggaagugccaggcgcucaagcccauguaccaccgcguggugagcggcuugggcuucggggcgucgcugcugccccagggcuucgacuuccaggcgcccccgucggcgccgcucggcugccacagccagggcggcuacggcggccucgacaugaugcccgcgggcuacgacgccggcgcgggcgcccccagccacgcgcacccucaccaccaccaccaccaccacgucccgcacaugucgcccaacccggguuccaccuacauggccagcugcccggugcccgcgggacccgggggcgucggugcggccgggggcggcggcggcggcgacuacgggccggacagcagcagcagcccgguacccucguccccggccauggcgagcgccaucgaaugccacucgcccuacacgagcccugcggcgcacuggagcucgccuggcgccucgccuuaccucaagcagccgccugcccugacgcccagcagcaaccccgccgccucggcaggccugcacuccagcauguccuccuacucgcuggagcagagcuacuugcaccagaacgcucgcgaggaccucucagguaacgcagcacgcuccagcccagccagcugggcgcaccgcuucuaggccuccagggcuggcggccacugccacucccacaaacagggaccccgaagcuaggaggucugagggcacugggaaaagcagaugcuggggaaagccggcaucuuauucgugggagcagggaucagggucuuacuguccucccaguaucccuggccagcagccgaagcuucagaauugucuggcugcugugagcgugguguaaaguccccugccuuccugggcucuuuggggaucccugugcaggagacugcaggucucccguucagagucucacuuagcuuggagagaaggcaucuggccuuuggggaacuuggucaggaagcugugucuaguuccuuuugucccuuuuuuuccuugcguucauuuugcuguacuucugucccgaaguaaaugucagaaucagauauguucuguauguuggggugucugcagcgagauguuugcagcugggcaaguguuaagaggagggggugggaggga

SEQ ID NO: 20022 - RNA, 2469 nt, Homo sapiens
ucccucccacccccuccucuuaacacuugcccagcugcaaacaucucgcugcagacaccccaacauacagaacauaucugauucugacauuuacuucgggacagaaguacagcaaaaugaacgcaaggaaaaaaagggacaaaaggaacuagacacagcuuccugaccaaguuccccaaaggccagaugccuucucuccaagcuaagugagacucugaacgggagaccugcagucuccugcacagggauccccaaagagcccaggaaggcaggggacuuuacaccacgcucacagcagccagacaauucugaagcuucggcugcuggccagggauacugggaggacaguaagacccugaucccugcucccacgaauaagaugccggcuuuccccagcaucugcuuuucccagugcccucagaccuccuagcuucggggucccuguuugugggaguggcaguggccgccagcccuggaggccuagaagcggugcgcccagcuggcugggcuggagcgugcugcguuaccugagagguccucgcgagcguucuggugcaaguagcucugcuccagcgaguaggaggacaugcuggagugcaggccugccgaggcggcgggguugcugcugggcgucagggcaggcggcugcuugagguaaggcgaggcgccaggcgagcuccagugcgccgcagggcucguguagggcgaguggcauucgauggcgcucgccauggccggggacgaggguaccgggcugcugcugcuguccggcccguagucgccgccgccgccgcccccggccgcaccgacgcccccgggucccgcgggcaccgggcagcuggccauguagguggaacccggguugggcgacaugugcgggacgugguggugguggugguggugagggugcgcguggcugggggcgcccgcgccggcgucguagcccgcgggcaucaugucgaggccgccguagccgcccuggcuguggcagccgagcggcgccgacgggggcgccuggaagucgaagcccuggggcagcagcgacgccccgaagcccaagccgcucaccacgcggugguacaugggcuugagcgccuggcacuuccgccugaagccgcgcggccggcggcggaacgagcccuccucgaacaugaacucgcuggccgggucgaugguccaguaguggcccuugccgggccgcccgaggcccuuaggcagcuugaugaagcacucguugagcgagagauuguggcgcaccgaguucuuccagcccugguaggcgccgcggaagaaggggaagcgcgccugcaggaacugguagaucucgcugagcgucaggcgcuugcugggcgagcucuggauggccaugacgaugagcgcgauguacgaguagggcggcuucucgggccgccgcagccccgagcucgccuucuuggcgcccccgcucccggcgcccgcgccgccgccgcccgcgcucuugcaggcagccgagggggcgcuggccgaauuggaggaggacgaggacgaggcgcaggaggcggaggacgacgacgaggaggaggagguggucuccggggcggcggcggcggcggcggcggcggcgggcggcgggcucaucagggcggccuggagcgcgccggggaccgggcugcacgcgcggcggagcggggccggcggcggcccgcccucgguggucaucugggacccgggagcgaggccgggccgcgagggcgggccccgggcgggaagcggaggcgccggagcggggucggcccagaagcccugcgagcgcccuagcccgccgcccgggcugcagccguggccacuccgggccagcgcuucggcgucgccucccucagcuccucuggggcuucuggcggcggcggcggcggcgggcgggaggcaacgcccggcgcaucccuccccgagccgcgggcccugccuugcgcaacggccucccaggccgcggggccgagcggccggcgccgggcgacugcgcccgcgagugggaccgcggccuggaccccggggacgagcccgacgucucccuucaggagcgcuccucgcucugucucucggacuuccucccucccucgcccuccccggccgcccuccucgcucccucccucccucccuccccccccaccccgcccugcccccuccucgcuccgcgccgccgcgcucacuccucccccucccgaccuggcggccgccucccucucuuaucucgcuccccgcucuccagggucuccucgcucuucauuccucucgcggccuccuccccuuucccucacucacccucuuuccaauugagggaucacagacucacuccgguucugccagggggacgacccccaccccucgcaaaacucgaccaccucugacuucaugaaauauucuuucuguuugccccccgcagcaagccccgcgucccaucccaggacccagccccgccccuccgcgcccccu

SEQ ID NO: 20023 - RNA, 2582 nt, Homo sapiens
guucgaccucucauucauuccgaacuuccuccugcugcgucuucuuucguguucaccacacucuucuaccuccccgccccucccaacccccacuuuucuugccaaaugucaaugauuugggacagcucccagccgugaauuaauaaagaccgagguucuguugcaggaaagggcagacauuagggaacaaauacguucaauuucaauuccacagucaacaaauagucauuuuuggaccgagguuaauguguucaaaacgcgucccucaggcacgaccaccgucuuuuuuuucccuccaaaccucucaaaguaagguuauuuccuaccgggaaaacagagucccaaaucuuguccgauuaaaauuucuaucucaaaaacaacucucucuccugcucucuaaaaauucaaagguuuauugcaaaaugccacauucacuuauuuccaacauuuaaggaauuugcugccauuagaaauauuauuuacagcagcucuuuucacuaaugucaaagauucaaaacaaccagauuuaaagcauugucauuuuuuggaacuaaaggaaaacaccaauauccugcacucacacacucuaaaaucuuuauaauguuucugcauuauaaaaucucaaaaucaugucaguugcauaaaaccccacugcaaagaauccauuuuaaggucuagagaacuccaaaccuuguuuccuucacauuucuuauggaaaaaacauauuaugcauucuccuuucuugccccaaaccaauuaccuaaagcacccccucccccaauacugcaaggauuugucugcaaagaaugccacagccugaacugauaggagguaacaauuccguuucaggaguuucuuuuuucccccguguuguccauucuauuaauaaccugcuucacuuucacuuuuaggccacguuaauuaauguucugacccagugucggagaaggggguuuucuagugcccucuucuauaucuuuucuucauucuggaugguaaaaaugugaacuuuaaaaagaccccugacagcguaacuacaacucaacauuccuuaacauaaaauggggacuaaauaauuccuuccauaaccaaucccaaacaaacaaaaauaacaaacacccgacaugacauauuccaaacacuucuuaacccuuuccuauauauaaaaugcagacaccaauguguaaaguagcaggcaaaugcaucuagaaaaguauaucuacguaaauuuggcugaauucauccucuucaaugguaagcauguuaaaauauguggucugaaguucccuaucacucucgauuugcccaccagccgggucugcggugcccgugcaaacgcugcagcuaggauauaggggggaggaggggcgggagaaugacaaaguucuaaaugcagcagucugagcccuggaauaucuuugcuuucagcacauaaacuuuccaguccuggcugccuagccauuuuauuccugcauucacauuucgacucuucaaaaucauaucuugcaguaucgcaggggccaguacauugccccagagcgcaccaaaccugguauaaacccagaaagggaaacaaaaauggaugugugcucaggaaaaagggggaaaaaaaccguguccagaaaauguccggccgcacacauuuccuggcgaacauuuggaaucuauagcuuuaggaaaaaccgaucugggacgcgcuaguccccaggaacugaugcccccacccucgggggauugccggcuucuccgcacccuggggcggccgcggacccgcuagucccccuccgcgccucgggccggggcaggcugccucccgccuccagccuccagccgggcugagcggccacuuaccuauuugcaccgcgaggaucagugaaauauaucugccguucaacuuaagucccauccuacguuuagucaaaccauuugcgaccgcagaccuuuaaauaguuaguuuagagaacgcgggggaaagccaaaaaauaggcauugccaacaaguuccgggagcgacagagacuuuaugcacugggaaggcagagggaggagagaaagagagggagcgaggaagagacagaaagagagagagagagagaaagagagagagagagagaggcugaggggggggggagagcugggaaugguucacuccauuagaagggggcggaggaaguacagccucacgcccacgagcaggccugacgugggggaugacacggaaugauuuuuuuuuuaauauagacaccuugguagagaaucgccauuuauagucaucagaagcuggaauuaaucagauaucuccaauuaaugugcgaucugaacgaaauuuugccucccgggggugagcacuuuccuauucuagcggucaccccugccucuuccucguuccgggggccccccagccccgccgccucccugcgcagaacaggggcucccccucccuuccccgccaggagcuggggaguccuggcgcgcccacucgauuguuucaaccugcucccccuccuccaucagcaccacagagaauccagcccgcucucuacgaugcagggggguuuaaaggagcgggagagggaaaaacag

SEQ ID NO: 20024 - RNA, 2582 nt, Homo sapiens
cuguuuuucccucucccgcuccuuuaaaccccccugcaucguagagagcgggcuggauucucuguggugcugauggaggagggggagcagguugaaacaaucgagugggcgcgccaggacuccccagcuccuggcggggaagggagggggagccccuguucugcgcagggaggcggcggggcuggggggcccccggaacgaggaagaggcaggggugaccgcuagaauaggaaagugcucacccccgggaggcaaaauuucguucagaucgcacauuaauuggagauaucugauuaauuccagcuucugaugacuauaaauggcgauucucuaccaaggugucuauauuaaaaaaaaaaucauuccgugucaucccccacgucaggccugcucgugggcgugaggcuguacuuccuccgcccccuucuaauggagugaaccauucccagcucuccccccccccucagccucucucucucucucucuuucucucucucucucucuuucugucucuuccucgcucccucucuuucucuccucccucugccuucccagugcauaaagucucugucgcucccggaacuuguuggcaaugccuauuuuuuggcuuucccccgcguucucuaaacuaacuauuuaaaggucugcggucgcaaaugguuugacuaaacguaggaugggacuuaaguugaacggcagauauauuucacugauccucgcggugcaaauagguaaguggccgcucagcccggcuggaggcuggaggcgggaggcagccugccccggcccgaggcgcggagggggacuagcggguccgcggccgccccagggugcggagaagccggcaaucccccgagggugggggcaucaguuccuggggacuagcgcgucccagaucgguuuuuccuaaagcuauagauuccaaauguucgccaggaaaugugugcggccggacauuuucuggacacgguuuuuuucccccuuuuuccugagcacacauccauuuuuguuucccuuucuggguuuauaccagguuuggugcgcucuggggcaauguacuggccccugcgauacugcaagauaugauuuugaagagucgaaaugugaaugcaggaauaaaauggcuaggcagccaggacuggaaaguuuaugugcugaaagcaaagauauuccagggcucagacugcugcauuuagaacuuugucauucucccgccccuccuccccccuauauccuagcugcagcguuugcacgggcaccgcagacccggcuggugggcaaaucgagagugauagggaacuucagaccacauauuuuaacaugcuuaccauugaagaggaugaauucagccaaauuuacguagauauacuuuucuagaugcauuugccugcuacuuuacacauuggugucugcauuuuauauauaggaaaggguuaagaaguguuuggaauaugucaugucggguguuuguuauuuuuguuuguuugggauugguuauggaaggaauuauuuaguccccauuuuauguuaaggaauguugaguuguaguuacgcugucaggggucuuuuuaaaguucacauuuuuaccauccagaaugaagaaaagauauagaagagggcacuagaaaacccccuucuccgacacugggucagaacauuaauuaacguggccuaaaagugaaagugaagcagguuauuaauagaauggacaacacgggggaaaaaagaaacuccugaaacggaauuguuaccuccuaucaguucaggcuguggcauucuuugcagacaaauccuugcaguauugggggagggggugcuuuagguaauugguuuggggcaagaaaggagaaugcauaauauguuuuuuccauaagaaaugugaaggaaacaagguuuggaguucucuagaccuuaaaauggauucuuugcagugggguuuuaugcaacugacaugauuuugagauuuuauaaugcagaaacauuauaaagauuuuagagugugugagugcaggauauugguguuuuccuuuaguuccaaaaaaugacaaugcuuuaaaucugguuguuuugaaucuuugacauuagugaaaagagcugcuguaaauaauauuucuaauggcagcaaauuccuuaaauguuggaaauaagugaauguggcauuuugcaauaaaccuuugaauuuuuagagagcaggagagagaguuguuuuugagauagaaauuuuaaucggacaagauuugggacucuguuuucccgguaggaaauaaccuuacuuugagagguuuggagggaaaaaaaagacgguggucgugccugagggacgcguuuugaacacauuaaccucgguccaaaaaugacuauuuguugacuguggaauugaaauugaacguauuuguucccuaaugucugcccuuuccugcaacagaaccucggucuuuauuaauucacggcugggagcugucccaaaucauugacauuuggcaagaaaaguggggguugggaggggcggggagguagaagaguguggugaacacgaaagaagacgcagcaggaggaaguucggaaugaaugagaggucgaac

SEQ ID NO: 20025 - RNA, 2538 nt, Homo sapiens
caaggauucccacggucguucugggcuggugcagaagcuggugcucccgcacccagcggccagcaggcucggcgcagcacaucuccccaccccacccccacacacccccguggggugcgucgauccuguagcucagagggagaagcuacuuagaacuucgugaagcacagaggaucuggagcgagccccgcagcugggaucaguggucuuaaguugaacccgcuuacaggaagaugcagcccagcucacagcgaagugugggggggccgucucuaaagccgagaagggaaccgcuuuagaaguggggguggggggaagaaagaaugaaugaaugaaugaaugaaugaauagaaagaagaaggaauauuaaagaucggagaggaaguucaagagagaaaagaguuuucucuuuccuuucuguuccuggugacuugggcccucaaucucgaugaagauaacacgaggagugcacaggcaagugcccaguugccagcaauugcuucaaaagcccauguucuucuuuucccccauucuuaggcacagccaaaauuggucagaaaggggaguaaagugggacacgagcuucaaaguagggaaaccaaagaagggagcauccacguccucucucugcagcuucucccccgcguucuucgggcgaauccgagggacgggcgcugcgcuggggaaaguuugucccacccgcguuucgcagcugguugcaaggagaggaggaggagagggagggucaagcucggagccugugaccgcacggaugaucgagccggcgucgcgcuuaccucgcaguccucguacuugauauuauccgucaauuuccaaagcauuuucauggaucggcgugaacggauaugccccucucggucucgcacccaaguggagcuacucucugggugagcgcaaagugcuggcugccggcggugagcgcaggaggaggaggaggagggagaggagguggaggaggagaaggaggagggagaggaggagggcaaggaggaggaggaggaagaggagggcgaggaggaggaggagggcgaggagaagggcgaggaggaggagagaagggaaagagcucccgugugcgcucggagaucucccucuaaugguagaaacuuuucccuuuuccagcucuuuaccaacagccuaaucgccucauuagcauaucaacaauaguccaauugcucgccaguaccacaaucugccgccggccgcuccgacacagguauaaaggccucucuacgccgcgaacuugcuucuagagcgcacuccagccugcgaacugauaaaaccuuccucgagcuccgccgcgaggcccugccccaacacccccucucuuaccccaauuccgccacauuccccuuccuuucuuucuccgcuuccuuuucuccagagaugccuucugcaaagcccggcacugcucaagguccaagcgccacgccuggggcccagcuucuagcacuucucccuuaacccugcuaccacgauccgagcugcccuuuuggccccgugcaauuuuauuagaaaucauuaucccuuucgcaauuaaacauaaccaccaaaccaagaccggcgaagucacuccaggauuuuuucccaacaagggaucgccuccgcucgaggcagccacccccucgggccgcagcgccuugggaguuuuauuggcuuugagcuuucccccagguuggagauucugccaagcggcuccgguggcucugcugggguuugcaaucccuuaauugcagcguguaaaauaaaaguuguacccugaagagguuacuugacagcuccagggguuaaacaauuuuucuccuguuugugugaagcuagggccaacugacaguucaaauugguguucaggcuaagguuuccugggugcaacguggacacgaauacagaacuccuauggaacugcacacccgcuucugaaguugagccuaaaaacagacgugugugugccugcaagucuagauaccgucucgugcgugcaucaaaauaaaucaccgggaaccgacuuuuagcuguguuaaucugcucuaguuuucccaagauuccccuuuuuaauuaaagcagggagaguuccuucaugauuuggugaugcuacuaacgcgggcgugcucgcgaggcagagcccggcugccgcggaaccuggaggccugggagccaccuacucguccagacuggucaguccgggcuuuuggacuccucaccggggccugcuggguccucuggggcuuuuaucccuuucgguuuugggauuuuuuuuuaaguaagaaaaaaaaaaaagaaaaggaccuaaugugacacuaggaaauacagaguaauuaauuuuccuggcugagcuuccucguuuguccuccaaaagaaaguuaccucugucuuuucucucugcuauauguacaaacuccuuaacuacacuaggucccgccucagaguugcucuaguaaggaccuuugauucaucugggcuuguuucucgaaaaucuccaggccucccauauuuccaccgggcguuccuaaaagggga

SEQ ID NO: 20026 - RNA, 2538 nt, Homo sapiens
uccccuuuuaggaacgcccgguggaaauaugggaggccuggagauuuucgagaaacaagcccagaugaaucaaagguccuuacuagagcaacucugaggcgggaccuaguguaguuaaggaguuuguacauauagcagagagaaaagacagagguaacuuucuuuuggaggacaaacgaggaagcucagccaggaaaauuaauuacucuguauuuccuagugucacauuagguccuuuucuuuuuuuuuuuucuuacuuaaaaaaaaaucccaaaaccgaaagggauaaaagccccagaggacccagcaggccccggugaggaguccaaaagcccggacugaccagucuggacgaguagguggcucccaggccuccagguuccgcggcagccgggcucugccucgcgagcacgcccgcguuaguagcaucaccaaaucaugaaggaacucucccugcuuuaauuaaaaaggggaaucuugggaaaacuagagcagauuaacacagcuaaaagucgguucccggugauuuauuuugaugcacgcacgagacgguaucuagacuugcaggcacacacacgucuguuuuuaggcucaacuucagaagcgggugugcaguuccauaggaguucuguauucguguccacguugcacccaggaaaccuuagccugaacaccaauuugaacugucaguuggcccuagcuucacacaaacaggagaaaaauuguuuaaccccuggagcugucaaguaaccucuucaggguacaacuuuuauuuuacacgcugcaauuaagggauugcaaaccccagcagagccaccggagccgcuuggcagaaucuccaaccugggggaaagcucaaagccaauaaaacucccaaggcgcugcggcccgaggggguggcugccucgagcggaggcgaucccuuguugggaaaaaauccuggagugacuucgccggucuugguuuggugguuauguuuaauugcgaaagggauaaugauuucuaauaaaauugcacggggccaaaagggcagcucggaucgugguagcaggguuaagggagaagugcuagaagcugggccccaggcguggcgcuuggaccuugagcagugccgggcuuugcagaaggcaucucuggagaaaaggaagcggagaaagaaaggaaggggaauguggcggaauugggguaagagaggggguguuggggcagggccucgcggcggagcucgaggaagguuuuaucaguucgcaggcuggagugcgcucuagaagcaaguucgcggcguagagaggccuuuauaccugugucggagcggccggcggcagauugugguacuggcgagcaauuggacuauuguugauaugcuaaugaggcgauuaggcuguugguaaagagcuggaaaagggaaaaguuucuaccauuagagggagaucuccgagcgcacacgggagcucuuucccuucucuccuccuccucgcccuucuccucgcccuccuccuccuccucgcccuccucuuccuccuccuccuccuugcccuccuccucucccuccuccuucuccuccuccaccuccucucccuccuccuccuccuccugcgcucaccgccggcagccagcacuuugcgcucacccagagaguagcuccacuugggugcgagaccgagaggggcauauccguucacgccgauccaugaaaaugcuuuggaaauugacggauaauaucaaguacgaggacugcgagguaagcgcgacgccggcucgaucauccgugcggucacaggcuccgagcuugacccucccucuccuccuccucuccuugcaaccagcugcgaaacgcgggugggacaaacuuuccccagcgcagcgcccgucccucggauucgcccgaagaacgcgggggagaagcugcagagagaggacguggaugcucccuucuuugguuucccuacuuugaagcucgugucccacuuuacuccccuuucugaccaauuuuggcugugccuaagaaugggggaaaagaagaacaugggcuuuugaagcaauugcuggcaacugggcacuugccugugcacuccucguguuaucuucaucgagauugagggcccaagucaccaggaacagaaaggaaagagaaaacucuuuucucucuugaacuuccucuccgaucuuuaauauuccuucuucuuucuauucauucauucauucauucauucauucuuucuuccccccacccccacuucuaaagcgguucccuucucggcuuuagagacggcccccccacacuucgcugugagcugggcugcaucuuccuguaagcggguucaacuuaagaccacugaucccagcugcggggcucgcuccagauccucugugcuucacgaaguucuaaguagcuucucccucugagcuacaggaucgacgcaccccacgggggugugugggggugggguggggagaugugcugcgccgagccugcuggccgcugggugcgggagcaccagcuucugcaccagcccagaacgaccgugggaauccuug

SEQ ID NO: 20027 - RNA, 2678 nt, Homo sapiens
ggcguuaaaagacauguuuacuuuuuuaauaagcaguucaauuguuuuucuuauucacguaacucaggaucaacaguaacuucaucuaaugugccaucagagcagucgcaaauugaaugaaagugauggccaccacaaaauccuuuuucuccugaacucuccauaaagucuccuuucuuugcacaucuuugugcuaaaauaauuagcuacuuguaaagacaguacacauagcaacacuacacauucacauauuuuucccacaucuguugucuuauuuaagcgcaacuuauuuggaaucagaauugaauucaaauugggacuaaggcaguaaguaacuaugaccucgaggaagucacuuaagcucucugggucucaguuuucucacuuguacaaugagauuaauaauaaaaauuauggcugagcaaguggcuaugccuguacuccuaguacuuugggaggccgaggaagguggauugcuugaacucaggaguuugagaccagccugggcaacauggugaaaccccaucucugccaaaauacaaaaauuagcugagugugguaaugcacacuuguggucccagcuacuugggaggcugagguggaaggaccaccugagcgggggacguugaaacuguagugagcugugaucaugcuucugcacuccagccugggugacagagcuugacucuaucuugggggggaagaaauuaccucacuggauaguacagauuaaauaagcuaauauuugcaaauuuccuugcacagaguaugcauucaauaaaugguagauuaaucuccaauaacugucccaagcuuuguaagucugccagaugguuuuaauuaucccugccuggauagaugaguuuaagugacuuauccaggguuaaacaauucauuaauggcagcacuagugcuucugauuccagggacccaccccagcccaucacccccagucaacuuuauagacuuuuauagaaugagaugcuguguccagcacaagaagagaauucuccuuggugaagguaagagccacaggaugcgaaagaccaugagugaccaugggcuucgguacuggaaacuccucagguuuuccuaagcaaaggauagcuggaccagauguaucugcaacaaucacauuucccuggugaucaaaggucacagcggaggcaguuauuuuggagggaaaguagaggcucagcccaaagguauccacuuggccgacaagcugcauacuugagcuaaacacuuucacccuggugcugcaaaccccaguccccagggccagggggugcuccaggaccgcaauggccccggugagccaagacacugccaccccucggggauugcacagaugagcuugcaaccuuucaguucuccgaaggaccccuuccgcgaagucgacguccaggaggugcagggacccugccuccgcaucaguuaccacaaucccauucugagggguggucuccacaccccaagguaaggagaauuggccuccaaugacaagcuugaucuggccaaaaaaaucaaacacuuugauggagcgaucgccggcgucagugacaaccacauggcagucguuggugauggugacauccacaggguaccuaaugucuugggcagcgucccccuucucuccaaacugaugcgcgcauccucccccugagucaaaaaucuugacacgccuccugccgucgugcaccaccacgacacgccccgucuugggacaaagcgccaguccggugggguugaccagggucccccagccgccgaaggugugguggcaggugagggcuccgggggcgcugggggcggcgcgaugggcggccggggacuggcgaagcgcugagcccaggagcucuaugaggugcagcaccggcaggcagucgcuggugucgcagccccggcaagcucgccugcagaaugggcacucgagggccagagugcgcgggugcgccagggcggccacgcaggccaggcagaccacguggccgcaggacagguugcgcgggcgccgcugcugccgguggccaaacuucucaaagcacaccuugcacucgagcaggcugaucuccgccucgcgcaugagcucaugcagcgcuggcccgcucuccgaggcuucggccgccauggcgcguccugugcacucccgccgcgccgccuggccgugccccagcgacgcucucggucacggucacagucauggucacggggugggacgugcgcccugacgucgagcgccgcgggccucugcacugcgaucugcugccccuuggugggcacgcgcggcacuguuuccugagggccugaugguggacguuugcaagacaaauccacaugcgcguuguguagaccuguaaucgucacagcagucauggauggauuguguacacuuucagaugaggaaacacaccuauugaggacaacaggauugcucccugucacccagccuguaagcggcaaaacaagaacuagaacccaaucuuccagcccgggugccuagcagugucuccaauccgcagcgccgggugcuacggcuguccgggcauaaaacauggucccuuagcucaugaugcuuaugaucugaaccggaaaacacgaacacacuagagaagauaaacuccaagggaggugaggcagauguguacauuucuuuugugucuucugucauacucaua

SEQ ID NO: 20028 - RNA, 2678 nt, Homo sapiens
uaugaguaugacagaagacacaaaagaaauguacacaucugccucaccucccuuggaguuuaucuucucuaguguguucguguuuuccgguucagaucauaagcaucaugagcuaagggaccauguuuuaugcccggacagccguagcacccggcgcugcggauuggagacacugcuaggcacccgggcuggaagauuggguucuaguucuuguuuugccgcuuacaggcugggugacagggagcaauccuguuguccucaauagguguguuuccucaucugaaaguguacacaauccauccaugacugcugugacgauuacaggucuacacaacgcgcauguggauuugucuugcaaacguccaccaucaggcccucaggaaacagugccgcgcgugcccaccaaggggcagcagaucgcagugcagaggcccgcggcgcucgacgucagggcgcacgucccaccccgugaccaugacugugaccgugaccgagagcgucgcuggggcacggccaggcggcgcggcgggagugcacaggacgcgccauggcggccgaagccucggagagcgggccagcgcugcaugagcucaugcgcgaggcggagaucagccugcucgagugcaaggugugcuuugagaaguuuggccaccggcagcagcggcgcccgcgcaaccuguccugcggccacguggucugccuggccugcguggccgcccuggcgcacccgcgcacucuggcccucgagugcccauucugcaggcgagcuugccggggcugcgacaccagcgacugccugccggugcugcaccucauagagcuccugggcucagcgcuucgccaguccccggccgcccaucgcgccgcccccagcgcccccggagcccucaccugccaccacaccuucggcggcugggggacccuggucaaccccaccggacuggcgcuuugucccaagacggggcgugucgugguggugcacgacggcaggaggcgugucaagauuuuugacucagggggaggaugcgcgcaucaguuuggagagaagggggacgcugcccaagacauuagguacccuguggaugucaccaucaccaacgacugccaugugguugucacugacgccggcgaucgcuccaucaaaguguuugauuuuuuuggccagaucaagcuugucauuggaggccaauucuccuuaccuugggguguggagaccaccccucagaaugggauugugguaacugaugcggaggcagggucccugcaccuccuggacgucgacuucgcggaagggguccuucggagaacugaaagguugcaagcucaucugugcaauccccgagggguggcagugucuuggcucaccggggccauugcgguccuggagcacccccuggcccuggggacugggguuugcagcaccagggugaaaguguuuagcucaaguaugcagcuugucggccaaguggauaccuuugggcugagccucuacuuucccuccaaaauaacugccuccgcugugaccuuugaucaccagggaaaugugauuguugcagauacaucugguccagcuauccuuugcuuaggaaaaccugaggaguuuccaguaccgaagcccauggucacucauggucuuucgcauccuguggcucuuaccuucaccaaggagaauucucuucuugugcuggacacagcaucucauucuauaaaagucuauaaaguugacugggggugaugggcuggggugggucccuggaaucagaagcacuagugcugccauuaaugaauuguuuaacccuggauaagucacuuaaacucaucuauccaggcagggauaauuaaaaccaucuggcagacuuacaaagcuugggacaguuauuggagauuaaucuaccauuuauugaaugcauacucugugcaaggaaauuugcaaauauuagcuuauuuaaucuguacuauccagugagguaauuucuucccccccaagauagagucaagcucugucacccaggcuggagugcagaagcaugaucacagcucacuacaguuucaacgucccccgcucaggugguccuuccaccucagccucccaaguagcugggaccacaagugugcauuaccacacucagcuaauuuuuguauuuuggcagagaugggguuucaccauguugcccaggcuggucucaaacuccugaguucaagcaauccaccuuccucggccucccaaaguacuaggaguacaggcauagccacuugcucagccauaauuuuuauuauuaaucucauuguacaagugagaaaacugagacccagagagcuuaagugacuuccucgaggucauaguuacuuacugccuuagucccaauuugaauucaauucugauuccaaauaaguugcgcuuaaauaagacaacagaugugggaaaaauaugugaauguguaguguugcuauguguacugucuuuacaaguagcuaauuauuuuagcacaaagaugugcaaagaaaggagacuuuauggagaguucaggagaaaaaggauuuugugguggccaucacuuucauucaauuugcgacugcucugauggcacauuagaugaaguuacuguugauccugaguuacgugaauaagaaaaacaauugaacugcuuauuaaaaaaguaaacaugucuuuuaacgcc

SEQ ID NO: 20029 - RNA, 2542 nt, Homo sapiens
ccuccggcucagccuagggguugggggcggcggcgcggggcggggcggggcggggcggugacgcggggcuggccgggcaagaggcgcggcggcguggggagggggcgcagucccggguucgaccggccgagccccgcgcgccccgcccgcgcccugcgccuccgcccggccggccggcgggggagggggcaugagccggcgcccgcgcgccgccccgagcugcgggccggccuagagccccgcgcgggccccgcgccggagccaagccgucgccgccgccgccgccaaaccgcgggcgcagcagugggcgccgcgaugcagcggccgggggagccgggcgccgcgcgcuucggcccgcccgagggcugcgcggaccaccggccgcaccgcuaucgcagcuucaugauugaggagauccucacggagccacccgggcccaagggcgccgcgcccgcagccgccgcugccgcggcgggcgagcugcugaaguucggcgugcaggcgcugcuggcggcgcggcccuuccacagccaccuggguacguguggcggccgcggggucgcgggccgggcuuggcgggagacagcgagcugaaccgcgggggcgccccgagccuccuccggcaucgaagcagccccgggaagcugcucugggagcgcagguucugggaccgucucucggagcccuccaggcgggaggcggagggugcaagcuccaggccucacagaaaccaggccucgugcccgcgggccgcccggggaggguguucgcucuuuccuucacugcuucccuucggccuccagcccggggaccccgagugagcauccccagugcaggcgcacugccaggcuacggacucucguggguggaagcgaccucaggccacgggcgccugggcuucgccgcagagggauggccgggaguggccgcggcugcccaacccagggaagucggaccucuggggaggaggccugcgcucccgagggcugggugcugacgcgggcccaagccggcccggaguccccgggagcuccagcgggcgaggaacgcggccuuggccgcagugcggaccugcuucggccuugccuuggggccagaggccugacugugagcagcugccuggcugucccuucugguuucaggucggcugggccucugcagggcuugaacggccugcgcagaccuuuucagcuucugcccuuucuucuaauuuggcggggccugcucugcccugauggugcugucuccaucgcacuccacccucgucuugucuuucccuaucucgcuuuccaaccgucugccggucggccucccucgcuucucucauuggggucggccugccucccaucucccaccuuuucccuacggguccucugccccacauuuaccugcgccuugcccugcccuuuccgacuccagccaggcuaggacucgcaccucagugacaggccugucggggaagggaggcuccuacgcuguagccgggaccccagcccuucaagucgccuucccugcacccccccaccuccuagucggugcucccuagccuggagacggcagggccagcgcgcuccuucuaaguccagcugggacucggccauucggcuaccuuucgucuccaucugcucuguugcuacuaauucguuugaagcgggcacacaaucauuuuaggacugaagaaaauggaaacaucugcauggggaagcgucugaaaauagaaaacgugaacaauaauuuccagguucucaggguacuuuggaauuuccgggaagcacccaacuccggcccagaugacuccuggccaccgcauggcuguugugccacgcacggaagagcaaaugugcacgcuccgugcauguucuuuuucuaacgcagcaaggcugauuugguuggagcaaacgccaucuucuuaggaccagcugccguuuucuuuuugguuucuacuuuccccgaaagacaagacacacuccgaguuucucgcagcugcaaacauguucaucaggaaccccgagaucucagaggcagcugaggccuggggaacuccaggacagaacacggacagggucgaggagauacucccucccaaaucuggggaacggcaacguugaggagggucuccaucugcgccaccggcgccgaccggcagggcguggagguuuugcgcugggaggcacuggccaagcgcgagcacccccgcggcacguggugcggcagucccuggggcagaggagcgcggccguagcucacccggguccucauucucuuucuucgcagccgugcugaaggccgagcaggcggcgguguucaaguucccacuggcgccgcugggcuguucagggcugagcucugcguugcuggcggcagggcccgggcugcccggcgccgcgggugcgccacaccugccgcucgaguugcagcuccgcgggaagcuggaggcggcaggcccuggggagccaggcaccaaagccaagaaggggcgucggagccgcacuguguucaccgagcugcagcugaugggccuggagaaacgcuucgagaagca

SEQ ID NO: 20030 - RNA, 2542 nt, Homo sapiens
ugcuucucgaagcguuucuccaggcccaucagcugcagcucggugaacacagugcggcuccgacgccccuucuuggcuuuggugccuggcuccccagggccugccgccuccagcuucccgcggagcugcaacucgagcggcagguguggcgcacccgcggcgccgggcagcccgggcccugccgccagcaacgcagagcucagcccugaacagcccagcggcgccagugggaacuugaacaccgccgccugcucggccuucagcacggcugcgaagaaagagaaugaggacccgggugagcuacggccgcgcuccucugccccagggacugccgcaccacgugccgcgggggugcucgcgcuuggccagugccucccagcgcaaaaccuccacgcccugccggucggcgccgguggcgcagauggagacccuccucaacguugccguuccccagauuugggagggaguaucuccucgacccuguccguguucuguccuggaguuccccaggccucagcugccucugagaucucgggguuccugaugaacauguuugcagcugcgagaaacucggagugugucuugucuuucggggaaaguagaaaccaaaaagaaaacggcagcugguccuaagaagauggcguuugcuccaaccaaaucagccuugcugcguuagaaaaagaacaugcacggagcgugcacauuugcucuuccgugcguggcacaacagccaugcgguggccaggagucaucugggccggaguugggugcuucccggaaauuccaaaguacccugagaaccuggaaauuauuguucacguuuucuauuuucagacgcuuccccaugcagauguuuccauuuucuucaguccuaaaaugauugugugcccgcuucaaacgaauuaguagcaacagagcagauggagacgaaagguagccgaauggccgagucccagcuggacuuagaaggagcgcgcuggcccugccgucuccaggcuagggagcaccgacuaggaggugggggggugcagggaaggcgacuugaagggcuggggucccggcuacagcguaggagccucccuuccccgacaggccugucacugaggugcgaguccuagccuggcuggagucggaaagggcagggcaaggcgcagguaaauguggggcagaggacccguagggaaaaggugggagaugggaggcaggccgaccccaaugagagaagcgagggaggccgaccggcagacgguuggaaagcgagauagggaaagacaagacgaggguggagugcgauggagacagcaccaucagggcagagcaggccccgccaaauuagaagaaagggcagaagcugaaaaggucugcgcaggccguucaagcccugcagaggcccagccgaccugaaaccagaagggacagccaggcagcugcucacagucaggccucuggccccaaggcaaggccgaagcagguccgcacugcggccaaggccgcguuccucgcccgcuggagcucccggggacuccgggccggcuugggcccgcgucagcacccagcccucgggagcgcaggccuccuccccagagguccgacuucccuggguugggcagccgcggccacucccggccaucccucugcggcgaagcccaggcgcccguggccugaggucgcuuccacccacgagaguccguagccuggcagugcgccugcacuggggaugcucacucgggguccccgggcuggaggccgaagggaagcagugaaggaaagagcgaacacccuccccgggcggcccgcgggcacgaggccugguuucugugaggccuggagcuugcacccuccgccucccgccuggagggcuccgagagacggucccagaaccugcgcucccagagcagcuucccggggcugcuucgaugccggaggaggcucggggcgcccccgcgguucagcucgcugucucccgccaagcccggcccgcgaccccgcggccgccacacguacccagguggcuguggaagggccgcgccgccagcagcgccugcacgccgaacuucagcagcucgcccgccgcggcagcggcggcugcgggcgcggcgcccuugggcccggguggcuccgugaggaucuccucaaucaugaagcugcgauagcggugcggccggugguccgcgcagcccucgggcgggccgaagcgcgcggcgcccggcucccccggccgcugcaucgcggcgcccacugcugcgcccgcgguuuggcggcggcggcggcgacggcuuggcuccggcgcggggcccgcgcggggcucuaggccggcccgcagcucggggcggcgcgcgggcgccggcucaugcccccucccccgccggccggccgggcggaggcgcagggcgcgggcggggcgcgcggggcucggccggucgaacccgggacugcgcccccuccccacgccgccgcgccucuugcccggccagccccgcgucaccgccccgccccgccccgccccgcgccgccgcccccaaccccuaggcugagccggagg

SEQ ID NO: 20031 - RNA, 2601 nt, Homo sapiens
cucggccaguuacaaaagaaauggucaggaucuggacaacgauaaugauaguauuaauccuccuauuaagaaucggcccaaacaaacccucgcugucagggcgacaggcgcccgcccaagcccagaccucggaccugguuccaagccuguucccgcugggucucugggcgcccgguuucugcaccuggagcucgcccgaugaggacaaggucuggaggccggccugggaacaggggccgaagggcgagccggacccuaggggauugguagggucggggagaagggguccaggcuaggggcgggcggggcgcacggagaccaggcggcuugagcgggagguggggagcuggaggagugccggguucgcgggcgggggacggggagaggggggcggggagaggggcgggagucgggggcggcgaggggaggggcggagcgcgggucccgccccggcgggccgcuggaaaaguuuagucucugacucgcucgggcagaggccgaggaagccgguuccggggacgggcaacagggacucagggaccagaaggcggcugcaggacgcgaccgagcaggaccccaggcccgggaacgacgucgcgagcgcugagacugccgggccucccagcccaucuggcauucgagcgcaggaccgggcgccccggcaccgccgcgcgccacccgcuaggaugccgguggccccagcgcccucagccgacggaggugagaggcgggcccgggcggggcgcggaaccaggguggggggcugggggccgaaggacccaccuuuccaacaaaauccccaccgaucccgggcgcgacggggacuugggcgcgccacggcggccggagcgcuccacaucagcaccccucccccagagccgcugcaggaacagggaggaggccuuuuccaccgcacccggagcguuuacaacgggcuggagcugaauaccuggaugaaaguggagaggcuguucguggagaaguuccaucagucguuuuccuuggacaauuaacaaguuaggcuuccacagugccagggccuggggaugcuggacgugggagaggguuguggucguuagccugggaaaaucauucuuuuaaacaauauucgccggaaaauuaguuuuuuccuaacauuucucaaacaaggcaauuagggccgucagaaucggugcuggaagacgaaguccccacagugcaauaaugagguucccacggaaaaucaguacguuguguucguaacugagauaacagcuagagaaggggcuuugggcuuuuugagucucccaauagucagucucucucucucucucucucucucucuuccucugacuuucuggcuuuggacacucccaaugguauauuucuuugugguguuuuuauauuuggauauaagagaggaacuucuuguuggauuuuuaagggaacacacuucguuuugacccuuccaauaaggaaaggggagcuacaggaacagagagcucuuuagaagguuacuuuuaaauggaggcccccccauucaugguacccacucccacuuggaccucugagaccuccagaauuaggcaucauucuaaaaucuggacauuagaagucacagacuuuguauauaaccacauauucauaauuuaucuuuucaauguuuuuuauucauagaugaaaaucuugcaggcauaguuaagaaaaauauaauuccuagaaaguacaagggaaggauuaugcucugcagauacaugacuaacaaggauagcuggccaugcccagggcugguguugguugaggagguggugauggugcggggcaugugugugugugugugugugugcgcuugaggaguuguggaaguguucauaucuguaaaguauuauuucauggaugcagaccuuaaugcuagguugaauaacuuuguugccauagaagaagaaccgcacgucaggcuuuuuucauuagcaaaccaguaagcacucacuuugggccucugaaaucacuuccaucaccuaacaccagagauacaaacugaagcuagcccuuaagagccucccccuaagauuuagagagaaugauuucucaaccaguuuucaucuuugaaagugccauuucucccuuuaucauugugauuuuuauucaaaugcaugagucucugauuuucuaccauauacaaaggguagagacuacaguuuccuauagaagaaacuucacauaguggccgaaggaucuuauuucucaaaauucaggaacugguuuccucuuucuggaaauuaugacauuaacuugauuucaugguaucucuuucaucuuccucaaugccugugcuguauguauauuuuuauuauauacuguagguauauuuuuauuaccaaaaaaaggagaauuugagcaugccacaaucuugaaaaaucugagguugcccugcuguagaacccuuuaacugccaggacuuuguacuguuucccaaguguuaccagagccaggccgccagccuuaugcagucuguuuaccuuagcuggaaccagggugcugugcuguggguucuaugaaacuuucuguuucuucauauuuggcuuuguaauuccuuucuuaucaguuuuggaggcauuuccu

SEQ ID NO: 20032 - RNA, 2601 nt, Homo sapiens
aggaaaugccuccaaaacugauaagaaaggaauuacaaagccaaauaugaagaaacagaaaguuucauagaacccacagcacagcacccugguuccagcuaagguaaacagacugcauaaggcuggcggccuggcucugguaacacuugggaaacaguacaaaguccuggcaguuaaaggguucuacagcagggcaaccucagauuuuucaagauuguggcaugcucaaauucuccuuuuuuugguaauaaaaauauaccuacaguauauaauaaaaauauacauacagcacaggcauugaggaagaugaaagagauaccaugaaaucaaguuaaugucauaauuuccagaaagaggaaaccaguuccugaauuuugagaaauaagauccuucggccacuaugugaaguuucuucuauaggaaacuguagucucuacccuuuguauaugguagaaaaucagagacucaugcauuugaauaaaaaucacaaugauaaagggagaaauggcacuuucaaagaugaaaacugguugagaaaucauucucucuaaaucuuagggggaggcucuuaagggcuagcuucaguuuguaucucugguguuaggugauggaagugauuucagaggcccaaagugagugcuuacugguuugcuaaugaaaaaagccugacgugcgguucuucuucuauggcaacaaaguuauucaaccuagcauuaaggucugcauccaugaaauaauacuuuacagauaugaacacuuccacaacuccucaagcgcacacacacacacacacacacaugccccgcaccaucaccaccuccucaaccaacaccagcccugggcauggccagcuauccuuguuagucauguaucugcagagcauaauccuucccuuguacuuucuaggaauuauauuuuucuuaacuaugccugcaagauuuucaucuaugaauaaaaaacauugaaaagauaaauuaugaauaugugguuauauacaaagucugugacuucuaauguccagauuuuagaaugaugccuaauucuggaggucucagagguccaagugggaguggguaccaugaaugggggggccuccauuuaaaaguaaccuucuaaagagcucucuguuccuguagcuccccuuuccuuauuggaagggucaaaacgaaguguguucccuuaaaaauccaacaagaaguuccucucuuauauccaaauauaaaaacaccacaaagaaauauaccauugggaguguccaaagccagaaagucagaggaagagagagagagagagagagagagagacugacuauugggagacucaaaaagcccaaagccccuucucuagcuguuaucucaguuacgaacacaacguacugauuuuccgugggaaccucauuauugcacuguggggacuucgucuuccagcaccgauucugacggcccuaauugccuuguuugagaaauguuaggaaaaaacuaauuuuccggcgaauauuguuuaaaagaaugauuuucccaggcuaacgaccacaacccucucccacguccagcauccccaggcccuggcacuguggaagccuaacuuguuaauuguccaaggaaaacgacugauggaacuucuccacgaacagccucuccacuuucauccagguauucagcuccagcccguuguaaacgcuccgggugcgguggaaaaggccuccucccuguuccugcagcggcucugggggaggggugcugauguggagcgcuccggccgccguggcgcgcccaaguccccgucgcgcccgggaucgguggggauuuuguuggaaagguggguccuucggcccccagccccccacccugguuccgcgccccgcccgggcccgccucucaccuccgucggcugagggcgcuggggccaccggcauccuagcggguggcgcgcggcggugccggggcgcccgguccugcgcucgaaugccagaugggcugggaggcccggcagucucagcgcucgcgacgucguucccgggccugggguccugcucggucgcguccugcagccgccuucuggucccugagucccuguugcccguccccggaaccggcuuccucggccucugcccgagcgagucagagacuaaacuuuuccagcggcccgccggggcgggacccgcgcuccgccccuccccucgccgcccccgacucccgccccucuccccgccccccucuccccgucccccgcccgcgaacccggcacuccuccagcuccccaccucccgcucaagccgccuggucuccgugcgccccgcccgccccuagccuggaccccuucuccccgacccuaccaauccccuaggguccggcucgcccuucggccccuguucccaggccggccuccagaccuuguccucaucgggcgagcuccaggugcagaaaccgggcgcccagagacccagcgggaacaggcuuggaaccagguccgaggucugggcuugggcgggcgccugucgcccugacagcgaggguuuguuugggccgauucuuaauaggaggauuaauacuaucauuaucguuguccagauccugaccauuucuuuuguaacuggccgag

SEQ ID NO: 20033 - RNA, 2538 nt, Homo sapiens
augugugcaugugcgaggguacaugugugcaucugugugugucccacacacaacccagaugggggcugacgcacaccagugaugaauaacucgcuuuggccacacggaugcugcuggggugggugggggcaggccuguguugagcaggauguggggcaacagggguuguguggccuuggcaauaggccaccagagcucugcuuuuaggagaaaaugggguguugguagacaacaccccuccaggcuggagggcaaaggagguguucuggggugagcugugcuucuccccaggcggggccuuaucccaaagccagcuccuucaccaggccaagccggccacuugcccagagcuccucccaugaucucagccccccuggggcagggcugggacaaugggugggccgccugccugcugagccugugccggccucuccugugacugaccugcaggacacgagagcuugucucucgcguccaucccuccaggccuggcugcuggccagugcugcaguaccaugccauggaugcccagccaucucauccucuccuccagaagcccccaggucagaguccccaccuggcugcccucccagugugcgggugaggccagcccaagcggggucccucagaccugcccuccucuuugccucaguuuccucaagaagaaccuguucccaucugccagcagggagaggaggccuaggaaccagaugggcaccuucccuagaagaagaguauuacggggggguuaaaggauuccaggauggggcugugaggaaccccucgguuuccuuuuuccaccacccugggccgccagccccagagcaggugguccauccccucccccagcucagcgggagacaacagcuggggggcggggugaggggcggcccagcuccucccccaucagggaccgagugccccuugcugggggccgguggaucuguucaccccuucagccgucuuugggggcucccuccacacuuguucuccagagggcuuccucccagggaucucagcuggccccuuaggcagcucggugccccccagcccagcugccuaguccccgcaguccccuucagguaggggaggagagcucaccccugccuccuccgcgacccgcggcgguaagggagucacuucgcggucgccauguggcagcaaacauccuuccaccucacuccagcccagguuucggggggagggcggcccacuccgagaggccccccggugggcggggcgcccggcccccagcccgcuccgcuccucccccgcccucgcuuuccuuugugcuguggccgggccgggcugagccgggcaggcugcgcuggcuccgcuagcucgguccccgccccguccccgcccggaccucgcccgcucgaagguggcgaaggugcccuuggccgccccgugcacaccugucccccgggcccgggggguagggugggggaugggcucccgcagggccacgcggccccgggccccacaucgggaccccgcgccuccgggccgcguccggccgccgcucccaccgcgcgccuugggccgccuccgggcgcucggggcccggcagugccccgccuggcccgccggccccucccccggcgcgcacaaaggcagccccucccggcccucccggcccgcugcaccauuucggggucccccucccuucccggcggcggggcggcggggcgggagagaaacaaaggcgcggcggcggcgcggggacaaaggggccgggggcgggggcggggggcucaccagucggccgcgcucuccucucggaucaccuccucguaagccgccagcagcuccaggcgguggccgcugaagcugacgccggccaugcuucgggccggaccgggccgaacggacagacgcgcggacggacgggcggacggaggaggagggagggaaagagggagucgccgccgccgccucggagccucugcagcgucgcgagccgagcgagccagcggccgggggaggggagccggccggcggggggcggggggcgcuggcuccgcccggcucgcucccuccgcucgcucgguccuagcgccgccccggcccggcccagggggaggcccgcccccccuucccggccugccccgggcgccccucacccaccgccccugcgcgccgcuccagggccagccccacccacgucccgaacccucaccugccccguccguaaccucggcgcuagcccuccuuccagccccgaacccagucccguccccaccuccccccgcccaccccccgucccaauccgguuccgccccacccauugcuucauugaucuccauuccuggugcgucccaccucauguuaaacccauuuucaucccaacccagcucacacaacaccccaccccuggcccgucuccuuucccugagagguccuugccuagucuaucccaucauauccacugucaucugcaucccacccucaaauccaccccaguugcuuucccaucccagcuucagccccaugcuuagcacgugucccccccaacaugugucacggcacaucuuc

SEQ ID NO: 20034 - RNA, 2538 nt, Homo sapiens
gaagaugugccgugacacauguugggggggacacgugcuaagcauggggcugaagcugggaugggaaagcaacugggguggauuugagggugggaugcagaugacaguggauaugaugggauagacuaggcaaggaccucucagggaaaggagacgggccaggggugggguguugugugagcuggguugggaugaaaauggguuuaacaugaggugggacgcaccaggaauggagaucaaugaagcaauggguggggcggaaccggauugggacggggggugggcggggggagguggggacgggacuggguucggggcuggaaggagggcuagcgccgagguuacggacggggcaggugaggguucgggacguggguggggcuggcccuggagcggcgcgcaggggcggugggugaggggcgcccggggcaggccgggaagggggggcgggccucccccugggccgggccggggcggcgcuaggaccgagcgagcggagggagcgagccgggcggagccagcgccccccgccccccgccggccggcuccccucccccggccgcuggcucgcucggcucgcgacgcugcagaggcuccgaggcggcggcggcgacucccucuuucccucccuccuccuccguccgcccguccguccgcgcgucuguccguucggcccgguccggcccgaagcauggccggcgucagcuucagcggccaccgccuggagcugcuggcggcuuacgaggaggugauccgagaggagagcgcggccgacuggugagccccccgcccccgcccccggccccuuuguccccgcgccgccgccgcgccuuuguuucucucccgccccgccgccccgccgccgggaagggagggggaccccgaaauggugcagcgggccgggagggccgggaggggcugccuuugugcgcgccgggggaggggccggcgggccaggcggggcacugccgggccccgagcgcccggaggcggcccaaggcgcgcggugggagcggcggccggacgcggcccggaggcgcggggucccgauguggggcccggggccgcguggcccugcgggagcccaucccccacccuaccccccgggcccgggggacaggugugcacggggcggccaagggcaccuucgccaccuucgagcgggcgagguccgggcggggacggggcggggaccgagcuagcggagccagcgcagccugcccggcucagcccggcccggccacagcacaaaggaaagcgagggcgggggaggagcggagcgggcugggggccgggcgccccgcccaccggggggccucucggagugggccgcccuccccccgaaaccugggcuggagugagguggaaggauguuugcugccacauggcgaccgcgaagugacucccuuaccgccgcgggucgcggaggaggcaggggugagcucuccuccccuaccugaaggggacugcggggacuaggcagcugggcuggggggcaccgagcugccuaaggggccagcugagaucccugggaggaagcccucuggagaacaaguguggagggagcccccaaagacggcugaaggggugaacagauccaccggcccccagcaaggggcacucggucccugaugggggaggagcugggccgccccucaccccgccccccagcuguugucucccgcugagcugggggaggggauggaccaccugcucuggggcuggcggcccagggugguggaaaaaggaaaccgagggguuccucacagccccauccuggaauccuuuaacccccccguaauacucuucuucuagggaaggugcccaucugguuccuaggccuccucucccugcuggcagaugggaacagguucuucuugaggaaacugaggcaaagaggagggcaggucugagggaccccgcuugggcuggccucacccgcacacugggagggcagccagguggggacucugaccugggggcuucuggaggagaggaugagauggcugggcauccauggcaugguacugcagcacuggccagcagccaggccuggagggauggacgcgagagacaagcucucguguccugcaggucagucacaggagaggccggcacaggcucagcaggcaggcggcccacccauugucccagcccugccccaggggggcugagaucaugggaggagcucugggcaaguggccggcuuggccuggugaaggagcuggcuuugggauaaggccccgccuggggagaagcacagcucaccccagaacaccuccuuugcccuccagccuggagggguguugucuaccaacaccccauuuucuccuaaaagcagagcucugguggccuauugccaaggccacacaaccccuguugccccacauccugcucaacacaggccugcccccacccaccccagcagcauccguguggccaaagcgaguuauucaucacuggugugcgucagcccccaucuggguugugugugggacacacacagaugcacacauguacccucgcacaugcacacau

SEQ ID NO: 20035 - RNA, 2529 nt, Homo sapiens
agagcuguaaguguauaaacuccagguugacagaagcauuuauuucucugggauuuaaaaaaauaauguaccguuguagauagauuuuuaacuccuucccaauaaggcccuuguagagauaauuuuuaaaucccagagaaacacauuauaguuagauaauuuaaauuccccaaauaacaccacuguaaauggauuuugagaaaauuccggagaaacgcgccauuuuggauugacuuuuuaaaaucuccggaagaauaauguugcauguagauauuuuaaauuccagaccuacacuucguacguuaauucuuucagaaucgaaagauacaguuaaaauuaauucauccucauagauuugguucaaaaaaaucaauauacgauuauauaucucucuagguuuuaaaaauaaaaccaaccaaagaccgcgcuuaaaacuuuugaaaacaaaaguagaguucagcguugauuauguuuuaaccaagcaaacaaccucucagaaaaaucacuuagggaugcaaaagagaaacagauacuaagaaaguggagagaaacauucagcuguguauuaagaaaugaacgcagaagaggcgcccacaccggggagcucggagccccuccggaacccggccggcugcgcugggcagcggauucgcugccccacugcccgcgccggccacccgcgggcccaguucgcugcuggaaaaaagcuccagcucggacaaaaaaaggcagcgcggagggagacgcgcaggagccggggcgggggccagagccgggcugcuccgggcuucggccgcgcacgugggccggaucccuugaucggcguuccggcuggccuugcugggaguccggccgcgccuguuggcccgcucgcccucaccguccucugugucucccuucuacuugaugaccccucuccccccguuuacccuucccgcccgccccuucucuuuggucucuuucauucugucgccuacugucacgguguuaaccucccucucugucucucugagugcguucucucgcccgucaccccucuuccuuucucggucuccuccucucccuucguccgagccgcuccuuagcgcccaguugcgcaaaucaaauucuuucccguucuauuuacuccugaucaagaggggcugucaguccaacccuccagcuguaggcucgugcaucugccagucucuuggcgcguggggaccgcguggaagugccuucgcgugugcguaaguuuccgcguucaccgucaggucgagaacgggaaaaagaaagcuccugacgcuucuggggcggagagggagcuugguugcgcggcgcgggcgucaggcccugcucccagcuccccgugcuccgcgcccggguaggcucugugcgcgccgcgcggggaacggcgcuuaccuggcagcuccgugucagacgacucgcuggcggaguucucgagcggcucgcgggggucggcgggccgggccagguggaaggcgggccccaugucaugggguggcggcggcggcggccggagccccuccggcagccgcuccaggcucaugccccccuugaaggcguccauggagguggggaccgcggcgggcgcuccaggggccggggcugggcgcgccccgccgcccuggcugcgaccugcggggacaagagcgcagcgccuaagcggcugcccuccagggcugccggcgccugcagcgacgccgugcccgccccauggaccgcccggggcugcggcgccgggcgggcagaggcggcggcagcuucucgcgacugggcgccuggcucagcgcuccgcgcugcgcuccugccgcucgggccucagcagcccggccggccccggcuccggcuccggcuccggcucgcgauccggggccgguuucuaaggcuccggacggcgccggcagagucugucuuaaagcgacagcgcgcacagccagguuccagcagucccugcgccaggggugcuggguggggugggccugggugggagggggcuggggagggagcgagcgagcgagggagcgcgggcggaauccagccccaagccgcccgcgccgccgcgcccucacugccgcccucccucccucccugccucgcccgcgcccucccccuccgcagccaccuucccgccgccuccccgccccccgcggccucgccgcgccucucccuccuuccccggugacacaccgaguucucccucggccucacaaaagaaacgcaucuggccugcgagucccgggcggcucgugcacaccucaggccucaaaugacuuguuucgccuagaaucaacucccgucucggccgccucgaaguccccagcccuggcgagaacagcccaggaugagugaauguuugccgaacaggaucgcaccgagcgggcgccuucgagccagcgccggggcgggggcagagcccggggcccguuccggcagcucccagcgguguccucgucgaggggccgccugccccuccuucuccagccucuucucccgggaacucagcccggcugagugacagcagccugc

SEQ ID NO: 20036 - RNA, 2529 nt, Homo sapiens
gcaggcugcugucacucagccgggcugaguucccgggagaagaggcuggagaaggaggggcaggcggccccucgacgaggacaccgcugggagcugccggaacgggccccgggcucugcccccgccccggcgcuggcucgaaggcgcccgcucggugcgauccuguucggcaaacauucacucauccugggcuguucucgccagggcuggggacuucgaggcggccgagacgggaguugauucuaggcgaaacaagucauuugaggccugaggugugcacgagccgcccgggacucgcaggccagaugcguuucuuuugugaggccgagggagaacucggugugucaccggggaaggagggagaggcgcggcgaggccgcggggggcggggaggcggcgggaagguggcugcggagggggagggcgcgggcgaggcagggagggagggagggcggcagugagggcgcggcggcgcgggcggcuuggggcuggauuccgcccgcgcucccucgcucgcucgcucccuccccagcccccucccacccaggcccaccccacccagcaccccuggcgcagggacugcuggaaccuggcugugcgcgcugucgcuuuaagacagacucugccggcgccguccggagccuuagaaaccggccccggaucgcgagccggagccggagccggagccggggccggccgggcugcugaggcccgagcggcaggagcgcagcgcggagcgcugagccaggcgcccagucgcgagaagcugccgccgccucugcccgcccggcgccgcagccccgggcgguccauggggcgggcacggcgucgcugcaggcgccggcagcccuggagggcagccgcuuaggcgcugcgcucuuguccccgcaggucgcagccagggcggcggggcgcgcccagccccggccccuggagcgcccgccgcgguccccaccuccauggacgccuucaaggggggcaugagccuggagcggcugccggaggggcuccggccgccgccgccgccaccccaugacauggggcccgccuuccaccuggcccggcccgccgacccccgcgagccgcucgagaacuccgccagcgagucgucugacacggagcugccagguaagcgccguuccccgcgcggcgcgcacagagccuacccgggcgcggagcacggggagcugggagcagggccugacgcccgcgccgcgcaaccaagcucccucuccgccccagaagcgucaggagcuuucuuuuucccguucucgaccugacggugaacgcggaaacuuacgcacacgcgaaggcacuuccacgcgguccccacgcgccaagagacuggcagaugcacgagccuacagcuggaggguuggacugacagccccucuugaucaggaguaaauagaacgggaaagaauuugauuugcgcaacugggcgcuaaggagcggcucggacgaagggagaggaggagaccgagaaaggaagaggggugacgggcgagagaacgcacucagagagacagagagggagguuaacaccgugacaguaggcgacagaaugaaagagaccaaagagaaggggcgggcgggaaggguaaacggggggagaggggucaucaaguagaagggagacacagaggacggugagggcgagcgggccaacaggcgcggccggacucccagcaaggccagccggaacgccgaucaagggauccggcccacgugcgcggccgaagcccggagcagcccggcucuggcccccgccccggcuccugcgcgucucccuccgcgcugccuuuuuuuguccgagcuggagcuuuuuuccagcagcgaacugggcccgcggguggccggcgcgggcaguggggcagcgaauccgcugcccagcgcagccggccggguuccggaggggcuccgagcuccccggugugggcgccucuucugcguucauuucuuaauacacagcugaauguuucucuccacuuucuuaguaucuguuucucuuuugcaucccuaagugauuuuucugagagguuguuugcuugguuaaaacauaaucaacgcugaacucuacuuuuguuuucaaaaguuuuaagcgcggucuuugguugguuuuauuuuuaaaaccuagagagauauauaaucguauauugauuuuuuugaaccaaaucuaugaggaugaauuaauuuuaacuguaucuuucgauucugaaagaauuaacguacgaaguguaggucuggaauuuaaaauaucuacaugcaacauuauucuuccggagauuuuaaaaagucaauccaaaauggcgcguuucuccggaauuuucucaaaauccauuuacagugguguuauuuggggaauuuaaauuaucuaacuauaauguguuucucugggauuuaaaaauuaucucuacaagggccuuauugggaaggaguuaaaaaucuaucuacaacgguacauuauuuuuuuaaaucccagagaaauaaaugcuucugucaaccuggaguuuauacacuuacagcucu

SEQ ID NO: 20037 - RNA, 2489 nt, Homo sapiens
gaaagacucucccacugccccuaccucaacagguagcugcggauccggggcuaauucccuacuaaaaagucuuaauuggcuuauggggagccugaaagaucucccuuguguuuacaaggugaaaggaaugauagaucccaaaugcccuagucugucuuuauccauuucuugguggaaaucaggugcguuuuauuuuuuaauuguuuuugaaacaggaacagaggcuuuggaggugagugggauaguguuucacuuuagugguugagccagcagggaaaagcaagaaaagccccagagacacuaauauuaggcaagaaacuuggcgacuuauuuuuaguuuuuauuuacaugaagcgucugcaguacaaaaauguaaacuuugauagcucauaauagaauaaacucuuuauguacaaaaauacauuuucauaugaaugaagcaucuugaauaaauuaaaguacucuccagcccugugccugaauagcuaagcaagagucuccaguucuuccuagagcgagucugcaguggugggggucgggauccauaaugcaugaagcccacuccuugucucugcuuuuuaagccuuuucauuguauugucagccggcucaaaccgaauuuucaugcucguuuuucuucauuagaguucuacaaauuguaaaauugacuuuucaccucgucuucaggggcugaucugucccuuuucuaaaucacacugaagugguggcuggggucaguucugagccagucacaaaggagguuuuguggaguucagaaagugcaaaaggaaaggccgucuaggggcgggcaggaggggcgcugggcugagggccggagaaacagaccaagagacauccgccgcgagggugcggcgaccuaacaagcggcucagguauccccgacugcuuuaaagcucccgcuuccucccuccgccuggagagggggucccgaggcggcagcuggggccccaucuauugccugcugacuaggggagggggaaaguaacagugucuacaaagggccuagugguaaggaaugaaacagggcguuguguggagcaagucuuugggcaggcuugggaaggagaaaacagggucgccggggcgguaggugaagucuucggaggcggcugggcuacuggggucagagagcggggaggcggcggcggcaccugagccccaggacuccgcgucgcuggcggggcuugggggaccgggcaggcaggggacgcacugcggcggcaggaggcgcucccgggcaccgccuccgggcagcccuugauccgccaggcgcagugucucggccagagcccagauguaguuguaggcgaagcgcagcgucucgauuuuggugagcuuggugucgucggggaacgagggcagcacgcugcgcagugcguccagggccgcguucaaguugugcaugcgguugcgcucgcgaucguuggccuugacgcgccggcuccugcgcagcgagugcagcagcgccucggagcggacccgcguccggccgcggcgccgccgccucuccugcucgucguccugugccccuggaaccucagacgcccgggagauauugggcgcgccccugcgggccggcgcgggcggccccgaagcggaggcugccuguuggagucuggcacagucuuccucgucggugaggaagccggauaggucacugccgcugcugcuggcgcagucgaggucggagaugcaggucucaaggcgggcuggcaucguugcgcugugcaggaccgacggacagauagaaaggcgcucagagcgcugcagcccggacugagggcagagccgccagggcgcacuuacguucccaacagccugggguuguuacucugugccaguugcgggugcgagagccuggaagggugcaggggcgcacggagaacuuggccuggccuccucgccucgccugcaggggccacgcgcccggccggucuccugagugaugucgccggcgaucagaucagcucgugugagcaccgaguguggcacacgacuggccucaggaccccuuaaguacccggcgcaacaaugggcgccccccucccuugccaccuccgcccccgcggcagcccgggugaauggagcgaggcggcaggucauccccgugcagcgcccggguauuugcauaauuuaugcucgcgggaggccgccaucgccccucccccaacccggagugugcccguaauuaccgccggccaaucggcggcgucgcgcggccccgggagucggcucgggcuaagcuggccagggcgucuccaggcagugaaacagaggcggggucggcgggcgauuagcggccgaggcacgcuccucuuggggcgggcugggcgccccucgcuggggugggacggggaggcggggcgcgagcgcgaaagugugagccgcccagugaguugcggaaaccuggaggguacuuggaguuuggguucgcauccccucuccagcugcuuaguggucgcgugacuu

SEQ ID NO: 20038 - RNA, 2489 nt, Homo sapiens
aagucacgcgaccacuaagcagcuggagaggggaugcgaacccaaacuccaaguacccuccagguuuccgcaacucacugggcggcucacacuuucgcgcucgcgccccgccuccccgucccaccccagcgaggggcgcccagcccgccccaagaggagcgugccucggccgcuaaucgcccgccgaccccgccucuguuucacugccuggagacgcccuggccagcuuagcccgagccgacucccggggccgcgcgacgccgccgauuggccggcgguaauuacgggcacacuccggguugggggaggggcgauggcggccucccgcgagcauaaauuaugcaaauacccgggcgcugcacggggaugaccugccgccucgcuccauucacccgggcugccgcgggggcggagguggcaagggaggggggcgcccauuguugcgccggguacuuaagggguccugaggccagucgugugccacacucggugcucacacgagcugaucugaucgccggcgacaucacucaggagaccggccgggcgcguggccccugcaggcgaggcgaggaggccaggccaaguucuccgugcgccccugcacccuuccaggcucucgcacccgcaacuggcacagaguaacaaccccaggcuguugggaacguaagugcgcccuggcggcucugcccucaguccgggcugcagcgcucugagcgccuuucuaucuguccgucgguccugcacagcgcaacgaugccagcccgccuugagaccugcaucuccgaccucgacugcgccagcagcagcggcagugaccuauccggcuuccucaccgacgaggaagacugugccagacuccaacaggcagccuccgcuucggggccgcccgcgccggcccgcaggggcgcgcccaauaucucccgggcgucugagguuccaggggcacaggacgacgagcaggagaggcggcggcgccgcggccggacgcggguccgcuccgaggcgcugcugcacucgcugcgcaggagccggcgcgucaaggccaacgaucgcgagcgcaaccgcaugcacaacuugaacgcggcccuggacgcacugcgcagcgugcugcccucguuccccgacgacaccaagcucaccaaaaucgagacgcugcgcuucgccuacaacuacaucugggcucuggccgagacacugcgccuggcggaucaagggcugcccggaggcggugcccgggagcgccuccugccgccgcagugcguccccugccugcccggucccccaagccccgccagcgacgcggaguccuggggcucaggugccgccgccgccuccccgcucucugaccccaguagcccagccgccuccgaagacuucaccuaccgccccggcgacccuguuuucuccuucccaagccugcccaaagacuugcuccacacaacgcccuguuucauuccuuaccacuaggcccuuuguagacacuguuacuuucccccuccccuagucagcaggcaauagauggggccccagcugccgccucgggacccccucuccaggcggagggaggaagcgggagcuuuaaagcagucggggauaccugagccgcuuguuaggucgccgcacccucgcggcggaugucucuuggucuguuucuccggcccucagcccagcgccccuccugcccgccccuagacggccuuuccuuuugcacuuucugaacuccacaaaaccuccuuugugacuggcucagaacugaccccagccaccacuucagugugauuuagaaaagggacagaucagccccugaagacgaggugaaaagucaauuuuacaauuuguagaacucuaaugaagaaaaacgagcaugaaaauucgguuugagccggcugacaauacaaugaaaaggcuuaaaaagcagagacaaggagugggcuucaugcauuauggaucccgacccccaccacugcagacucgcucuaggaagaacuggagacucuugcuuagcuauucaggcacagggcuggagaguacuuuaauuuauucaagaugcuucauucauaugaaaauguauuuuuguacauaaagaguuuauucuauuaugagcuaucaaaguuuacauuuuuguacugcagacgcuucauguaaauaaaaacuaaaaauaagucgccaaguuucuugccuaauauuagugucucuggggcuuuucuugcuuuucccugcuggcucaaccacuaaagugaaacacuaucccacucaccuccaaagccucuguuccuguuucaaaaacaauuaaaaaauaaaacgcaccugauuuccaccaagaaauggauaaagacagacuagggcauuugggaucuaucauuccuuucaccuuguaaacacaagggagaucuuucaggcuccccauaagccaauuaagacuuuuuaguagggaauuagccccggauccgcagcuaccuguugagguaggggcagugggagagucuuuc

SEQ ID NO: 20039 - RNA, 3634 nt, Homo sapiens
gcauaucugguuuuaaaguguugauuuaagccagccgggcaugguggcucacgccuguaaucccagcacuuugggaggccaaggcggguggaucacaaggucaagagaucgagaccauccuggccaacguagugaaaccccaucucuacuaaaaauacaaaaacuagcugggcaugguggcgcacgccuguagucccagcuacucgggaggcugaggcaggagaaucgcuugaaccagggagguagagguugcagugagccaagacugcgccaccacauuccagccuggcaacagagcgagagacugucucaaaaaaaugaaaaacuaaaguguuaauuuaagagaacuaggaugcauuggcugcuuaaguaaacugcuucuaaaaaugaauagccuaagcuacaagcaggagaauuuuuuuuuucucuuuguguauacauggggucucacuauguugcccaggcugaucucaaacuccugagcucaagcaauccuccagccucggccucccaaagggcugggauuacaggcaugcaccaccaagcccgacccaagcagaagaauuccuaaguggcugguagucuuggccucuaucaagguuuggaggcacauugccauuaugaccuuaucccucuacacuaugaccucacuagaaucaagacagcagcagccauaucucaguccagaagaccacaauuagggaacuucagaaaacacacacacacacacacacacacaauuauacauauaaaauccuuaaaucaagaacaaccaaauauauuacuuuuuaugagaugaaugauagccaucuucuauuaacacuaccaauuagccugaccaaaaaaagguauuaauguagaugccaauuaguguggccucacugaaauauaacuuagaucgaaauuaacugagcguaauaugaaauggcaccaaguaucacugauuuaacaccuggugaaauaaaaaauuguguuauuucauguucuguucuucagauaaccaaacaguaucuuucacuuuggcuucuuaaaaauuaggguucacaggccaggugugguggcucacacuuguaaucccagcacuuugggaggcagaggugggcagaucacgaggucaggaguuccagaccagccuggccaacaaggcgaaacaccgucuguauuaaaaauacaaaaaaaaaaaaaaaaaaaauuagccaggcgccuguaaucccagcuacucaggaggcugaggcaggagagcugcuugaaccuggaaggcagaaggugcugugagccgagaucgcgccauuacacuccagccugggcaacaagagcaaaauuccgccucaagaaaaaaaaaaaauaggguucacaaucagcaagugugaagugcauacuaaaacucugcuccaaacacacuuacuguaagugauguaaacccaauggguaugccccaaacuccauuuuuuucucauaguuaaguacugagaucccucuccaaucugcagcucccacuuucugcaggccaagaaaguuaaacaaaaaauacaagcagguacucagugaggaccugagggauucucccacgaguaaaauacaucuauuuucacacaagguucuuuuggucaacuucuggguuuugcucuuacuccagaauugaagcuacuauaguguuauaaaucuguugagaaaagaaaucuagacuucuaugaagauuuuuaauauuuuaauuugccaaaaagcuucucaaauauuuuuauagcuacaagucacauuuauuaaaugauuccaguuacaaucccaagcacauuuacuacacaacagacaaugcuaaauggugaagaaaagugucuccggcuuuuuaguguaagacagacgaucuuucauuaguucuucuaaugaaagcacuugcaucuacucugaaaaaucuggcgaagguaaagagugaaaaagaggaggaagagaaaaggcaaucagccaauuugauaaacuauuuuugucguuacuguucaauauuuaugaagcaccuuaaugcuagagaucugacaaaaauucgguaaggcuguuccaaacaauaacagaaaaaaaaaucacuuuucaauagcuggcgggggaggaggaggagcacuauauucaaaaaguaauucacuauaccucauucaugaaugaaagccaaauuucacccauaggcuguuaaccgaugcuccgaaacuuauucgcaaaguacauagagaaagaaauugcgcugggcgaaaccuaacucgggcagagaagcggcuucaaaaccugaaagggagaaaacgagucaggucguugcuccagaaauuuccgagcgcccggcuccccgggagggagcgcgggcgccagcggcggggaggggacgguggcaccugucacucgagcggcccccacggggucucgggaggcucagcggucgccggccugggagucgggugcgagucccuccccgccgccccgagccuugcgccgagcgucgggccgcggcccucccgugcccucugcccagcggcuccggucaguggggcccgucgccucaggccgaguccccgccacccgaggccggggcgccgaggggagcgcugucgagccgcugccuacgccuccggggugccggagcggacacccgcgaggcgggcccgccuccgcguacucaccgggccucccgugccgccggcucggcccuccucucccuccuccccccgccgccgccucucccgcggcuccccgggcggccgcacugggcguugggacuggucugggucaagugucggcagagcugggggcaggcucgcgccgggcgggggucgcggucggcccacaggcugggcacuaacgggucccggggcgccggggcggaccgcggaggugagcgcggcugcaggcugcggugaggggcggggagagcgcggcugagagcaggcgggcgggcggaggguggagggaagcccgggcggaggaggcggcgugagagccucggggcgggggcgggggcgggggcggggccuggcgcguccgccgagcgcggggguuuguuuauuuucgcgguugguagcggcgcuggcgcugguuagagguucgccggugacgugagcgcccgaguugggggagaggaccagaaccaccugcuggagaaggggagcuacgggggccgggcaggguccaaacgccucacguaggcggcggcgccacggucuucggggucacagggaagagaagggcucuccucaagcggguggaaggagggaggccucccgagggagugagacucuaggccacucccccgcagcaaggcaggaucaccugcgacgcggagagcgguuagagggcccuggaguggaaaagggcagugggaccugguagcuuggguucccugcaacuugggguucgaccuccaggcaaugaaguagggaugguccugcaagucaagauuccaguagcaagagugcaucagaucucuguaaggaaaauaacuaacauugcucaguucccuguagaguugcagggcgcuuuaacguuaucucccuugguucuccaucaggucguaguggacuaauuuuacaggcgaaguuaagugacuuacccaaaaccucacagcuaauaaacggcagagccggcacccagcuguacuggc

SEQ ID NO: 20040 - RNA, 3634 nt, Homo sapiens
gccaguacagcugggugccggcucugccguuuauuagcugugagguuuuggguaagucacuuaacuucgccuguaaaauuaguccacuacgaccugauggagaaccaagggagauaacguuaaagcgcccugcaacucuacagggaacugagcaauguuaguuauuuuccuuacagagaucugaugcacucuugcuacuggaaucuugacuugcaggaccaucccuacuucauugccuggaggucgaaccccaaguugcagggaacccaagcuaccaggucccacugcccuuuuccacuccagggcccucuaaccgcucuccgcgucgcaggugauccugccuugcugcgggggaguggccuagagucucacucccucgggaggccucccuccuuccacccgcuugaggagagcccuucucuucccugugaccccgaagaccguggcgccgccgccuacgugaggcguuuggacccugcccggcccccguagcuccccuucuccagcaggugguucugguccucucccccaacucgggcgcucacgucaccggcgaaccucuaaccagcgccagcgccgcuaccaaccgcgaaaauaaacaaacccccgcgcucggcggacgcgccaggccccgcccccgcccccgcccccgccccgaggcucucacgccgccuccuccgcccgggcuucccuccacccuccgcccgcccgccugcucucagccgcgcucuccccgccccucaccgcagccugcagccgcgcucaccuccgcgguccgccccggcgccccgggacccguuagugcccagccugugggccgaccgcgacccccgcccggcgcgagccugcccccagcucugccgacacuugacccagaccagucccaacgcccagugcggccgcccggggagccgcgggagaggcggcggcggggggaggagggagaggagggccgagccggcggcacgggaggcccggugaguacgcggaggcgggcccgccucgcggguguccgcuccggcaccccggaggcguaggcagcggcucgacagcgcuccccucggcgccccggccucggguggcggggacucggccugaggcgacgggccccacugaccggagccgcugggcagagggcacgggagggccgcggcccgacgcucggcgcaaggcucggggcggcggggagggacucgcacccgacucccaggccggcgaccgcugagccucccgagaccccgugggggccgcucgagugacaggugccaccguccccuccccgccgcuggcgcccgcgcucccucccggggagccgggcgcucggaaauuucuggagcaacgaccugacucguuuucucccuuucagguuuugaagccgcuucucugcccgaguuagguuucgcccagcgcaauuucuuucucuauguacuuugcgaauaaguuucggagcaucgguuaacagccuaugggugaaauuuggcuuucauucaugaaugagguauagugaauuacuuuuugaauauagugcuccuccuccucccccgccagcuauugaaaagugauuuuuuuuucuguuauuguuuggaacagccuuaccgaauuuuugucagaucucuagcauuaaggugcuucauaaauauugaacaguaacgacaaaaauaguuuaucaaauuggcugauugccuuuucucuuccuccucuuuuucacucuuuaccuucgccagauuuuucagaguagaugcaagugcuuucauuagaagaacuaaugaaagaucgucugucuuacacuaaaaagccggagacacuuuucuucaccauuuagcauugucuguuguguaguaaaugugcuugggauuguaacuggaaucauuuaauaaaugugacuuguagcuauaaaaauauuugagaagcuuuuuggcaaauuaaaauauuaaaaaucuucauagaagucuagauuucuuuucucaacagauuuauaacacuauaguagcuucaauucuggaguaagagcaaaacccagaaguugaccaaaagaaccuugugugaaaauagauguauuuuacucgugggagaaucccucagguccucacugaguaccugcuuguauuuuuuguuuaacuuucuuggccugcagaaagugggagcugcagauuggagagggaucucaguacuuaacuaugagaaaaaaauggaguuuggggcauacccauuggguuuacaucacuuacaguaaguguguuuggagcagaguuuuaguaugcacuucacacuugcugauugugaacccuauuuuuuuuuuuucuugaggcggaauuuugcucuuguugcccaggcuggaguguaauggcgcgaucucggcucacagcaccuucugccuuccagguucaagcagcucuccugccucagccuccugaguagcugggauuacaggcgccuggcuaauuuuuuuuuuuuuuuuuuuuguauuuuuaauacagacgguguuucgccuuguuggccaggcuggucuggaacuccugaccucgugaucugcccaccucugccucccaaagugcugggauuacaagugugagccaccacaccuggccugugaacccuaauuuuuaagaagccaaagugaaagauacuguuugguuaucugaagaacagaacaugaaauaacacaauuuuuuauuucaccagguguuaaaucagugauacuuggugccauuucauauuacgcucaguuaauuucgaucuaaguuauauuucagugaggccacacuaauuggcaucuacauuaauaccuuuuuuuggucaggcuaauugguaguguuaauagaagauggcuaucauucaucucauaaaaaguaauauauuugguuguucuugauuuaaggauuuuauauguauaauuguguguguguguguguguguguguuuucugaaguucccuaauuguggucuucuggacugagauauggcugcugcugucuugauucuagugaggucauaguguagagggauaaggucauaauggcaaugugccuccaaaccuugauagaggccaagacuaccagccacuuaggaauucuucugcuugggucgggcuugguggugcaugccuguaaucccagcccuuugggaggccgaggcuggaggauugcuugagcucaggaguuugagaucagccugggcaacauagugagaccccauguauacacaaagagaaaaaaaaaauucuccugcuuguagcuuaggcuauucauuuuuagaagcaguuuacuuaagcagccaaugcauccuaguucucuuaaauuaacacuuuaguuuuucauuuuuuugagacagucucucgcucuguugccaggcuggaaugugguggcgcagucuuggcucacugcaaccucuaccucccugguucaagcgauucuccugccucagccucccgaguagcugggacuacaggcgugcgccaccaugcccagcuaguuuuuguauuuuuaguagagaugggguuucacuacguuggccaggauggucucgaucucuugaccuugugauccacccgccuuggccucccaaagugcugggauuacaggcgugagccaccaugcccggcuggcuuaaaucaacacuuuaaaaccagauaugc

SEQ ID NO: 20041 - RNA, 2747 nt, Homo sapiens
auacuggcacuuuuuuuugcccccucaaaggaaauaugcuaauagacagccccuuugcaaauauaauuccuccuucccaacccuucaaauugcuaaggccccacuggucagcaccuucccuuucgaguccaggacuacuguucugucccccacaugcuugcuuccucccggacguccugaacacugcagcuagcuuucuggacggcagacgaguugggaguuucuggagcuuggaauuggggcgggggaggagguccaagaagucaagcuccggagaggagcuucaggggaagugcccagagucguggccggggaaccggcuacaccaaguugacuuggaaaaaguuuugggaaguauccccaaccaucccuucuaucugucccaagccacaggugcccggcgcggggucgaggcgagcacgggagugggacgcgggcucucccgcagccaacggcggggggcgcgagggcuaaaagagcggcccaagcagcagcagcaagauggaggcgagugggguccaggcgccccggggcgccaagcggccgccgccgccgcugcuccugcgcccaggcccauagggcagguccccgcggccgcccgaugcagcagcgccgcugcccgggcgcggugggugcgggacgccgucgucgucguccagcggcugcucaccacccgcgcccccggugcgcugcucgucaucguaguccucaucguaguagucguccaggcccccguccgagccgcugcugccggggccguugcccagcucggcgccgaagcacaggcgggccauguucuccuugaccgacucgcagaugggccgcucgaggccgucgcacacgcagucguugagcagcgccgccuugggcauagccagcauguccucaaugacggugcggcauucguccgugcagcgcagcccguugaagacuuugccgcaguaggucagguagcggcucagcgccagguugcagcggcugucgcggucgcagcgccgccgggccucggugcagcccaugaccccgcccgcgccggggccgcccgcgccgccgccgcucguccggggcaggcacggcucaauggcgcgcuugguggacuugcaguucucguccugcgcgcagucacaguccuccagggcgggcccgcggcgcgugugguugagcugaaugagggccgagaugcagugacucgggcagcgccagcgcgacgagaaagaggcggccgaggccgggaaagcggcggcggcggccccgggcgcgucgcccccgccgugcugcgccagcaccggcgcgcacgccucggcguacugguuguaggcguagcugcacuccggcucccccuggcacugcagcagcgccugccagcagaugaggcggcggccgugcgccagccccgauccccgcggcgccgagcccagcagcugcagcagcgccaucaggcacagccaggcgcccggcacuguccccccgcgggccucgccgccgccgcccagcagcgcggccaccaucgcgggcagcggcggccgccgggagaggaggggaaaggagacgaggcgcggggagcggcggacgcggagccgguggaaaaguuuguccaaguccugcccacuucuugcaugagugucuucauaaauccaugcgcgccgcuggcugaugccccgcugguggcagaagguccccuuucgcucuggcugcgguggcuuccuggaaaugaacagcugucgagaucuggucccgcucucccacccgagagcccuccgcucggcccccggugguggcgggagaggcucacugucgccccgggggggugcgggccgcggggccguggcggggcugcaggaccgcgcggcgcggcgggugcauuuugcuccgcgccugcagauccguugugcggccggcuguccccgugccggcugcucgcgcugcggccgcggcggcuccuuccuccugggcucagugccucgccgccgccaccgccgccgcggucucucgcaucgcgccgcuuccuggcccggcguccgcgcgcugcccgccuucccgcggcccggccgccccgcguccccucccccuccgcccgcggcaaccccggccuccgcagagcuccggggagcucuuuccgggaagcgcggggagaacaagaaagucggcgcugccggagagcggcucccuggcuucacucggcggcagcuucucgggugaccaagagcccggggagcggauccgcugagcccggcugcagacucguuagcagcgaggcuuuaaauacaaaagugggccgggagcccccgcguggugccgcggugcccccucauuaugcaugcauggaaaagcaaacaaacaaaaacauuagcaacgcuccuccggcucgccgagccccggccccgcgcgcuccgagccugcccgcuuucuccuuucuccacucucuuucgcccuuugcucggcccccuuucccggcuuuucgagaugcuauugguccugccuguuguuguugaaaguuuuuuuuuuuuuuuuuacgagccgcuggagugggguugcggagugggggagggcgggaggguggugggcagcucacauucaggcauucagggcuugaaaggaacggcuuagggagccugacggaggcccggagcuccuccuacucuuaaggaggcucggauaugcagccccagcucgcgcacagaaccagcgggcagggcuuaggggcagcuguuugcauccggcucagccacgggccuuuuuuguuuguu

SEQ ID NO: 20042 - RNA, 2747 nt, Homo sapiens
aacaaacaaaaaaggcccguggcugagccggaugcaaacagcugccccuaagcccugcccgcugguucugugcgcgagcuggggcugcauauccgagccuccuuaagaguaggaggagcuccgggccuccgucaggcucccuaagccguuccuuucaagcccugaaugccugaaugugagcugcccaccacccucccgcccucccccacuccgcaaccccacuccagcggcucguaaaaaaaaaaaaaaaaacuuucaacaacaacaggcaggaccaauagcaucucgaaaagccgggaaagggggccgagcaaagggcgaaagagaguggagaaaggagaaagcgggcaggcucggagcgcgcggggccggggcucggcgagccggaggagcguugcuaauguuuuuguuuguuugcuuuuccaugcaugcauaaugagggggcaccgcggcaccacgcgggggcucccggcccacuuuuguauuuaaagccucgcugcuaacgagucugcagccgggcucagcggauccgcuccccgggcucuuggucacccgagaagcugccgccgagugaagccagggagccgcucuccggcagcgccgacuuucuuguucuccccgcgcuucccggaaagagcuccccggagcucugcggaggccgggguugccgcgggcggagggggaggggacgcggggcggccgggccgcgggaaggcgggcagcgcgcggacgccgggccaggaagcggcgcgaugcgagagaccgcggcggcgguggcggcggcgaggcacugagcccaggaggaaggagccgccgcggccgcagcgcgagcagccggcacggggacagccggccgcacaacggaucugcaggcgcggagcaaaaugcacccgccgcgccgcgcgguccugcagccccgccacggccccgcggcccgcacccccccggggcgacagugagccucucccgccaccaccgggggccgagcggagggcucucgggugggagagcgggaccagaucucgacagcuguucauuuccaggaagccaccgcagccagagcgaaaggggaccuucugccaccagcggggcaucagccagcggcgcgcauggauuuaugaagacacucaugcaagaagugggcaggacuuggacaaacuuuuccaccggcuccgcguccgccgcuccccgcgccucgucuccuuuccccuccucucccggcggccgccgcugcccgcgaugguggccgcgcugcugggcggcggcggcgaggcccgcggggggacagugccgggcgccuggcugugccugauggcgcugcugcagcugcugggcucggcgccgcggggaucggggcuggcgcacggccgccgccucaucugcuggcaggcgcugcugcagugccagggggagccggagugcagcuacgccuacaaccaguacgccgaggcgugcgcgccggugcuggcgcagcacggcgggggcgacgcgcccggggccgccgccgccgcuuucccggccucggccgccucuuucucgucgcgcuggcgcugcccgagucacugcaucucggcccucauucagcucaaccacacgcgccgcgggcccgcccuggaggacugugacugcgcgcaggacgagaacugcaaguccaccaagcgcgccauugagccgugccugccccggacgagcggcggcggcgcgggcggccccggcgcgggcggggucaugggcugcaccgaggcccggcggcgcugcgaccgcgacagccgcugcaaccuggcgcugagccgcuaccugaccuacugcggcaaagucuucaacgggcugcgcugcacggacgaaugccgcaccgucauugaggacaugcuggcuaugcccaaggcggcgcugcucaacgacugcgugugcgacggccucgagcggcccaucugcgagucggucaaggagaacauggcccgccugugcuucggcgccgagcugggcaacggccccggcagcagcggcucggacgggggccuggacgacuacuacgaugaggacuacgaugacgagcagcgcaccgggggcgcggguggugagcagccgcuggacgacgacgacggcgucccgcacccaccgcgcccgggcagcggcgcugcugcaucgggcggccgcggggaccugcccuaugggccugggcgcaggagcagcggcggcggcggccgcuuggcgccccggggcgccuggaccccacucgccuccaucuugcugcugcugcuugggccgcucuuuuagcccucgcgccccccgccguuggcugcgggagagcccgcgucccacucccgugcucgccucgaccccgcgccgggcaccuguggcuugggacagauagaagggaugguuggggauacuucccaaaacuuuuuccaagucaacuugguguagccgguuccccggccacgacucugggcacuuccccugaagcuccucuccggagcuugacuucuuggaccuccucccccgccccaauuccaagcuccagaaacucccaacucgucugccguccagaaagcuagcugcaguguucaggacguccgggaggaagcaagcaugugggggacagaacaguaguccuggacucgaaagggaaggugcugaccaguggggccuuagcaauuugaaggguugggaaggaggaauuauauuugcaaaggggcugucuauuagcauauuuccuuugagggggcaaaaaaaagugccaguau

SEQ ID NO: 20043 - RNA, 2947 nt, Homo sapiens
gucacaaaccuucugauugaaaacccaaauguucaucaacagggacugucuaaauagguuaaaaaacauucaaaucuacauaaacauuuaaauccauacguacuuguuaaugguuuuauucauaaaaccguauguacauuggccuaagcaguaauuaaaaucaaguaagccagucuuauaugcaccaacucagaacaaucauucuaauaagaaacacuaugaaaacggaaaaaugugcaaaacaacaugugugcuacucgcacguguaugguagagaauauauaguauauauaguaugcaugcacagccuauuucuagaaggcuucacaagaaacugggaagaguaguugccucuagagaaggacacuuggagacugugagaccaacuuuucugcacguacuccugugcaccuuuagaauuggaguucuguaccauguaaaugcauuacuuguccuaaaauuaaaucccauucaacacagauccuuucaagagguauaaacaauaacgggcagaaacuauguauaggcccacccguucccagccccauccguccucggcgaggcccucuccugggaagggcacaacguuagcgggacuuggcuucucagucucagcaggcuucaccucccgcacaccccccgcagcuaccggccggggacugguacucagggcaaccccuuccuaugcccgcucugguucccaagggccauccaccaaagccgagaaacccgcucugcucucagcuucauuucaaaacgaacuuaguuuccagauuguccaugaaccuagaauauuauuucuccuaaacgucuguguuugucuaaacacuuccacuuaauguucucgccacuccagcuuaccugguuuaucaaaggcuaggggcuggaaacaguuuuuaauaacgccacgcaccgagguugacacauuccccgccacugaaaacagacugccaauucccucaaaaucguggacagcucugcuguuuacacagcguugccacauacaucaucacauuuaaugccuucacacgcgucacugucaaucccagcaaaccuaacagcugccaaauuggauuuaugagucuccaagaacagucgaaucagcacuaacagaacagcuaucgaagggcugcuuggcuaccugcucuggcuggcugggauuucucaaaagugacaacccggacauucgucuugccggcuggcucgaaugccaccaacgugacaccuuccuucucgaggccccggcggggagcggaccccgggaggcggaggcguucggggggcgcgcuagggggcagggcgcgggaggcccaggagaggggcucgggcuuacgcgccggacgggcaacgcggcgcccagggucccaaggcuacggagcagcggggguuuggccaacgccaaaaaggggcagcucccgugccaggcgcguucagcgcgcucggggaauccucaggggcugauucagagguugugacucgcgcgagggccaaccgggcucgcaaucccugaaggcggaauccacaggaacucagaagcagcccgcggggaggagcugcagguucgaggcgccgggcugacgcccgcaacuuagaaaggugacccucgguccaucuugcugguggaggagggugcacaagcuaaaguuaaagcucgcagcccacgcagcuagaaacucggggcggggggcgcuccucaggagccaggcuccuaaaggggguguggcggccggggcguuuaagggggugggggcgaaggcauuucggcccggccccggaggccccgggcagcccggugggaggugggccagggccccgcgccgggugcggccguccggggcccuccgcgcgcccacuggccggcucaccggugauguccagguacacgucguccugggggucccggcggcgcgggucuugcugcguggagcugcggaucuucuucacacccggcgaggucgacgagcagcgccgcgagcaggggggcgcggcggcccagcucgaccgccgcucgcuuuuccgcuucauggaggcggccgcggcccgucagggggccacgaccauggccccgcgcgcccgcgcgcccgccgaggcucccgccagccccgcgcgggcgcucggggcggcgggcgcagagcggcgcugcggggacggcgggcgccggcagagcccggcgggaggcggucgcgcaggagccggaggaggagcccggcccacagcgccugccccgcugccucccgcggccgccgcaggaccggcgccgcagcccucgcuacagcgccuccugccgcggccggcgcccccagcccgcccccaggugcccgcagccggcuggcgcggccgaggcgacggggcugcagcuggcggccggagcugcccgggguaaccgugcgugcccaccgcggccgcggccgcugcugcguaggcgccggggcacagcaggacgcggcucguggggaccccaggagggcuguuccguggcgcuucauucacaaaaaagggcccacaacccuccucggggcccgcagacugaggccuuucauuggccaaugcggcgugacgucacggagacggggccuuucuacaggcagguacucggugacgccauaaagaaaacucugagggcuuccgccaaucagagauaaagugugcuagcgaccuucgccagccccccaacuuuuguuucuucuguguccuccaggugccagcaccccagaucccaacuuucuuuagugagucaccaaacauuuacacagccccacccuaguaacuuaacuccaggucuuuggcauauauauaucuuaaaguauuucuugaauuuccuuguaauucgcgccaagagaaagggacuuuugccauggcugccagcuuggaagaggauggccugauuacauuaccugcagcuauauagauuuaaaguagaguugauuucagaacuuaaguaaaacua

SEQ ID NO: 20044 - RNA, 2947 nt, Homo sapiens
uaguuuuacuuaaguucugaaaucaacucuacuuuaaaucuauauagcugcagguaauguaaucaggccauccucuuccaagcuggcagccauggcaaaagucccuuucucuuggcgcgaauuacaaggaaauucaagaaauacuuuaagauauauauaugccaaagaccuggaguuaaguuacuaggguggggcuguguaaauguuuggugacucacuaaagaaaguugggaucuggggugcuggcaccuggaggacacagaagaaacaaaaguuggggggcuggcgaaggucgcuagcacacuuuaucucugauuggcggaagcccucagaguuuucuuuauggcgucaccgaguaccugccuguagaaaggccccgucuccgugacgucacgccgcauuggccaaugaaaggccucagucugcgggccccgaggaggguugugggcccuuuuuugugaaugaagcgccacggaacagcccuccugggguccccacgagccgcguccugcugugccccggcgccuacgcagcagcggccgcggccgcggugggcacgcacgguuaccccgggcagcuccggccgccagcugcagccccgucgccucggccgcgccagccggcugcgggcaccugggggcgggcugggggcgccggccgcggcaggaggcgcuguagcgagggcugcggcgccgguccugcggcggccgcgggaggcagcggggcaggcgcugugggccgggcuccuccuccggcuccugcgcgaccgccucccgccgggcucugccggcgcccgccguccccgcagcgccgcucugcgcccgccgccccgagcgcccgcgcggggcuggcgggagccucggcgggcgcgcgggcgcgcggggccauggucguggcccccugacgggccgcggccgccuccaugaagcggaaaagcgagcggcggucgagcugggccgccgcgccccccugcucgcggcgcugcucgucgaccucgccgggugugaagaagauccgcagcuccacgcagcaagacccgcgccgccgggacccccaggacgacguguaccuggacaucaccggugagccggccagugggcgcgcggagggccccggacggccgcacccggcgcggggcccuggcccaccucccaccgggcugcccggggccuccggggccgggccgaaaugccuucgcccccacccccuuaaacgccccggccgccacacccccuuuaggagccuggcuccugaggagcgccccccgccccgaguuucuagcugcgugggcugcgagcuuuaacuuuagcuugugcacccuccuccaccagcaagauggaccgagggucaccuuucuaaguugcgggcgucagcccggcgccucgaaccugcagcuccuccccgcgggcugcuucugaguuccuguggauuccgccuucagggauugcgagcccgguuggcccucgcgcgagucacaaccucugaaucagccccugaggauuccccgagcgcgcugaacgcgccuggcacgggagcugccccuuuuuggcguuggccaaacccccgcugcuccguagccuugggacccugggcgccgcguugcccguccggcgcguaagcccgagccccucuccugggccucccgcgcccugcccccuagcgcgccccccgaacgccuccgccucccgggguccgcuccccgccggggccucgagaaggaaggugucacguugguggcauucgagccagccggcaagacgaauguccggguugucacuuuugagaaaucccagccagccagagcagguagccaagcagcccuucgauagcuguucuguuagugcugauucgacuguucuuggagacucauaaauccaauuuggcagcuguuagguuugcugggauugacagugacgcgugugaaggcauuaaaugugaugauguauguggcaacgcuguguaaacagcagagcuguccacgauuuugagggaauuggcagucuguuuucaguggcggggaaugugucaaccucggugcguggcguuauuaaaaacuguuuccagccccuagccuuugauaaaccagguaagcuggaguggcgagaacauuaaguggaaguguuuagacaaacacagacguuuaggagaaauaauauucuagguucauggacaaucuggaaacuaaguucguuuugaaaugaagcugagagcagagcggguuucucggcuuugguggauggcccuugggaaccagagcgggcauaggaagggguugcccugaguaccaguccccggccgguagcugcggggggugugcgggaggugaagccugcugagacugagaagccaagucccgcuaacguugugcccuucccaggagagggccucgccgaggacggauggggcugggaacgggugggccuauacauaguuucugcccguuauuguuuauaccucuugaaaggaucuguguugaaugggauuuaauuuuaggacaaguaaugcauuuacaugguacagaacuccaauucuaaaggugcacaggaguacgugcagaaaaguuggucucacagucuccaaguguccuucucuagaggcaacuacucuucccaguuucuugugaagccuucuagaaauaggcugugcaugcauacuauauauacuauauauucucuaccauacacgugcgaguagcacacauguuguuuugcacauuuuuccguuuucauaguguuucuuauuagaaugauuguucugaguuggugcauauaagacuggcuuacuugauuuuaauuacugcuuaggccaauguacauacgguuuuaugaauaaaaccauuaacaaguacguauggauuuaaauguuuauguagauuugaauguuuuuuaaccuauuuagacagucccuguugaugaacauuuggguuuucaaucagaagguuugugac

SEQ ID NO: 20045 - RNA, 2514 nt, Homo sapiens
uggagcacgggaaaggcagggauuucacacuagccauucauuugucagcugugggggaggggacgcagaagcuagagagagagaacagaggcugggagaggggaagggaggcagagaagauggagacagagggagacacaaagaugaggaacgcgacccagagagacucugccgcgggugugcgcgcggcaggacaacucuccaggcgccguguagauuucucccccuucccgcagcaucucccagggacaugcaggacuugccgagacgcaguuggauuggagagcaaauaguuuaggcuaugacacuauuuuucuaccccgcucuccucugccuaacacccagaccgcuccacgcccagugacacagaccgcgggccagaacaacccggaugcccuaggucugcacgcaccagggaugucgcccuacagcgcccacgccucugcaggacgguggggcgcuccagccgaggacgucccccggggcucccggcacacgcgcgcgccgcugccgcuagaccugccaguaaaguugcucaacuagagcggagaacuaggagaggguggggaauauguaaggaaacggaggacuccuguagucugggcgagaggacugacccagaggccccugauucggguccccgagccaccuuugucugcagugcgcucugggugccgguuugcuuguugagaugggagcgacagacccuauuucacucuucagggugagaaaaauuguugcacaucccugccgauucagaacaggcuuuucccgcccaggggccucccagaccuccgcggggcuccaacaaccccaccccccauccucugcuccuucccugcuggccccuucgcaccgcgugcaggacaaaagaacccaggggcgccgggagagaaccgugacaguccccaagucgucaaagagacacggcggggauccugcaccucccccggccggaccuccucccagacugccugcggucugaaggggucagguccgcgcaaggucccaggcugcuugggcgccgggucgcacugucaggagcugcccgggaguggcuuuccaggaacaccaggcacugaccacacaccaggggcugggaaaccagguggccugcaccaaggcggcuucggggacuugucuguggcaagucuugguaguccccauucaaacuuuugccucgagcguguuaagaacaacaacaacaaaaaaaucaaagugccaaaggucccucucuucucuccagcucaagaacccaccacuuuucuaugauuucuuuacaauuuauucccucccuucccccaauuccguuagucauuuuaccccccaccccacccuggguuucuuuugucugaaucuuuuucaacaccaaggucccucuguaugccucuccccaaaagcccuuaugaaaguuaccugcauuuuuuaagugccuacauuuucuuaacuucgccuuacagcucuuugccuuaauuaaagccuucuaccaauugcuucuuuuuucuaagcucgcggguuuuuuucuauaaguuuuuuguuuuuguuuuuuaaggggggaacaaaagaaacgugauuaccuuggaaggcggcuuauugcaguuuggggggaaaauucacugcagcgcugcgcgacuggguucggcguugcccaggcgggucacauaggaagcgugguggcccggggaaggaugcggagggugcgggacggugcuggaagaugcgggaggaugcggggcuggccgaagaucuuggucccagcuccuguccacaacaccuaauguucucggcuguugcguccgcacgccuggaguucuuccccagaaaggcucggggcagcucgccugcaaguucaaaugcggguugugacacccaucaucauuauaucacuguaccgucagagccgaggaggagacucagcgagaagaaggaggagggagaggaggaggguucauucacaggcuccaaaagcgcuccgcagcuucagccacuccuaagaguccaggcuuggaaagcaggcggaggggcggaaaggcagcuccccgcgccugcgguagggaccgccugccucccuccccaggcacucccaccucuuggcguuucuuccugacaagaaguaccaaucggcuuggggacagcagcgcuccccauucagggacucacucaguaacaucgcucugcucgcggaaaccacugcccucccacuccuuccccacccccauuuccccgccccccgugcagcuaguucuggguuaggggaaaggagcccccaggcucuuagggggcaggccagcaauagacaauugaguacgaucacuucuucucgggagcacacaaaacuguaaaaucagcaaagaacuugguuacagcguguuuacgcgcccacagagcuugccugucccaucaaagggaagugucaggcucaaggcuccugccaaccugaaagagacacugagaaaacgagauccuucggggaccuagagggaaaguguaagaauuccccacugcacucccagg

SEQ ID NO: 20046 - RNA, 2514 nt, Homo sapiens
ccugggagugcaguggggaauucuuacacuuucccucuagguccccgaaggaucucguuuucucagugucucuuucagguuggcaggagccuugagccugacacuucccuuugaugggacaggcaagcucugugggcgcguaaacacgcuguaaccaaguucuuugcugauuuuacaguuuugugugcucccgagaagaagugaucguacucaauugucuauugcuggccugcccccuaagagccugggggcuccuuuccccuaacccagaacuagcugcacggggggcggggaaauggggguggggaaggagugggagggcagugguuuccgcgagcagagcgauguuacugagugagucccugaauggggagcgcugcuguccccaagccgauugguacuucuugucaggaagaaacgccaagaggugggagugccuggggagggaggcaggcggucccuaccgcaggcgcggggagcugccuuuccgccccuccgccugcuuuccaagccuggacucuuaggaguggcugaagcugcggagcgcuuuuggagccugugaaugaacccuccuccucucccuccuccuucuucucgcugagucuccuccucggcucugacgguacagugauauaaugaugaugggugucacaacccgcauuugaacuugcaggcgagcugccccgagccuuucuggggaagaacuccaggcgugcggacgcaacagccgagaacauuagguguuguggacaggagcugggaccaagaucuucggccagccccgcauccucccgcaucuuccagcaccgucccgcacccuccgcauccuuccccgggccaccacgcuuccuaugugacccgccugggcaacgccgaacccagucgcgcagcgcugcagugaauuuuccccccaaacugcaauaagccgccuuccaagguaaucacguuucuuuuguuccccccuuaaaaaacaaaaacaaaaaacuuauagaaaaaaacccgcgagcuuagaaaaaagaagcaauugguagaaggcuuuaauuaaggcaaagagcuguaaggcgaaguuaagaaaauguaggcacuuaaaaaaugcagguaacuuucauaagggcuuuuggggagaggcauacagagggaccuugguguugaaaaagauucagacaaaagaaacccaggguggggugggggguaaaaugacuaacggaauugggggaagggagggaauaaauuguaaagaaaucauagaaaagugguggguucuugagcuggagagaagagagggaccuuuggcacuuugauuuuuuuguuguuguuguucuuaacacgcucgaggcaaaaguuugaauggggacuaccaagacuugccacagacaaguccccgaagccgccuuggugcaggccaccugguuucccagccccugguguguggucagugccugguguuccuggaaagccacucccgggcagcuccugacagugcgacccggcgcccaagcagccugggaccuugcgcggaccugaccccuucagaccgcaggcagucugggaggagguccggccgggggaggugcaggauccccgccgugucucuuugacgacuuggggacugucacgguucucucccggcgccccuggguucuuuuguccugcacgcggugcgaaggggccagcagggaaggagcagaggauggggggugggguuguuggagccccgcggaggucugggaggccccugggcgggaaaagccuguucugaaucggcagggaugugcaacaauuuuucucacccugaagagugaaauagggucugucgcucccaucucaacaagcaaaccggcacccagagcgcacugcagacaaagguggcucggggacccgaaucaggggccucugggucaguccucucgcccagacuacaggaguccuccguuuccuuacauauuccccacccucuccuaguucuccgcucuaguugagcaacuuuacuggcaggucuagcggcagcggcgcgcgcgugugccgggagccccgggggacguccucggcuggagcgccccaccguccugcagaggcgugggcgcuguagggcgacaucccuggugcgugcagaccuagggcauccggguuguucuggcccgcggucugugucacugggcguggagcggucuggguguuaggcagaggagagcgggguagaaaaauagugucauagccuaaacuauuugcucuccaauccaacugcgucucggcaaguccugcaugucccugggagaugcugcgggaagggggagaaaucuacacggcgccuggagaguuguccugccgcgcgcacacccgcggcagagucucucugggucgcguuccucaucuuugugucucccucugucuccaucuucucugccucccuuccccucucccagccucuguucucucucucuagcuucugcguccccucccccacagcugacaaaugaauggcuagugugaaaucccugccuuucccgugcucca

SEQ ID NO: 20047 - RNA, 3156 nt, Homo sapiens
cccuccaagauaaaugaagaguuaaaaacuuugcuucuggccgggcguuguggcucacaccuguaaucccggcacuuugggaggccgagguggguggaucacuugaggucaggaguucgagaccagccugggcaacauggugaaaccccaucucuacuaaaaauacaaaaauuggccaggcgugauggugcacaccugucaucccugcuacuccagaggcuggcucaugagaaucgguugaacccaggaggcagagguugcagugagccgagaucacaccacugcacuccagccugggugacagaaugagacuccgucucaaaaaaaccaaaaacuaaaaacgacagaaaaaguugcuucugcuucauuuccuuuucaucucucaguagaguuuaacauaugaaauguauuuuucgaaauuuuguuaauauguuuauucauguuuuaauaauagcauaauaaccuuauaaauuccuaaagacguaaauaagaacgguuguucccacuaacaccccaaccugaaguguggcucuggcuuuaccugaaguggguacagggaugcggagggguggaaggaccgguggggacagauggacccaugaaccagcggguggaugugagcugaggggagggauacggacuggaggagccaaagcccgugacguaggggugcgugcuucccucaauggggagacccugcugccgcuguuguuggccaagucgccguggccgaagcgcgguggccgaagcgggggacgggggugggacuuacggggacagaaggcggagcuuccagcagcugcuggccccccuggguccagaggagccuugccgcccucaccugcgcagagccuggagccgacgcgucacccccagcggaagcgccucgcugcccgggcgucuggcgaggugugcgcuccgggucccagcuccagcgcuucgcggcagucgcccgccucuuuccgcaagcagggcggggacugggcggcaucuaccgagaucugcgauucgaggcgccgaggagccgaagaccacagcucagcucagacggcgcccuagggccgcacagagggucgggcagugccggagagagguuugaaagcgccgccgccaacucgacagcgcgucccaggucagugugaggcgccgucccugccggcugcacuugggaaacuuuggcuugcaguggcggcugccgggaggaggacaucgagggcgcagcguggaacccagcggcccgcacggccucagugcucccugcccggugcgcgcaagccccugaagcccgcaccucccgcucacccugacauugcagugccccgagcaggaugagagacccagggccagccgagggccgccgggcugcaggggccucccgagagacucugccccgccaccccggggcgcgcuccacgcgagcucacccucgcgccuccugccuuucccacugguucucgguuccaguuuugcggccgcuggggcuuggacuccgcggggaugcggguuccgccuccuucucagccucgccgagcggcgggaaccggcgagggcugcccggccgcggggugucgaggaggaugcggggcggggggccugaugggcgaaggucggcgcagcagcgggagcggcgcgcgcugggccgcaagagcgcgcgggucggaggggcugacuugggcgcgucuccggaggggcugacuugggcgcgucuccgcaggugccucggcagcugggcagcaggaggugccggcugggcgcugggggcgggcuggggacugcggagcccuuugcagcuuccaggagcuccugcuuccaggagccacacaggggcgggcagccgguucccgcccuucucaggugcgcacagccuuggcaccaggauaccggacccccuuagcagagagccgggugcagaggugcgccugcuccgggaugggggcaguggcugcgccccucagacgcaccauuucccaagggagggccgcguccggccggcgggcgagcggcgcagggaccgcuccgcagcggcugugggcagaacccguuuucauggauggugaucgccuuagcccgccagcugccugcccuggcucagagaugaggcgacgaaacgcgcaccccgcccccaucggugcccuggagcugucgccccagucaccuuccuuugcccuucuccgacagcgccuugagcucgcuuccuccugcucucaggaaaaacugaggaaacgcgccugguuccaggggucggcggggaccguggagacgcugccagcauccucaacagcuuggaaaucccaucaccuugguucccugagacuuggaggacuagguuggccucucucucucucucucucucucucucuguguguguguguguguguguguguguguguguguguuuuggggggaggugaaucaguaacagagguuggggcauagaugccccaaaggccugggggacagccgaaguaacuaggagaacacggcagcccuuugcggguaugugugggaaacacagcaaaccuuaccagcuacgcgucuccuuggacaguuucuaaauauuucuugcaagucaauaccagggaagaaucuuuuucuggccagucauuccauuuuccaggacgaccucagaugcaucuuuuauucugucucugccccuuuccuugggugggaggagguacacauuugcuuguggcaagcaggcuugccuuauuccaguguagcuggccucccuccuggccuucggcugcccacuagggcucuggguuuuuucaaacccgucuaggaaaggcagggcagcaaaccuccagcuccuggcccauucuacuaauucaaggcuguccucuucucugggaccugugagcucccuggacccgucucuaggcuguggcagccaucuaucucugccuuucacuccugcaggggagccgagcaucgcaccacuuggaaguaaugucggagacagcucugugugaaucugaggcagggguccauagcaaacaggaaguggccuggaaugaggaaugaagaguuugccucagauuuucuccaagugugcauuagaagcaccucccauggaauaugugggaguggagccuagaauuuucuuuuuaacaggcacuccauguguuucuuaugcccacaaaagaagaacccauu

SEQ ID NO: 20048 - RNA, 3156 nt, Homo sapiens
aauggguucuucuuuugugggcauaagaaacacauggagugccuguuaaaaagaaaauucuaggcuccacucccacauauuccaugggaggugcuucuaaugcacacuuggagaaaaucugaggcaaacucuucauuccucauuccaggccacuuccuguuugcuauggaccccugccucagauucacacagagcugucuccgacauuacuuccaaguggugcgaugcucggcuccccugcaggagugaaaggcagagauagauggcugccacagccuagagacggguccagggagcucacaggucccagagaagaggacagccuugaauuaguagaaugggccaggagcuggagguuugcugcccugccuuuccuagacggguuugaaaaaacccagagcccuagugggcagccgaaggccaggagggaggccagcuacacuggaauaaggcaagccugcuugccacaagcaaauguguaccuccucccacccaaggaaaggggcagagacagaauaaaagaugcaucugaggucguccuggaaaauggaaugacuggccagaaaaagauucuucccugguauugacuugcaagaaauauuuagaaacuguccaaggagacgcguagcugguaagguuugcuguguuucccacacauacccgcaaagggcugccguguucuccuaguuacuucggcugucccccaggccuuuggggcaucuaugccccaaccucuguuacugauucaccuccccccaaaacacacacacacacacacacacacacacacacacacagagagagagagagagagagagagagaggccaaccuaguccuccaagucucagggaaccaaggugaugggauuuccaagcuguugaggaugcuggcagcgucuccacgguccccgccgaccccuggaaccaggcgcguuuccucaguuuuuccugagagcaggaggaagcgagcucaaggcgcugucggagaagggcaaaggaaggugacuggggcgacagcuccagggcaccgaugggggcggggugcgcguuucgucgccucaucucugagccagggcaggcagcuggcgggcuaaggcgaucaccauccaugaaaacggguucugcccacagccgcugcggagcggucccugcgccgcucgcccgccggccggacgcggcccucccuugggaaauggugcgucugaggggcgcagccacugcccccaucccggagcaggcgcaccucugcacccggcucucugcuaaggggguccgguauccuggugccaaggcugugcgcaccugagaagggcgggaaccggcugcccgccccuguguggcuccuggaagcaggagcuccuggaagcugcaaagggcuccgcaguccccagcccgcccccagcgcccagccggcaccuccugcugcccagcugccgaggcaccugcggagacgcgcccaagucagccccuccggagacgcgcccaagucagccccuccgacccgcgcgcucuugcggcccagcgcgcgccgcucccgcugcugcgccgaccuucgcccaucaggccccccgccccgcauccuccucgacaccccgcggccgggcagcccucgccgguucccgccgcucggcgaggcugagaaggaggcggaacccgcauccccgcggaguccaagccccagcggccgcaaaacuggaaccgagaaccagugggaaaggcaggaggcgcgagggugagcucgcguggagcgcgccccgggguggcggggcagagucucucgggaggccccugcagcccggcggcccucggcuggcccugggucucucauccugcucggggcacugcaaugucagggugagcgggaggugcgggcuucaggggcuugcgcgcaccgggcagggagcacugaggccgugcgggccgcuggguuccacgcugcgcccucgauguccuccucccggcagccgccacugcaagccaaaguuucccaagugcagccggcagggacggcgccucacacugaccugggacgcgcugucgaguuggcggcggcgcuuucaaaccucucuccggcacugcccgacccucugugcggcccuagggcgccgucugagcugagcuguggucuucggcuccucggcgccucgaaucgcagaucucgguagaugccgcccaguccccgcccugcuugcggaaagaggcgggcgacugccgcgaagcgcuggagcugggacccggagcgcacaccucgccagacgcccgggcagcgaggcgcuuccgcugggggugacgcgucggcuccaggcucugcgcaggugagggcggcaaggcuccucuggacccaggggggccagcagcugcuggaagcuccgccuucuguccccguaagucccacccccgucccccgcuucggccaccgcgcuucggccacggcgacuuggccaacaacagcggcagcagggucuccccauugagggaagcacgcaccccuacgucacgggcuuuggcuccuccaguccguaucccuccccucagcucacauccacccgcugguucauggguccaucuguccccaccgguccuuccaccccuccgcaucccuguacccacuucagguaaagccagagccacacuucagguugggguguuagugggaacaaccguucuuauuuacgucuuuaggaauuuauaagguuauuaugcuauuauuaaaacaugaauaaacauauuaacaaaauuucgaaaaauacauuucauauguuaaacucuacugagagaugaaaaggaaaugaagcagaagcaacuuuuucugucguuuuuaguuuuugguuuuuuugagacggagucucauucugucacccaggcuggagugcaguggugugaucucggcucacugcaaccucugccuccuggguucaaccgauucucaugagccagccucuggaguagcagggaugacaggugugcaccaucacgccuggccaauuuuuguauuuuuaguagagaugggguuucaccauguugcccaggcuggucucgaacuccugaccucaagugauccacccaccucggccucccaaagugccgggauuacaggugugagccacaacgcccggccagaagcaaaguuuuuaacucuucauuuaucuuggaggg

SEQ ID NO: 20049 - RNA, 2481 nt, Homo sapiens
ggugugcccucgucgcgcccugggcuggcgggccaauaugagcggcaggcccagagagcgcaggugggggcgacccucaggucacgccagggucauggcccgcucugaccccugcucugccccugcccuaggaagauguuagcucagaggcacagagcuacgccuucgaagcgcgcagcgccggccaaggggaaggaaaggggagccuggagaaaaucgcagggaagaacuagagggagccgggcccagaagcucagggcgaggccgaggcggcugaggcugcuuuagcuccugcuccgggcuggagcugccagggcugccgccgccgccuccuucaggcgggcgcaggcgagcgggcgggcggagugggggacucuccgggcgcugacauuugcaggcugcccuccugauugguccccucgccgagcugcucacggguucauucaacuguuaagcaccuccccgucucucuaaaggacauuauaaugcaagaagcccccuuuuuaaccacaaaccgaauuuucuuucauuuaggugaucuauauauaucuauaucguauagcuuauagcuuauaucuauuuuaaauaacuuaaagccgcuaaaauuugggggggaacagcuuucgcccuggagcggugcgcgaugcugucucaugccgaccuccuggacgccaggcuaggugagugcgcgccucucgcccgggcagccaggagaagccggggcaggaaauugucaauuuguuccuuauuuuaccuuaaugcgaccuaaauggacuaauuucuuuaaaaguaauugugcugcauuaaaguuuaauuugauuuaacaucgccuuuaaaaaaaaaucuauggaauauguagauccaagaaaggaguuggggaauguuguuacuuuuuguuuuucuuauuuuucucuuccccccucccccgccuuuuuuuuuuuuucgaaaggcgauauaccccgugauaauuuguuaggagguguuucucucucuuuuuucccucuccuguuuguuuugauuugggauuucuuucuccuucccuccccccguuucucucuccccaccaucuucuucucuccuccuuuucuaagugugguguaauuuguaaaaaaucuggcauaaaggagaagcugcugccaucaaggcggauuugcuaagugugcugguugagaaggagagaagccaaauucaaccucacagucaucccccccucuucugcaagggacucagcguugccaauggcugugaggaaugcgccuuuuauuucucuggaaagaaaaguugaaaucucuaaaguuugauucacgguuguccauagaguucacucgaguuuccuuaaugcuaucuggguugcugagcucuggguuuccggauugggaaucuucggugauggaugugacuccauuuuccaaacacuuucucugauuugagggggaggcggagcugauuuggguugauuucggggggugaaagcuuggaggcuuauucaucuuccgaaaguaagagggaaucggcugagggccggagguacaguucgucaggcugccgaagcgcaggugccgcagcaaccgaggaauuguuuaauuuucuuucugccccccgcaccccuguguccaaagauuugcucucgauuuccuggggcgccugggguacgguuuauggaagggauucagaggcauguuuuauugccgggacugggaguguuuuauugugggagagacgaaagcuugugcuguuuacuacgggagccggcugcggcgagggcaaggggccgggagauauuauuccaacccggcuguccaaauucuggggaacccagcugaauacccugggaguuucuuccuuaggacaagcgcgggugcggagggggccgaggacggguugaaggaaggcugcgcggggaagacagccccuccuggcaucgccaagaaaguagugaccgcgauccccuugccuccucagguaugaaagaugccgccgagcuucugggccaccgggaggcggugaaguguaggcugggcguggggggcuccgaccccgggggccauccgggggaccuggcgcccaacucugacccaguggagggagccacucugcugcccggggaggacaucaccacagugggcucuacuccggccucgcuggcggugagcgccaaagacccggacaagcagcccgggccccagggcggcccgaaccccagccaagccggccagcagcagggccaacagaagcagaagcgccaccggacgcgcuucacccccgcacagcucaacgaguuggagaggagcuucgccaagacucacuaccccgacaucuuuaugcgugaggagcuggcacugcguaucgggcugaccgagucccgagugcagguacgaggggcuugggaucugggacagaaggcaaggacagggcgggaggauuugggcaaagggagcagggucuucccuuccccugucgagauccugggcugcuuucagg

SEQ ID NO: 20050 - RNA, 2481 nt, Homo sapiens
ccugaaagcagcccaggaucucgacaggggaagggaagacccugcucccuuugcccaaauccucccgcccuguccuugccuucugucccagaucccaagccccucguaccugcacucgggacucggucagcccgauacgcagugccagcuccucacgcauaaagaugucgggguagugagucuuggcgaagcuccucuccaacucguugagcugugcgggggugaagcgcguccgguggcgcuucugcuucuguuggcccugcugcuggccggcuuggcugggguucgggccgcccuggggcccgggcugcuuguccgggucuuuggcgcucaccgccagcgaggccggaguagagcccacuguggugauguccuccccgggcagcagaguggcucccuccacugggucagaguugggcgccaggucccccggauggcccccggggucggagccccccacgcccagccuacacuucaccgccucccgguggcccagaagcucggcggcaucuuucauaccugaggaggcaaggggaucgcggucacuacuuucuuggcgaugccaggaggggcugucuuccccgcgcagccuuccuucaacccguccucggcccccuccgcacccgcgcuuguccuaaggaagaaacucccaggguauucagcuggguuccccagaauuuggacagccggguuggaauaauaucucccggccccuugcccucgccgcagccggcucccguaguaaacagcacaagcuuucgucucucccacaauaaaacacucccagucccggcaauaaaacaugccucugaaucccuuccauaaaccguaccccaggcgccccaggaaaucgagagcaaaucuuuggacacaggggugcggggggcagaaagaaaauuaaacaauuccucgguugcugcggcaccugcgcuucggcagccugacgaacuguaccuccggcccucagccgauucccucuuacuuucggaagaugaauaagccuccaagcuuucaccccccgaaaucaacccaaaucagcuccgccucccccucaaaucagagaaaguguuuggaaaauggagucacauccaucaccgaagauucccaauccggaaacccagagcucagcaacccagauagcauuaaggaaacucgagugaacucuauggacaaccgugaaucaaacuuuagagauuucaacuuuucuuuccagagaaauaaaaggcgcauuccucacagccauuggcaacgcugagucccuugcagaagagggggggaugacugugagguugaauuuggcuucucuccuucucaaccagcacacuuagcaaauccgccuugauggcagcagcuucuccuuuaugccagauuuuuuacaaauuacaccacacuuagaaaaggaggagagaagaagaugguggggagagagaaacggggggagggaaggagaaagaaaucccaaaucaaaacaaacaggagagggaaaaaagagagagaaacaccuccuaacaaauuaucacgggguauaucgccuuucgaaaaaaaaaaaaaggcgggggaggggggaagagaaaaauaagaaaaacaaaaaguaacaacauuccccaacuccuuucuuggaucuacauauuccauagauuuuuuuuuaaaggcgauguuaaaucaaauuaaacuuuaaugcagcacaauuacuuuuaaagaaauuaguccauuuaggucgcauuaagguaaaauaaggaacaaauugacaauuuccugccccggcuucuccuggcugcccgggcgagaggcgcgcacucaccuagccuggcguccaggaggucggcaugagacagcaucgcgcaccgcuccagggcgaaagcuguucccccccaaauuuuagcggcuuuaaguuauuuaaaauagauauaagcuauaagcuauacgauauagauauauauagaucaccuaaaugaaagaaaauucgguuugugguuaaaaagggggcuucuugcauuauaauguccuuuagagagacggggaggugcuuaacaguugaaugaacccgugagcagcucggcgaggggaccaaucaggagggcagccugcaaaugucagcgcccggagagucccccacuccgcccgcccgcucgccugcgcccgccugaaggaggcggcggcggcagcccuggcagcuccagcccggagcaggagcuaaagcagccucagccgccucggccucgcccugagcuucugggcccggcucccucuaguucuucccugcgauuuucuccaggcuccccuuuccuuccccuuggccggcgcugcgcgcuucgaaggcguagcucugugccucugagcuaacaucuuccuagggcaggggcagagcaggggucagagcgggccaugacccuggcgugaccugagggucgcccccaccugcgcucucugggccugccgcucauauuggcccgccagcccagggcgcgacgagggcacacc

SEQ ID NO: 20051 - RNA, 2595 nt, Homo sapiens
guuucccccacggcauuugcccacuuuuaaaauggaguucuacuaaggccugccuuuuagaguuguugggauaauuaaaugagaaaauacagaaugcuuuuaccacagugccucacgugcaggaggcacugcugcccacuauuucccgaaauggccuggaaacugccaaaagguggagaaucaugucuuaccgaucucccuauccucugcuccgucaccuaacaaaggaggccccuaauaacuaaauaaauugcaaaacgaccaaaaaaaaaguguugcuuuguuugaggaaauaucucugccucccacacacacuuaagaugucuauuuuaaagcaccacuaagaaaauauucauaaaggcugggugugguggcuuacgccuguaaucccagcacuuugggaggccaaggcgggcgaaucaccugaggucaggaguucgagaccagccugaccaaauggcaaaacccugucucuacuaaaaauacaaaaauuagcugugcauacuagugggugccuguaaucccagcuauucgggaggcugagcaggagaaucgcuugaacccgggaggcagagguugcagugagcccagaugaugccacugcacugggggacagagccagacuccgucucggaaaaacacacacacacacacacacaagcaccucauauguacagugcaaaagaacuacuguuacuauuguuacacuugggaacgccuaguuuucuaucacaccaagaaucaccaaaaaacaccauaagugccuucaugggaaacguuucucuuuuccagguaucccaauaauacaccuguugccuaagggccacacacugacuggccuggaaagccgccgccuccuccucgagcaggguaauuccccaagcgggcaguguggccagcgagccccggguccggccuaaggaugccgcggcuuuucccucgggcccgguggcuucccgaggagcgcgaggggcucggcgccgcucccaaccccuaggcgcagaggccaucuuggcccucgaccccugcuccccgcacgcuuccuccgacgcaggcaacauggcuggcgcgcggggccggcccagucccggagguccccaaacuccguggcccggcugggcgcgggucccggcuuccgugcgcaccgaggcgcucccaggcagcgcgcgcccacguucgccgggcaggcaccgcccggaggcaguuccgccccccugggggcagcccuuuuggucacggaugagaauccgaagcgugagcagcuucccucgaaguccagccucacucgaaauuaacuccccgccccccagcuuaaaucgacgcggguucacacaacucgcaacaaguggauucgaaguagccaguguggcccacaccgugacuccuggaauauuucacagauugaauccagcccccgucuccccgggauauccaaagggguggggugggagcggaaggaaugaaauuccccccgggaucuaagccgcccgggccgccgaacagccgccucgcugcagccucaggcuuaggacccccaaggagcugggcgcaggaucccucuccaugaaggccgcccccccaaacugcagccccagagcggaugcaggaucgucgcuguucaggaaugucgugccccauaaaagugaaaaguugcccgcgccgcugaggcacugcuagcuuucagcguuuccgcggaauaaagcuugaucggcggcuccaagccaccccucgccccaggaggcagccucccaaguuggccggugcugcucucuccgcagacccgcgccucucugguucccacgagucccagcucggggacgaaacugccaccgaaaccagcgcggagcguccuccccccggcaccuccccuaacauagucgccgcgguccccccacggggacccucgggcucccgugcgccccugacgccgcgcccaacacucacccgcucgccgcaacugggcccgacccuccgggggccaacggugccagggagcgcgcucaccuggcgggcgcaccugacgccgcaccgaccgccagcgcucagccggggacugggcuggggacgucuccucccccuucucccucuccuuucccuccucccuacaaccggcccugcccccgggcaugcgcaccaacguggaagggggugcgggaagccugcgggccagcgccgcgagucccaccugcugcguccuagaccggcuccucggcgcucuggaccuggcucucgguuccugccgccuccgccagaggaagcagggagggagagguggacgcgggaguguagguguggugugucggccuccucccucggugaccaauucaccugaaacucggaugggagggggcgggaggacgcgguccugcuucccacacccugccagcgcgcuguuaaaggaaccgcgcgacguugcggcccgagaggcggggcgcagaggagaggcgcgggcuccuagggggcagcacggaugggggucccugaccaccccggggugcguucggugcuccgccugcuucggauggaaccuuggggugucugauggagagaggccgaacgagguccagaggggacuguuuccuccggaaagagggu

SEQ ID NO: 20052 - RNA, 2595 nt, Homo sapiens
acccucuuuccggaggaaacaguccccucuggaccucguucggccucucuccaucagacaccccaagguuccauccgaagcaggcggagcaccgaacgcaccccgggguggucagggacccccauccgugcugcccccuaggagcccgcgccucuccucugcgccccgccucucgggccgcaacgucgcgcgguuccuuuaacagcgcgcuggcagggugugggaagcaggaccgcguccucccgcccccucccauccgaguuucaggugaauuggucaccgagggaggaggccgacacaccacaccuacacucccgcguccaccucucccucccugcuuccucuggcggaggcggcaggaaccgagagccagguccagagcgccgaggagccggucuaggacgcagcaggugggacucgcggcgcuggcccgcaggcuucccgcacccccuuccacguuggugcgcaugcccgggggcagggccgguuguagggaggagggaaaggagagggagaagggggaggagacguccccagcccaguccccggcugagcgcuggcggucggugcggcgucaggugcgcccgccaggugagcgcgcucccuggcaccguuggcccccggagggucgggcccaguugcggcgagcgggugaguguugggcgcggcgucaggggcgcacgggagcccgaggguccccguggggggaccgcggcgacuauguuaggggaggugccggggggaggacgcuccgcgcugguuucgguggcaguuucguccccgagcugggacucgugggaaccagagaggcgcgggucugcggagagagcagcaccggccaacuugggaggcugccuccuggggcgagggguggcuuggagccgccgaucaagcuuuauuccgcggaaacgcugaaagcuagcagugccucagcggcgcgggcaacuuuucacuuuuauggggcacgacauuccugaacagcgacgauccugcauccgcucuggggcugcaguuugggggggcggccuucauggagagggauccugcgcccagcuccuuggggguccuaagccugaggcugcagcgaggcggcuguucggcggcccgggcggcuuagaucccggggggaauuucauuccuuccgcucccaccccaccccuuuggauaucccggggagacgggggcuggauucaaucugugaaauauuccaggagucacggugugggccacacuggcuacuucgaauccacuuguugcgaguugugugaacccgcgucgauuuaagcuggggggcggggaguuaauuucgagugaggcuggacuucgagggaagcugcucacgcuucggauucucauccgugaccaaaagggcugcccccaggggggcggaacugccuccgggcggugccugcccggcgaacgugggcgcgcgcugccugggagcgccucggugcgcacggaagccgggacccgcgcccagccgggccacggaguuuggggaccuccgggacugggccggccccgcgcgccagccauguugccugcgucggaggaagcgugcggggagcaggggucgagggccaagauggccucugcgccuagggguugggagcggcgccgagccccucgcgcuccucgggaagccaccgggcccgagggaaaagccgcggcauccuuaggccggacccggggcucgcuggccacacugcccgcuuggggaauuacccugcucgaggaggaggcggcggcuuuccaggccagucaguguguggcccuuaggcaacagguguauuauugggauaccuggaaaagagaaacguuucccaugaaggcacuuaugguguuuuuuggugauucuuggugugauagaaaacuaggcguucccaaguguaacaauaguaacaguaguucuuuugcacuguacauaugaggugcuuguguguguguguguguguguuuuuccgagacggagucuggcucugucccccagugcaguggcaucaucugggcucacugcaaccucugccucccggguucaagcgauucuccugcucagccucccgaauagcugggauuacaggcacccacuaguaugcacagcuaauuuuuguauuuuuaguagagacaggguuuugccauuuggucaggcuggucucgaacuccugaccucaggugauucgcccgccuuggccucccaaagugcugggauuacaggcguaagccaccacacccagccuuuaugaauauuuucuuaguggugcuuuaaaauagacaucuuaagugugugugggaggcagagauauuuccucaaacaaagcaacacuuuuuuuuuggucguuuugcaauuuauuuaguuauuaggggccuccuuuguuaggugacggagcagaggauagggagaucgguaagacaugauucuccaccuuuuggcaguuuccaggccauuucgggaaauagugggcagcagugccuccugcacgugaggcacugugguaaaagcauucuguauuuucucauuuaauuaucccaacaacucuaaaaggcaggccuuaguagaacuccauuuuaaaagugggcaaaugccgugggggaaac

SEQ ID NO: 20053 - RNA, 2744 nt, Homo sapiens
gaucccggcugcgggcccgugucugcccuagcgcgaugggcucgaaugcccggcuccacgaaucccggccuuucacccccacggccucucggcacugccccagcuagacaccagcgagcucgucacagcgcgggcaggcacugcggggcagcugcagacgagcccugucauacggccggaggaggccucgccugcccgugcggcgggcuccgggcacccugauaccuugacacaggaggccccgggcggccgggaagggcugugcgggggagggacugcgucuacacccgcgcccgacucgcucgggucacggcacugcccugccaccaggcggcuggggcgggggugaggccaggcgucggcccucgcgauucuguuuuguacgcugaggcucggagccuucgaagaacgggacagcggggcccacggacggcucugaaggccuucccgcggccgcaagagaucucggcggccggcguuugaggcgcgcggcuccgcugggaagcgagacccggguggcgggacaagacuugcuucccggccacgcgcgcucggccggccguggggcggggcauaggccgugacgugaugucgcguaucgagucuccgcccccuucccgccuccccguauauaagacuucgccgagcgcucucacucgcacaaguggaccgggguguugggugcuagucggcaccagaggcaagggugcgaggaccacggccggcucggacgugugaccgcgccuaggggguggcagcgggcagugcggggcggcaaggcgaccauggagcuuuugcggacuaucaccuaccagccagccgccagcaccaaaaugugcgagcaggcgcugggcaaggguugcggagcggacucgaagaagaagcggccgccgcagccccccgaggaaucgcagccaccucagucccaggcgcaagugcccccggcggccccucaccaccaucaccaccauucgcacucggggccggagaucucgcggauuaucgucgaccccacgacugggaagcgcuacugccggggcaaagugcugggaaaggugacaagcggagggcgccgggcugccgggcgggcgggaggucuguccgggcgaccccaagccgggcaagcccgcggggucccucgcccgccgcuuccggguuuuucggggguccgaucccagcgcgaggugggcuccucaccugcccucuggcuuuugugcgccggcagcgcuggggaucggcuuugcauucuuagccucagaacugugugucucccgcagcccagagaaaugcaucuugagucuggaagcgagggcuuucuacaucagaccucucucccucuaucugcucccagggaauuuuccugacaagucucaucagagauuauuuuucaugucuccccguuccaacucccuccauaaagcuccccuuuauaaaagaagaagagaaacuguuugaacuugcuguuuccagcaaugcauuucucuucaugagggagcuuuaacgaagucgaaugccucccucuguccacccuccuccauuccucaauuuuuuuuuuuuugcuuuucuuucuucccauuuauuuauuuauuuaaaauaucugccguccauuuuugugccauccucaauuccgucucggcuuuguuuccuuucaggguggcuuugcaaaauguuacgagaugacagauuugacaaauaacaaagucuacgccgcaaaaauuauuccucacagcagaguagcuaaaccucaucaaagggaaaaggugcguaugacucuugaguaaaguauuuucuuugugugcaaggauggcccuucccuguuaggaaaaugucuucugcauguguaaucacuggcuuuuccgaggugacuggaagcuaauaagccuuaccuugcuuuuucauuuagauugacaaagaaauagagcuucacagaauucuucaucauaagcauguagugcaguuuuaccacuacuucgaggacaaagaaaacauuuacauucucuuggaauacugcaguagaaggguaagugucaacuccuauuugagaacauuugcuuaccccgaauuaacaugguauucaaagaguauuuuaucugggauuuuagcuguggcagcacuuacacugcaaaguuaacuuucauugcucauccugcaaagggaaaccagugauuuugauaacuguuuugacagauucucuuuuuuccuucuccucuucuuagucaauggcucauauuuugaaagcaagaaagguguugacagagccagaaguucgauacuaccucaggcagauugugucuggacugaaauaccuucaugaacaagaaaucuugcacagagaucucaaacuagguaagucauugacgccaaaagcugaguuuuguguuagaguucuuuuuucucucucuguuuuuuuuuacauauuaauguucuuaauugggaucucgugucugcaaucuugcuuuugaaugggcgacuuucauauaacaauuggcugccuggcuccaaaguggauguguguguacuugguuagaacgcauuuucaaagggauucacauuuuguuuuguuuaucgucuagggaacuuuuuuauuaaugaagccauggaacuaaaaguuggggacuucggucuggcagccaggcuagaacccuuggaacacagaaggagguaagagucagaaagaugcauccuaguagacuuuuguggagaccaaauaugccuucauuauuuugcauuuaauguuucagagg

SEQ ID NO: 20054 - RNA, 2744 nt, Homo sapiens
ccucugaaacauuaaaugcaaaauaaugaaggcauauuuggucuccacaaaagucuacuaggaugcaucuuucugacucuuaccuccuucuguguuccaaggguucuagccuggcugccagaccgaaguccccaacuuuuaguuccauggcuucauuaauaaaaaaguucccuagacgauaaacaaaacaaaaugugaaucccuuugaaaaugcguucuaaccaaguacacacacauccacuuuggagccaggcagccaauuguuauaugaaagucgcccauucaaaagcaagauugcagacacgagaucccaauuaagaacauuaauauguaaaaaaaaacagagagagaaaaaagaacucuaacacaaaacucagcuuuuggcgucaaugacuuaccuaguuugagaucucugugcaagauuucuuguucaugaagguauuucaguccagacacaaucugccugagguaguaucgaacuucuggcucugucaacaccuuucuugcuuucaaaauaugagccauugacuaagaagaggagaaggaaaaaagagaaucugucaaaacaguuaucaaaaucacugguuucccuuugcaggaugagcaaugaaaguuaacuuugcaguguaagugcugccacagcuaaaaucccagauaaaauacucuuugaauaccauguuaauucgggguaagcaaauguucucaaauaggaguugacacuuacccuucuacugcaguauuccaagagaauguaaauguuuucuuuguccucgaaguagugguaaaacugcacuacaugcuuaugaugaagaauucugugaagcucuauuucuuugucaaucuaaaugaaaaagcaagguaaggcuuauuagcuuccagucaccucggaaaagccagugauuacacaugcagaagacauuuuccuaacagggaagggccauccuugcacacaaagaaaauacuuuacucaagagucauacgcaccuuuucccuuugaugagguuuagcuacucugcugugaggaauaauuuuugcggcguagacuuuguuauuugucaaaucugucaucucguaacauuuugcaaagccacccugaaaggaaacaaagccgagacggaauugaggauggcacaaaaauggacggcagauauuuuaaauaaauaaauaaaugggaagaaagaaaagcaaaaaaaaaaaaauugaggaauggaggaggguggacagagggaggcauucgacuucguuaaagcucccucaugaagagaaaugcauugcuggaaacagcaaguucaaacaguuucucuucuucuuuuauaaaggggagcuuuauggagggaguuggaacggggagacaugaaaaauaaucucugaugagacuugucaggaaaauucccugggagcagauagagggagagaggucugauguagaaagcccucgcuuccagacucaagaugcauuucucugggcugcgggagacacacaguucugaggcuaagaaugcaaagccgauccccagcgcugccggcgcacaaaagccagagggcaggugaggagcccaccucgcgcugggaucggacccccgaaaaacccggaagcggcgggcgagggaccccgcgggcuugcccggcuuggggucgcccggacagaccucccgcccgcccggcagcccggcgcccuccgcuugucaccuuucccagcacuuugccccggcaguagcgcuucccagucguggggucgacgauaauccgcgagaucuccggccccgagugcgaaugguggugaugguggugaggggccgccgggggcacuugcgccugggacugagguggcugcgauuccucggggggcugcggcggccgcuucuucuucgaguccgcuccgcaacccuugcccagcgccugcucgcacauuuuggugcuggcggcuggcugguaggugauaguccgcaaaagcuccauggucgccuugccgccccgcacugcccgcugccacccccuaggcgcggucacacguccgagccggccgugguccucgcacccuugccucuggugccgacuagcacccaacaccccgguccacuugugcgagugagagcgcucggcgaagucuuauauacggggaggcgggaagggggcggagacucgauacgcgacaucacgucacggccuaugccccgccccacggccggccgagcgcgcguggccgggaagcaagucuugucccgccacccgggucucgcuucccagcggagccgcgcgccucaaacgccggccgccgagaucucuugcggccgcgggaaggccuucagagccguccgugggccccgcugucccguucuucgaaggcuccgagccucagcguacaaaacagaaucgcgagggccgacgccuggccucacccccgccccagccgccugguggcagggcagugccgugacccgagcgagucgggcgcggguguagacgcagucccucccccgcacagcccuucccggccgcccggggccuccugugucaagguaucagggugcccggagcccgccgcacgggcaggcgaggccuccuccggccguaugacagggcucgucugcagcugccccgcagugccugcccgcgcugugacgagcucgcuggugucuagcuggggcagugccgagaggccgugggggugaaaggccgggauucguggagccgggcauucgagcccaucgcgcuagggcagacacgggcccgcagccgggauc

SEQ ID NO: 20055 - RNA, 2545 nt, Homo sapiens
aaacaaaaccgacaaacgcaaccgaauuaacacuauugcuuguuugggucacugaagaaaacuuuucccgugucgacagaauucuagcccgacuuucguuuggaacucaggaucagaccuuuacaaaauuaccgaccuggguuagaggugcccgcacgugucgagaccaucuggccaaggacagagagaugcccccugggagaauguuuuaaccggcgcagcggagccgcuuggcugcgcccgccgcagcccuacucccacuccgugcaccgggcuccgcagugacccgggcuccgcagugacccgggcucccgcagcgacccgggcuccgguugcccagguaacgcaggacgcaggcgcgaaaggcgggugccuggcgcgcgcugcagcucccccuccccccggcgggccgcggaggcgacgcgcugccugcgcccugaggcgagugguucuccagccggaaaaucgcggcuccggugccgcucugggcucagccagugagaggccgggggugugguagagagaaggagccggccggguacuuaggaccgcgccagccucugagcccggccuccuucgcacuuucgagugcgcguuugcugcccgccgcagcccgggcguugaagguaguaaagcggccacccggccgcaucauggugacccccugucccaccagccccucgagccccgccgcccgagcggggaggcgggacaacgaccagaaccuucgcgccccggugaagaagagcaggcguccgcgccuccggaggaagcagccgcugcauccccugaacccgugcccgcucccgggagacuccggcauuugcgaccuguucgagucccccagcuccggcucagacggcgcagagagccccucugcggcgcggggugguagcccccugcccggcccggcccagcccguggcgcagcuagaucuacagaccuuccgcgacuacggccagagcugcuacgccuuccgcaaggcgcaggagagccacuuccacccgcgggaggcgcuggcacggcagccacaagugaggugcugguagagccagcuccacgccgccgcucuuccucuccucccaggcucucuccucuccugccggcucggcccuccgagcgcccgggcccgcgacagcccaggucccgccccgagucgaagcacaaggggccguggaggggcgucaccggccucauuuuacagauggagaaaaguggggcguagacggcuugagggacuugccccgucccaagcuggcuacuggggcacgguagagaggaauucguuuccggguugagucuggacuccuaccgaacucgggcaaguuauuuaacaccccugagcuucuuucuucaucugcaaaauggaaccccuccccuuccuuugaauugcugagcccauuacgcgagguaacguguacgacgcucucugcacagcgccaggucccaaucccgguguuccggcucagcacggcccacgcguuucccaguuuccauugcguuucucuuucugaaaucuucuugccccucuccugggaagcuccccgauucuucuuggcccuuccuucccuuccacagucccucuccacccuaagcccagcgggcccgccuccccccuccuucccggcaggugacggcggaaucccgcuguaagcugcucagcuggcugaucccggugcaccgccaauucggccucuccuucgagucgcugugccugacggugaacacucuggaccgcuuccucaccaccacgccgguggcugcagacugcuuccagcugcuuggggucaccuccuugcucaucgcuugcaaacagguaccugggguaucaaacagguacacgcggcaucuggggacgcagccaaacucccccgccacucccuggccgcccgucuuuccagcgcgcacgauucagugcuggguucccagaacucauuuuaucagacauuugcauacgcauauaucccuuagccuuaacuucacaauuucuccacaaacgaaaaauccugucacucggcuuccaaagaaauagccuaauagacuaauagcuguaaucagucccaaauagcucuuuuggcaccucuagucuagccuccgaaaaagccuucaaaauuucccaagcuuuuuuuuuuuaguuggacaguaguuagaucaacugcgcuggaaguacgcucuaggucacuuacguggaagcaguggagaggcagagccccggcugucucucuggaagggauggggaaaguccgggcgucauacuggggugggccuggggcccgggaagccgcaaagcgggguugagugcgcccuguguugcagguggaggugcacccgccgcgcgugaagcagcuucuggcccucugcugcggcgccuucucccggcagcagcucugcaaccucgagugcaucgugcugcacaagcugcacuucacccugggugcgcccaccauuagcuucuuccuggagcauuucacgcacgcucgcguggaggcggggcaggcugaggccuccgaagcucuggaagcgcaagcccuggcgcggggggugg

SEQ ID NO: 20056 - RNA, 2545 nt, Homo sapiens
ccaccccccgcgccagggcuugcgcuuccagagcuucggaggccucagccugccccgccuccacgcgagcgugcgugaaaugcuccaggaagaagcuaauggugggcgcacccagggugaagugcagcuugugcagcacgaugcacucgagguugcagagcugcugccgggagaaggcgccgcagcagagggccagaagcugcuucacgcgcggcgggugcaccuccaccugcaacacagggcgcacucaaccccgcuuugcggcuucccgggccccaggcccaccccaguaugacgcccggacuuuccccaucccuuccagagagacagccggggcucugccucuccacugcuuccacguaagugaccuagagcguacuuccagcgcaguugaucuaacuacuguccaacuaaaaaaaaaaagcuugggaaauuuugaaggcuuuuucggaggcuagacuagaggugccaaaagagcuauuugggacugauuacagcuauuagucuauuaggcuauuucuuuggaagccgagugacaggauuuuucguuuguggagaaauugugaaguuaaggcuaagggauauaugcguaugcaaaugucugauaaaaugaguucugggaacccagcacugaaucgugcgcgcuggaaagacgggcggccagggaguggcgggggaguuuggcugcguccccagaugccgcguguaccuguuugauaccccagguaccuguuugcaagcgaugagcaaggaggugaccccaagcagcuggaagcagucugcagccaccggcgugguggugaggaagcgguccagaguguucaccgucaggcacagcgacucgaaggagaggccgaauuggcggugcaccgggaucagccagcugagcagcuuacagcgggauuccgccgucaccugccgggaaggaggggggaggcgggcccgcugggcuuaggguggagagggacuguggaagggaaggaagggccaagaagaaucggggagcuucccaggagaggggcaagaagauuucagaaagagaaacgcaauggaaacugggaaacgcgugggccgugcugagccggaacaccgggauugggaccuggcgcugugcagagagcgucguacacguuaccucgcguaaugggcucagcaauucaaaggaaggggagggguuccauuuugcagaugaagaaagaagcucagggguguuaaauaacuugcccgaguucgguaggaguccagacucaacccggaaacgaauuccucucuaccgugccccaguagccagcuugggacggggcaagucccucaagccgucuacgccccacuuuucuccaucuguaaaaugaggccggugacgccccuccacggccccuugugcuucgacucggggcgggaccugggcugucgcgggcccgggcgcucggagggccgagccggcaggagaggagagagccugggaggagaggaagagcggcggcguggagcuggcucuaccagcaccucacuuguggcugccgugccagcgccucccgcggguggaaguggcucuccugcgccuugcggaaggcguagcagcucuggccguagucgcggaaggucuguagaucuagcugcgccacgggcugggccgggccgggcagggggcuaccaccccgcgccgcagaggggcucucugcgccgucugagccggagcugggggacucgaacaggucgcaaaugccggagucucccgggagcgggcacggguucaggggaugcagcggcugcuuccuccggaggcgcggacgccugcucuucuucaccggggcgcgaagguucuggucguugucccgccuccccgcucgggcggcggggcucgaggggcuggugggacagggggucaccaugaugcggccggguggccgcuuuacuaccuucaacgcccgggcugcggcgggcagcaaacgcgcacucgaaagugcgaaggaggccgggcucagaggcuggcgcgguccuaaguacccggccggcuccuucucucuaccacacccccggccucucacuggcugagcccagagcggcaccggagccgcgauuuuccggcuggagaaccacucgccucagggcgcaggcagcgcgucgccuccgcggcccgccggggggagggggagcugcagcgcgcgccaggcacccgccuuucgcgccugcguccugcguuaccugggcaaccggagcccgggucgcugcgggagcccgggucacugcggagcccgggucacugcggagcccggugcacggagugggaguagggcugcggcgggcgcagccaagcggcuccgcugcgccgguuaaaacauucucccagggggcaucucucuguccuuggccagauggucucgacacgugcgggcaccucuaacccaggucgguaauuuuguaaaggucugauccugaguuccaaacgaaagucgggcuagaauucugucgacacgggaaaaguuuucuucagugacccaaacaagcaauaguguuaauucgguugcguuugucgguuuuguuu

SEQ ID NO: 20057 - RNA, 2580 nt, Homo sapiens
aguggagggggaagcccugaucacagagaugggaggugggcgagagggagggagggagagagggagaagacagggcgccccagccauaucaaugucaguuaccagugacccagacacaacacgugcagcuugcauugacuuuuacuagacuguuuacuuuuauucgucccauuucauaaccugcagagacucgaagagcagauuaaagaaccugacaaaaacaggaugcgacggauguuuuuacaugcugguuucauguaggcggguacaggaauuauuugugacagggguuaagaaaguaagagaacgagagagaggagagaggagagauggaggggagagagagggagaaggaaagagaaagaaagaaagaaaagaaagaagagaaagaaagaaaagaaagagaaagaaagaaaaaaaggaagaaagaaagagagagaggaagaaagaaaagaaagagagagagagagaaacagaucaagcaaaaggcacuucugaaaaaugaaagcaaaaaagcaacccggcccagcccggagcuaccccgcgcggccuccaggcgcagccagcccgacgggcccguuuugcaauccgccagaccggagcacgcccgcggccaccgcgaucuuucgaaaucuccgagggcugcuuuccuccgcgcccacguccgggcaccaggcagagccucuccucuaaaggcgggcaacccagcgcagugccaugcagacggcgaggggcagugcccaggagggcaguuuacaacauacuuaaaauguuaacgcugaagcagggaaaguaaugccuuaagguggggggaggggggagucuuccuaccauuucacgguuauaaguaccuaucucauaccuagcaagaaauauuugcaagugauuucucccucuucccccuuuuuaauguucggauuugggucgagaagacuucucaugaaucaccaauaugacuuuaacaaucauuggaucgcaagcugcuauuauuauuuuaaacauucugcccaaagacuaauugaaauaaacaaaucuauuuuuaaaaggcaagcuucagaaauuugcucuuaacccauuucagaauuuaagucaguuaugggcugcucacuguuuuacagaaagcuaagggucagaaagaagaaugaggcagaggggaaaaaaacuguaaagugcucaaagcacuuugggguaauaauuuggcuuuuuuuuuuuuuuuuuuuuuuuugcgagaaugggggaugggguuggaagaagcauccacuaggcagaaagcuacuucccuugaaaaucuucagcacccacauuuccaaguuugggcaaaguuucugaaaccacgucccccagccaccaaauaaaauucaguaucucucccccaaacccccagguuuucuuuucuuucuuuccuuuuuuuuuuuuaaguauccaaaagaugugggagggagagagaugagacugcaaaugggucgacugaaaucuccaggcuacuacugauacuuguucccuucuucagagccaaacagaggagaucacaucuaaaguuaucauggccagaacuuggagcauuuaacccuaacuacuaagaccccagcucgcucccuuuccuuuuucaagauaaccgagcuccaaacucaguucccaguccuaaagugucauugccuacaauuuucccacuccucuccaucccggaguccccaaguugguucaacaucuuccgagagcagcguugcucagaacagaccaaguggagaccacagaaaagucgaccccccuguccucagccaagccuccccagcgcauccccacucgcuuacccugggcacugcgguccuccaugaacuggcagagcagcagcagcaggaggcaaagcccacccggcuggugccucgcgcggaccauccugggggcaggcgcggggcgaggagcgcagcggcgcggggagccggcgcggcggcggguggcucgggcgagcggcgcgcgucgcagaggccagcggcggagggcgcagcgaucccggcgcagccccgcgcucgccgccggccgcccgcgcgauucaauggacgucagaagccgggcgcagccgcgcuuuaaaucuagacgggggucuccgcgguuugcggugggcggucucccaguguguggggcugugggagggcggccgcgagcgagggugugcgcggcuccuuggggguggggagcuuucaaaaguucagugugaaucaggugacauuucccaccuucuggaaacccuucccaauuaucuuucggaggugcccgaaaucaaaacggcuggaagggaaucgucgaguucuuauuugcguaggagcgagagggagggggaaggcgaccggggcggggguugggggcuacgcgucggggguggggaguggggaagaacacccacuucaaguccugcucgccgccgcucgccggcagcgccggcgcgcccgggguggcgggugugugugugagugugugugugagugugugugcgcgcgcgcgcgagugugagagggagggcgcggugggggcgcuggaggcgguggcggggggaacccgggaguuugucuccgugcugccucu

SEQ ID NO: 20058 - RNA, 2580 nt, Homo sapiens
agaggcagcacggagacaaacucccggguuccccccgccaccgccuccagcgcccccaccgcgcccucccucucacacucgcgcgcgcgcgcacacacacucacacacacacucacacacacacccgccaccccgggcgcgccggcgcugccggcgagcggcggcgagcaggacuugaaguggguguucuuccccacuccccacccccgacgcguagcccccaacccccgccccggucgccuucccccucccucucgcuccuacgcaaauaagaacucgacgauucccuuccagccguuuugauuucgggcaccuccgaaagauaauugggaaggguuuccagaaggugggaaaugucaccugauucacacugaacuuuugaaagcuccccacccccaaggagccgcgcacacccucgcucgcggccgcccucccacagccccacacacugggagaccgcccaccgcaaaccgcggagacccccgucuagauuuaaagcgcggcugcgcccggcuucugacguccauugaaucgcgcgggcggccggcggcgagcgcggggcugcgccgggaucgcugcgcccuccgccgcuggccucugcgacgcgcgccgcucgcccgagccacccgccgccgcgccggcuccccgcgccgcugcgcuccucgccccgcgccugcccccaggaugguccgcgcgaggcaccagccgggugggcuuugccuccugcugcugcugcucugccaguucauggaggaccgcagugcccaggguaagcgaguggggaugcgcuggggaggcuuggcugaggacaggggggucgacuuuucuguggucuccacuuggucuguucugagcaacgcugcucucggaagauguugaaccaacuuggggacuccgggauggagaggagugggaaaauuguaggcaaugacacuuuaggacugggaacugaguuuggagcucgguuaucuugaaaaaggaaagggagcgagcuggggucuuaguaguuaggguuaaaugcuccaaguucuggccaugauaacuuuagaugugaucuccucuguuuggcucugaagaagggaacaaguaucaguaguagccuggagauuucagucgacccauuugcagucucaucucucucccucccacaucuuuuggauacuuaaaaaaaaaaaaggaaagaaagaaaagaaaaccuggggguuugggggagagauacugaauuuuauuugguggcugggggacgugguuucagaaacuuugcccaaacuuggaaaugugggugcugaagauuuucaagggaaguagcuuucugccuaguggaugcuucuuccaaccccaucccccauucucgcaaaaaaaaaaaaaaaaaaaaaaaagccaaauuauuaccccaaagugcuuugagcacuuuacaguuuuuuuccccucugccucauucuucuuucugacccuuagcuuucuguaaaacagugagcagcccauaacugacuuaaauucugaaauggguuaagagcaaauuucugaagcuugccuuuuaaaaauagauuuguuuauuucaauuagucuuugggcagaauguuuaaaauaauaauagcagcuugcgauccaaugauuguuaaagucauauuggugauucaugagaagucuucucgacccaaauccgaacauuaaaaagggggaagagggagaaaucacuugcaaauauuucuugcuagguaugagauagguacuuauaaccgugaaaugguaggaagacuccccccuccccccaccuuaaggcauuacuuucccugcuucagcguuaacauuuuaaguauguuguaaacugcccuccugggcacugccccucgccgucugcauggcacugcgcuggguugcccgccuuuagaggagaggcucugccuggugcccggacgugggcgcggaggaaagcagcccucggagauuucgaaagaucgcgguggccgcgggcgugcuccggucuggcggauugcaaaacgggcccgucgggcuggcugcgccuggaggccgcgcgggguagcuccgggcugggccggguugcuuuuuugcuuucauuuuucagaagugccuuuugcuugaucuguuucucucucucucucuuucuuuucuuucuuccucucucucuuucuuucuuccuuuuuuucuuucuuucucuuucuuuucuuucuuucucuucuuucuuuucuuucuuucuuucucuuuccuucucccucucucuccccuccaucucuccucucuccucucucucguucucuuacuuucuuaaccccugucacaaauaauuccuguacccgccuacaugaaaccagcauguaaaaacauccgucgcauccuguuuuugucagguucuuuaaucugcucuucgagucucugcagguuaugaaaugggacgaauaaaaguaaacagucuaguaaaagucaaugcaagcugcacguguugugucugggucacugguaacugacauugauauggcuggggcgcccugucuucucccucucucccucccucccucucgcccaccucccaucucugugaucagggcuucccccuccacu

SEQ ID NO: 20059 - RNA, 2614 nt, Homo sapiens
ccccccacccccacucaacccuagaggguaagggauaaucuuuggccaucguauccccgguguuaucacuaagauucuggggguugcgcgcgggcuaggcccgacccgggggccacguaccuggguguggauaauuuugugccugcagagcgugcuggccuggcgaaagccuuugccgcagacuuugcacacgaacggucuggcuccgguguggaccggcauguggcgggugagauuauagugagcguuaaacaccuauggaaagacauggggggccuuguggugcgucuguccgagggccuacaaucagccccgggggggccacagccuaccucccccaaccaacacccccuucagaaaccagagccuuuuucaguuuguaaagugcugcccaaacuccugcuuacaccaauacuguguggccgcugacaagggcauccccauuuuacagaauaggaaacugaggcccaacgaggcucccaguuuggguagucaacuacuggggagcuccucagcuugaaaaaggggcauuccaggcugccccaaggaagccgccgccgccgaucgccccucccggccccccucgccgaacccugggccucaccuugccgcacaccucgcaggugaaguuuuugggcuugccaucugcggagccuccuggcagcuugcuguggcccuugacgccuccgcgcucggcagucagggccgaguuuuccuucaguaccugcuccagcggcgccggcaagcgcuccuuauggggauagggagccgggugggggaacuuguccgcagccaggccggccagcuuggcguucuccagcagaaagagcuuggggugagcagccagggcggcgggggccugcgcauugaggaggccagacgggaagagguggccgcugaggagcucagacggcggguacgcggucgaguccagguaguugaaguaguagagcgagccgcuggccggcagccccacagccugguugaugaccugcggcuugaugacccugcccgcgggcagcgcggacggcgccaggcccagcucggccuugcagcacacgccacaguugguuuugcacaagccgcuggcgccgcacacuggggcccccccgccgccgccgccgccaccgccgccgccgccuccgccgccgcccgcccggaggcugcuuuuccagagcuccgaguaacugagcagugucuuugacggcaccucguagccuaggggcuggagggggaucauacagggcagcggcgagcagagguugagcaguuucuugcccuggcugccguccgccucuagcgcuccaggccggggcucaaagggcgcacggggcuccgacgucuuggccaugaugcgcucgauggaaaaggccagugucuuggaaguggccggcgacgcuccggcgcgcgggcaggccgggggcaccauggucuccagggaagccgagcuugccauggcgcgcggagcugagccgagccaggcugggccagggcgcagccucucuccucuaagucugcauuccggaaaaggcaggggggaaaacugcaauuuaauaagcaccuagucgggcccgggucacccauuugcauucaaaugaacaggggcaaaacaaagugcacccaaggguaccaaauuaccgcccauuaacccggcgcgcaaaggaacccaccagccccugcccugggacuuugaaagggggaagaagggggaggguuuacaaaagaaaagggggggggcggugagaaaagagucucaaauuaaccccccugagcccuucccuggacccgggccucugccacgcgugcugggagcuggacagugaaggggcaaaguuaaagaggaccggagagccaccucgcauuuaccucuuucccccaccaccaaggagaugcguuccgagccaugcagcgugucucuucugucacauuuugauggcaaacaucuuccccuccgcgugagaucacugucuuuuacauucagcugacaucacaugaagucacuugaaguggaaugacaugggcggcggcgcggcucccguagcggccccuguguucccccgcgccugccggccgccgccaccaccgccccucaaacuuuaaaaggaggcaacuggcgcccgcgcuccucucgggaaagugcgagcgguuugcgaauagggaaagagggaagagacgggagggggagggggaggaaucgugaugguuuugccgguggaaggaaagggggggggggacccaaacccaaaccuaggcagaguuccgugcgugauucacaacuuuggaggccugcagguuugggggacgcggggagggcggagggucccggacgcggcgcccccaaagggccccuggguaucagucuaguagccgaaguaucccuuagcccuccgcagccgagcugggcaucgugcuaauaaacugccauuuacccacggaaccggcgccagccccgaacacgcgcaaaugauaauuaccucauuaggauguggcgcauggacgcgggcgccgcguuuggaggggggaacuuguuaauggggaaauauuaauuuaugcaaaagcaaugagcucgccuuggcuggcgucggaggucgggagaaagcucccacugacuaag

SEQ ID NO: 20060 - RNA, 2614 nt, Homo sapiens
cuuagucagugggagcuuucucccgaccuccgacgccagccaaggcgagcucauugcuuuugcauaaauuaauauuuccccauuaacaaguuccccccuccaaacgcggcgcccgcguccaugcgccacauccuaaugagguaauuaucauuugcgcguguucggggcuggcgccgguuccguggguaaauggcaguuuauuagcacgaugcccagcucggcugcggagggcuaagggauacuucggcuacuagacugauacccaggggcccuuugggggcgccgcguccgggacccuccgcccuccccgcgucccccaaaccugcaggccuccaaaguugugaaucacgcacggaacucugccuagguuuggguuugggucccccccccccuuuccuuccaccggcaaaaccaucacgauuccucccccucccccucccgucucuucccucuuucccuauucgcaaaccgcucgcacuuucccgagaggagcgcgggcgccaguugccuccuuuuaaaguuugaggggcggugguggcggcggccggcaggcgcgggggaacacaggggccgcuacgggagccgcgccgccgcccaugucauuccacuucaagugacuucaugugaugucagcugaauguaaaagacagugaucucacgcggaggggaagauguuugccaucaaaaugugacagaagagacacgcugcauggcucggaacgcaucuccuugguggugggggaaagagguaaaugcgagguggcucuccgguccucuuuaacuuugccccuucacuguccagcucccagcacgcguggcagaggcccggguccagggaagggcucagggggguuaauuugagacucuuuucucaccgcccccccccuuuucuuuuguaaacccucccccuucuucccccuuucaaagucccagggcaggggcugguggguuccuuugcgcgccggguuaaugggcgguaauuugguacccuugggugcacuuuguuuugccccuguucauuugaaugcaaaugggugacccgggcccgacuaggugcuuauuaaauugcaguuuuccccccugccuuuuccggaaugcagacuuagaggagagaggcugcgcccuggcccagccuggcucggcucagcuccgcgcgccauggcaagcucggcuucccuggagaccauggugcccccggccugcccgcgcgccggagcgucgccggccacuuccaagacacuggccuuuuccaucgagcgcaucauggccaagacgucggagccccgugcgcccuuugagccccggccuggagcgcuagaggcggacggcagccagggcaagaaacugcucaaccucugcucgccgcugcccuguaugaucccccuccagccccuaggcuacgaggugccgucaaagacacugcucaguuacucggagcucuggaaaagcagccuccgggcgggcggcggcggaggcggcggcggcgguggcggcggcggcggcgggggggccccagugugcggcgccagcggcuugugcaaaaccaacuguggcgugugcugcaaggccgagcugggccuggcgccguccgcgcugcccgcgggcagggucaucaagccgcaggucaucaaccaggcuguggggcugccggccagcggcucgcucuacuacuucaacuaccuggacucgaccgcguacccgccgucugagcuccucagcggccaccucuucccgucuggccuccucaaugcgcaggcccccgccgcccuggcugcucaccccaagcucuuucugcuggagaacgccaagcuggccggccuggcugcggacaaguucccccacccggcucccuauccccauaaggagcgcuugccggcgccgcuggagcagguacugaaggaaaacucggcccugacugccgagcgcggaggcgucaagggccacagcaagcugccaggaggcuccgcagauggcaagcccaaaaacuucaccugcgaggugugcggcaaggugaggcccaggguucggcgaggggggccgggaggggcgaucggcggcggcggcuuccuuggggcagccuggaaugccccuuuuucaagcugaggagcuccccaguaguugacuacccaaacugggagccucguugggccucaguuuccuauucuguaaaauggggaugcccuugucagcggccacacaguauugguguaagcaggaguuugggcagcacuuuacaaacugaaaaaggcucugguuucugaaggggguguugguugggggagguaggcuguggcccccccggggcugauuguaggcccucggacagacgcaccacaaggccccccaugucuuuccauagguguuuaacgcucacuauaaucucacccgccacaugccgguccacaccggagccagaccguucgugugcaaagucugcggcaaaggcuuucgccaggccagcacgcucugcaggcacaaaauuauccacacccagguacguggcccccgggucgggccuagcccgcgcgcaacccccagaaucuuagugauaacaccggggauacgauggccaaagauuaucccuuacccucuaggguugagugggggugggggg

SEQ ID NO: 20061 - RNA, 2447 nt, Homo sapiens
gucucguacauuugucgcguugaugaagacuucacagcuccaucagcugcgggcaagggggucugaggcagucuuaggcaaguuggggcccagcggggagaaguugcagaagaacugauuagaggaccccaggaggcuucagagcugggcgagguagagagucuccugugcgccuucucuccucucugcaauucggggacuccuugcacuggggcaggcccccggccaggugcaugggaggaagcacggagaauuuacaagccucucgauuccucaguccagacgcuguuggguccccuccgcuggagaucgcgcuucccccaaaucuuugugagcguugcggaagcacgcgggguccgggucgcugagcgcugcaagacaggggagggagccgggcgggagagggaggggcggcgccggggcgggcccugauauagagcaggcgccgcgggucgcagcacagugcggagaccgcagccccggagcccgggccaggguccaccuguccccgcagcgccggcucgcgcccuccugccgcagccaccggugagugccgcgguccugagauccccgggccggaugcgcggcggccccagcucccgagcgucugccucccccgcccugggcugcccgggcucccugggcuccccggcggcugcacggagucaaggcgccccgucccgggcgucccccgcgggugccgauccaggcugcccggaguccggagcccagagaggagagagacagcuggggagccuggucaccgcgggcaucuccccugcgcugcagucgcccgccuggccugccuucccguuccuccgccucuugcccugacuucuccuuccuuugcagagccgccgucuagcgccccgaccucgccaccaugagagcccugcuggcgcgccugcuucucugcguccuggucgugagcgacuccaaagugagugcgcucuugcuuugacugaugcugcccaaggaccucugaucagcaccaggggagaggaggggcugcucagggagcugggguccuccggauuccauccacagcagggccagacucuccccaggaaaugggacaggguggcagcggaggcuugagaaccacggggguuggcacuggcuggcaagggaggaagaggccgccgggacugccccagccugcgggcaucugguagaugaagcuugcuugggucaauccauuucuccuggcuggaaacccauggucuuccauuugagaacuagauacgaacagggugaggcgagagggagagggaagaguggguuuugggauuggggccaguuuacccucacccuggagucccuggagcaugggaccuuugaugaagccuccucccgaaucucuuccagggcagcaaugaacuucaucaaguuccaugugaguauccaccccuacaacaguuggcugcacagacaaguugggaaggcuucaggggacauccccucccugcccucugcugcagggcugcgccaccccuuaccacuuccacucccccucgcuuaccccaccuuuguucucuccagcgaacugugacugucuaaauggaggaacauguguguccaacaaguacuucuccaacauucacuggugcaacugcccaaagaaauucggagggcagcacugugaaauagguauggggaucuccacugcaacugggagagaaauuuggggacagggagggaugggugggaggcaagagcaggcaggaguuaggagcuggagguagggugggugacaucuucaucccuaugugacaagcauaaacacacacacacgcucacgaaacaguggccacacaaaugugaggugggguuggaaggagacccuguccagucuucuggcaggucugaaacgacaucuuuaaaauguccguuggcagccgggcaugguggcucacgcuuguaaucccagcauuuugagaggucaaggugaguggaucauuugaggucaggaguucaagaccagccuggacaacaugguguaacccugccucuacuaaaaaugcaaaaaucagccuggcaugguaguggaugccuguagucccagcuacuugggaggcugaggcaggagaauugcuugaaccugggaggcagagaucucagugagcugagaucacaccacugcacuccaacugggcgacagagcaagacuccaucucaaaaaaaaaaaauaaaaguuaguuggaauguucuucucuuucucauauucucucauccuccuguccccuuguagauaagucaaaaaccugcuaugaggggaauggucacuuuuaccgaggaaaggccagcacugacaccaugggccggcccugccugcccuggaacucugccacuguccuucagcaaacguaccaugcccacagaucugaugcucuucagcugggccuggggaaacauaauuacugcaggugaggugggggcaacaagga

SEQ ID NO: 20062 - RNA, 2447 nt, Homo sapiens
uccuuguugcccccaccucaccugcaguaauuauguuuccccaggcccagcugaagagcaucagaucugugggcaugguacguuugcugaaggacaguggcagaguuccagggcaggcagggccggcccauggugucagugcuggccuuuccucgguaaaagugaccauuccccucauagcagguuuuugacuuaucuacaaggggacaggaggaugagagaauaugagaaagagaagaacauuccaacuaacuuuuauuuuuuuuuuuugagauggagucuugcucugucgcccaguuggagugcaguggugugaucucagcucacugagaucucugccucccagguucaagcaauucuccugccucagccucccaaguagcugggacuacaggcauccacuaccaugccaggcugauuuuugcauuuuuaguagaggcaggguuacaccauguuguccaggcuggucuugaacuccugaccucaaaugauccacucaccuugaccucucaaaaugcugggauuacaagcgugagccaccaugcccggcugccaacggacauuuuaaagaugucguuucagaccugccagaagacuggacagggucuccuuccaaccccaccucacauuuguguggccacuguuucgugagcguguguguguguuuaugcuugucacauagggaugaagaugucacccacccuaccuccagcuccuaacuccugccugcucuugccucccacccaucccucccuguccccaaauuucucucccaguugcaguggagauccccauaccuauuucacagugcugcccuccgaauuucuuugggcaguugcaccagugaauguuggagaaguacuuguuggacacacauguuccuccauuuagacagucacaguucgcuggagagaacaaaggugggguaagcgagggggaguggaagugguaagggguggcgcagcccugcagcagagggcagggaggggauguccccugaagccuucccaacuugucugugcagccaacuguuguagggguggauacucacauggaacuugaugaaguucauugcugcccuggaagagauucgggaggaggcuucaucaaaggucccaugcuccagggacuccagggugaggguaaacuggccccaaucccaaaacccacucuucccucucccucucgccucacccuguucguaucuaguucucaaauggaagaccauggguuuccagccaggagaaauggauugacccaagcaagcuucaucuaccagaugcccgcaggcuggggcagucccggcggccucuuccucccuugccagccagugccaacccccgugguucucaagccuccgcugccacccugucccauuuccuggggagagucuggcccugcuguggauggaauccggaggaccccagcucccugagcagccccuccucuccccuggugcugaucagagguccuugggcagcaucagucaaagcaagagcgcacucacuuuggagucgcucacgaccaggacgcagagaagcaggcgcgccagcagggcucucaugguggcgaggucggggcgcuagacggcggcucugcaaaggaaggagaagucagggcaagaggcggaggaacgggaaggcaggccaggcgggcgacugcagcgcaggggagaugcccgcggugaccaggcuccccagcugucucucuccucucugggcuccggacuccgggcagccuggaucggcacccgcgggggacgcccgggacggggcgccuugacuccgugcagccgccggggagcccagggagcccgggcagcccagggcgggggaggcagacgcucgggagcuggggccgccgcgcauccggcccggggaucucaggaccgcggcacucaccgguggcugcggcaggagggcgcgagccggcgcugcggggacagguggacccuggcccgggcuccggggcugcggucuccgcacugugcugcgacccgcggcgccugcucuauaucagggcccgccccggcgccgccccucccucucccgcccggcucccuccccugucuugcagcgcucagcgacccggaccccgcgugcuuccgcaacgcucacaaagauuugggggaagcgcgaucuccagcggaggggacccaacagcgucuggacugaggaaucgagaggcuuguaaauucuccgugcuuccucccaugcaccuggccgggggccugccccagugcaaggaguccccgaauugcagagaggagagaaggcgcacaggagacucucuaccucgcccagcucugaagccuccugggguccucuaaucaguucuucugcaacuucuccccgcugggccccaacuugccuaagacugccucagacccccuugcccgcagcugauggagcugugaagucuucaucaacgcgacaaauguacgagac

SEQ ID NO: 20063 - RNA, 2576 nt, Homo sapiens
gcgcgcucgccccgggagcaggagcagcgggaggaggaggagcuggcgcggcggccacgggcgcccagcgcgccuucucggcgccuggagccagacgcgaguaauccuggguggcccgcagcggagccguggccgggcuagaggagccggcuggacugcgggagugccgggcggcucgcgguguccgccucgggcugcuccccugcgcugcguucucgcggccccgcgccggcgcugcgcucugcgaugcgagccgcugcguguccagccggggcucuggcgaggaaacucacuucaaaagcagcugcaccaagggggagauuaaagccuuugccgccuuccaaucaaaugggagcccgaggugauuggagggucaaggggaugugacgcgucccgcgccgccgccgccgccgcugccaggacucucagugccgguuuuaaugggcagcucccucuucgccgccccccuguguguccccucccucgauuucgcugggaggacgagauggacauuuauucuacguuugccauccgccgccucccucuuuuuuccuccucgucguucuuccuuuccccagcucgaaaauaaacugaaaccuucuuuugaaggggggugcgcgugaggaacagacugcgggggguguccagaaggagcaccggugggaguguggacaccggccggacugucaacuccaggggcgaagggaaccugcacacccaguguuuuuuccuucgcaguaaucgagaucccgcgcggcgcagcgcagccaccaggguaagaaggcaagguggggagccggagcuggaagaagcccgcccgcccgcucuaauuuccucagauuccgcggcggagaaaccagaagcuagaugggcagucgcagcggcggcggcucaacaccgcgaggagcgcugggcucuccgcccuucccggccacgugacgcccggggacgcguagauuggggcagcagcgggggucacauguuuccucuguuucacccucagucugucccccaaccccccauucuuacucucccacccuguuuuccucccucccccccuucuuugggcaucuccaccccuccaucaauugucaauguuccucgaccgcaaucaaucaguuauuugucagcucuugucaauccucccgugauuuaugucagcuuuuguugcugauuacaaggcgggugcgacuugaagggaaaaagagagagggagagagagacggagaggaaggaggagauugagagggaacuggaggaggggaaaagaggagcggccuccugggauggggguggggugggggcucuaagaaaaagaaugaaagaggcgcacggugucaggaaaaugaauagcgagaguaaagugcgcaggugcgcccagggcgccgagaggggcgcgcaggccuggagugugcgccugcccucucggugucggagagacgcccuuccaccucugggagccucggucuguuggggucgcggaguucgggcgcggcuccggguacccgagaccagcggcggcaacuucuaacacgggagauuucccgccaccccaccccgccgccgcgaguccucgcggggcguguugcgugcggaggucaggcugccacccucuguaguucccuaaccccaaacucggagacuucuaagagccacaccaccaaggaacuucuaguccuggaggucaaugguggggcaaaccucgccucaauucuuugacccccucgggucguaagcagggcuaagaggcugcgaagaagaggccuggccauggguguaugggggaagaaacaucucaggcucacucaugcccccuccccgaccuucucccaccugccgccauccccgcaggcuggggagccaggguaacucggggcugcucucucgaauuuauuggaacgccgagucggaaugagcugcgcuaggagagccgagggaaggagcgagagagggagggggcggcugccugugggaacgcggguucuuccagggaagcggagcgggacugccgcguuccccucgauuugcaccgucacucggguuguuugggaagaaaaggggaggcgcugugcgugccaccggguaccuggaccuggaugcccaguguguaugcaugccuguggcgcugcgugaguuaucggggcucugauagcguccggagcggguucgagggucuccuccaggaacucgcagaaauuagaggggguggggaggaggacacacccccuuccucggaacgacuuagaagacuuugaaucuccccuccuccgcuuuuccgccccggcucuucuuuuguugucaaguccuuuugauaaaugguggggcugggagcucugggagucgggagccagucugugcccgcguggggggcgggggccgagccuggagacccgguuucgaccggcgcgcaccuggggcugagccgggugcgcgcgggggucgggucuggaacugcccuugguaugcucgcccucuccucuuggcccaucucacuccccucccccaccugacuccccuccccggcuucuuucucugucucccacuccgcacggguaccgagaacuuuccggggugag

SEQ ID NO: 20064 - RNA, 2576 nt, Homo sapiens
cucaccccggaaaguucucgguacccgugcggagugggagacagagaaagaagccggggaggggagucaggugggggaggggagugagaugggccaagaggagagggcgagcauaccaagggcaguuccagacccgacccccgcgcgcacccggcucagccccaggugcgcgccggucgaaaccgggucuccaggcucggcccccgccccccacgcgggcacagacuggcucccgacucccagagcucccagccccaccauuuaucaaaaggacuugacaacaaaagaagagccggggcggaaaagcggaggaggggagauucaaagucuucuaagucguuccgaggaaggggguguguccuccuccccacccccucuaauuucugcgaguuccuggaggagacccucgaacccgcuccggacgcuaucagagccccgauaacucacgcagcgccacaggcaugcauacacacugggcauccagguccagguacccgguggcacgcacagcgccuccccuuuucuucccaaacaacccgagugacggugcaaaucgaggggaacgcggcagucccgcuccgcuucccuggaagaacccgcguucccacaggcagccgcccccucccucucucgcuccuucccucggcucuccuagcgcagcucauuccgacucggcguuccaauaaauucgagagagcagccccgaguuacccuggcuccccagccugcggggauggcggcaggugggagaaggucggggagggggcaugagugagccugagauguuucuucccccauacacccauggccaggccucuucuucgcagccucuuagcccugcuuacgacccgagggggucaaagaauugaggcgagguuugccccaccauugaccuccaggacuagaaguuccuuggugguguggcucuuagaagucuccgaguuugggguuagggaacuacagaggguggcagccugaccuccgcacgcaacacgccccgcgaggacucgcggcggcggggugggguggcgggaaaucucccguguuagaaguugccgccgcuggucucggguacccggagccgcgcccgaacuccgcgaccccaacagaccgaggcucccagagguggaagggcgucucuccgacaccgagagggcaggcgcacacuccaggccugcgcgccccucucggcgcccugggcgcaccugcgcacuuuacucucgcuauucauuuuccugacaccgugcgccucuuucauucuuuuucuuagagcccccaccccacccccaucccaggaggccgcuccucuuuuccccuccuccaguucccucucaaucuccuccuuccucuccgucucucucucccucucucuuuuucccuucaagucgcacccgccuuguaaucagcaacaaaagcugacauaaaucacgggaggauugacaagagcugacaaauaacugauugauugcggucgaggaacauugacaauugauggagggguggagaugcccaaagaagggggggagggaggaaaacagggugggagaguaagaaugggggguugggggacagacugagggugaaacagaggaaacaugugacccccgcugcugccccaaucuacgcguccccgggcgucacguggccgggaagggcggagagcccagcgcuccucgcgguguugagccgccgccgcugcgacugcccaucuagcuucugguuucuccgccgcggaaucugaggaaauuagagcgggcgggcgggcuucuuccagcuccggcuccccaccuugccuucuuacccugguggcugcgcugcgccgcgcgggaucucgauuacugcgaaggaaaaaacacugggugugcagguucccuucgccccuggaguugacaguccggccgguguccacacucccaccggugcuccuucuggacaccccccgcagucuguuccucacgcgcaccccccuucaaaagaagguuucaguuuauuuucgagcuggggaaaggaagaacgacgaggaggaaaaaagagggaggcggcggauggcaaacguagaauaaauguccaucucguccucccagcgaaaucgagggaggggacacacaggggggcggcgaagagggagcugcccauuaaaaccggcacugagaguccuggcagcggcggcggcggcggcgcgggacgcgucacauccccuugacccuccaaucaccucgggcucccauuugauuggaaggcggcaaaggcuuuaaucucccccuuggugcagcugcuuuugaagugaguuuccucgccagagccccggcuggacacgcagcggcucgcaucgcagagcgcagcgccggcgcggggccgcgagaacgcagcgcaggggagcagcccgaggcggacaccgcgagccgcccggcacucccgcaguccagccggcuccucuagcccggccacggcuccgcugcgggccacccaggauuacucgcgucuggcuccaggcgccgagaaggcgcgcugggcgcccguggccgccgcgccagcuccuccuccucccgcugcuccugcucccggggcgagcgcgc

SEQ ID NO: 20065 - RNA, 2477 nt, Homo sapiens
ccgcggugcacucgcugcucuucgcccuucgcccuggaaaaacggggaaaagagagaucaacccgaagagagaaagaacgggauacgugguggggggggggagcccgcgucuccccuggguuagucgcaccccuccagcucaccgcacagcaauaaguuccggggcgacuuucaccuauuuugcuccccguuuuugccgaacccuaaaaugaaaggacacaauuuggggcugacucuugcagcucagauggcgacuugugcguuuucagcggcaucucccggagaaaaagccaugcgcgccugauuguucuguggccccaaagcugcagcggggguguguguguuggggugugugucuguguguguacagagacguccacacuaacucgcggcugcaggaucagcgucuggaagcagacguuucggcuacagacccagagaggaggagcuggagaucaggaggcgugagccgccaagaguuugcagaaucuguggugugaaugaacugggggcaccugggcgcacagaucgccccccuucccccgccccgggccacaguugaguagugguacauuuuuuucacccucuugugaagaauuucuuuuuauuauuauuugucguaaggucuuuugcacaaucacgcccacauuugggguuggaaagcccuaauuaccgccgucgcugauggacguuggaaacggagcgccucuccguggaacaguugccugcgcgcccucgccggaccggcggcucccuaguugcgccccgaccaggcccugcccuugcugccggcucgcgcgcguccgcgcccccuccauuccugggcgcaucccagcucugccccaacucgggaguccaggcccgggcgccagugcccgcuucagcuccgguucacugcgcccgccggacgcgcgccggaggacuccgcagcccugcuccugaccguccccccaggcuuaacccggucgcuccgcucggauuccucggcugcgcucgcucggguggcgacuuccuccccgcgcccccucccccucgccaugaagguagguguucagugcgcugccacuuuuuuucuuuacuuccccccacccccuguuggaaguuaacugaguucccuucgccucuuccuaucccuccauuuccccaaccgccugaagaagcuggaacuccagcgucgcuggcaggaaccccuaccccuucgcccuccacgccgggcgcacugccucagugucccaggagaucacuucuggucgcaccacccguucugcaaacaauuuugauuuuugagaaaaaguggggaagagcgauaguagacaaacugagugcgguucacugacgacuuuccuuuugcucugagaacaucgaguguaauuuacuauguauauuucaguaacaggauaaugauucaauucaacaaauauuuaccaagcgcccacugcgcgggcaccgggacgguguguggccggggcucgggauggggaaagggacuccuugguugagagaacccgcagaggaacuaggggccaacuacuccagagcggcguacaccuuccccgacacccccccgcaccgacggaggccagauuguaggcuugccuuggccgaguaacucgagcgcuucaggccccuuugccuuuaagagugccuggcggggggccagcgcgcaccccggcgcggggagcggggucgcguuauuagcauuauuagccgccacugggugagcucaggcacuuugcagcaguggugggggcggggaguuguggugguaguggcuguaaucccguacuccgggacagcgcuccccggcccccugagcggaguccgccuuguccuuuagaaaacacuugggccuccgcuuugggagagcaggcgggggccaguuugcgaacucuuguuuguuuuaauugucaguuguauguuaaagccgaaucacacacuccgagggucacugagaguucacuuuuacgaaaaguuaacguuucuuccugcaacauaaguuuuuauuuucuaaacaauuuuucuuaucuguccuccaagcuucgauuccuauuuccauuuuucuggucuuucccauuuuaaguuucuuagaaaauaagguuagaauugaaauuaagauguuuccuggaagcaaauaaccccucuuccccccaaaaaguuaaaaaaaacaacaacaaaaaacuucaagucuggagaccccacggcccuguuugacuuucuaaucccugucugguaucgaggccccuucuccucucucgccucucuuuucucucuucucucuuuaaauggguaauucgcuguuuggaaguaacuugggccuugcggugaggucgcaccuccucagccccugcccuccccccagccaccuucgcacauucacugccgaaccagccagauuuaguuucuagacagacucugccaggggaguuucgagggggcaaugcggagagugcgcagcgaaccgcgggccgacaaaugug

SEQ ID NO: 20066 - RNA, 2477 nt, Homo sapiens
cacauuugucggcccgcgguucgcugcgcacucuccgcauugcccccucgaaacuccccuggcagagucugucuagaaacuaaaucuggcugguucggcagugaaugugcgaagguggcuggggggagggcaggggcugaggaggugcgaccucaccgcaaggcccaaguuacuuccaaacagcgaauuacccauuuaaagagagaagagagaaaagagaggcgagagaggagaaggggccucgauaccagacagggauuagaaagucaaacagggccguggggucuccagacuugaaguuuuuuguuguuguuuuuuuuaacuuuuuggggggaagagggguuauuugcuuccaggaaacaucuuaauuucaauucuaaccuuauuuucuaagaaacuuaaaaugggaaagaccagaaaaauggaaauaggaaucgaagcuuggaggacagauaagaaaaauuguuuagaaaauaaaaacuuauguugcaggaagaaacguuaacuuuucguaaaagugaacucucagugacccucggagugugugauucggcuuuaacauacaacugacaauuaaaacaaacaagaguucgcaaacuggcccccgccugcucucccaaagcggaggcccaaguguuuucuaaaggacaaggcggacuccgcucagggggccggggagcgcugucccggaguacgggauuacagccacuaccaccacaacuccccgcccccaccacugcugcaaagugccugagcucacccaguggcggcuaauaaugcuaauaacgcgaccccgcuccccgcgccggggugcgcgcuggccccccgccaggcacucuuaaaggcaaaggggccugaagcgcucgaguuacucggccaaggcaagccuacaaucuggccuccgucggugcgggggggugucggggaagguguacgccgcucuggaguaguuggccccuaguuccucugcggguucucucaaccaaggagucccuuuccccaucccgagccccggccacacaccgucccggugcccgcgcagugggcgcuugguaaauauuuguugaauugaaucauuauccuguuacugaaauauacauaguaaauuacacucgauguucucagagcaaaaggaaagucgucagugaaccgcacucaguuugucuacuaucgcucuuccccacuuuuucucaaaaaucaaaauuguuugcagaacggguggugcgaccagaagugaucuccugggacacugaggcagugcgcccggcguggagggcgaagggguagggguuccugccagcgacgcuggaguuccagcuucuucaggcgguuggggaaauggagggauaggaagaggcgaagggaacucaguuaacuuccaacaggggguggggggaaguaaagaaaaaaaguggcagcgcacugaacaccuaccuucauggcgagggggagggggcgcggggaggaagucgccacccgagcgagcgcagccgaggaauccgagcggagcgaccggguuaagccuggggggacggucaggagcagggcugcggaguccuccggcgcgcguccggcgggcgcagugaaccggagcugaagcgggcacuggcgcccgggccuggacucccgaguuggggcagagcugggaugcgcccaggaauggagggggcgcggacgcgcgcgagccggcagcaagggcagggccuggucggggcgcaacuagggagccgccgguccggcgagggcgcgcaggcaacuguuccacggagaggcgcuccguuuccaacguccaucagcgacggcgguaauuagggcuuuccaaccccaaaugugggcgugauugugcaaaagaccuuacgacaaauaauaauaaaaagaaauucuucacaagagggugaaaaaaauguaccacuacucaacuguggcccggggcgggggaaggggggcgaucugugcgcccaggugcccccaguucauucacaccacagauucugcaaacucuuggcggcucacgccuccugaucuccagcuccuccucucugggucuguagccgaaacgucugcuuccagacgcugauccugcagccgcgaguuaguguggacgucucuguacacacacagacacacaccccaacacacacacccccgcugcagcuuuggggccacagaacaaucaggcgcgcauggcuuuuucuccgggagaugccgcugaaaacgcacaagucgccaucugagcugcaagagucagccccaaauuguguccuuucauuuuaggguucggcaaaaacggggagcaaaauaggugaaagucgccccggaacuuauugcugugcggugagcuggaggggugcgacuaacccaggggagacgcgggcuccccccccccaccacguaucccguucuuucucucuucggguugaucucucuuuuccccguuuuuccagggcgaagggcgaagagcagcgagugcaccgcgg

SEQ ID NO: 20067 - RNA, 2026 nt, Homo sapiens
aacuucugcagcugugucacugcaggccugcuuucuggugaacguucuaggucuggugggaacacuggcuugucucagccccucuggccugcaggcccgcuccaugcuauuccuguagcagcuaacacugccuccugcacuagcagugccagagaaggcaaaggacacugcccagcuguaauuucccugugccagaggccacugagcucaaaggugaggcuggcucucugcacagaaccucaggaugguucuugccacacaagccacagcagagagacuuggagcuucugcucaacauuucacaaagaagcaagaacccaacuggcaggacagcugcccuauugcuuagauagggacagagccuggggcuugagcccuagaguuccaguccuauccaaacuuucugagcaccauuuaaaugacacgagaugagaaaaucaucagaaaugucuuuuguaccccuucagaaguaaugcagaaggucucaacuaaaugacaugcucuuauaaaagacggggauauaggaaaggcccacaccaagaauaauaucuaacuuuaauucuugcaagcuguauaaaccuggacaaggaacuguuuugcaucaguaaaaugggaaugcuuccuuaauuaccuucuacagaguugcaagaaucaaaggauuaaauguauaggaggugccuugugagguaccuuacaaaaagugcaauaaauacgauguauaauucuucauuucuagagcaaugauuacccucaaaacguuauuuguacacaaaaugaagaguuuucugaugaaugaguaugguaacgagucggggucugcaguggaaaucccaauccucauucuccaaagcugggcccgagcaggagcauucaagacuauucaagcugacuuuuucacaaugcuuuucaaaacaaaucuugauuauuuucuuuuugaaaaaccaccugccagguucaaaggaaaauacauuaaaauaaaacaaacaaaaaagcugaguucuggguugcugggcugugcagacagcaugauguggcaaggaaaagaggcgcaggagcagcugggaaccccgguccggcaguggacucccgggugugccuccuucccacagcccuggaccggcugggccuugacuucccuuccuuugccucuaaccaucuccaccugcgccuucaccucccgcuccagcaacaacccugggggcagauuguucaucuuuucauuccuagaccucagcagggcuguuaaguuuacaacugggcucuacccaauuuaaagucaggcguuugugacucuugggaaagagggggaacaggugccuccgaaacgcugaacaacgcuagaaaccgugcccucuuaaaagacacgacccuaagcgggcacagagacgaggacgaggacugccagguccgcaccuggggcugguccagcagggcggcccccgggcccaugcuccagggcagggcccucuccucuguucuuugucccaacaauucgcgaagguuggcgccaccggcgucacucaaggcuugcgggcguggacagagggggcccuagcccgccgcagcagcgccggguccccgucuccguucuccgacgucugggcgcaggguuuuuccaucggccgccacgcaggguggcggaagggucgucguccucggagggagcgccagcgcugcggcggcuccuaagaaaguuggcgcgggcccgaggggcgcgccucaccagcccagcacccacccuaccggcccugcacugccucaguuuccccaccuacgccgcggcaggccccgccuacggacaucacgugccucgcggagccccggcgcgcagcaccuaccucaagugccucccuucugccggccuuuuaccgccccgacgcccgggcgcuaaggggccaaaccgcccggcccggagggucccaggggcgggccccgcgcuugcgcagccucuagccugugcugcaucgcgcgcuaccgcgccaccgccaugugacccgccccgccccccgugggaggagcuccgggc

SEQ ID NO: 20068 - RNA, 2026 nt, Homo sapiens
gcccggagcuccucccacggggggcggggcgggucacauggcgguggcgcgguagcgcgcgaugcagcacaggcuagaggcugcgcaagcgcggggcccgccccugggacccuccgggccgggcgguuuggccccuuagcgcccgggcgucggggcgguaaaaggccggcagaagggaggcacuugagguaggugcugcgcgccggggcuccgcgaggcacgugauguccguaggcggggccugccgcggcguagguggggaaacugaggcagugcagggccgguagggugggugcugggcuggugaggcgcgccccucgggcccgcgccaacuuucuuaggagccgccgcagcgcuggcgcucccuccgaggacgacgacccuuccgccacccugcguggcggccgauggaaaaacccugcgcccagacgucggagaacggagacggggacccggcgcugcugcggcgggcuagggcccccucuguccacgcccgcaagccuugagugacgccgguggcgccaaccuucgcgaauuguugggacaaagaacagaggagagggcccugcccuggagcaugggcccgggggccgcccugcuggaccagccccaggugcggaccuggcaguccucguccucgucucugugcccgcuuagggucgugucuuuuaagagggcacgguuucuagcguuguucagcguuucggaggcaccuguucccccucuuucccaagagucacaaacgccugacuuuaaauuggguagagcccaguuguaaacuuaacagcccugcugaggucuaggaaugaaaagaugaacaaucugcccccaggguuguugcuggagcgggaggugaaggcgcagguggagaugguuagaggcaaaggaagggaagucaaggcccagccgguccagggcugugggaaggaggcacacccgggaguccacugccggaccgggguucccagcugcuccugcgccucuuuuccuugccacaucaugcugucugcacagcccagcaacccagaacucagcuuuuuuguuuguuuuauuuuaauguauuuuccuuugaaccuggcaggugguuuuucaaaaagaaaauaaucaagauuuguuuugaaaagcauugugaaaaagucagcuugaauagucuugaaugcuccugcucgggcccagcuuuggagaaugaggauugggauuuccacugcagaccccgacucguuaccauacucauucaucagaaaacucuucauuuuguguacaaauaacguuuugaggguaaucauugcucuagaaaugaagaauuauacaucguauuuauugcacuuuuuguaagguaccucacaaggcaccuccuauacauuuaauccuuugauucuugcaacucuguagaagguaauuaaggaagcauucccauuuuacugaugcaaaacaguuccuuguccagguuuauacagcuugcaagaauuaaaguuagauauuauucuuggugugggccuuuccuauauccccgucuuuuauaagagcaugucauuuaguugagaccuucugcauuacuucugaagggguacaaaagacauuucugaugauuuucucaucucgugucauuuaaauggugcucagaaaguuuggauaggacuggaacucuagggcucaagccccaggcucugucccuaucuaagcaauagggcagcuguccugccaguuggguucuugcuucuuugugaaauguugagcagaagcuccaagucucucugcuguggcuuguguggcaagaaccauccugagguucugugcagagagccagccucaccuuugagcucaguggccucuggcacagggaaauuacagcugggcaguguccuuugccuucucuggcacugcuagugcaggaggcaguguuagcugcuacaggaauagcauggagcgggccugcaggccagaggggcugagacaagccaguguucccaccagaccuagaacguucaccagaaagcaggccugcagugacacagcugcagaaguu

SEQ ID NO: 20069 - RNA, 2600 nt, Homo sapiens
agcguucagcagggccgggagcgccaggucguccccggggcccgggccccaugacuccugccccaaagcccacuccacccgaccucccuuuccugaggcuguucccaguugcugcuuugggucgcuccggagcucaagaacucggguugccugccgccccacucuccacgcacauacuugguuuucuucuuaggggcauuggcagguagacuuugaggaagaaaaguaaaggaucgaacagcucagcccucccucccgaccguggaugcccggagucgaccaacaccucagguccgggugcggaggccgcgggcgccccugcgcgaccguccgcgcccggcaagagccgcgcggcuuucgccuuugcuggucccgcgccaccgcuggggcgggcugcgaaaggguugggaagagcaaaggguuuuuuuguuuuguuuugagacgcagaagcccuuuaaaaagcccggcgaggagagguccagaaguagagaaagcagacggaggcaagcugugcccgcggggcaaagggacaguagaaggggcgggcgcccggguuccccggaaaacccucggccccaaggaaucuccuggggcgggagagcgcgguucuaaaaccgagaggauaggaaggggaagggggaguuguguuucaauuucggauucaccaggauucaucucuagucacauuuuucuucucaaauuuuuaaaucgaaaagauaaaagccaaaagaacuuucauccccagagcuuuuuauugggggaaaggaauguaacucggggugguuguccuucacuucccuacucgaaucuucuccuaaugccgaaauguguuuacagguagccucaguuuaccaaguauguaucuuuuggggguuuaaccucucacaaagccuucaacucacaaaccgcgauccuuggaaaccauccuccaaagcagugcuuggaggccucuaaggcccccggaccaacucccgcuggaagaagccugcagggacucgggaaucacgggaaccuuucccgucgguuccgggccuggagggccaggaagagccgcgcguccgccuuucgucccgccaggaacuccccauaggacacgacaccgcaggaacaagcguccugggagccccugggaucuuggcugucgucucuagggacccuacaccgugaaaugauagaggcgagguuccuuggguuccgcaagucgacgaaaauagcucguggagaaggcgcguccugcaacugcaguucgcaagcucucagggcgccccgccagcugggggccagauugggugacacuccccucgacgcagccuccggagcggcgcgcacucuccagaggccagcaggacugcgcucucuaccgcagaaccugcuccagcuagguguucucuccccaucucgccgucgcucugcccccucacucucucuggaccucagagccgguucucuccuuccuccucccgcgcuuuccguccggggaucgcaaccuccagcccgugggcaacgcguucagcccaagaccccacaguuuuucccaacgaccccccuaccaagggcuucucuuguuucugcucuccugccccgcacuucccaaaggugagaaucucccagggacugcuggacagagaaggccugggcaggggcaguagccgauauuuaaaggucuuucagcgccagcauccccaccuccagcaccacuauuggaaaauaauuaggccaccuuuugccucggucacagccugugaccagcuucuuccccccaaggaggcuccuagacccccucugccugucuccccucaccagguagccuugcucaccauaggucccugcaguagcgggcucgccagcagcagcuccuggggaccucugaacgguugcagugaaccugggcgagggccggggacuguggcgcugcaggcucgagauagcuuggacgggaaucccaucggggagacaagcuagauacucagccggagcagcagcggcgucucaggcucgcgucccucagcucggaugccacacucaccuagcuuccgggccgggcuccgcgcuccuucccucccucccuccuccucugccuucucgcaucuuccuuccuccucuuucccucccucgcuuucuuucuuuccuuccuccuccucuuccccggcggccccucccuccuucccuccucccucgcucgccucccuuucuggggaugggagccccgcccacauccuccccuccagccgcccgaccucgccuagcaggcccgggucccggaagcccaggcagcgcccgaguccgcagcugccgucggagcugggacgccgcugccuccagcucugggaagcggcuggggcucaccuggggaccacgugcggagguacuagaaagcaugcaccgacuagucgccguaccuuccaaaaauacccaugggagucugggcuucccugaguuuaguguaacugcugcccaaacugaugauuaaaacacugaguaaucaccauuuacccugaguaauuagagauaaugaaacaccucuaaaaucagguuauggagaaaggagcuguuggaucgguuuaaaagguggccuuccauaaacuguuaaaagauuucca

SEQ ID NO: 20070 - RNA, 2600 nt, Homo sapiens
uggaaaucuuuuaacaguuuauggaaggccaccuuuuaaaccgauccaacagcuccuuucuccauaaccugauuuuagagguguuucauuaucucuaauuacucaggguaaauggugauuacucaguguuuuaaucaucaguuugggcagcaguuacacuaaacucagggaagcccagacucccauggguauuuuuggaagguacggcgacuagucggugcaugcuuucuaguaccuccgcacgugguccccaggugagccccagccgcuucccagagcuggaggcagcggcgucccagcuccgacggcagcugcggacucgggcgcugccugggcuuccgggacccgggccugcuaggcgaggucgggcggcuggaggggaggaugugggcggggcucccauccccagaaagggaggcgagcgagggaggagggaaggagggaggggccgccggggaagaggaggaggaaggaaagaaagaaagcgagggagggaaagaggaggaaggaagaugcgagaaggcagaggaggagggagggagggaaggagcgcggagcccggcccggaagcuaggugaguguggcauccgagcugagggacgcgagccugagacgccgcugcugcuccggcugaguaucuagcuugucuccccgaugggauucccguccaagcuaucucgagccugcagcgccacaguccccggcccucgcccagguucacugcaaccguucagagguccccaggagcugcugcuggcgagcccgcuacugcagggaccuauggugagcaaggcuaccuggugaggggagacaggcagagggggucuaggagccuccuuggggggaagaagcuggucacaggcugugaccgaggcaaaagguggccuaauuauuuuccaauaguggugcuggagguggggaugcuggcgcugaaagaccuuuaaauaucggcuacugccccugcccaggccuucucuguccagcagucccugggagauucucaccuuugggaagugcggggcaggagagcagaaacaagagaagcccuugguaggggggucguugggaaaaacuguggggucuugggcugaacgcguugcccacgggcuggagguugcgauccccggacggaaagcgcgggaggaggaaggagagaaccggcucugagguccagagagagugagggggcagagcgacggcgagauggggagagaacaccuagcuggagcagguucugcgguagagagcgcaguccugcuggccucuggagagugcgcgccgcuccggaggcugcgucgaggggagugucacccaaucuggcccccagcuggcggggcgcccugagagcuugcgaacugcaguugcaggacgcgccuucuccacgagcuauuuucgucgacuugcggaacccaaggaaccucgccucuaucauuucacgguguagggucccuagagacgacagccaagaucccaggggcucccaggacgcuuguuccugcggugucguguccuauggggaguuccuggcgggacgaaaggcggacgcgcggcucuuccuggcccuccaggcccggaaccgacgggaaagguucccgugauucccgagucccugcaggcuucuuccagcgggaguugguccgggggccuuagaggccuccaagcacugcuuuggaggaugguuuccaaggaucgcgguuugugaguugaaggcuuugugagagguuaaacccccaaaagauacauacuugguaaacugaggcuaccuguaaacacauuucggcauuaggagaagauucgaguagggaagugaaggacaaccaccccgaguuacauuccuuucccccaauaaaaagcucuggggaugaaaguucuuuuggcuuuuaucuuuucgauuuaaaaauuugagaagaaaaaugugacuagagaugaauccuggugaauccgaaauugaaacacaacucccccuuccccuuccuauccucucgguuuuagaaccgcgcucucccgccccaggagauuccuuggggccgaggguuuuccggggaacccgggcgcccgccccuucuacugucccuuugccccgcgggcacagcuugccuccgucugcuuucucuacuucuggaccucuccucgccgggcuuuuuaaagggcuucugcgucucaaaacaaaacaaaaaaacccuuugcucuucccaacccuuucgcagcccgccccagcgguggcgcgggaccagcaaaggcgaaagccgcgcggcucuugccgggcgcggacggucgcgcaggggcgcccgcggccuccgcacccggaccugagguguuggucgacuccgggcauccacggucgggagggagggcugagcuguucgauccuuuacuuuucuuccucaaagucuaccugccaaugccccuaagaagaaaaccaaguaugugcguggagaguggggcggcaggcaacccgaguucuugagcuccggagcgacccaaagcagcaacugggaacagccucaggaaagggaggucggguggagugggcuuuggggcaggagucauggggcccgggccccggggacgaccuggcgcucccggcccugcugaacgcu

SEQ ID NO: 20071 - RNA, 2517 nt, Homo sapiens
ugcugauaacaaagcccauuggugagaaacaaagaaacaauucaagaaaucuaccucuccccagacuguugccuuuccauggcagagauuuuaauuaucuuagcuuuuuaccacuuucaacugcugcgaaccuaaaaugucagugcguuuaacaucuaaaauaccaacucacuaaaccacaaacuuggaaaaaccgcucaaccacuauuauuccacauuugaagucauuuccgguaaucauuuucaccuaauuaguagucuggguaauuagauuucgagguaaguaacagauuuauuaggguuuuggagaaucuugauuauaugugucuaaggaacgaaagcuaaacaaacaaguauuuaacuuuuaauagacacccaucaaauauuuaagcauauuccaaaaaagucuucaagauuggcacagggcuugccagaaauugugaaguaaaguuagaaucccaccaaucagauaaugacgggaccccacauuuguagugcaagcugcuuccauguugauuuugauguguggaggcugcagauccugcgggaggcaaauuuucagacauuuggguccucggcagcugcagcagaguuuccuguuaacucuaacugccuuuugcacauuuuaguuuugaagaaaguagauacacaaacacccaaaguugugaaacuaguagaauuucucccuaccuuucaaguuuccuacaauccuauaagaaaaagagcucaagggggaaaagaaaggaagaaaaagaaaaguuauuuacuuucuucagcugagcuccccgccuccaccccagcaaagagauucaaaguagauguuaauauagacuggcaguuugcaagucuggccuuuauuuuccuaaaauguggcacuuauaugcaaggaucucuacuuugaaacuuugacaccaugagagauugcuucaaaauggcggauacaagauaaaggucucacugacuuuaaaggacuccggguuuucauauuuacguugcuuaagacagcaaggcacaaaaguccauaaaugaaacuuaguaacugcaacuucuuucugauuuaaauucagagcacaaaagucaugcuuuucuacccuaagaucuaacuuaauauaauuuuauaaaugucuuucuuggaggaguuuguauuauccucaguacaacuaauuuaguugccccuacaauacagacuuuauguuuuuguauugucuuuucuuuucaaaaugcuguucuuuggaggcugcgaaaauaaacaaaaaucuccagcuuagaggcuguuuaaacacauaugcgacagcuuuaaaauacaguuguauauguguuuaaacagccucuaaacuggagauuggagauuuuuuguuuaaucguacuaccuugcaaaauucugaacuacagugcuauagagaaucguaaaaucauaucagauguacccuugagaaauauggaaauguucuuacauguagagcucucacccaauuagaaaugccugacacaucauacaauaaaguagcacauuccaacauaaaaagccaguaacacacagaaagcaccagggccgagauccuuccaggggcuccuuugcccuuaccauugcaaaauggcuaaaauucucaaaauagacuauuuucacuuuugcuccuggauccaccuuuaaaaggaaaagaggaaaaccaaaacccaaaacuaagagauucucuccacaaccggccuagguaugcacucugcauagaaggcaugggcccuucaaucuaacuuucaaagcucuuuuccucucgaagcaggguccagaacggggaaaagaaauaacuuuugaaaaauccacgccucacuaugacugcucacgagguggccucuggagaacucauaccuagaagcugaccgcggucgcgcggcgaguuccggcagccggucggcgaccgcaccuccgggcgcgagugccugggucccgcguuccugcccggcagccccgcagccccgcagccccgcagccccgcagccccgcaggccuggcgcccgaggucccgcuccacugcccgcgccccccgcgcagccuuauaucuaacggucaauucgugcaaucugucgcuucucccucccccacgccuuguuuuuuuuuucuuccaagaagcccaucuaccaguugcuguguccucgcucaacaauaauuaccucguccgagaauuaauuauaauaaauguuuucuugauaaacuaacgagauaauccgaggggcacacgucccuuaauuacaggccgccaugcuccucucugcuucucguccgggcugauuaauuuucugcaugauggaaaggaaacaaaacuacgcggacuggcgacuggccugcggcugggaagacgacgaagaggaggaaagaaagaaaaaggagacgugugggcaccgcggaaaacggccggcgcuggccucucuccggcgaacucgagugaaaguuucuggccucggggaaucaaauaacucugccacccgcgagggagggaggaagaaacgugccaaaaggguugg

SEQ ID NO: 20072 - RNA, 2517 nt, Homo sapiens
ccaacccuuuuggcacguuucuuccucccucccucgcggguggcagaguuauuugauuccccgaggccagaaacuuucacucgaguucgccggagagaggccagcgccggccguuuuccgcggugcccacacgucuccuuuuucuuucuuuccuccucuucgucgucuucccagccgcaggccagucgccaguccgcguaguuuuguuuccuuuccaucaugcagaaaauuaaucagcccggacgagaagcagagaggagcauggcggccuguaauuaagggacgugugccccucggauuaucucguuaguuuaucaagaaaacauuuauuauaauuaauucucggacgagguaauuauuguugagcgaggacacagcaacugguagaugggcuucuuggaagaaaaaaaaaacaaggcgugggggagggagaagcgacagauugcacgaauugaccguuagauauaaggcugcgcggggggcgcgggcaguggagcgggaccucgggcgccaggccugcggggcugcggggcugcggggcugcggggcugcggggcugccgggcaggaacgcgggacccaggcacucgcgcccggaggugcggucgccgaccggcugccggaacucgccgcgcgaccgcggucagcuucuagguaugaguucuccagaggccaccucgugagcagucauagugaggcguggauuuuucaaaaguuauuucuuuuccccguucuggacccugcuucgagaggaaaagagcuuugaaaguuagauugaagggcccaugccuucuaugcagagugcauaccuaggccgguuguggagagaaucucuuaguuuuggguuuugguuuuccucuuuuccuuuuaaagguggauccaggagcaaaagugaaaauagucuauuuugagaauuuuagccauuuugcaaugguaagggcaaaggagccccuggaaggaucucggcccuggugcuuucuguguguuacuggcuuuuuauguuggaaugugcuacuuuauuguaugaugugucaggcauuucuaauugggugagagcucuacauguaagaacauuuccauauuucucaaggguacaucugauaugauuuuacgauucucuauagcacuguaguucagaauuuugcaagguaguacgauuaaacaaaaaaucuccaaucuccaguuuagaggcuguuuaaacacauauacaacuguauuuuaaagcugucgcauauguguuuaaacagccucuaagcuggagauuuuuguuuauuuucgcagccuccaaagaacagcauuuugaaaagaaaagacaauacaaaaacauaaagucuguauuguaggggcaacuaaauuaguuguacugaggauaauacaaacuccuccaagaaagacauuuauaaaauuauauuaaguuagaucuuaggguagaaaagcaugacuuuugugcucugaauuuaaaucagaaagaaguugcaguuacuaaguuucauuuauggacuuuugugccuugcugucuuaagcaacguaaauaugaaaacccggaguccuuuaaagucagugagaccuuuaucuuguauccgccauuuugaagcaaucucucauggugucaaaguuucaaaguagagauccuugcauauaagugccacauuuuaggaaaauaaaggccagacuugcaaacugccagucuauauuaacaucuacuuugaaucucuuugcugggguggaggcggggagcucagcugaagaaaguaaauaacuuuucuuuuucuuccuuucuuuucccccuugagcucuuuuucuuauaggauuguaggaaacuugaaagguagggagaaauucuacuaguuucacaacuuuggguguuuguguaucuacuuucuucaaaacuaaaaugugcaaaaggcaguuagaguuaacaggaaacucugcugcagcugccgaggacccaaaugucugaaaauuugccucccgcaggaucugcagccuccacacaucaaaaucaacauggaagcagcuugcacuacaaauguggggucccgucauuaucugauuggugggauucuaacuuuacuucacaauuucuggcaagcccugugccaaucuugaagacuuuuuuggaauaugcuuaaauauuugaugggugucuauuaaaaguuaaauacuuguuuguuuagcuuucguuccuuagacacauauaaucaagauucuccaaaacccuaauaaaucuguuacuuaccucgaaaucuaauuacccagacuacuaauuaggugaaaaugauuaccggaaaugacuucaaauguggaauaauagugguugagcgguuuuuccaaguuugugguuuagugaguugguauuuuagauguuaaacgcacugacauuuuagguucgcagcaguugaaagugguaaaaagcuaagauaauuaaaaucucugccauggaaaggcaacagucuggggagagguagauuucuugaauuguuucuuuguuucucaccaaugggcuuuguuaucagca

SEQ ID NO: 20073 - RNA, 2810 nt, Homo sapiens
cagggagagaagguggaagagucuccacagugguuugccccuaccugaacuuaguggcaaaaugaagcugcccaaaugaagcagcugaauuuccuuccucagagcccgcaucugccuaggggcugggaaaugaguacuuucguggcucuuagcccagaagaggcaggguggagaaggaaaagguggcaggguggcugacccucaguccccacaccucuuuuggccugcaucucuuugucuuucagaccagcuuuuaaucuuucugccucuugccccugugcagccacugagcacgcucucugggcuagacacugggcuaggggucuggaaauacaaagacaaaugaugcguaguccuggcugcuggagaaagaccuucaccuccccaggucccugccuucugucacccugagcucccuuacccacugacacccccugcaacccuugucuguucugccccuugacuguucugucauaacucaaccaagcucugcagugugugugcucccagagagaagcgacacaaagaaaagggagggggggcagaaaggagggaaucccgcugacaucacugcucauuagcaugugugaccucaucagggggugggacaauuuccccaggugucuaggggggagggcaugugugugugucgggggggggggugguauuuaaagggaaaagcugacagugcugcugagugagggagagggugcugcgagcugcugggcugcacacgcacacgcacacgcacacgcacacugaugcacacggaccuggacacagacauggacauggacacagaaaccacagcacucugccccucuggcagccgccgggccuccccuccagggacgcccacaccaggugagggcuaaccugggcagguuccggcugaaaccaugggggugggagcugaagcuuugguggggaggucagaacuagggguugagggagcuugagcucagucagcaagaggagaagagcaauugagaaaguggagaagaccccugcucacacaagggauuggggcugggcuaggguggaggggaagagcugccuaaaugcccccucccccagcacucccagggcuuugcuugagaaacugguacauggccccuagcucagccucauucccgaggcuggaacaggcaagaaggaaggggagaggaaaggggcagcccacaagccugggaaucacaggcaggggcuaccccggggaacuauuguaaggguucuucuggcugcuggaggcccuggcugcuggccaaguauugauccugggcuauuuccagccucccucuagcccccuuuguugugucuguuguuccuccuccaguuacccugacccacgcauugucacucucccuuucgcucacacacacacacacacacacacacuaucucucucucucuacuucuacugcucuaugaacacaauauucucucccacucacagggacagacagggaugcaggauucucacauccaaccacgcaaugagggaugcucaccuacagggccacgggaagcagcagccccucucucucucucacacacacacacagagaacccacagagacccagcacgcacaucaucucaaaaagcaaaggcccuuuccuaggaagaagcucacuacaaaguuuuuuacucugcuauaccuacuccccagacacugggcagcaguuucagcuugucauccucucugcuccucaguuuggggauuaccagugcuggaaacaggaggaggaagggccucuugauggaaaaagaggcagcuuccccaaaccucccccaacuccaccguacagggccagaggccuagucuggggguuugccuguguaucaguguaaagugugaguggguaugugagccugcauucaggucccuucccugcauggggcacguuuugaauagguugggguugggaccgcauuggagaagcuaucaugucaacuccaguucaggcuucuggagacuuuaguguaagaggucaggccagacauucucaguuccuucuggguaauggucaucaaguggguguagcugggccucugauacuggaacagccuggauugagccuucugcauaugguugagcauaucccacucauagcuuccuuuucuuugcccucccauuuuauuuuagaagcagaugccacgcuacuaaagaagucagagaaacuguuggcagaguuggaccggagcggguuacccucugccccuggggcccccagacgaagaggcaguaugccuguccccuacaagcaccagcuccggcgggcccaggcuguagaugaacuugacuggccaccucaggccucauccucuggcucgucugacuccuugggcucaggggaggcagccccugcucaaaaggauggcaucuucaaggucaugcuagugggggagagcggcgugggcaagagcacccuagcaggcacuuuugguggucuccagggagacagugcucacgaaccggagaacccagguauuuggggaagcccuccagggguugagggggcucuggggcccuggucagggaaggaagugcucgugaccugagcagccccugaaggacagagcuuaacagaagcuuuuccaaugcuuucuguggcagccucccugaagaggggcaggguucccuggugcugagaucugaggugucccugguuaccaggucucacaaauguugggaaaccuccuaauggacuuuauacccucucccuauuucccagcagaggauaccuaugagagacgcaucaugguggauaaggaggaagugacucuagucguuuaugacaucugggaa

SEQ ID NO: 20074 - RNA, 2810 nt, Homo sapiens
uucccagaugucauaaacgacuagagucacuuccuccuuauccaccaugaugcgucucucauagguauccucugcugggaaauagggagaggguauaaaguccauuaggagguuucccaacauuugugagaccugguaaccagggacaccucagaucucagcaccagggaacccugccccucuucagggaggcugccacagaaagcauuggaaaagcuucuguuaagcucuguccuucaggggcugcucaggucacgagcacuuccuucccugaccagggccccagagcccccucaaccccuggagggcuuccccaaauaccuggguucuccgguucgugagcacugucucccuggagaccaccaaaagugccugcuagggugcucuugcccacgccgcucucccccacuagcaugaccuugaagaugccauccuuuugagcaggggcugccuccccugagcccaaggagucagacgagccagaggaugaggccugagguggccagucaaguucaucuacagccugggcccgccggagcuggugcuuguaggggacaggcauacugccucuucgucugggggccccaggggcagaggguaacccgcuccgguccaacucugccaacaguuucucugacuucuuuaguagcguggcaucugcuucuaaaauaaaaugggagggcaaagaaaaggaagcuaugagugggauaugcucaaccauaugcagaaggcucaauccaggcuguuccaguaucagaggcccagcuacacccacuugaugaccauuacccagaaggaacugagaaugucuggccugaccucuuacacuaaagucuccagaagccugaacuggaguugacaugauagcuucuccaaugcggucccaaccccaaccuauucaaaacgugccccaugcagggaagggaccugaaugcaggcucacauacccacucacacuuuacacugauacacaggcaaacccccagacuaggccucuggcccuguacgguggaguugggggagguuuggggaagcugccucuuuuuccaucaagaggcccuuccuccuccuguuuccagcacugguaauccccaaacugaggagcagagaggaugacaagcugaaacugcugcccagugucuggggaguagguauagcagaguaaaaaacuuuguagugagcuucuuccuaggaaagggccuuugcuuuuugagaugaugugcgugcugggucucuguggguucucugugugugugugugagagagagagaggggcugcugcuucccguggcccuguaggugagcaucccucauugcgugguuggaugugagaauccugcaucccugucugucccugugagugggagagaauauuguguucauagagcaguagaaguagagagagagagauagugugugugugugugugugugugugagcgaaagggagagugacaaugcgugggucaggguaacuggaggaggaacaacagacacaacaaagggggcuagagggaggcuggaaauagcccaggaucaauacuuggccagcagccagggccuccagcagccagaagaacccuuacaauaguuccccgggguagccccugccugugauucccaggcuugugggcugccccuuuccucuccccuuccuucuugccuguuccagccucgggaaugaggcugagcuaggggccauguaccaguuucucaagcaaagcccugggagugcugggggagggggcauuuaggcagcucuuccccuccacccuagcccagccccaaucccuugugugagcaggggucuucuccacuuucucaauugcucuucuccucuugcugacugagcucaagcucccucaaccccuaguucugaccuccccaccaaagcuucagcucccacccccaugguuucagccggaaccugcccagguuagcccucaccuggugugggcgucccuggaggggaggcccggcggcugccagaggggcagagugcugugguuucuguguccauguccaugucuguguccagguccgugugcaucagugugcgugugcgugugcgugugcgugugcagcccagcagcucgcagcacccucucccucacucagcagcacugucagcuuuucccuuuaaauaccacccccccccccgacacacacacaugcccuccccccuagacaccuggggaaauugucccacccccugaugaggucacacaugcuaaugagcagugaugucagcgggauucccuccuuucugcccccccucccuuuucuuugugucgcuucucucugggagcacacacacugcagagcuugguugaguuaugacagaacagucaaggggcagaacagacaaggguugcagggggugucaguggguaagggagcucagggugacagaaggcagggaccuggggaggugaaggucuuucuccagcagccaggacuacgcaucauuugucuuuguauuuccagaccccuagcccagugucuagcccagagagcgugcucaguggcugcacaggggcaagaggcagaaagauuaaaagcuggucugaaagacaaagagaugcaggccaaaagagguguggggacugagggucagccacccugccaccuuuuccuucuccacccugccucuucugggcuaagagccacgaaaguacucauuucccagccccuaggcagaugcgggcucugaggaaggaaauucagcugcuucauuugggcagcuucauuuugccacuaaguucagguaggggcaaaccacuguggagacucuuccaccuucucucccug

SEQ ID NO: 20075 - RNA, 1984 nt, Homo sapiens
aacccaaacccagacccaggaccuagucacagcuccaaccuacacuuccuauuaaucuuaaaacaaagcaaaacaaaacaaaaagauaucagcauuguagccuccaaucugagcccauuucccuucucuggcuaccauaccuccuucuccuauaugauaccauucacuacuuuguucaauuauccagucuagaccugcaucuugaggccacacccagccuucucacuccccacaccccucuuuccucucucacugcuccuuccuggucucuucucaucuggccccaccucuaaggaguccuccugccuucuggguugcccuggaaaacagacuauccccccuccuagugaagggaguggguagggguuucagccccacccucaggaagaugcgucuucccuguccucugcucugugguacuuccucucuggcugauuuagcaaacagcaccuagaccuggggccaggccuuuggcagugggacagauccagggauaggcuacaccacccugcccugacccugggauuggcaucagcuuccaaccaguuccugccaaagcuuguaaguaaguuuccugggagcggccgugguuguggugguggugggacagugugcagccaugaaagaaggugcaaaggaaucuccaaagaaagccugaccagcguaaaaaguugggaggcuuuguccuugucacuuguccacuaaacuccuccccucccuguuauuccugguugacccugggcaucucuggggacaguaggcaggugauugggaaaguuaaugggauugaggggcugagggccuggcagggggcaaaaagacuggccuuucaaggggugcagcauugguaggaacucuguuugguucugggcuuuagggucuccuaaggggaggagacugaaaaggucuggaaaugcugcugcugcuguggucacuguauauuuugcaauugggucuguggacaggaaggggccgcaugacccaguuaggaaacuagucuuuguacucaaccagaucccuuuaaguugucagucugcagcgaugggggcaguauauuucagggggaccucugaugcugcugacccuggagauagacuagaguucucagccuagguguguccauggcgucaggaaacccuugguccucuacucucaugcguguguccgcccucacucuccagguccucccgacggccaugaacacuacaucuucugcagcaccccccucacuagguguagaguucaucucucugcuggcuaucauccugcugucaguggcgcuggcuguggggcuucccggcaacagcuuugugguguggaguauccugaaaaggaugcagaagcgcucugucacugcccugauggugcugaaccuggcccuggccgaccuggccguauugcucacugcucccuuuuuccuucacuuccuggcccaaggcaccuggaguuuuggacuggcugguugccgccugugucacuaugucugcggagucagcauguacgccagcguccugcuuaucacggccaugagucuagaccgcucacuggcgguggcccgccccuuugugucccagaagcuacgcaccaaggcgauggcccggcgggugcuggcaggcaucuggguguuguccuuucugcuggccacacccguccucgcguaccgcacaguagugcccuggaaaacgaacaugagccugugcuucccgcgguaccccagcgaagggcaccgggccuuccaucuaaucuucgaggcugucacgggcuuccugcugcccuuccuggcugugguggccagcuacucggacauagggcgucggcuacaggcccggcgcuuccgccgcagccgccgcaccggccgccugguggugcucaucauccugaccuucgccgccuucuggcugcccuaccacguggugaaccuggcugaggcgggccgcgcgcuggccggccaggccgccggguuagggcucguggggaagcggcu

SEQ ID NO: 20076 - RNA, 1984 nt, Homo sapiens
agccgcuuccccacgagcccuaacccggcggccuggccggccagcgcgcggcccgccucagccagguucaccacgugguagggcagccagaaggcggcgaaggucaggaugaugagcaccaccaggcggccggugcggcggcugcggcggaagcgccgggccuguagccgacgcccuauguccgaguagcuggccaccacagccaggaagggcagcaggaagcccgugacagccucgaagauuagauggaaggcccggugcccuucgcugggguaccgcgggaagcacaggcucauguucguuuuccagggcacuacugugcgguacgcgaggacggguguggccagcagaaaggacaacacccagaugccugccagcacccgccgggccaucgccuuggugcguagcuucugggacacaaaggggcgggccaccgccagugagcggucuagacucauggccgugauaagcaggacgcuggcguacaugcugacuccgcagacauagugacacaggcggcaaccagccaguccaaaacuccaggugccuugggccaggaagugaaggaaaaagggagcagugagcaauacggccaggucggccagggccagguucagcaccaucagggcagugacagagcgcuucugcauccuuuucaggauacuccacaccacaaagcuguugccgggaagccccacagccagcgccacugacagcaggaugauagccagcagagagaugaacucuacaccuagugaggggggugcugcagaagauguaguguucauggccgucgggaggaccuggagagugagggcggacacacgcaugagaguagaggaccaaggguuuccugacgccauggacacaccuaggcugagaacucuagucuaucuccagggucagcagcaucagaggucccccugaaauauacugcccccaucgcugcagacugacaacuuaaagggaucugguugaguacaaagacuaguuuccuaacugggucaugcggccccuuccuguccacagacccaauugcaaaauauacagugaccacagcagcagcagcauuuccagaccuuuucagucuccuccccuuaggagacccuaaagcccagaaccaaacagaguuccuaccaaugcugcaccccuugaaaggccagucuuuuugcccccugccaggcccucagccccucaaucccauuaacuuucccaaucaccugccuacuguccccagagaugcccagggucaaccaggaauaacagggaggggaggaguuuaguggacaagugacaaggacaaagccucccaacuuuuuacgcuggucaggcuuucuuuggagauuccuuugcaccuucuuucauggcugcacacugucccaccaccaccacaaccacggccgcucccaggaaacuuacuuacaagcuuuggcaggaacugguuggaagcugaugccaaucccagggucagggcagggugguguagccuaucccuggaucugucccacugccaaaggccuggccccaggucuaggugcuguuugcuaaaucagccagagaggaaguaccacagagcagaggacagggaagacgcaucuuccugaggguggggcugaaaccccuacccacucccuucacuaggaggggggauagucuguuuuccagggcaacccagaaggcaggaggacuccuuagagguggggccagaugagaagagaccaggaaggagcagugagagaggaaagagggguguggggagugagaaggcuggguguggccucaagaugcaggucuagacuggauaauugaacaaaguagugaaugguaucauauaggagaaggagguaugguagccagagaagggaaaugggcucagauuggaggcuacaaugcugauaucuuuuuguuuuguuuugcuuuguuuuaagauuaauaggaaguguagguuggagcugugacuagguccugggucuggguuuggguu

SEQ ID NO: 20077 - RNA, 2609 nt, Homo sapiens
acugcuccagcagagcugcauuagcuccuucaguccuucuaagccgggagucucaggcccggcuuggggcagcucagccaaugaaggccgguucugccuguugcacacugcuucguacacgagugaugguucgguuggcacuggaguaggggaggagggugagaagagaaggcauucaggguaaaagggaauuaucugcuucaucauggaaagaggcagggaguguaaugugggggcacgaggagggaggagggcagucuaaguaggugagcgggaaggggaagccuuggggcuuucaagagaagggcaccugggguuaaggaucccagaauccuccuagagucuuacacucaacuucucuuccagcaagcacugcccacauuaggaucccgaagcugcaggagacacaaagcugaggaucgguccaaucacuggcaagacuccuuuccuauacaucauccccugggagggcccagagaaguguaggaauccuggcuguguguuugggccgggauccuuaccuguagacgucacuggcuguggaggccuuccgguuuacguuaacaaacaguucuggggccaaguagcccagggugcccccuggcuccccggacccugucccugacugugagccucccugaaauguggacaggccaaaaucugccagcugcaaaggaaggaaagaagugggagguagggaagacaagggggccagagagccuccaggaaccccccugcccccagaaggugcagguucagcuuuguaaagggaguguggaggucaagggaagagguucccuuggaugguagaucuaggugccuugugguagggcuaggucaaggucugagucuccagggcugggucagccaugacucuuuggaggggcugguggggcagcugguggaaaugacucguguggcucagggccucuaucaccugguaggcaggagcuaaaacuccuggcugggcuuuguccccuggcagcccuguguccagagagagaggcuacgccuauucaauagacagggcucuggaggucuaguguccggcgggccuggcuggagcagcucuggggccuugucuugaggcugagagggguguagaccagcugaccuugacgugcagcucuggguccagcaggacguuggauggcuugaggucccggugcaggagcaccggguucuggucgugcagguaaaacaucccaagcaccacuucuuucagcaggcggcaaaggagcggccagggccgagggcacugggacugcagcagccccgacaaggagccguucuccaugaauuuagucaccagagccggcuugggaucuuggucccaguucaccuucucgauaaccccuucuaggcgcagcacgaauucguuauccagacuugccauggccuugaccucccuggauaucgccuuccuacacuccaggagagagcuggagucgcaccggggucgugggaaaaucccucccuucgccauucaggccccagagcacaguggcuccaccuuuuuggccagauugcggcuggggucaaccggggucacucacgaguuuacgaucuugaccgccacaucguagccccacuuccuauguugcgcccggaacacugugccgaacccgccuuugccgacgagcuccugguucuccaguuccucgauggacaccaagggggcgggggcaccgcugggccugagagaggggugucgcccacuagccggccgugccgugccucagcgcugcuccccgcgccccugugacucggcguucucacugcaauccccagccucccucgccggcccccaccguccccggacucaaagacguucucugagcgagucuguggggcucucugggugugaaugucggaggcugcgaucgacaugccacucccuacucaccauaacuugacgcacgacaucaggcuggaaggugccagggggccucuggaaauugcgagccguaggagauggagugacuucuggggcuugguccuuucgcagagaggggaaggggucugucugugcaggggucagucucuagaccaagacggugagucuacuuuccggguuguuacccuuuuuccgaguugacugaacaacuucccuuauaggcgccucuacagucccgccccugggguggggcagggggcagagcgaaagcuagugccuuucuccuugacuagcguuuccugagcaccugccgcagccagauuagguguugcugggcauugaggauguuagggaaggaguccucaccuuccaggaacccacaaucaacccacuccuacagucaaagccuucccuuuucccacaggauuuccugcuccacgaccugccaggccaugaguggagauggugcuuaggaggguuuuaugguucuagggcucagcucucucacagcugcccuaagaucauagccaacacguauauaaaacuuaucaugcaccagguauauauauuagcuuauuuaauucucacacgaacccuaaggggauagguacugcuuuuauuaccuuucuauaggugaggaaacugagacacugagaguuuaaguaccuugccuaagcccauauggaaauaauggcucugaaccaucaaguua

SEQ ID NO: 20078 - RNA, 2609 nt, Homo sapiens
uaacuugaugguucagagccauuauuuccauaugggcuuaggcaagguacuuaaacucucagugucucaguuuccucaccuauagaaagguaauaaaagcaguaccuauccccuuaggguucgugugagaauuaaauaagcuaauauauauaccuggugcaugauaaguuuuauauacguguuggcuaugaucuuagggcagcugugagagagcugagcccuagaaccauaaaacccuccuaagcaccaucuccacucauggccuggcaggucguggagcaggaaauccugugggaaaagggaaggcuuugacuguaggaguggguugauuguggguuccuggaaggugaggacuccuucccuaacauccucaaugcccagcaacaccuaaucuggcugcggcaggugcucaggaaacgcuagucaaggagaaaggcacuagcuuucgcucugcccccugccccaccccaggggcgggacuguagaggcgccuauaagggaaguuguucagucaacucggaaaaaggguaacaacccggaaaguagacucaccgucuuggucuagagacugaccccugcacagacagaccccuuccccucucugcgaaaggaccaagccccagaagucacuccaucuccuacggcucgcaauuuccagaggcccccuggcaccuuccagccugaugucgugcgucaaguuauggugaguagggaguggcaugucgaucgcagccuccgacauucacacccagagagccccacagacucgcucagagaacgucuuugaguccggggacggugggggccggcgagggaggcuggggauugcagugagaacgccgagucacaggggcgcggggagcagcgcugaggcacggcacggccggcuagugggcgacaccccucucucaggcccagcggugcccccgcccccuugguguccaucgaggaacuggagaaccaggagcucgucggcaaaggcggguucggcacaguguuccgggcgcaacauaggaaguggggcuacgauguggcggucaagaucguaaacucgugagugaccccgguugaccccagccgcaaucuggccaaaaagguggagccacugugcucuggggccugaauggcgaagggagggauuuucccacgaccccggugcgacuccagcucucuccuggaguguaggaaggcgauauccagggaggucaaggccauggcaagucuggauaacgaauucgugcugcgccuagaagggguuaucgagaaggugaacugggaccaagaucccaagccggcucuggugacuaaauucauggagaacggcuccuugucggggcugcugcagucccagugcccucggcccuggccgcuccuuugccgccugcugaaagaaguggugcuugggauguuuuaccugcacgaccagaacccggugcuccugcaccgggaccucaagccauccaacguccugcuggacccagagcugcacgucaaggucagcuggucuacaccccucucagccucaagacaaggccccagagcugcuccagccaggcccgccggacacuagaccuccagagcccugucuauugaauaggcguagccucucucucuggacacagggcugccaggggacaaagcccagccaggaguuuuagcuccugccuaccaggugauagaggcccugagccacacgagucauuuccaccagcugccccaccagccccuccaaagagucauggcugacccagcccuggagacucagaccuugaccuagcccuaccacaaggcaccuagaucuaccauccaagggaaccucuucccuugaccuccacacucccuuuacaaagcugaaccugcaccuucugggggcagggggguuccuggaggcucucuggcccccuugucuucccuaccucccacuucuuuccuuccuuugcagcuggcagauuuuggccuguccacauuucagggaggcucacagucagggacaggguccggggagccagggggcacccugggcuacuuggccccagaacuguuuguuaacguaaaccggaaggccuccacagccagugacgucuacagguaaggaucccggcccaaacacacagccaggauuccuacacuucucugggcccucccaggggaugauguauaggaaaggagucuugccagugauuggaccgauccucagcuuugugucuccugcagcuucgggauccuaaugugggcagugcuugcuggaagagaaguugaguguaagacucuaggaggauucugggauccuuaaccccaggugcccuucucuugaaagccccaaggcuuccccuucccgcucaccuacuuagacugcccuccucccuccucgugcccccacauuacacucccugccucuuuccaugaugaagcagauaauucccuuuuacccugaaugccuucucuucucacccuccuccccuacuccagugccaaccgaaccaucacucguguacgaagcagugugcaacaggcagaaccggccuucauuggcugagcugccccaagccgggccugagacucccggcuuagaaggacugaaggagcuaaugcagcucugcuggagcagu

SEQ ID NO: 20079 - RNA, 2505 nt, Homo sapiens
agagaggauaagaaaaacaagcauuuugugguggguugaauugcguugucguuuuuagaggcauuucgugauccaugguugcgcucccgugaagagcgagucuagagaaggaauccgaaggugggugagaguugagggaauuugaauuccauaauuacgacucgaauuucugcaaucagcucgcggcuguguugccugcuccugccacaaaaacgccaugcagcgccgagccaagucggauggaaguggguuaggguauuauauaagcccuugcgggagggaagauggucuuuuauguguguuucuuuugcagcggcggcggcgagcgcggcucagguugauuuagaauacgggugacaguggccuggcgcgagcccacugcugacgaaagcggcuuaucccgcgcgguuuccauggagacgagccggagccgcggcggcggcggggcugucagcgagcgcggcggagcuggcgcguccgugggggucugcaggaggaaggcggaggccggggccgggaccgggacccucgcggcagacauggacuugcauugugacugugccgccgaaacgccggccgccgagccgccgucggggaagauuaauaaagcugccuucaaauuauucaagaagaggaaaucggguggcaccaugcccagcauuuuuggggucaaaaacaaaggggacgggaaaagcucggguccgacggggcuggugaggagcaggacccacgacggacuugccgaggugcuggugcuggagagcggcaggaaggaggagccgcgcggcgggggcgacagcggcgggggcggcggggggcggccgaacccggggccccccagagccgcagggcccggcgggggcucccucgccagcagcucgguggccaagucgcacagcuucuucucgcugcugaagaagaacgggcgcucggaaaacggcaagggagagccuguggacgcgagcaaggccggcggcaaacaaaagcgggggcugcgggggcuguucagcggcaugcgcuggcacaggaaagacaagcgggccaaggcggaggccgcggaggggcgcgcgcccgggggcggcuugauccuacccggcucgcucaccgccagccuggagugcgucaaggaggagacgcccagagccgcgcgcgagccggaggagcccagccaggacgccccgcgagacccagcaggugagcccgcagggggagaggaggugcccgcccccgccgaccgcgccccagcgcggagcugccgagaggcagagggccucgcgcaccccggcgacaccggcgcccggggagaggacgccgcggggcaucggcgcgccgagccggggcccggggagguccgcacggcagaggacgcuuccaggacgggggccguucccguaaagacggucccccuugucgacuccgaaggcggcagcggccgggcgcccgccgccccagacccugccucugucgauccacccucagacccgucggcagaucguauuuguuugauguuuucugacgugacuucacugaaaagcuuugacucucuuacaggcuguggagauauuauugcagaccaagaggaagaggcaggucccagcugugacaagcauguccccgggccaggcaagccggcucugucuaaaaagaaccccggcgugguggccuaccaaggaggcggggaagagauggccagcccggacgagguggacgacaccuaucuacaggaguucugggacaugcucucccagaccgaggagcagggacccgagccccaggagggcgcggcuaagguggcagcugcgcuggaaaccaagguggugcccgagacccccaaagacaccagguguguggaagcggccaaggacgcguccucggucaagcgcaggaggcucaaccggauucccaucgagccccauccuaaggaggagcccaagcacccggagaaggagcagcaggaaggcguccccaacagcgacgagggcuacugggacuccaccacgccaggcccagaggaagacagcucgagcagcgggaagaaggcgggcaucccccgggauagcuacagcggggacgcgcucuaugaucucuaugcugacccggacggaaguccagcaacccuuccuggagggaaggacaacgaggagacguccucccugucccgguuaaagcccguaucuccaggcaccaucaccuguccacugcgaacaccaggcagcuugcugaaggacucuaagaucccuauuagcaucaagcaccugaccaaccuuccaucuagccaucccguggugcaccagcaacccuccaggagugagaugcccagaacaaaaaucccgguuuccaaagugcugguccgcagagucagcaaccggggcuuggcugggaccaccaucagagcaacggccugccacgacagugccaaaaaguugugaggucuuccaggccaagguggaugggccccaugccaaggaauacaacuuuucccuggaaaccacuaaaguaaguuuu

SEQ ID NO: 20080 - RNA, 2505 nt, Homo sapiens
aaaacuuacuuuagugguuuccagggaaaaguuguauuccuuggcauggggcccauccaccuuggccuggaagaccucacaacuuuuuggcacugucguggcaggccguugcucugaugguggucccagccaagccccgguugcugacucugcggaccagcacuuuggaaaccgggauuuuuguucugggcaucucacuccuggaggguugcuggugcaccacgggauggcuagauggaagguuggucaggugcuugaugcuaauagggaucuuagaguccuucagcaagcugccugguguucgcaguggacaggugauggugccuggagauacgggcuuuaaccgggacagggaggacgucuccucguuguccuucccuccaggaaggguugcuggacuuccguccgggucagcauagagaucauagagcgcguccccgcuguagcuaucccgggggaugcccgccuucuucccgcugcucgagcugucuuccucugggccuggcgugguggagucccaguagcccucgucgcuguuggggacgccuuccugcugcuccuucuccgggugcuugggcuccuccuuaggauggggcucgaugggaauccgguugagccuccugcgcuugaccgaggacgcguccuuggccgcuuccacacaccuggugucuuugggggucucgggcaccaccuugguuuccagcgcagcugccaccuuagccgcgcccuccuggggcucgggucccugcuccucggucugggagagcaugucccagaacuccuguagauaggugucguccaccucguccgggcuggccaucucuuccccgccuccuugguaggccaccacgccgggguucuuuuuagacagagccggcuugccuggcccggggacaugcuugucacagcugggaccugccucuuccucuuggucugcaauaauaucuccacagccuguaagagagucaaagcuuuucagugaagucacgucagaaaacaucaaacaaauacgaucugccgacgggucugaggguggaucgacagaggcagggucuggggcggcgggcgcccggccgcugccgccuucggagucgacaagggggaccgucuuuacgggaacggcccccguccuggaagcguccucugccgugcggaccuccccgggccccggcucggcgcgccgaugccccgcggcguccucuccccgggcgccggugucgccggggugcgcgaggcccucugccucucggcagcuccgcgcuggggcgcggucggcgggggcgggcaccuccucucccccugcgggcucaccugcugggucucgcggggcguccuggcugggcuccuccggcucgcgcgcggcucugggcgucuccuccuugacgcacuccaggcuggcggugagcgagccggguaggaucaagccgcccccgggcgcgcgccccuccgcggccuccgccuuggcccgcuugucuuuccugugccagcgcaugccgcugaacagcccccgcagcccccgcuuuuguuugccgccggccuugcucgcguccacaggcucucccuugccguuuuccgagcgcccguucuucuucagcagcgagaagaagcugugcgacuuggccaccgagcugcuggcgagggagcccccgccgggcccugcggcucuggggggccccggguucggccgccccccgccgcccccgccgcugucgcccccgccgcgcggcuccuccuuccugccgcucuccagcaccagcaccucggcaaguccgucguggguccugcuccucaccagccccgucggacccgagcuuuucccguccccuuuguuuuugaccccaaaaaugcugggcauggugccacccgauuuccucuucuugaauaauuugaaggcagcuuuauuaaucuuccccgacggcggcucggcggccggcguuucggcggcacagucacaaugcaaguccaugucugccgcgagggucccggucccggccccggccuccgccuuccuccugcagacccccacggacgcgccagcuccgccgcgcucgcugacagccccgccgccgccgcggcuccggcucgucuccauggaaaccgcgcgggauaagccgcuuucgucagcagugggcucgcgccaggccacugucacccguauucuaaaucaaccugagccgcgcucgccgccgccgcugcaaaagaaacacacauaaaagaccaucuucccucccgcaagggcuuauauaauacccuaacccacuuccauccgacuuggcucggcgcugcauggcguuuuuguggcaggagcaggcaacacagccgcgagcugauugcagaaauucgagucguaauuauggaauucaaauucccucaacucucacccaccuucggauuccuucucuagacucgcucuucacgggagcgcaaccauggaucacgaaaugccucuaaaaacgacaacgcaauucaacccaccacaaaaugcuuguuuuucuuauccucucu

SEQ ID NO: 20081 - RNA, 2613 nt, Homo sapiens
ugagguucggagagauuuauaaagagagaccguagaagacuccaggugaucaguuuuugcugggaccgaaauucuccguaaaaccugcauguaacagagaauugccgaguugaaacagggcagugaaucucaucccuacaaauuucccucccuacccccuucuuccuuuggacacuccugucuuacuuggcuuuuacuagccacccgauccauuucccaaucgcccuguauggcucucccgccccuuccaguccaacagggaggaccaagccagagcucuggggucgggguaccacagucaacacaacccagaggcgggggguuuaccuucucuaccuucccccaaaucaaugaccccagucccuggaucccggggccugugcagagacgguccgugcacccgccccgcaaacucccuaacccccuauccguuuucaagcgaaucuccgcaguucggaccagcacuuccuagucgcaaucccgcgcacgcagcguggugccgcgguuugucccuuggggagguggaggcgcgcaccggucccuuucucgagagagccgaguuuucuugaagugcaagcuuccugucagccuaggcaaaccaguugcaaggcgcuguguccucuagcggcaaacucuagcaguucauuugcgagcgcucaccuacaccuaagggaucuggucucucaaaucugagacccaagaggggagaaagugcccugaacgcaguccaggcgcucgcaaaugcccuccccguaaugagaccgggagacuggggcgcaaucgcucgaacuacgaacagcugauugucuccuccacggcagauggucuuugagcacagauuugcauucauugucuucaaaucuguuuucgcgcugguguucuagauuucagcagcagcagaucuaugcgcagaucagaauacaaaaggagaagcaagaaaaugacacccagccaggaggauguuuaauaggcaccgcgagcagccccgcgcaguuaaaaaaccgucuaggguuucagcuguucggugaggcugcugccaccgccugccggccaccagcccgcggccagcaccgcggcgaccgcgcgcggugggcgaaguuuccacgacucccccgucccuccccgcccacuaccgggggcuucgggaacggagagguggggagggaaccggaggacccgcgggaauacuccccggccgcucgcgcacucagcccgccucgaucugucagcaaccucuccuccacacgggugcgacugccgcucgcgcccgcccgcccgcggguguuuuccuuagguccuggaccguuuuccccagcacuguauuugagcagcacuugccccucgcuuguccgccccaccccaucccccgccuucuuucauauguucuccacucucagcaacgugcaagccgcacacaacaucugauaucaccauggaacuccaggagaccuggggagccauucagggagcugggugcucugggggacguuugcgcaaaacauaagcacauguggccacgcucacaagcaugcacacagauccgaaccccgggaacgaacgugccucccggcaggcuacaaaagccuacaucuagaggcaggauccagggaggcuucccgcagccaggccgaaccccugcguccccagcccgcagagaccugcuacccuaagucagugcagggugugggggccccccaauccugcgcaagcacacgggguucgugcuaggacucgacgcccgcagcuuucuguccccuuucaccucccggagucccggcaacgcagagcguggcgcgcgccgccggaggacgucggcccggcuugccaggcgccggccaaucccgcgcguccaugcaaaugaggcuccuuaucgggccgcagcuccgccucccgcagccagggccguaguaacccauucauggggcccgcgcgcggcugcagccgggcuccguggcgcucgcagccaccgccuccucucggcuccaggucuuccccuucuuuuuacaacugauccuguuggggauuuuuuuuuuuucuaaauuggaacgguggggaggagcagggaggggggaccuggaggaaggggagagauuaggcagccaucaauuuccuccaguuucucccagaacaggugaugcuucuaaauugugaucacuuucaggaggcagcacugcagcuggaaggaugcgagcgaccuaggguggaguggcugaggcggcagaucugaacuugcggaggauaagaacccaaacuuugacuacaucaguccgcaccucgccagugaagcaaaggacggguuaucuuuuuuuuuuuucuaagacucaaacuugggcacuugaucccuuuucuuggauugcuuuggaggagacgauuugcuggcaacguugggaacagucaggacuguguuguaacucuuacuuuuaaagcgacaguagaggaucagacuuuuuaaauguuuggaauucaagauacuuuaggaagaggaccaacucugaaagagaaaucgcugggcgcggagauggauucggucagguccuggguccggaaugucggagugguggacgcuaaugucgccgcgcagagguaacgacacggccgcgcaauuauuaugcu

SEQ ID NO: 20082 - RNA, 2613 nt, Homo sapiens
agcauaauaauugcgcggccgugucguuaccucugcgcggcgacauuagcguccaccacuccgacauuccggacccaggaccugaccgaauccaucuccgcgcccagcgauuucucuuucagaguugguccucuuccuaaaguaucuugaauuccaaacauuuaaaaagucugauccucuacugucgcuuuaaaaguaagaguuacaacacaguccugacuguucccaacguugccagcaaaucgucuccuccaaagcaauccaagaaaagggaucaagugcccaaguuugagucuuagaaaaaaaaaaaagauaacccguccuuugcuucacuggcgaggugcggacugauguagucaaaguuuggguucuuauccuccgcaaguucagaucugccgccucagccacuccacccuaggucgcucgcauccuuccagcugcagugcugccuccugaaagugaucacaauuuagaagcaucaccuguucugggagaaacuggaggaaauugauggcugccuaaucucuccccuuccuccagguccccccucccugcuccuccccaccguuccaauuuagaaaaaaaaaaaauccccaacaggaucaguuguaaaaagaaggggaagaccuggagccgagaggaggcgguggcugcgagcgccacggagcccggcugcagccgcgcgcgggccccaugaauggguuacuacggcccuggcugcgggaggcggagcugcggcccgauaaggagccucauuugcauggacgcgcgggauuggccggcgccuggcaagccgggccgacguccuccggcggcgcgcgccacgcucugcguugccgggacuccgggaggugaaaggggacagaaagcugcgggcgucgaguccuagcacgaaccccgugugcuugcgcaggauuggggggcccccacacccugcacugacuuaggguagcaggucucugcgggcuggggacgcagggguucggccuggcugcgggaagccucccuggauccugccucuagauguaggcuuuuguagccugccgggaggcacguucguucccgggguucggaucugugugcaugcuugugagcguggccacaugugcuuauguuuugcgcaaacgucccccagagcacccagcucccugaauggcuccccaggucuccuggaguuccauggugauaucagauguugugugcggcuugcacguugcugagaguggagaacauaugaaagaaggcgggggaugggguggggcggacaagcgaggggcaagugcugcucaaauacagugcuggggaaaacgguccaggaccuaaggaaaacacccgcgggcgggcgggcgcgagcggcagucgcacccguguggaggagagguugcugacagaucgaggcgggcugagugcgcgagcggccggggaguauucccgcggguccuccgguucccuccccaccucuccguucccgaagcccccgguagugggcggggagggacgggggagucguggaaacuucgcccaccgcgcgcggucgccgcggugcuggccgcgggcugguggccggcaggcgguggcagcagccucaccgaacagcugaaacccuagacgguuuuuuaacugcgcggggcugcucgcggugccuauuaaacauccuccuggcugggugucauuuucuugcuucuccuuuuguauucugaucugcgcauagaucugcugcugcugaaaucuagaacaccagcgcgaaaacagauuugaagacaaugaaugcaaaucugugcucaaagaccaucugccguggaggagacaaucagcuguucguaguucgagcgauugcgccccagucucccggucucauuacggggagggcauuugcgagcgccuggacugcguucagggcacuuucuccccucuugggucucagauuugagagaccagaucccuuagguguaggugagcgcucgcaaaugaacugcuagaguuugccgcuagaggacacagcgccuugcaacugguuugccuaggcugacaggaagcuugcacuucaagaaaacucggcucucucgagaaagggaccggugcgcgccuccaccuccccaagggacaaaccgcggcaccacgcugcgugcgcgggauugcgacuaggaagugcugguccgaacugcggagauucgcuugaaaacggauaggggguuagggaguuugcggggcgggugcacggaccgucucugcacaggccccgggauccagggacuggggucauugauuugggggaagguagagaagguaaaccccccgccucuggguuguguugacugugguaccccgaccccagagcucuggcuugguccucccuguuggacuggaaggggcgggagagccauacagggcgauugggaaauggaucggguggcuaguaaaagccaaguaagacaggaguguccaaaggaagaaggggguagggagggaaauuuguagggaugagauucacugcccuguuucaacucggcaauucucuguuacaugcagguuuuacggagaauuucggucccagcaaaaacugaucaccuggagucuucuacggucucucuuuauaaaucucuccgaaccuca

SEQ ID NO: 20083 - RNA, 2517 nt, Homo sapiens
aggaagcggcggggcuggugguggugguagcagcggcggcagcggcggcagaggcggcggcggcggcggcggcggcggcggcgguggcgguggcgguggcgguggcagaucggggggcgggggggcggcgggcgcgugucuguuugugagaucaauacugaggccgcguccgacccccuugagccgagauccccccccagcccagcccccaccccaccccccgcacacgccccaccccccccacgacccagccucauaccgcaccagcugaggcacccaagaggauuacccccuggggcccucucccgccccccaaaaaagagaagauccccucuccuggcccaucccuucccuucuucccuccccccuccccccgaacuuucccucucgcaugcuuuuccccugcaccacggaucgccucucggaugccgcuugccuggaagcugcguuaggagcgagcggcggcgguggcggcgguggcggcggcggcggcagcucgggagugcuaugaccggcaaacucgccgagaagcugccggugaccaugagcaguuugcuaaaccaacugccugacaaucuguaccccgaggagauccccagcgcgcucaaccucuucuccggcagcagcgacucgguaguccauuacaaucagauggcuacagguaagggcggcggggaggcggcgaggcagcgaggaaggaaggggagaggaagaggaggaggggacgaccuggugauggauggauggauggauggauggauggauggauggauggguggauggguggauagauaaauggauggagagaugggggcgcgcugggaauuuugcggggggcgaguugcuuuucccacccacuccucccgcccuccucgaucgagaaggcuagguuggcgacgccacgguagaggcuucgguucucccgggugggggcagccgccgaccggagggagguaggugcgagcggcucugggguucucccucaccacgcagggggcccgaucgccgggcuacgcgcaaggcguggugcugucgcccucuucccgggaggagcccggcgucuuuuucacccgcgcucuccccccuuacucccucagccucccacccgggauggagccaugugcggcguggaguccccgcggugggagagguacugcgacgcugccuuuccggggcguucagcaaagccguggggguguggggacggcggggagaaggaggggguucacccgcggggcgagggccugccacggggaacgaucccggggccggggagcuggggaagggcggccucucccgccauggagacaccggccgguuuuccgccgcucuccacccucccuagcuggggcuaggauuuuccccuccagcaagagccuaaagcuccuucaugcccgaggaggcuggggccgggguaggugaagggagagcucccuuugagggcgacacccuucuacgcuccgaggacaaagcgucggagcgcucugggucggcgacccgggagcagcgcgcguggggggcaucgccggggagggaaaggcgcggcguccuggagcggacagggccaagggaagaggccgaguugugugcgguggagagcgagagcccagcgcgcuccgggucugaaacuaccuguagcugcagcuaccugcccgccccaccucgggaagaacaacaaugcuucucgcgcgcgcgcgcgugugugugugguacgugagugugugcgcggcuugugcgcugugugugcagcagccacuccacaccccgauccguaguauuuugcuauauccagguugcgcccgggagcgcggcaccgcccgcuuugcgcggggcucagcguuccucuuaccccaugcgcuacgcacuccacccggccgcacccuccgcaccugggcaaggaccugggcgccgcggcccggagccggaucggcuucacucaccccuccccucucucccccgcucuccgcagagaauguaauggacaucggucugaccaacgagaagcccaacccggaacucucuuacuccggcuccuuccagccagcccccggcaacaagaccgugaccuacuugggaaaguucgccuucgacuccccuuccaacuggugccaggacaacaucauuagccucaugagcgccggcaucuugggggugcccccggcuucaggggcgcucagcacgcagacguccacggccagcauggugcagccaccgcagggugacguggaggccauguaucccgcgcuaccccccuacuccaacugcggcgaccucuacucagagcccgugucuuuccacgacccccagggcaaucccgggcucgccuauuccccccaggauuaccaaucggccaagccggcguuggacagcaaucucuuccccaugauuccugacuacaaccucuaccaccaccccaacgacaugggcuccauuccggagcacaagcccuuccagggcauggaccccauccgggucaacccgcccccuauuaccccucuggagaccaucaaggcauuc

SEQ ID NO: 20084 - RNA, 2517 nt, Homo sapiens
gaaugccuugauggucuccagagggguaauagggggcggguugacccggaugggguccaugcccuggaagggcuugugcuccggaauggagcccaugucguugggguggugguagagguuguagucaggaaucauggggaagagauugcuguccaacgccggcuuggccgauugguaauccuggggggaauaggcgagcccgggauugcccugggggucguggaaagacacgggcucugaguagaggucgccgcaguuggaguagggggguagcgcgggauacauggccuccacgucacccugcgguggcugcaccaugcuggccguggacgucugcgugcugagcgccccugaagccgggggcacccccaagaugccggcgcucaugaggcuaaugauguuguccuggcaccaguuggaaggggagucgaaggcgaacuuucccaaguaggucacggucuuguugccgggggcuggcuggaaggagccggaguaagagaguuccggguugggcuucucguuggucagaccgauguccauuacauucucugcggagagcgggggagagaggggaggggugagugaagccgauccggcuccgggccgcggcgcccagguccuugcccaggugcggagggugcggccggguggagugcguagcgcaugggguaagaggaacgcugagccccgcgcaaagcgggcggugccgcgcucccgggcgcaaccuggauauagcaaaauacuacggaucgggguguggaguggcugcugcacacacagcgcacaagccgcgcacacacucacguaccacacacacacgcgcgcgcgcgcgagaagcauuguuguucuucccgagguggggcgggcagguagcugcagcuacagguaguuucagacccggagcgcgcugggcucucgcucuccaccgcacacaacucggccucuucccuuggcccuguccgcuccaggacgccgcgccuuucccuccccggcgaugccccccacgcgcgcugcucccgggucgccgacccagagcgcuccgacgcuuuguccucggagcguagaagggugucgcccucaaagggagcucucccuucaccuaccccggccccagccuccucgggcaugaaggagcuuuaggcucuugcuggaggggaaaauccuagccccagcuagggaggguggagagcggcggaaaaccggccggugucuccauggcgggagaggccgcccuuccccagcuccccggccccgggaucguuccccguggcaggcccucgccccgcgggugaacccccuccuucuccccgccguccccacacccccacggcuuugcugaacgccccggaaaggcagcgucgcaguaccucucccaccgcggggacuccacgccgcacauggcuccaucccgggugggaggcugagggaguaaggggggagagcgcgggugaaaaagacgccgggcuccucccgggaagagggcgacagcaccacgccuugcgcguagcccggcgaucgggcccccugcguggugagggagaaccccagagccgcucgcaccuaccucccuccggucggcggcugcccccacccgggagaaccgaagccucuaccguggcgucgccaaccuagccuucucgaucgaggagggcgggaggagugggugggaaaagcaacucgccccccgcaaaauucccagcgcgcccccaucucuccauccauuuaucuauccacccauccacccauccauccauccauccauccauccauccauccauccaucaccaggucguccccuccuccucuuccucuccccuuccuuccucgcugccucgccgccuccccgccgcccuuaccuguagccaucugauuguaauggacuaccgagucgcugcugccggagaagagguugagcgcgcuggggaucuccucgggguacagauugucaggcaguugguuuagcaaacugcucauggucaccggcagcuucucggcgaguuugccggucauagcacucccgagcugccgccgccgccgccaccgccgccaccgccgccgcucgcuccuaacgcagcuuccaggcaagcggcauccgagaggcgauccguggugcaggggaaaagcaugcgagagggaaaguucggggggaggggggagggaagaagggaagggaugggccaggagaggggaucuucucuuuuuuggggggcgggagagggccccaggggguaauccucuugggugccucagcuggugcgguaugaggcugggucgugggggggguggggcgugugcgggggguggggugggggcugggcuggggggggaucucggcucaagggggucggacgcggccucaguauugaucucacaaacagacacgcgcccgccgcccccccgccccccgaucugccaccgccaccgccaccgccaccgccgccgccgccgccgccgccgccgccgccucugccgccgcugccgccgcugcuaccaccaccaccagccccgccgcuuccu

SEQ ID NO: 20085 - RNA, 2532 nt, Homo sapiens
auccauuccaggcccuagcacauauuagguauugauggauugauggauaagaggcacaaggagacaccagcaaucccacaccucucaaaaaaaugaagugacagucugaggcacagaaaacagggaguagggagcccacauuuauuuagcgcugacuguguguuaagcacuauuaaguguuuuauguauguuuucauauuuaacccuuaccaccaacucuaugggaagaugcaugaucaguuccauuuuacaggugugaaaguggcaguucagacaugaucauuaccauucugaggugguacagcuauaaugaguagcagggucaggauugaaagcuagaugugccugccuucaaaguccaugcgcaguccacucugcccuguacccacucccagcccccagcgagaaaaaugacagcaaauguccugguuuacccgcagcccagcagguguagagggguaagggcugagggauuugcccugauuuccuccauuggauggucucuuauuccugccugugggccacccucccaggagagucccugaacagggucuccagagccaggacuagagcaaccugccccuccgccccuggugccccacacaggcaguccaguucuagcaacuaugccacuuccccuggcucuggcuauuuggagaugagcugaagucagagaggcaggaagucaaggaaaaguucugauaucuugucccuguguguccccaaacagccugcccagggucauccaaucaggcaaauggcccgagugccuggccaucuggucacuccaggggcaggacccuucugggcucagcaggagugaugggguuacauagagucuucagagacaaagaacacacacacauacaggcaaacacacacuccgggguccugaccucagcuaauuagccucuggugucucgggggugacagagcugauauacaauaucuggguucucuuuguauuuucccucuuuccaccccaacuuggccuuggcgggggucucugggcacauagggacaaaguuaagucccccuucuggguuggcuucucugacuuugacagcugucuccuaagucccagaaagcuucagcuacugguuaaacuacgggauacccagagagcacgaucucagggaaucccuggaaaaacuuucuucuuccacuugggcugggugguggcugggggaccugcuccuuggagacucaggccucccagauccaagccagacagaugugcagccccagggcagcccagacaggcuggaaaacacccagcuccuggagcaggagagaugggggagaaggggaaagaacacacacacacacacacacacacacacacacacacacacacacgcacgcacaggaguuuggccagaaaaguuuccuacagaaggaaaagccgccuugcccgccgguuuucccgggacgcaaggagacuuccucuggaauccucugggaagaugagaggcagcggcagcagcuuccaccaacagcggcaaaacuucaguccgaaaagucccccaaaucccccucccucucccccucguucuuuuguuccccacugcauugccaaccaggcagcucccggcuucccacacuggacuguccucccccaaccccaagcccgaacccgcccgcgccuccccgccuggcccgucgccggggggccggggggcgcucacccgccuugcaggggucuuuguaguugaggggcuccgagucguccuccuccgccaggucauagguguagucggccaaguccagcggccggccgggacgcgggagcagcagcagcccgagcagcagcggcaggcgggccacgccgggcaugcuggcggggcggcggcgagggaagcggcgcacuggaggccaggggagggcguccucucgcccgcuugcuugcucgaucgcgaccgcgaccgcucccgcccucgcuccccgaccucuuccccuucccucugcucgccucccuccuuccugucucccgccccccgcucgguccgcggcuccgcgcucguccucgggcuccagccgucucccucucccuuuccuucuuuuucucucuuucuuucucucccucccucccucccuccgacuccccccccccuuuuuagggaaaugagcucgcuggagggcggguuuucgcccgagcucugccccccucggggccgggacagugcucggccgggccgggccgcgcgccagccggggcggggaaggcggagagccgcgcgcccggggagggggcucgggccgcccgggccgcgggccgcgggccgcgaggccggggcuggagcucgggccccggggugccgggagggcugucccuccugaagugcccucuagcggcggccucccccgcgggcgcgcggccgagcccccgccccgccgcgggacacgcugucagguccucgcgccgccccugccccgcgcccccgccucgggucggucucuccgcccgcgucucccuaucuccccuucuuggacccucgcucucucgcgucucgcucucugcgcucugucucu

SEQ ID NO: 20086 - RNA, 2532 nt, Homo sapiens
agagacagagcgcagagagcgagacgcgagagagcgaggguccaagaaggggagauagggagacgcgggcggagagaccgacccgaggcgggggcgcggggcaggggcggcgcgaggaccugacagcgugucccgcggcggggcgggggcucggccgcgcgcccgcgggggaggccgccgcuagagggcacuucaggagggacagcccucccggcaccccggggcccgagcuccagccccggccucgcggcccgcggcccgcggcccgggcggcccgagcccccuccccgggcgcgcggcucuccgccuuccccgccccggcuggcgcgcggcccggcccggccgagcacugucccggccccgaggggggcagagcucgggcgaaaacccgcccuccagcgagcucauuucccuaaaaaggggggggggagucggagggagggagggagggagagaaagaaagagagaaaaagaaggaaagggagagggagacggcuggagcccgaggacgagcgcggagccgcggaccgagcggggggcgggagacaggaaggagggaggcgagcagagggaaggggaagaggucggggagcgagggcgggagcggucgcggucgcgaucgagcaagcaagcgggcgagaggacgcccuccccuggccuccagugcgccgcuucccucgccgccgccccgccagcaugcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcgggugagcgccccccggccccccggcgacgggccaggcggggaggcgcgggcggguucgggcuugggguugggggaggacaguccagugugggaagccgggagcugccugguuggcaaugcaguggggaacaaaagaacgagggggagagggagggggauuugggggacuuuucggacugaaguuuugccgcuguugguggaagcugcugccgcugccucucaucuucccagaggauuccagaggaagucuccuugcgucccgggaaaaccggcgggcaaggcggcuuuuccuucuguaggaaacuuuucuggccaaacuccugugcgugcguguguguguguguguguguguguguguguguguguguguguguucuuuccccuucucccccaucucuccugcuccaggagcuggguguuuuccagccugucugggcugcccuggggcugcacaucugucuggcuuggaucugggaggccugagucuccaaggagcaggucccccagccaccacccagcccaaguggaagaagaaaguuuuuccagggauucccugagaucgugcucucuggguaucccguaguuuaaccaguagcugaagcuuucugggacuuaggagacagcugucaaagucagagaagccaacccagaagggggacuuaacuuugucccuaugugcccagagacccccgccaaggccaaguugggguggaaagagggaaaauacaaagagaacccagauauuguauaucagcucugucacccccgagacaccagaggcuaauuagcugaggucaggaccccggaguguguguuugccuguauguguguguguucuuugucucugaagacucuauguaaccccaucacuccugcugagcccagaaggguccugccccuggagugaccagauggccaggcacucgggccauuugccugauuggaugacccugggcaggcuguuuggggacacacagggacaagauaucagaacuuuuccuugacuuccugccucucugacuucagcucaucuccaaauagccagagccaggggaaguggcauaguugcuagaacuggacugccuguguggggcaccaggggcggaggggcagguugcucuaguccuggcucuggagacccuguucagggacucuccugggaggguggcccacaggcaggaauaagagaccauccaauggaggaaaucagggcaaaucccucagcccuuaccccucuacaccugcugggcugcggguaaaccaggacauuugcugucauuuuucucgcugggggcugggaguggguacagggcagaguggacugcgcauggacuuugaaggcaggcacaucuagcuuucaauccugacccugcuacucauuauagcuguaccaccucagaaugguaaugaucaugucugaacugccacuuucacaccuguaaaauggaacugaucaugcaucuucccauagaguuggugguaaggguuaaauaugaaaacauacauaaaacacuuaauagugcuuaacacacagucagcgcuaaauaaaugugggcucccuacucccuguuuucugugccucagacugucacuucauuuuuuugagaggugugggauugcuggugucuccuugugccucuuauccaucaauccaucaauaccuaauaugugcuagggccuggaauggau

SEQ ID NO: 20087 - RNA, 2832 nt, Homo sapiens
gcgcuucccagcuuuaacaggcugugguugagcgugagaaauguuccagaauuccacacagucccacuccagcuccagaggcugcguuucccuuuucagcucaugcugacacaaagguacauucuguucagcggcgcguggaaaaacaugugaauccgguuagaagcgcacuucagacuccuccaggacgcccuugugcuucuaaucuugcaugcuaacuuagauaugcgucugucacucacgacaugcccaugaugcugccuaggggauguguccccccaugcaaagaaacccagguagacagaagcacagggaucccuaacgccgaagcgccuccacaaggcagugagugcaugugcccgugcagagacaggugagcaccggcgcgcacagucgugcccagcagaggcacaagcacaagcucacacgcaugcacucacgcgcagccccacacgcggauggccccagagaccgcccgguagagcacacagcggccacgccuccccuuccgugacucccaggccccgcgccgccccgcgcgcgcccccgccgcccgcgccgcaguccgcagccacccggcgcggucagccccggcugcggcuccagcuccgcgcuccgcucuucucucccgagccggaucgcgggagcgagcaggggaggggaccgcagccggcgcccgagggcaggaggaguccgcaggcgggccccuggcugcgguagcagcugccgguggcagggaggugccagcccgcgcgggguggcccagccgcgggagcgguggggcgggggccgcggccgccggccccagggagagaucgcgggcagcauggcggggcugcgggccagggggggcccggggccggggcugcuggcgcucuccgcgcucggcuucugccucaugcugcaagucagcgcuaagaggccccccaagacgccccccugcccgcccagcugcucuugcaccagggacaccgccuucugcguggacucaaaggcggugcccaggaaccugcccucggaggucaucucccugugaguguccagcccuggccuuggggguuggggagggagaggaggccgaggacagcucugggagaggacaggagaacccccgcucccccucuucagagugcggggaccagggggacugcagggguccucagggcuggagauuccaggcaccagucgggcagggaguucugcaguuuugcaggcucagcggccauggguggggaaagcaggaguucaccaccaagaaugaaucaucaucaccacgagcgacagugagaccuacugugugcugugcuccagacuuggggggguugcuuacacgagcaugugggccccugccugugaugucacaccaagggcaggagaguggcggccagagcaggaugagaaugagcuaugcccucccagcacccuggcauggggcacaugcccgccacugaccagccacuuggcacucagcucggccagccugucacucacaacagccagccucaggggcucccccuugucugugggaccagagagguugugagguccuuggggaccaggaugccagcccccacccccaugccccaucucucaacagcacccagcccauuguggguguuuggaugaugaugacaacggugugggugauggaaccuuuucuugccugagagggaagcugagccuggggccaugggugccccaagaggcaauaggggaggacccuggugaaggcaggcagugaauuugggaggagaagggaaagacacacagaugggggcuaaauuaggugaaauggggcauuuccagggcaagugaguacaaaagcuacugcccuccguguucaccucucccugccucagcacagcccuugcagaccccacaguacugacucggguguccccgcaggacccuggugaaugccgccuucucagagauccaggauggagcguucucccaccucccgcugcugcaguucuuguauggauagggccuuguggaaggguugggggaacuauggggugguagcaggggacaaauccugggcuggggagagggagaguggacagaggcagccucugcagacgaagaugcaggugucccuugcuuuuguucugauaggauguacccaaaagacggggcagccuugagucaggggagucggggcagcaggaggacagcuagggauggcacagagaagccaagcaagugggaugcggggaugggcuuggcugcucuggaaaccccagagaauugggugcgauagccugggcuagugcccaaggugggcacuguggggccaucuuagagacaggugaucccaggaaucagaguucccagaaagagcugggggcugaaagaaagggauggcaggagugucuccaacccuacaagaugccguccaugagggacaguuguccaugaggggcuggaaugggacagaaugagggugggggagagggagaggagaugccacccgggaggaccaggagcuggcuugacaagagagcucugccuuggcccauguuuaggauccaacagggacccugggagcuucuggggccagaacaggcuccugccuggccuuguugcccagguggcccagggauuccccaugggguccccagggguagcagcagggcagucaugucuuggggaagcccagggcugaggcagcgggcugggggcuggggcagcaggcacacccuuggaagcucuaauuccaccuuugucucugcagguuacucaacuccaacaaguuuacacugauuggagacaacgccuucacaggacugucgcaccugcaguaucugugugugggagggaaaggggcaa

SEQ ID NO: 20088 - RNA, 2832 nt, Homo sapiens
uugccccuuucccucccacacacagauacugcaggugcgacaguccugugaaggcguugucuccaaucaguguaaacuuguuggaguugaguaaccugcagagacaaagguggaauuagagcuuccaagggugugccugcugccccagcccccagcccgcugccucagcccugggcuuccccaagacaugacugcccugcugcuaccccuggggaccccauggggaaucccugggccaccugggcaacaaggccaggcaggagccuguucuggccccagaagcucccagggucccuguuggauccuaaacaugggccaaggcagagcucucuugucaagccagcuccugguccucccggguggcaucuccucucccucucccccacccucauucugucccauuccagccccucauggacaacugucccucauggacggcaucuuguaggguuggagacacuccugccaucccuuucuuucagcccccagcucuuucugggaacucugauuccugggaucaccugucucuaagauggccccacagugcccaccuugggcacuagcccaggcuaucgcacccaauucucugggguuuccagagcagccaagcccauccccgcaucccacuugcuuggcuucucugugccaucccuagcuguccuccugcugccccgacuccccugacucaaggcugccccgucuuuuggguacauccuaucagaacaaaagcaagggacaccugcaucuucgucugcagaggcugccucuguccacucucccucuccccagcccaggauuuguccccugcuaccaccccauaguucccccaacccuuccacaaggcccuauccauacaagaacugcagcagcgggaggugggagaacgcuccauccuggaucucugagaaggcggcauucaccaggguccugcggggacacccgagucaguacuguggggucugcaagggcugugcugaggcagggagaggugaacacggagggcaguagcuuuuguacucacuugcccuggaaaugccccauuucaccuaauuuagcccccaucugugugucuuucccuucuccucccaaauucacugccugccuucaccaggguccuccccuauugccucuuggggcacccauggccccaggcucagcuucccucucaggcaagaaaagguuccaucacccacaccguugucaucaucauccaaacacccacaaugggcugggugcuguugagagauggggcaugggggugggggcuggcauccugguccccaaggaccucacaaccucucuggucccacagacaagggggagccccugaggcuggcuguugugagugacaggcuggccgagcugagugccaaguggcuggucaguggcgggcaugugccccaugccagggugcugggagggcauagcucauucucauccugcucuggccgccacucuccugcccuuggugugacaucacaggcaggggcccacaugcucguguaagcaacccccccaagucuggagcacagcacacaguaggucucacugucgcucguggugaugaugauucauucuugguggugaacuccugcuuuccccacccauggccgcugagccugcaaaacugcagaacucccugcccgacuggugccuggaaucuccagcccugaggaccccugcagucccccugguccccgcacucugaagagggggagcggggguucuccuguccucucccagagcuguccucggccuccucucccuccccaacccccaaggccagggcuggacacucacagggagaugaccuccgagggcagguuccugggcaccgccuuugaguccacgcagaaggcggugucccuggugcaagagcagcugggcgggcaggggggcgucuuggggggccucuuagcgcugacuugcagcaugaggcagaagccgagcgcggagagcgccagcagccccggccccgggcccccccuggcccgcagccccgccaugcugcccgcgaucucucccuggggccggcggccgcggcccccgccccaccgcucccgcggcugggccaccccgcgcgggcuggcaccucccugccaccggcagcugcuaccgcagccaggggcccgccugcggacuccuccugcccucgggcgccggcugcgguccccuccccugcucgcucccgcgauccggcucgggagagaagagcggagcgcggagcuggagccgcagccggggcugaccgcgccggguggcugcggacugcggcgcgggcggcgggggcgcgcgcggggcggcgcggggccugggagucacggaaggggaggcguggccgcugugugcucuaccgggcggucucuggggccauccgcguguggggcugcgcgugagugcaugcgugugagcuugugcuugugccucugcugggcacgacugugcgcgccggugcucaccugucucugcacgggcacaugcacucacugccuuguggaggcgcuucggcguuagggaucccugugcuucugucuaccuggguuucuuugcauggggggacacauccccuaggcagcaucaugggcaugucgugagugacagacgcauaucuaaguuagcaugcaagauuagaagcacaagggcguccuggaggagucugaagugcgcuucuaaccggauucacauguuuuuccacgcgccgcugaacagaauguaccuuugugucagcaugagcugaaaagggaaacgcagccucuggagcuggagugggacuguguggaauucuggaacauuucucacgcucaaccacagccuguuaaagcugggaagcgc

SEQ ID NO: 20089 - RNA, 2370 nt, Homo sapiens
ccuguaacccaucuaaggauuaaaggcugaagaauaacacagaagaguuuaaaauugacuuugcccuuugaaaaacaauaagcaauucuggauuugaaaccaacaaucauguaauauuaaaaaggcaccuaauuugcuguuugagguaccuguaauccucccaggacaugugaguuccuggaaaaagcugucucuuuuguuguuuuuguuguuguugcuguuguugacaaaguuguucaggacaaagagacccugggguagucuccauugugagaaagaucaccaggaaccaccuucaugcccaugugcucucuggcucccccuccagccugguggaggaccuggcugaaaaauacuugaacucagcagugccaaagauuuucauaacugcaugcaauggagcaacaagucugagagcuaagggccagaagacaaugcaagcaguuauuucauaaaucccaagaacagcaguuugggcuuaugaaaccuuuccugguuucaugaauauuuccguucugcgcccucccauguccccacugugcccccucauuccacuggcacuuguuccacaucugcaaaguuacagcugagaggggagaggcacggaaaggagaagaggagggaaacugcggaaaggccuggugcagguccagggaguccugucuggcugagucgggacaagcugcuuaaacucgccugccuggugacacacccgugggcggcaagugaaccaaccugcccuccagcgaccuuucccgugauuaucgucaggggccccgccaccacucggccuacugcguugagcuucaggaaaccauuccucaguuuacugauaagaaaacugaggccgcagccuucgcggggcagguccugggagcugggagaucccggcgccauccuagcgggggccgcacuuacucuccgagucgcugaagccgcugcugucgcugacacuggcgcugcugcgccgcuucaugcgcuccaggugcuccucguaguggaaguggcgcucguggaagggcgacgcgaagucggccagcaccgcgucaaacucgcacagcgcguccgacagguccuccgcggccgccgaguccagggccggggcugcgggcagggccaggggcucagugcacggaagucaggggggcagcgggaccaccucccagggccaggaggggccgccacgguucccgaagauaacugacacuuggcgccucugccaagugacagccacgcagucgcuguuaccuuguaaucuucuccaccacccccgaagugcguucuauuaccaaguccguuuuacagacaagaaaacugagccuucgccaggcccagggucacccagcgacuuggcgcggccagauuccuccccaggcgcugccgguuaccuguccccgccgcuccccccaaccccgggcgcgcgcggagcuggugguggagggaaggugggacaugggggccagcccgggccggaaaggaggcugcagccgcccgcgcgggaagaccggggacagguucccgccggggaggauggaaggguggggggugugaagggacgacacggggccccuccuuucucacccgccaucugcagagccgagacuuuaaggggaccccggaccccgcacucaccugcggccgcggcggccgcggggcugcccugcgccgcgggcggcuucaugaggcggcucagcugggcccggcgcgcguggccuuggguccugcgagguggcagccggggcuauucgggggcuugcugucccgcacacuucagcccugccagucccuucggcgcugcgcuccagccgcgccgcucccagcacgguccgcgcccgcccuaccaccggcucggguuccuagaucuuauagccuucggcggccggagcggaggcggggccggggcggggcugcggagccggggcgacgggucuguccccgccgcccuccgaggaggccccugcccccaggcaccgcccucgccacgcgcccgcccuggaaccgcggugacgaggagucgccgaagccccgguuacagccccaaauauuuacccgccucucgcccccgcgcccugacaacccggcccacgcgguguccucggcgucaccagagcugacugcugggcgcgagcucugcugcuucccgccgcgugccaggcaccuccgcgagccgcagcuuccucggcugugaaguggacgugggcaugcagagccucccuggcuggcggugagggacgaaggagcccgcggccgugucccagucgggugucggggacgcggagguccccuacgcauugucccaaggggacuuccgagauggugggcgggcggaguggagagggucggggcgagaggggcaggaguugggggagu

SEQ ID NO: 20090 - RNA, 2370 nt, Homo sapiens
acucccccaacuccugccccucucgccccgacccucuccacuccgcccgcccaccaucucggaaguccccuugggacaaugcguaggggaccuccgcguccccgacacccgacugggacacggccgcgggcuccuucgucccucaccgccagccagggaggcucugcaugcccacguccacuucacagccgaggaagcugcggcucgcggaggugccuggcacgcggcgggaagcagcagagcucgcgcccagcagucagcucuggugacgccgaggacaccgcgugggccggguugucagggcgcgggggcgagaggcggguaaauauuuggggcuguaaccggggcuucggcgacuccucgucaccgcgguuccagggcgggcgcguggcgagggcggugccugggggcaggggccuccucggagggcggcggggacagacccgucgccccggcuccgcagccccgccccggccccgccuccgcuccggccgccgaaggcuauaagaucuaggaacccgagccggugguagggcgggcgcggaccgugcugggagcggcgcggcuggagcgcagcgccgaagggacuggcagggcugaagugugcgggacagcaagcccccgaauagccccggcugccaccucgcaggacccaaggccacgcgcgccgggcccagcugagccgccucaugaagccgcccgcggcgcagggcagccccgcggccgccgcggccgcaggugagugcgggguccgggguccccuuaaagucucggcucugcagauggcgggugagaaaggaggggccccgugucgucccuucacaccccccacccuuccauccuccccggcgggaaccuguccccggucuucccgcgcgggcggcugcagccuccuuuccggcccgggcuggcccccaugucccaccuucccuccaccaccagcuccgcgcgcgcccgggguuggggggagcggcggggacagguaaccggcagcgccuggggaggaaucuggccgcgccaagucgcugggugacccugggccuggcgaaggcucaguuuucuugucuguaaaacggacuugguaauagaacgcacuucgggggugguggagaagauuacaagguaacagcgacugcguggcugucacuuggcagaggcgccaagugucaguuaucuucgggaaccguggcggccccuccuggcccugggagguggucccgcugccccccugacuuccgugcacugagccccuggcccugcccgcagccccggcccuggacucggcggccgcggaggaccugucggacgcgcugugcgaguuugacgcggugcuggccgacuucgcgucgcccuuccacgagcgccacuuccacuacgaggagcaccuggagcgcaugaagcggcgcagcagcgccagugucagcgacagcagcggcuucagcgacucggagaguaagugcggcccccgcuaggauggcgccgggaucucccagcucccaggaccugccccgcgaaggcugcggccucaguuuucuuaucaguaaacugaggaaugguuuccugaagcucaacgcaguaggccgagugguggcggggccccugacgauaaucacgggaaaggucgcuggagggcagguugguucacuugccgcccacgggugugucaccaggcaggcgaguuuaagcagcuugucccgacucagccagacaggacucccuggaccugcaccaggccuuuccgcaguuucccuccucuucuccuuuccgugccucuccccucucagcuguaacuuugcagauguggaacaagugccaguggaaugagggggcacaguggggacaugggagggcgcagaacggaaauauucaugaaaccaggaaagguuucauaagcccaaacugcuguucuugggauuuaugaaauaacugcuugcauugucuucuggcccuuagcucucagacuuguugcuccauugcaugcaguuaugaaaaucuuuggcacugcugaguucaaguauuuuucagccagguccuccaccaggcuggagggggagccagagagcacaugggcaugaaggugguuccuggugaucuuucucacaauggagacuaccccagggucucuuuguccugaacaacuuugucaacaacagcaacaacaacaaaaacaacaaaagagacagcuuuuuccaggaacucacauguccugggaggauuacagguaccucaaacagcaaauuaggugccuuuuuaauauuacaugauuguugguuucaaauccagaauugcuuauuguuuuucaaagggcaaagucaauuuuaaacucuucuguguuauucuucagccuuuaauccuuagauggguuacagg

SEQ ID NO: 20091 - RNA, 2538 nt, Homo sapiens
acuggcgcauggucguucugguccagcacgcgcacuugcacuagggcgcugcuggaaagcugaggggagccgccgucgcuagcuuggaugcgaacgucgaguuggcgcagcgucucauagucgaagcugcgcagcgcguagauggcuccgguagcuggguccaccgagacauaaguggacacggcgcccccggcgcggcccaccucggccuccagcagccgguaggugaccuggccguugcggcccaggucccggucgcgggcggccaccguggccagguaggcgccuggcggguuguucucgcgcaccgacaccucauagaccggccgcgugaagagcggcgcguugucguucucgucgcccacacgcaccguguagggccgcacugugcgcagcgggggcgcgccgcgauccucggccaccagcgucaaguuguacucggcgaugcguucgcgguccagcgacgccgcggucaccaccagguagcugcccgcguaggccggcugcagccggaagugcucgugcccauagagggcgcagcgcacuugcccguuggcgcccgagucccuguccgaggugcugaccagggccaccaggcucucgcgcgccgcccccuccggcaccagcgaaguggcaccagccuccggcgucccggcucccgccggcgagcuagcguccgcucccccgagugcagcggcggcggcggcagcggcgaagggugagguugccggcgcgccuggggcggccagcggggugauggcgaugucgggugcguugucauugacgucucggaugcgcacgaugaccuugcagguggcagcgcggggcccggguccgcgguccugcgcccgcacguccagcucguagguguccugacgcucguaguccacgggcccggccagggugaggcggccugaucgcgggucaagccgaaagaggcggcgcgccuccggcggggugcgggcgccaaaugcgaacaccacgucgccguuaggucccucgucggggucggcugcguccaggucgagaagcagggagcccacgggcgcgucuuccgccagcuccacuucggccacggcgcccugcgggaaggccgggcuguggucauucgcauccaggacgcgcacgcugagggcagccguggcggagcgcggcgggcggccgccguccugggccaccagcuccaggcuguaggcggccuggcucucgcgguccagcuccugcagcagcaccaggucugcgcacugagcgccguccgcucgcgucugcagcuccacgcgaaaggggcugugcggcucggccaggcgcacggucugcagcccguuggcgcccacguccucguccaccggcaccuccaaggggaugcgcgugcccacugccgcacccucggacaccucuaccgggaucugggcccuggggaagcgcggcgcguggucguugacgucccucaccucuaccuccacgugcaccagccggaacugcuccugcgagaagcugaccacaucgaaggccagcacgcacugcggggccuggccacacagccgcucgcgguccaggccggcguccccgacggucagcugcccgucgccuucgcgcacccggagcagagagcuguugaauugcuucaucaggcggaagcuugugucacccgauacuuucauaugcagguccucggccagggucccgaugaccgugccgggggcauccuccucgaaggugcuguaucggacuguuuugcucugggccacugagagcacccagcagaggcugaagagcugcaaggggaaaaggcaggggcugccccaacgccucacaggacucaugccuccagccucaagugcgauccgaaaggcuaaggaagucuucucugguuuccaggucgggcgucagucucaggcucucggaaucacgcucuuugcgagcccugugcgggagaagucugcggguagcagcuccgagccuccagcgggcucugaggacgcgcggacccgcccucacucugcgccucuccgucucuuacagaagcugcgccgccucgcgccgccuuugccuuuauagccgccgauaugcuaaucacccgagccggguagccaauggccgccucccccucgcgucgccccuccgccugccucugacaaucccuuuaauguggaaaggcuuagaggggaaaacaagaaaggaaaauuagggaaucuuucuuuuguuuaacuccuuuugcuuuuucccccuuuucuugucagcacccugcauguagaggaguuggcacagggcuccaggaguaaaaggagcggaugguuuuguuaauugucgccugccucccuccgugccgcggcuagaacuaagugcgaacacgcugggguuucaccccaguggcuccugauuccgccuucccccagccccugccaacacacacacucugcauuuugcaccucugacgcuuccaaacccuugcagcccccuacccacagacuugcucugcugaaugaggcucugcuuuccuucucuccuagcuacggugccuggaauagccucucgauu

SEQ ID NO: 20092 - RNA, 2538 nt, Homo sapiens
aaucgagaggcuauuccaggcaccguagcuaggagagaaggaaagcagagccucauucagcagagcaagucuguggguagggggcugcaaggguuuggaagcgucagaggugcaaaaugcagaguguguguguuggcaggggcugggggaaggcggaaucaggagccacuggggugaaaccccagcguguucgcacuuaguucuagccgcggcacggagggaggcaggcgacaauuaacaaaaccauccgcuccuuuuacuccuggagcccugugccaacuccucuacaugcagggugcugacaagaaaagggggaaaaagcaaaaggaguuaaacaaaagaaagauucccuaauuuuccuuucuuguuuuccccucuaagccuuuccacauuaaagggauugucagaggcaggcggaggggcgacgcgagggggaggcggccauuggcuacccggcucgggugauuagcauaucggcggcuauaaaggcaaaggcggcgcgaggcggcgcagcuucuguaagagacggagaggcgcagagugagggcggguccgcgcguccucagagcccgcuggaggcucggagcugcuacccgcagacuucucccgcacagggcucgcaaagagcgugauuccgagagccugagacugacgcccgaccuggaaaccagagaagacuuccuuagccuuucggaucgcacuugaggcuggaggcaugaguccugugaggcguuggggcagccccugccuuuuccccuugcagcucuucagccucugcugggugcucucaguggcccagagcaaaacaguccgauacagcaccuucgaggaggaugcccccggcacggucaucgggacccuggccgaggaccugcauaugaaaguaucgggugacacaagcuuccgccugaugaagcaauucaacagcucucugcuccgggugcgcgaaggcgacgggcagcugaccgucggggacgccggccuggaccgcgagcggcuguguggccaggccccgcagugcgugcuggccuucgauguggucagcuucucgcaggagcaguuccggcuggugcacguggagguagaggugagggacgucaacgaccacgcgccgcgcuuccccagggcccagaucccgguagagguguccgagggugcggcagugggcacgcgcauccccuuggaggugccgguggacgaggacgugggcgccaacgggcugcagaccgugcgccuggccgagccgcacagccccuuucgcguggagcugcagacgcgagcggacggcgcucagugcgcagaccuggugcugcugcaggagcuggaccgcgagagccaggccgccuacagccuggagcugguggcccaggacggcggccgcccgccgcgcuccgccacggcugcccucagcgugcgcguccuggaugcgaaugaccacagcccggccuucccgcagggcgccguggccgaaguggagcuggcggaagacgcgcccgugggcucccugcuucucgaccuggacgcagccgaccccgacgagggaccuaacggcgacgugguguucgcauuuggcgcccgcaccccgccggaggcgcgccgccucuuucggcuugacccgcgaucaggccgccucacccuggccgggcccguggacuacgagcgucaggacaccuacgagcuggacgugcgggcgcaggaccgcggacccgggccccgcgcugccaccugcaaggucaucgugcgcauccgagacgucaaugacaacgcacccgacaucgccaucaccccgcuggccgccccaggcgcgccggcaaccucacccuucgccgcugccgccgccgccgcugcacucgggggagcggacgcuagcucgccggcgggagccgggacgccggaggcuggugccacuucgcuggugccggagggggcggcgcgcgagagccugguggcccuggucagcaccucggacagggacucgggcgccaacgggcaagugcgcugcgcccucuaugggcacgagcacuuccggcugcagccggccuacgcgggcagcuaccugguggugaccgcggcgucgcuggaccgcgaacgcaucgccgaguacaacuugacgcugguggccgaggaucgcggcgcgcccccgcugcgcacagugcggcccuacacggugcgugugggcgacgagaacgacaacgcgccgcucuucacgcggccggucuaugaggugucggugcgcgagaacaacccgccaggcgccuaccuggccacgguggccgcccgcgaccgggaccugggccgcaacggccaggucaccuaccggcugcuggaggccgaggugggccgcgccgggggcgccguguccacuuaugucucgguggacccagcuaccggagccaucuacgcgcugcgcagcuucgacuaugagacgcugcgccaacucgacguucgcauccaagcuagcgacggcggcuccccucagcuuuccagcagcgcccuagugcaagugcgcgugcuggaccagaacgaccaugcgccagu

SEQ ID NO: 20093 - RNA, 2593 nt, Homo sapiens
ugccaggugaccuccuacggcgcuuggagaccugagcagccuugcacucuuaggcggcagcguccuuucucccucuugccaguaacugcugccaugucaaccaguggaaucaagggcuucuggcgagcagcagcugaaaagggcgccucugcaggcaggcggaucacuuucuauaaguuuaagcuacaggcugagaccuuuuauucuguacgagaaaggauccuuuacugucccacgcacuagauucuucuacuuuacguguaacuuuucaaaacuuuauuaguuuaguuacugaacugccuccaugggguccuaauuccaggcucagaaucuuccauccagccuucuaaaacucuaccuucaaaagaggucaaaaagacuguguaaugaccuuguaaaacacuaaccccagacaguggaaccaauccugaucucuuaaacccccagugagucauaagagcuugagaagauuucaaggaaaucuuccgcacauuggacacgguccaaucagguucugaacaauucaaucaucccccggucuguggccacacucccccaauagauccaaacugaaguaccaucugggggaggggugguuugaggcagggaguagagaaagcauggagugguaggugggggugggguggggguuccucuggguucucucgguucaggagguccaaagaagacgaagcagcccagaggauuugcggcugcagguucuguaguggagggaaggugggcggacaggucucacccagcuacuacuggagggggagaaugggagggcagcagccaggggacaaaggugggacaagaggcucuguaaucaucucucgggcaggagaaggacugggcgcuggaguggcgagggggucuggggagcucacucccugcagaagacguacucgguguagcugguccagaucuuguccucgcucuggucggugcugcuggcaaaggcgcaggugcccguggagcugcacgccaccauguggaagcccgacucggacagcuugucgaaggccugcuccaggaaguugaacuugagguaauagcgcgagguguagcgcuccgggggacggucggggucccggcuuucguucaggguguccccaaacaccuccuuggccagcgacgucuuuccgcaaacggugaugcgcgccacucgccggaacuuggcguccgccugcgcgucccgcccgaugguguaggagccgcgguagccgauggugauguagcccgagcgccggcugccguccagcgacugggacggcgugagcagcgggcccgccgcgcccccggacggacugcggcuagccagcuccagcgugggcgacggcgccccggcagaggcgcccuccugcuguucgggcuccgaguagccaagcggcagcagcucgucacccagcgagcccuccuugugcaccccgcgccgcgagggcggcggccccgggccgggcugcuggggcgccccgaggcggcgcacgagcucuggcagcucgaaguacucggccucgcgcugcagccggcugcgcucggggaaguagucgggcagcacgagcugcaagucccgcagguaauccaggauguagcggaagaggaagccgucccgguccagaaagaagcggccuuugcugucccgggccagcuccugcggcugcugcugcgugaacaugcgccagagcagcgagucgggcaccgacaccaccgugcagcgccgggucacguacaccuggccccccacguucagcuccacgaugucggggaagagcgguggcuccgcggaggacgacgaggagccacugccgcccccgccgccgcccccguuggguaauccacgugugcuguccgccagagccaugacagagagguggccgggccgggacaguggcaggaagccgcgcugcacucaggagcugcaaccgccuuccccggagccccggaacccggacgcucgcucagcccugcgccccgccgccgccgccgccgccaccgccgccaccgccaccgccgccaccuccuagagccgcgcggagccgagcggugcgagcgcgccgcugugcgcccccuugaguuccagugcgcuccgcccgccuugcccgcgcgcuccaggcgagugccgggucgcggcccgcgcgcugcuuaaguagagccgccugcucuggugccguggcgcgcaggaggcgugggcggcggcggagccucgcuuaccgggcgaggggagguggggagcggggacucgauuugcaucuuaaacgcggacgccacgcggggcugcuggcuccaccccggcucgcgagcgcugggggcgcccggacucccacccgcuccccacccaccagccccgccccguggucccgcccaacuuucucccucuuccgaagaggacccgcccgagacuuggcggcuucggaagacagcuccuuggagggacagucaccgcgcccccuccccucucgccccagcccgcacccaaggacucuggaaggaggacgugaacuuucggaagccugucgccccgggaguggaaaugcguggccgccuccggcccucccgccugcggaacugggcgcuuccagcagugcagcug

SEQ ID NO: 20094 - RNA, 2593 nt, Homo sapiens
cagcugcacugcuggaagcgcccaguuccgcaggcgggagggccggaggcggccacgcauuuccacucccggggcgacaggcuuccgaaaguucacguccuccuuccagaguccuugggugcgggcuggggcgagaggggagggggcgcggugacugucccuccaaggagcugucuuccgaagccgccaagucucgggcggguccucuucggaagagggagaaaguugggcgggaccacggggcggggcugguggguggggagcgggugggaguccgggcgcccccagcgcucgcgagccgggguggagccagcagccccgcguggcguccgcguuuaagaugcaaaucgaguccccgcuccccaccuccccucgcccgguaagcgaggcuccgccgccgcccacgccuccugcgcgccacggcaccagagcaggcggcucuacuuaagcagcgcgcgggccgcgacccggcacucgccuggagcgcgcgggcaaggcgggcggagcgcacuggaacucaagggggcgcacagcggcgcgcucgcaccgcucggcuccgcgcggcucuaggagguggcggcgguggcgguggcggcgguggcggcggcggcggcggcggggcgcagggcugagcgagcguccggguuccggggcuccggggaaggcgguugcagcuccugagugcagcgcggcuuccugccacugucccggcccggccaccucucugucauggcucuggcggacagcacacguggauuacccaacgggggcggcggcgggggcggcaguggcuccucgucguccuccgcggagccaccgcucuuccccgacaucguggagcugaacguggggggccagguguacgugacccggcgcugcacgguggugucggugcccgacucgcugcucuggcgcauguucacgcagcagcagccgcaggagcuggcccgggacagcaaaggccgcuucuuucuggaccgggacggcuuccucuuccgcuacauccuggauuaccugcgggacuugcagcucgugcugcccgacuacuuccccgagcgcagccggcugcagcgcgaggccgaguacuucgagcugccagagcucgugcgccgccucggggcgccccagcagcccggcccggggccgccgcccucgcggcgcggggugcacaaggagggcucgcugggugacgagcugcugccgcuuggcuacucggagcccgaacagcaggagggcgccucugccggggcgccgucgcccacgcuggagcuggcuagccgcaguccguccgggggcgcggcgggcccgcugcucacgccgucccagucgcuggacggcagccggcgcucgggcuacaucaccaucggcuaccgcggcuccuacaccaucgggcgggacgcgcaggcggacgccaaguuccggcgaguggcgcgcaucaccguuugcggaaagacgucgcuggccaaggagguguuuggggacacccugaacgaaagccgggaccccgaccgucccccggagcgcuacaccucgcgcuauuaccucaaguucaacuuccuggagcaggccuucgacaagcuguccgagucgggcuuccacaugguggcgugcagcuccacgggcaccugcgccuuugccagcagcaccgaccagagcgaggacaagaucuggaccagcuacaccgaguacgucuucugcagggagugagcuccccagacccccucgccacuccagcgcccaguccuucuccugcccgagagaugauuacagagccucuugucccaccuuuguccccuggcugcugcccucccauucucccccuccaguaguagcugggugagaccuguccgcccaccuucccuccacuacagaaccugcagccgcaaauccucugggcugcuucgucuucuuuggaccuccugaaccgagagaacccagaggaacccccaccccacccccaccuaccacuccaugcuuucucuacucccugccucaaaccaccccucccccagaugguacuucaguuuggaucuauugggggaguguggccacagaccgggggaugauugaauuguucagaaccugauuggaccguguccaaugugcggaagauuuccuugaaaucuucucaagcucuuaugacucacuggggguuuaagagaucaggauugguuccacugucugggguuaguguuuuacaaggucauuacacagucuuuuugaccucuuuugaagguagaguuuuagaaggcuggauggaagauucugagccuggaauuaggaccccauggaggcaguucaguaacuaaacuaauaaaguuuugaaaaguuacacguaaaguagaagaaucuagugcgugggacaguaaaggauccuuucucguacagaauaaaaggucucagccuguagcuuaaacuuauagaaagugauccgccugccugcagaggcgcccuuuucagcugcugcucgccagaagcccuugauuccacugguugacauggcagcaguuacuggcaagagggagaaaggacgcugccgccuaagagugcaaggcugcucaggucuccaagcgccguaggaggucaccuggca

SEQ ID NO: 20095 - RNA, 2591 nt, Homo sapiens
auaacacauuuuccaagccucaauguuuucacugacauauacacauuuacaaucuuaaggugaacucagccauaagggaaaauaggagcagugccuuuuuccuuuuuuguaaacugugucagaaauccaagcgaguggacucagggagacuucuaguaguuuguuguuguuguuuguuuaggaagaaaauccaauugacaacuuucaucucacaaauauuucuuguuugcguuucuugcccuugagaaagagcucuugcucugauuugcaaauggcgugauaaacaaaagaaaccgugaucaucucacacaaaaggccagauucgagccggucacuggucaagaauggaucugguugggaguucugcuugagagaacagagaucugcaaaguucaaauaguacaaacagggaggcgaggcugcucagagccaucccacucccagaaacgaaugacacaagcagcuuuucccgugugccagccauuucagaccucacauuugaacagcgugcaugcaacacggaccgggaggggguuggggguuggggggcugaggggcgaggaagaagaaugagaaacaaaaacaaaaccgaccaugaaacuuccaacaaaacuggaaaggccaacaugucaaaaaguuacuccuccaccuccgugggucaaaacgcaacagguuccgaagugcaaagcaaacgccaacugcugccgcacacaaccgccugcuuucgaguuggcugccgaagugcgggucugaaaugauccugcgaauucacaggccugcucgcccgcgcccuugcgcgcuuggccacuccugccccgccuggccucucugccucuaccuggcaccuauacauucuauguacauacaaaccgggcccccggucgcgggagggcgcacggggaggccgcagcgcucguaccuauacauauguacacgugugcacaccgguccucgcgaggcggccccgcggggucauagcgcggcagcguaggccgcgggguagggguccagcuggggcuugcccaugcccggcagcaggauguaggcgagcggcggcugcagcccggggcugggccacgcgcugcaguugcacgggaucauguagcccggguugcccgggcuggggugcgagugcgugugccccccggcggcggcggccgccgcugcagccgccgccgccgcgccguggaaggcgcccgcgcccgcggucggguagcccagcgacgacgcguacgggaggccggacgaggacgacgagaucucugccauuuuggagcccaggucgagcagcgaguaggggcugcccgcggcggcggcggcggcggcagcggcggcggcagcggccgacugcgggaagaagacgcgugcggcggcagcggcggcggccgcggccgccuucucgggauuggcgagcagcgacucaggcaccaggccgccgcccgcccccgcgugcagcccggcgcccgccuugagcgcagggugcucggcguccgccacgccgcccaggccguagggcaccgggaaggcgaacuuguccuucuugagcagcgucuugggcuugcgccgcggccgguacuuguagucggggugcuccuucaugugcauggcgcguagacgcuuggccucgucgaugaacggccgcuucuccgacucugugagcaguuuccacucggcgcccaagcgcuugcugaucuccgaguugugcaucuugggguucuccugggccaucuugcgccgcugagcccgcgaccacaccaugaaggcguucaugggccgcuugacgugguccaccggcuuggacaugcucucgcccugccgcggcugcagcccgccgccucccgggcccucgcccucggcccggaggaaaucaauguuggcugcccgcggagacccgcucggccggccggggcucgucgcgccccggcgucgcucccgccccggaggagggggcugggggaccagcccagggccacgccgcgccccgggccgccuuagugucuccggccgagcgcucgagcagguugucucugggacacucuaacuucucggcggugcccccuccccgcggcggcaguuugcccuuuacguucuuuggguccuucgucugcaguggcguuugcuggugagcuccccgcagguagcggcggccgggcagagcgcuccuccuccucggucguucucucuuaaaugcaaagcguccccaaaaguugcgucgcggagacuccucgaaguugagccgaggagcccgccgccgcgugcugccaagugccaaagggggcucucagcggcuggaguguuuggguucuccucggugacuuucucauuugacagaagcagauggggguggggaaggcggggagguggcccuggaggaggaagaggagggggaggcggaggaguguccaggcgugccacgagaacgcagagcgcagcaauggauauaaauacaaauacagcagcaccagccugucuucuuggcuccgggcagggugcgccgaugggaaacccccaaucggcugggugauuuuuuuuuuuuggaggggggagcugucccccgcagcaccugccucucgagucuuccucucccgcug

SEQ ID NO: 20096 - RNA, 2591 nt, Homo sapiens
cagcgggagaggaagacucgagaggcaggugcugcgggggacagcuccccccuccaaaaaaaaaaaaucacccagccgauuggggguuucccaucggcgcacccugcccggagccaagaagacaggcuggugcugcuguauuuguauuuauauccauugcugcgcucugcguucucguggcacgccuggacacuccuccgccucccccuccucuuccuccuccagggccaccuccccgccuuccccacccccaucugcuucugucaaaugagaaagucaccgaggagaacccaaacacuccagccgcugagagcccccuuuggcacuuggcagcacgcggcggcgggcuccucggcucaacuucgaggagucuccgcgacgcaacuuuuggggacgcuuugcauuuaagagagaacgaccgaggaggaggagcgcucugcccggccgccgcuaccugcggggagcucaccagcaaacgccacugcagacgaaggacccaaagaacguaaagggcaaacugccgccgcggggagggggcaccgccgagaaguuagagugucccagagacaaccugcucgagcgcucggccggagacacuaaggcggcccggggcgcggcguggcccugggcuggucccccagcccccuccuccggggcgggagcgacgccggggcgcgacgagccccggccggccgagcgggucuccgcgggcagccaacauugauuuccuccgggccgagggcgagggcccgggaggcggcgggcugcagccgcggcagggcgagagcauguccaagccgguggaccacgucaagcggcccaugaacgccuucaugguguggucgcgggcucagcggcgcaagauggcccaggagaaccccaagaugcacaacucggagaucagcaagcgcuugggcgccgaguggaaacugcucacagagucggagaagcggccguucaucgacgaggccaagcgucuacgcgccaugcacaugaaggagcaccccgacuacaaguaccggccgcggcgcaagcccaagacgcugcucaagaaggacaaguucgccuucccggugcccuacggccugggcggcguggcggacgccgagcacccugcgcucaaggcgggcgccgggcugcacgcgggggcgggcggcggccuggugccugagucgcugcucgccaaucccgagaaggcggccgcggccgccgccgcugccgccgcacgcgucuucuucccgcagucggccgcugccgccgccgcugccgccgccgccgccgccgcgggcagccccuacucgcugcucgaccugggcuccaaaauggcagagaucucgucguccucguccggccucccguacgcgucgucgcugggcuacccgaccgcgggcgcgggcgccuuccacggcgcggcggcggcggcugcagcggcggccgccgccgccggggggcacacgcacucgcaccccagcccgggcaacccgggcuacaugaucccgugcaacugcagcgcguggcccagccccgggcugcagccgccgcucgccuacauccugcugccgggcaugggcaagccccagcuggaccccuaccccgcggccuacgcugccgcgcuaugaccccgcggggccgccucgcgaggaccggugugcacacguguacauauguauagguacgagcgcugcggccuccccgugcgcccucccgcgaccgggggcccgguuuguauguacauagaauguauaggugccagguagaggcagagaggccaggcggggcaggaguggccaagcgcgcaagggcgcgggcgagcaggccugugaauucgcaggaucauuucagacccgcacuucggcagccaacucgaaagcaggcgguugugugcggcagcaguuggcguuugcuuugcacuucggaaccuguugcguuuugacccacggagguggaggaguaacuuuuugacauguuggccuuuccaguuuuguuggaaguuucauggucgguuuuguuuuuguuucucauucuucuuccucgccccucagccccccaacccccaacccccucccgguccguguugcaugcacgcuguucaaaugugaggucugaaauggcuggcacacgggaaaagcugcuugugucauucguuucugggagugggauggcucugagcagccucgccucccuguuuguacuauuugaacuuugcagaucucuguucucucaagcagaacucccaaccagauccauucuugaccagugaccggcucgaaucuggccuuuugugugagaugaucacgguuucuuuuguuuaucacgccauuugcaaaucagagcaagagcucuuucucaagggcaagaaacgcaaacaagaaauauuugugagaugaaaguugucaauuggauuuucuuccuaaacaaacaacaacaacaaacuacuagaagucucccugaguccacucgcuuggauuucugacacaguuuacaaaaaaggaaaaaggcacugcuccuauuuucccuuauggcugaguucaccuuaagauuguaaauguguauaugucagugaaaacauugaggcuuggaaaauguguuau

SEQ ID NO: 20097 - RNA, 2444 nt, Homo sapiens
ggccgcggcuccgaacaauaaccgccgcgcgcggggcggcgcgaguagggccgcgggggagggagcugucgccgcagagcgccgcggagaggacgccuggacuccgccugccgccccggcgcccccgccgcggucagguggagccgcuggugcgcuggccccgggugccgagcgcggagcucgccucgguccucuccucgcccgucugccuggcgugcgcacggccgccgcgguugugacugcauucuaccggcgcugcucggugcggccgggcuccggguccgcugggcgugcgagugagugugugcgugcgcgcgcgggugcgcgcaggggugggggcugcggcgcggcgcucgccccccgguagccccccucuccucucggcuccccacaccucccuccggcucccuccucccgcccgcccuccccugcccugcccgcccgcccccgccgcagcuccuuuaauacacuuugguucuccgccuggcuuuggacucuucuccuccuccaccuccuccuccuccucccgcgccgccgccuccuccuccucuuccucuccgcgccuucgcuacgcgcccggccgcccgaggcagauccaggcggcggcggaggcggcgggcgcaggagagcggcucccagggcugaaguggccgccaccaccgccgccugcgccuggagcccgguggccgccggacgcaccgcgcggaucgggagcgggagucgaggcggcgcggaggcgcagggcucgcaggggcgggcgggcgcgcuggccaugcuccuggacgcggguccgcaguucccggccaucggggugggcagcuucgcgcgccaccaucaccacuccgccgcggcggcggcggcggcugccgccgagaugcaggaccgugaacugagccuggcggcggcgcagaacggcuucguugacuccgccgccgcgcacaugggagccuucaagcucaacccgggcgcgcacgagcuguccccgggccagagcucggcguucacgucgcagggccccggcgccuaccccggcuccgcugcggcugccgcugcggccgcagcgcucgggccccacgccgcgcacguuggcuccuacucugggccgcccuucaacuccacccgggacuuccuguuccgcagccgcggcuucggggacucggcgccgggcggcgggcagcacgggcuguucgggccgggcgcgggcggccugcaccacgcgcacucggacgcgcagggccaccuccucuucccgggccugccagagcagcacgggccgcacggcucgcagaaugugcucaacgggcagaugcgccucgggcugcccggcgagguguucgggcgcucggagcaauaccgccagguggccagcccgcggaccgaccccuacucggcggcgcaacuccacaaccaguacggccccaugaauaugaacauggguaugaacauggcagcagccgcggcccaccaccaccaccaccaccaccaccaccccggugccuuuuuccgcuauaugcggcagcagugcaucaagcaggagcuaaucugcaaguggaucgaccccgagcaacugagcaaucccaagaagagcugcaacaaaacuuucagcaccaugcacgagcuggugacacacgucucgguggagcacgucggcggcccggagcagagcaaccacgucugcuucugggaggaguguccgcgcgagggcaagcccuucaaggccaaauacaaacuggucaaccacauccgcgugcacacaggcgagaaacccuuccccugccccuucccgggcuguggcaaagucuucgcgcgcuccgagaaccucaagauccacaaaaggacccacacagguaaccgcgggcugggacagggaccaggcgcggaggggagacacgcacaggcugagacucaggcugugggugccgacgcugggcgcagaccgccagccggggaccugggaugggagguguuuuugcguguacgaaagagccagcagcuuguuucuguuggacgaugacaauauuauugggcuagguuuuuccaugugcggaaaucgaguuuugaaugauuagccucacaucaaauguaugcuugggucaugcaauugcuucguuugcucagccccgguuaauaauuuccguuuuaaguagaaagcacaaaauaaaacugcucgcuaauucggugcccgggaagcgagccuagagaggauuuugccagcuugucugaaugugcuuuucugcucggaguguaugucugucugagugguuuguguguuuucccacuucuuuuacucgggguccaaacgcccuucccgggacuguuucccaugaaaugagucuggugugagccgaagcuguaaugcguuucucauuuuuaaaguguuuuuaaagcccgucucggggugggucgcgggggcuuuacugugguuucgcagcaguuugugaaau

SEQ ID NO: 20098 - RNA, 2444 nt, Homo sapiens
auuucacaaacugcugcgaaaccacaguaaagcccccgcgacccaccccgagacgggcuuuaaaaacacuuuaaaaaugagaaacgcauuacagcuucggcucacaccagacucauuucaugggaaacagucccgggaagggcguuuggaccccgaguaaaagaagugggaaaacacacaaaccacucagacagacauacacuccgagcagaaaagcacauucagacaagcuggcaaaauccucucuaggcucgcuucccgggcaccgaauuagcgagcaguuuuauuuugugcuuucuacuuaaaacggaaauuauuaaccggggcugagcaaacgaagcaauugcaugacccaagcauacauuugaugugaggcuaaucauucaaaacucgauuuccgcacauggaaaaaccuagcccaauaauauugucaucguccaacagaaacaagcugcuggcucuuucguacacgcaaaaacaccucccaucccagguccccggcuggcggucugcgcccagcgucggcacccacagccugagucucagccugugcgugucuccccuccgcgccuggucccugucccagcccgcgguuaccuguguggguccuuuuguggaucuugagguucucggagcgcgcgaagacuuugccacagcccgggaaggggcaggggaaggguuucucgccugugugcacgcggaugugguugaccaguuuguauuuggccuugaagggcuugcccucgcgcggacacuccucccagaagcagacgugguugcucugcuccgggccgccgacgugcuccaccgagacgugugucaccagcucgugcauggugcugaaaguuuuguugcagcucuucuugggauugcucaguugcucggggucgauccacuugcagauuagcuccugcuugaugcacugcugccgcauauagcggaaaaaggcaccggggugguggugguggugguggugguggugggccgcggcugcugccauguucauacccauguucauauucauggggccguacugguuguggaguugcgccgccgaguaggggucgguccgcgggcuggccaccuggcgguauugcuccgagcgcccgaacaccucgccgggcagcccgaggcgcaucugcccguugagcacauucugcgagccgugcggcccgugcugcucuggcaggcccgggaagaggagguggcccugcgcguccgagugcgcguggugcaggccgcccgcgcccggcccgaacagcccgugcugcccgccgcccggcgccgaguccccgaagccgcggcugcggaacaggaagucccggguggaguugaagggcggcccagaguaggagccaacgugcgcggcguggggcccgagcgcugcggccgcagcggcagccgcagcggagccgggguaggcgccggggcccugcgacgugaacgccgagcucuggcccggggacagcucgugcgcgcccggguugagcuugaaggcucccaugugcgcggcggcggagucaacgaagccguucugcgccgccgccaggcucaguucacgguccugcaucucggcggcagccgccgccgccgccgcggcggaguggugaugguggcgcgcgaagcugcccaccccgauggccgggaacugcggacccgcguccaggagcauggccagcgcgcccgcccgccccugcgagcccugcgccuccgcgccgccucgacucccgcucccgauccgcgcggugcguccggcggccaccgggcuccaggcgcaggcggcggugguggcggccacuucagcccugggagccgcucuccugcgcccgccgccuccgccgccgccuggaucugccucgggcggccgggcgcguagcgaaggcgcggagaggaagaggaggaggaggcggcggcgcgggaggaggaggaggagguggaggaggagaagaguccaaagccaggcggagaaccaaaguguauuaaaggagcugcggcgggggcgggcgggcagggcaggggagggcgggcgggaggagggagccggagggagguguggggagccgagaggagaggggggcuaccggggggcgagcgccgcgccgcagcccccaccccugcgcgcacccgcgcgcgcacgcacacacucacucgcacgcccagcggacccggagcccggccgcaccgagcagcgccgguagaaugcagucacaaccgcggcggccgugcgcacgccaggcagacgggcgaggagaggaccgaggcgagcuccgcgcucggcacccggggccagcgcaccagcggcuccaccugaccgcggcgggggcgccggggcggcaggcggaguccaggcguccucuccgcggcgcucugcggcgacagcucccucccccgcggcccuacucgcgccgccccgcgcgcggcgguuauuguucggagccgcggcc

SEQ ID NO: 20099 - RNA, 2147 nt, Homo sapiens
aaagcucaagaaaugauucucagacacagcggaguuuggggacaucaagggcucugagugcauuuuaaagcagcccaggagagagacaaagcaagaccauaaugaaacaccccacccagucuuagaguuugagcuacagcacggugaucaugagcagacuccaaacccaaauccugauacugucaccugcuagcuguguaacccuagaaaaguuacaaaaccucuuugggccucaguuuccucaauaaaauauaauaaaaaacuaguacccgccucacccgugaagcuuaaaugagcuagcauaugucaagugcuuagaauaggggcugguucacaguaaguaugaaccauuauuauuugcagacaaggaaacuaagaggugauaaguaguuugacccauguuccaaagucaguuuuaaucuugggaauaaaaccuaaaaauuucuuucuccuccaucagaauuccuucuagcucaaacuaaguauccuacauucaauucuaucuucucugccuucauagacccuuccauuuacuucucuugaauaucuuguucccaaaguguuuucaaggcaggucuguuaccaagccacuccaucagcagcaccuagcacugugccucccgcagcaaggcaggcaggauggauggacggaugcaggcaugcauggguagguggaugaagggcagaugaagaacuaucgagaaaggaaucgcggugucagggguaaagcccuggccugcgagagccgggcucggauuucagugcccucacagcuagccauauggccuuggacaaguuacugaaccccuccgugccuagguuuccagaauguagagggccacuuccacucaaguggcuggagaagaagguaagcgccccggacggacgcuauugcagagucgcccggggauuccucucuccaccugugcuugagcuccucccgcuucuacgcuagggaccaggugggagagauacacggauucccagaaaaauggcucucucaggugggagucaaggguuacgagaggagagguaggggaagcaaugaacuccuccacacgauguguugggagagaggaaagagggauucaagugggaauuuuccacucaacaaacauuccaccaucauuugagaaaaaggcgcugggauggugaauuucaaacagucugagaaaugggcgacucggcacugugcggccuguaaggaaugaaucauuuaguuuucacccaccagguaggcaggccgggggcgaggacccuccgagcgccguccgagcgcaggugguagcccagccaagcaaacgcugggcagaggcggcaccgaggaggggaacgggcugcugcacucccggucgcguccagccgggaugggcugcgaaguugucggauucuuucccgcacagcacggggcucgcccgucggaaaagccaccgagggcggcgcagcggcagggcgcgagcagagcggggacgggcgggucggggguacucacgccgcgggcgaagggcuccacgagccgggccgaguccucggcggcgcguggggcgcgggugcgggcuccggggcggacgugcagaggcggcccgggccggggcuaugaaucagcugcggggcaagcgcggaggggcgggaguuacuggaaaaccgcgggggagggcagaggggugaggucuuuugcaauuucccgucuugcugcgcacucuuggcacuccugggacccacaggaauucccucccuucagucccggggggaggcggccgcgauccugggggaggcgcagccucacaacccggacuuugcgggcgggcgggcacuggugagaagaggaagugggagaggccugggaaggaaacuuggaaaccgaaaacucggcggccgaggcuccgugccccgcgcgcagcgcugcuccugccccggccaaggacgcacgggccagccggcggaaccagagguaagccgagugaccgaugaggccuggggcuguguaucccacaggggcacuugucaucccaacccagaggccaaacccgugagauccccguccgaaaaucuucaggcaagagaaguccuuuaacuaaauuuuggccguguuuccauuuggcguccagagcaacgaaaacguguuugaaccgaaucaaacggucccc

SEQ ID NO: 20100 - RNA, 2147 nt, Homo sapiens
ggggaccguuugauucgguucaaacacguuuucguugcucuggacgccaaauggaaacacggccaaaauuuaguuaaaggacuucucuugccugaagauuuucggacggggaucucacggguuuggccucuggguugggaugacaagugccccugugggauacacagccccaggccucaucggucacucggcuuaccucugguuccgccggcuggcccgugcguccuuggccggggcaggagcagcgcugcgcgcggggcacggagccucggccgccgaguuuucgguuuccaaguuuccuucccaggccucucccacuuccucuucucaccagugcccgcccgcccgcaaaguccggguugugaggcugcgccucccccaggaucgcggccgccuccccccgggacugaagggagggaauuccugugggucccaggagugccaagagugcgcagcaagacgggaaauugcaaaagaccucaccccucugcccucccccgcgguuuuccaguaacucccgccccuccgcgcuugccccgcagcugauucauagccccggcccgggccgccucugcacguccgccccggagcccgcacccgcgccccacgcgccgccgaggacucggcccggcucguggagcccuucgcccgcggcgugaguacccccgacccgcccguccccgcucugcucgcgcccugccgcugcgccgcccucgguggcuuuuccgacgggcgagccccgugcugugcgggaaagaauccgacaacuucgcagcccaucccggcuggacgcgaccgggagugcagcagcccguuccccuccucggugccgccucugcccagcguuugcuuggcugggcuaccaccugcgcucggacggcgcucggaggguccucgcccccggccugccuaccuggugggugaaaacuaaaugauucauuccuuacaggccgcacagugccgagucgcccauuucucagacuguuugaaauucaccaucccagcgccuuuuucucaaaugaugguggaauguuuguugaguggaaaauucccacuugaaucccucuuuccucucucccaacacaucguguggaggaguucauugcuuccccuaccucuccucucguaacccuugacucccaccugagagagccauuuuucugggaauccguguaucucucccaccuggucccuagcguagaagcgggaggagcucaagcacagguggagagaggaauccccgggcgacucugcaauagcguccguccggggcgcuuaccuucuucuccagccacuugaguggaaguggcccucuacauucuggaaaccuaggcacggagggguucaguaacuuguccaaggccauauggcuagcugugagggcacugaaauccgagcccggcucucgcaggccagggcuuuaccccugacaccgcgauuccuuucucgauaguucuucaucugcccuucauccaccuacccaugcaugccugcauccguccauccauccugccugccuugcugcgggaggcacagugcuaggugcugcugauggaguggcuugguaacagaccugccuugaaaacacuuugggaacaagauauucaagagaaguaaauggaagggucuaugaaggcagagaagauagaauugaauguaggauacuuaguuugagcuagaaggaauucugauggaggagaaagaaauuuuuagguuuuauucccaagauuaaaacugacuuuggaacaugggucaaacuacuuaucaccucuuaguuuccuugucugcaaauaauaaugguucauacuuacugugaaccagccccuauucuaagcacuugacauaugcuagcucauuuaagcuucacgggugaggcggguacuaguuuuuuauuauauuuuauugaggaaacugaggcccaaagagguuuuguaacuuuucuaggguuacacagcuagcaggugacaguaucaggauuuggguuuggagucugcucaugaucaccgugcuguagcucaaacucuaagacugggugggguguuucauuauggucuugcuuugucucucuccugggcugcuuuaaaaugcacucagagcccuugauguccccaaacuccgcugugucugagaaucauuucuugagcuuu

SEQ ID NO: 20101 - RNA, 2616 nt, Homo sapiens
cuguuuaaaauuggggaaagagugauuuaugcuggagaaugcagucuagaccugaauuauuuuacuuuacggugaagguaguuguauugaauguguuaagaugugcaaauuaagccggcgagcgaaccaaauaaaaauacuaaaugcccuuugggauucucuguggagucuuugagaggcagagaagcaguuguugaguuucuaaugguauaaggaaaaguggcaacgagaagaaaggggguggguauuguguuugugugugaguuuugaacugagucaccuacggcugcgucucuauaacagggaaaccucgagcaaaccugugccuuuaagacucaguugcuauccaaacagaaguaaacagaguggaccauuagcagacgccgggcgcggaggcggagccagggcgcugagggccccgcgcggcggcgggacgcccgcccgaaggggaggcggggccgcuacuaaagcccaagacucccggccuggggcagccuggggagggacgcgggcggggacggagcucggcgugcuugcugcuggagggugauggcccugcaaggcugugggcuccgaccucaccgggagucgacagcgagagguucgccgaagagcgagguucugggcgagcgcugaacgccggccccaagcaccccgggucuuuacacaguccgcguccacagacucugacgaagacguggaucugcucucgcuuuagcugcucgcgguccuccagaucauguccgcgacuccugcgacuccgcgcggaaaaaaaaguuugccaggcguggacucaaugaccuuuccaagcugugcgccucgcugccuggaccgggucugagcgcggcugcccagguugaccuuucugcgggaggugaguguucgcucugggaaggggcuguagcugcccuuuggaaggaaggguuuggggguguaagaggcguucagauucucggucuggugugccccaaauucagaugugaaaauagaucauggggaugcaaucccagggcacuguauuucucacuuccuugggucccuggcacgcgacucccagcuaacacccaaccacacacauuucuacauacuguuucuuaauuuuguuuugggauauuuaaucuaagcggucagcaagacuucuuauaaaagcuggucuacguacacugagaucaaaccccacaaucccaugguguuucugcuccugcccuagcaagccugggucgacuugucccggggcagccgcggcagcgcagcguggacgggcccggacacccggugccugcccagccagcgacgcugaaggcacauuucaagagggaaauaguucaguccucgguaauuugucaaccucgugcuggcuuuaaaauucuccucccaccuucuaguccugacugagggggcccaaaagcaaacuccccgggggcuuaaacgcucggauuccugagaaacggcaagugagaaaggaguugcaguuguacgaagaaggagcgaggaaaagguguuuguggagggagccccggaucugucuuccuaccuguuagccgagaacaaaagggggcuggcguuucccgaagcgaaagggcgcagacagccacuuucucugcuaaacaaacugcaguccugggcagaacaagaaaauuacucacgcagggggagcaaggggagcacagagaaacagaaccuagauuaugcggaaggcaucuuaauuuaauuaacuccuugggaaggcagaggcgcucugaaggggcaggaacuucgcagccguuucucuauucaccugauacagucuggcccuaacaaucuguccuuuaacaauuuuuuuucuuuuuaaugaucuucuuugaucuacuuagucuauagcucucuaauuuauauaaaauucugcugugguuugggcugaaauucagugagccuaccuauccgaccaucagucauuuaucucauauaccagugcacagguuuuagcagaugaacccugacuguauauuauuuuuagauaauucaguguaauauuaccauuaccaaagagcgaaacuccuuaucaaguuacuucuuaauuuuuuucuccaauguuuugaaagcuucacugaacugaaauaaguguguacacaucuuccuuggugacagccagucaaguaaauuuuacaaaauuucuccacaugccuggaaauuccugugaagaagacugaugaaagaaaaguagccucagcuccaccaacauauuuaugacuuuucauugguuuaaguuucuuuccuugcaagauuaaaaguaaccaguggucugaaacgggacgguggagaaaugacagcagaugaugaucgcuguuauuuccugaaagggagugugggaacuacaaggcucagcucuagacaaaacgaaaguacuuuaggaucucugcauucacuuaaaauacuucuuuugacauacauuuccagcaacucaaugggaguguggaaauuuaaccuuccuaauuauuuguggcaagagccauugguggauauuuaagguuguucuguuuguaaaaggguuucaaaaggaccaaugguuugcucuuccucuaugaagaaacuaucugcccuacaaauuaaaacaaacagguacuaugaaauagcacu

SEQ ID NO: 20102 - RNA, 2616 nt, Homo sapiens
agugcuauuucauaguaccuguuuguuuuaauuuguagggcagauaguuucuucauagaggaagagcaaaccauugguccuuuugaaacccuuuuacaaacagaacaaccuuaaauauccaccaauggcucuugccacaaauaauuaggaagguuaaauuuccacacucccauugaguugcuggaaauguaugucaaaagaaguauuuuaagugaaugcagagauccuaaaguacuuucguuuugucuagagcugagccuuguaguucccacacucccuuucaggaaauaacagcgaucaucaucugcugucauuucuccaccgucccguuucagaccacugguuacuuuuaaucuugcaaggaaagaaacuuaaaccaaugaaaagucauaaauauguugguggagcugaggcuacuuuucuuucaucagucuucuucacaggaauuuccaggcauguggagaaauuuuguaaaauuuacuugacuggcugucaccaaggaagauguguacacacuuauuucaguucagugaagcuuucaaaacauuggagaaaaaaauuaagaaguaacuugauaaggaguuucgcucuuugguaaugguaauauuacacugaauuaucuaaaaauaauauacagucaggguucaucugcuaaaaccugugcacugguauaugagauaaaugacugauggucggauagguaggcucacugaauuucagcccaaaccacagcagaauuuuauauaaauuagagagcuauagacuaaguagaucaaagaagaucauuaaaaagaaaaaaaauuguuaaaggacagauuguuagggccagacuguaucaggugaauagagaaacggcugcgaaguuccugccccuucagagcgccucugccuucccaaggaguuaauuaaauuaagaugccuuccgcauaaucuagguucuguuucucugugcuccccuugcucccccugcgugaguaauuuucuuguucugcccaggacugcaguuuguuuagcagagaaaguggcugucugcgcccuuucgcuucgggaaacgccagcccccuuuuguucucggcuaacagguaggaagacagauccggggcucccuccacaaacaccuuuuccucgcuccuucuucguacaacugcaacuccuuucucacuugccguuucucaggaauccgagcguuuaagcccccggggaguuugcuuuugggcccccucagucaggacuagaaggugggaggagaauuuuaaagccagcacgagguugacaaauuaccgaggacugaacuauuucccucuugaaaugugccuucagcgucgcuggcugggcaggcaccggguguccgggcccguccacgcugcgcugccgcggcugccccgggacaagucgacccaggcuugcuagggcaggagcagaaacaccaugggauugugggguuugaucucaguguacguagaccagcuuuuauaagaagucuugcugaccgcuuagauuaaauaucccaaaacaaaauuaagaaacaguauguagaaaugugugugguuggguguuagcugggagucgcgugccagggacccaaggaagugagaaauacagugcccugggauugcauccccaugaucuauuuucacaucugaauuuggggcacaccagaccgagaaucugaacgccucuuacacccccaaacccuuccuuccaaagggcagcuacagccccuucccagagcgaacacucaccucccgcagaaaggucaaccugggcagccgcgcucagacccgguccaggcagcgaggcgcacagcuuggaaaggucauugaguccacgccuggcaaacuuuuuuuuccgcgcggagucgcaggagucgcggacaugaucuggaggaccgcgagcagcuaaagcgagagcagauccacgucuucgucagagucuguggacgcggacuguguaaagacccggggugcuuggggccggcguucagcgcucgcccagaaccucgcucuucggcgaaccucucgcugucgacucccggugaggucggagcccacagccuugcagggccaucacccuccagcagcaagcacgccgagcuccguccccgcccgcgucccuccccaggcugccccaggccgggagucuugggcuuuaguagcggccccgccuccccuucgggcgggcgucccgccgccgcgcggggcccucagcgcccuggcuccgccuccgcgcccggcgucugcuaaugguccacucuguuuacuucuguuuggauagcaacugagucuuaaaggcacagguuugcucgagguuucccuguuauagagacgcagccguaggugacucaguucaaaacucacacacaaacacaauacccacccccuuucuucucguugccacuuuuccuuauaccauuagaaacucaacaacugcuucucugccucucaaagacuccacagagaaucccaaagggcauuuaguauuuuuauuugguucgcucgccggcuuaauuugcacaucuuaacacauucaauacaacuaccuucaccguaaaguaaaauaauucaggucuagacugcauucuccagcauaaaucacucuuuccccaauuuuaaacag

SEQ ID NO: 20103 - RNA, 2692 nt, Homo sapiens
uuagcucuuccgcucgacccacaaucccuaguguuugcagguguugcauucccccaaccccuuucuucucuucaaccaguagccuccaccuucccaucccugcuuuggagaaggaggaaaacgcagcuugagaucuacucgaagaacugacccucagcucucacaggcugccgccgagcugcaagcaugccgccgcuccacucggguaaacuucggagugaguuaccugcacucggagaagggccuuaccugagcgcgccucugccaauggcagcucaccugagggagcuccccagccaaucaucgcgcagcucgucccucgggcuuguacccuuuagugaaagaauucagcuccuugcgagaaaguuaccuguggccgcccaaguccgccacuuucugcucugugucugcccauugccacgauccaggaggacuccgcgccgcccggccgccuccgagcucgggccccaugugaggggcccccccuuaucccaccuuuccggcuaggugagggcgcgagcgggcgagcgagcgagaguggugaggggggacggaaaagcagaauuaccuguagcucuuguucugccaucucgggcgcucucacacaccuucaccugcacagacuugaaaguccaguuucaccagaggcugaggcuccaggaaaagcggagcaaguucauuggaucaaacaugucacaagagucggacaaguaaguggaucacacgcgccggcugcugcuacuacuaccacuuugggcugauggcaacugguuuguuauguuuuuguuuuuaaguugcuauuguugguauuuuucuuucuuuuuucuuuuucuuuuugguggauccagacuuuuccgcauuauguuucuacccugauuaaggggagaaacccuacaacaaugugaauauuuaauauccccuuugggccuugauaguaaaaguggguuuuccuuuuccuucuucccuuaggaauggucucagcucccgcuccuggaugaauacuuggauauugccagagguuuugguagaugggcgcgggaggccugcucuucccucucuguuuuagcugcucccaccgaucuggcguuuagggccauuuggaaguucagcugaguuccuucgauuuguccaaagggccuacuggaaaaguggggcuuggccgcuuuugugugaccgcaacaaagagcuuuuauaugaggcagaaacggccaucuucucgcaccgggcaggagggugggcgugagugcgcgcccgcguguggccccgaugggaggcgaggcgcugggaggccggggggcgcgggggcggccggcgccgucccccacucccucgacaucccgccuuccuccccccucccccgccucccucccccggguccgcccccgcauuguuuggccaccuuccucaggugcccggggggaaaggacgguucgcgaacugggggaacucaugugaggccucgaguuagggccucggcggggcgcgaaggggcgccugccacugagcgauucacccgcgcccccgacggcgucugcacgccccucgagcucgcggcccuccacgcaguuggccgccaccucggacgcggcaggcgggacugcguggggcgcgccgagccuucucggggugcucucgccgucaaggccgagggcucggggcggcgggaacgcugggcucgcguccuucccgucccggacaggcacuccagacgcgucggggagccacagccugcgcggccggagccgcccgcgggucacugggcccgguccggccgcguccugacggccuccccccuggccggcccccgcccucggaaggcuuugugcgagccgggggagguggggccugggcgggcgcgggagggagccggaggugggucccgcggccuuucucgggauucggcggggacacucccuucccccuccucucgggcgcguccgggccugggaacuggcugcguccuauuggaagugcgcggggccgcccuuuugcuuuccccgguaacuuugccguggcguugcggccaccccgaggggaccuuccugaaggugucucgccggagagggccggugccccaaggccgcgggccgcugggccugucauggagaaguggcggggacccgucccaaguugagggaccacgagggaggagugggaaggcccugcggaccuguucagggguggaggggaaggacuagccucaacauaaagccgcuggcagguuaggcgaaccuaagaaaaugcgcugucauacuuaaaaagcaaaaaacugccagauaguuguaccccguuagccaccgaugaggaauuaaccgaguacagcauaccggaggggaagaacuagcguuaccaacacgggagcgggucagaggcaggguaggaagaggagagugugugguugucugagaacacccccagcuccuccccauaucucucuagucuucaaggaaacacgacucgaguuugaaauuuucaguagccaaauccggaggcgacagcaaguuuuugggguuuguuuugaucuuugccugcgucaaagaugauugcaaaucuaauuuaauuaaucgcgcaauuaacauuuaguuugcuuaguuuugugauacaacagaacucgaauucugaaugaaaacgggucggucuuuauuuucaccaguuauacuuagcagcaauaagaacaauguguuuaccauca

SEQ ID NO: 20104 - RNA, 2692 nt, Homo sapiens
ugaugguaaacacauuguucuuauugcugcuaaguauaacuggugaaaauaaagaccgacccguuuucauucagaauucgaguucuguuguaucacaaaacuaagcaaacuaaauguuaauugcgcgauuaauuaaauuagauuugcaaucaucuuugacgcaggcaaagaucaaaacaaaccccaaaaacuugcugucgccuccggauuuggcuacugaaaauuucaaacucgagucguguuuccuugaagacuagagagauauggggaggagcuggggguguucucagacaaccacacacucuccucuuccuacccugccucugacccgcucccguguugguaacgcuaguucuuccccuccgguaugcuguacucgguuaauuccucaucgguggcuaacgggguacaacuaucuggcaguuuuuugcuuuuuaaguaugacagcgcauuuucuuagguucgccuaaccugccagcggcuuuauguugaggcuaguccuuccccuccaccccugaacagguccgcagggccuucccacuccucccucguggucccucaacuugggacggguccccgccacuucuccaugacaggcccagcggcccgcggccuuggggcaccggcccucuccggcgagacaccuucaggaagguccccucgggguggccgcaacgccacggcaaaguuaccggggaaagcaaaagggcggccccgcgcacuuccaauaggacgcagccaguucccaggcccggacgcgcccgagaggagggggaagggaguguccccgccgaaucccgagaaaggccgcgggacccaccuccggcucccucccgcgcccgcccaggccccaccucccccggcucgcacaaagccuuccgagggcgggggccggccaggggggaggccgucaggacgcggccggaccgggcccagugacccgcgggcggcuccggccgcgcaggcuguggcuccccgacgcgucuggagugccuguccgggacgggaaggacgcgagcccagcguucccgccgccccgagcccucggccuugacggcgagagcaccccgagaaggcucggcgcgccccacgcagucccgccugccgcguccgagguggcggccaacugcguggagggccgcgagcucgaggggcgugcagacgccgucgggggcgcgggugaaucgcucaguggcaggcgccccuucgcgccccgccgaggcccuaacucgaggccucacaugaguucccccaguucgcgaaccguccuuuccccccgggcaccugaggaagguggccaaacaaugcgggggcggacccgggggagggaggcgggggaggggggaggaaggcgggaugucgagggagugggggacggcgccggccgcccccgcgccccccggccucccagcgccucgccucccaucggggccacacgcgggcgcgcacucacgcccacccuccugcccggugcgagaagauggccguuucugccucauauaaaagcucuuuguugcggucacacaaaagcggccaagccccacuuuuccaguaggcccuuuggacaaaucgaaggaacucagcugaacuuccaaauggcccuaaacgccagaucggugggagcagcuaaaacagagagggaagagcaggccucccgcgcccaucuaccaaaaccucuggcaauauccaaguauucauccaggagcgggagcugagaccauuccuaagggaagaaggaaaaggaaaacccacuuuuacuaucaaggcccaaaggggauauuaaauauucacauuguuguaggguuucuccccuuaaucaggguagaaacauaaugcggaaaagucuggauccaccaaaaagaaaaagaaaaaagaaagaaaaauaccaacaauagcaacuuaaaaacaaaaacauaacaaaccaguugccaucagcccaaagugguaguaguagcagcagccggcgcgugugauccacuuacuuguccgacucuugugacauguuugauccaaugaacuugcuccgcuuuuccuggagccucagccucuggugaaacuggacuuucaagucugugcaggugaaggugugugagagcgcccgagauggcagaacaagagcuacagguaauucugcuuuuccguccccccucaccacucucgcucgcucgcccgcucgcgcccucaccuagccggaaaggugggauaagggggggccccucacauggggcccgagcucggaggcggccgggcggcgcggaguccuccuggaucguggcaaugggcagacacagagcagaaaguggcggacuugggcggccacagguaacuuucucgcaaggagcugaauucuuucacuaaaggguacaagcccgagggacgagcugcgcgaugauuggcuggggagcucccucaggugagcugccauuggcagaggcgcgcucagguaaggcccuucuccgagugcagguaacucacuccgaaguuuacccgaguggagcggcggcaugcuugcagcucggcggcagccugugagagcugagggucaguucuucgaguagaucucaagcugcguuuuccuccuucuccaaagcagggaugggaagguggaggcuacugguugaagagaagaaagggguugggggaaugcaacaccugcaaacacuagggauugugggucgagcggaagagcuaa

SEQ ID NO: 20105 - RNA, 2723 nt, Homo sapiens
ucuaauaucuaugacagaguugguaccccaaacuagguugauuucuacagcaguucaacuuccuauuaggguuuguaucaauaaaacugugggacccgccagggcuggaaucccacugcuaccugagcauccaguuggugaccaggcuccccgaauuaauaaaaguauuuguuguuguuuuuauagcaguuguccaggaaguaucuccuuucgaacucaagucacuugggcaauuggcuuuacaaagcaaauuggcuccguuuaaggauucuugacuccugaaauccgcaaggaaguggguucuuuuagagccagcgccaagagcuucaaaaaauccuucuaaggugaaccccuccggacccggauagcgagauggggcucagccuugcgccucgggggucguaacagacggcaagguggagguggcuucccggccccgcagccggaccucggcaccccgagcccguucaccggggccggguccuggcgggccgcggagugaggccgggcggcgcagcgcaggcggugcccgggcgcagggccagucccgccgccgccgccgccgccgccgccgccgccgccgcgagcccggaccugcccgcccgaccuggcggcgcagucucgcgggaucgcucagcucucgcuccccgugcggcucucgaggcagcuccagucccggacgcaaccccggagccgucucaggucccuggggggaacgguggguuagacggggacgggaagggacagcggccuucgaccgccccccgaggugaggcuuccacggcugggacugggcaggggccgggcgggugccgggggaagcggggagggccucgaggggcgaggggccgcggcugggaugaggcgcgccgggagccgcaggugcuggggaggcaacggcgggacggcccgcaccugaguuuccucggaagcgggaaccggcucugaaaggcgaugccggggccccgcggcgccgcgcaggccaggaacgcugcugucuggcucuaggccuggggcagguucccggguguggggcgcuggcggaccgggcaucaguguguguuggggcgcggguaauucguaauccggggccuacagccuuccucccgcaaggggacugccuucgcccuucccccgggacagauuugcgcacuuuccuuucgacggcagcacuacacccuccuagccagugaaaacugcaauguugcuccuccacuggaggaauccuaaaagucucccucuaguuggccuuacgaaaaucgagaaaacuacauacccagaagacugccacaaaaacugacucuucagagucuuuuacaaguuuaagaacucuuugggucuuaaggaauuucccagggccuuaguuuucuuguacuuaauaagcuuuccaacaggggcccuuagauuguaugcuuauauuaauccuuuauaauuuacuccgaaucaccagcuuuccuuuuuuccuccaucuuacucuugccauucccucuuuuuaacccugucuuccauacagcaccaaccuccuagcaucgguuuccuagaggugcagcuuccuuagcaaaugauauauuccaugcuaaggcagguggaagaguaucucguuaggacagaauuuuccguuguuuuuccaguguuuguuaccuggggugaaaaucuuaacucugcacuuugacuccacauuugaguuuaugacaaauguugcugauacacccuccuuuuguuuuuacaguaauugacccaggacucauuuucaggaaagccugaaaaugaguaaaauagugaaaugaggaauuugaacauuuuaucuuuggauggggaucuucugaggaugcaaagagugauucauccaagccaugugguaaaaucaggaauuugaagaaaauggaaauguuuacauuuuuguugacguguauuuuucuaccccuccuaagagggcacagucucuucaccugugaaccaauuacuguucccagauguaugaaaauggccuacaacaugacguuuuucccuaaucugaugggucauuaugaccagaguauugccgcgguggaaauggaggugaguagugcuucauacguuuauugaauaguaguuuaugcucuguucuagaauaaacuaguaaaaauaagucuauuuuuaaacagagccgauuucuucaaguuguguacaaguuguguuuugaaaaguccuuuugaaaauuaaaucccucuacugacuuauguuuuguguaccuuugcggcccuguuuaguagauucguuugaauaggguucauuuuauauaaugaaguaugguuacacaugauuucuaaauaccuuguaccuagaaaauauuuugcuuuccugaaucaaguaugauaguucuucuagaaaugcgaauucugaauauuuuucuacuucacugaacauguaauauuuauugccuggacuaaaacugaagaaauuuacaaguuuuuauaaguaguuguaauauucacuugguacaguuuuucugaaauaaauaaauuaucagaauauuuuguugcuguagacuguauuuuaaggcuaucacaaagucacuaaaaagugacuuuguuuucuaagcauagcacuuauauguucuuuauaagauacuuguuaaaagaaaccacuugggaggaguacagugacacuaaagauugccuuaggugccuuaguuaccugucucugguuuagagauaugcaaauuacuagggagugugagaaga

SEQ ID NO: 20106 - RNA, 2723 nt, Homo sapiens
ucuucucacacucccuaguaauuugcauaucucuaaaccagagacagguaacuaaggcaccuaaggcaaucuuuagugucacuguacuccucccaagugguuucuuuuaacaaguaucuuauaaagaacauauaagugcuaugcuuagaaaacaaagucacuuuuuagugacuuugugauagccuuaaaauacagucuacagcaacaaaauauucugauaauuuauuuauuucagaaaaacuguaccaagugaauauuacaacuacuuauaaaaacuuguaaauuucuucaguuuuaguccaggcaauaaauauuacauguucagugaaguagaaaaauauucagaauucgcauuucuagaagaacuaucauacuugauucaggaaagcaaaauauuuucuagguacaagguauuuagaaaucauguguaaccauacuucauuauauaaaaugaacccuauucaaacgaaucuacuaaacagggccgcaaagguacacaaaacauaagucaguagagggauuuaauuuucaaaaggacuuuucaaaacacaacuuguacacaacuugaagaaaucggcucuguuuaaaaauagacuuauuuuuacuaguuuauucuagaacagagcauaaacuacuauucaauaaacguaugaagcacuacucaccuccauuuccaccgcggcaauacucuggucauaaugacccaucagauuagggaaaaacgucauguuguaggccauuuucauacaucugggaacaguaauugguucacaggugaagagacugugcccucuuaggagggguagaaaaauacacgucaacaaaaauguaaacauuuccauuuucuucaaauuccugauuuuaccacauggcuuggaugaaucacucuuugcauccucagaagauccccauccaaagauaaaauguucaaauuccucauuucacuauuuuacucauuuucaggcuuuccugaaaaugaguccugggucaauuacuguaaaaacaaaaggaggguguaucagcaacauuugucauaaacucaaauguggagucaaagugcagaguuaagauuuucaccccagguaacaaacacuggaaaaacaacggaaaauucuguccuaacgagauacucuuccaccugccuuagcauggaauauaucauuugcuaaggaagcugcaccucuaggaaaccgaugcuaggagguuggugcuguauggaagacaggguuaaaaagagggaauggcaagaguaagauggaggaaaaaaggaaagcuggugauucggaguaaauuauaaaggauuaauauaagcauacaaucuaagggccccuguuggaaagcuuauuaaguacaagaaaacuaaggcccugggaaauuccuuaagacccaaagaguucuuaaacuuguaaaagacucugaagagucaguuuuuguggcagucuucuggguauguaguuuucucgauuuucguaaggccaacuagagggagacuuuuaggauuccuccaguggaggagcaacauugcaguuuucacuggcuaggaggguguagugcugccgucgaaaggaaagugcgcaaaucugucccgggggaagggcgaaggcaguccccuugcgggaggaaggcuguaggccccggauuacgaauuacccgcgccccaacacacacugaugcccgguccgccagcgccccacacccgggaaccugccccaggccuagagccagacagcagcguuccuggccugcgcggcgccgcggggccccggcaucgccuuucagagccgguucccgcuuccgaggaaacucaggugcgggccgucccgccguugccuccccagcaccugcggcucccggcgcgccucaucccagccgcggccccucgccccucgaggcccuccccgcuucccccggcacccgcccggccccugcccagucccagccguggaagccucaccucggggggcggucgaaggccgcugucccuucccguccccgucuaacccaccguuccccccagggaccugagacggcuccgggguugcguccgggacuggagcugccucgagagccgcacggggagcgagagcugagcgaucccgcgagacugcgccgccaggucgggcgggcagguccgggcucgcggcggcggcggcggcggcggcggcggcggcggcgggacuggcccugcgcccgggcaccgccugcgcugcgccgcccggccucacuccgcggcccgccaggacccggccccggugaacgggcucggggugccgagguccggcugcggggccgggaagccaccuccaccuugccgucuguuacgacccccgaggcgcaaggcugagccccaucucgcuauccggguccggagggguucaccuuagaaggauuuuuugaagcucuuggcgcuggcucuaaaagaacccacuuccuugcggauuucaggagucaagaauccuuaaacggagccaauuugcuuuguaaagccaauugcccaagugacuugaguucgaaaggagauacuuccuggacaacugcuauaaaaacaacaacaaauacuuuuauuaauucggggagccuggucaccaacuggaugcucagguagcagugggauuccagcccuggcgggucccacaguuuuauugauacaaacccuaauaggaaguugaacugcuguagaaaucaaccuaguuugggguaccaacucugucauagauauuaga

SEQ ID NO: 20107 - RNA, 4034 nt, Homo sapiens
gaggacagaguacgcgugcaagguuuugcaaugugccagagcuuaguaaguguuagcacuuaugaaaacagcguuuauauaucauuugggucaugggacucuuggaaaaccugaugauaccuaugguuucuuccugccuccgccccacccccaccuuccagccuccaaaaaugucaccuccaaaaaacaaauaaggcagggcgcgguggcucacgccuguaaucccagcacuuugggaggccgaggcgggcggaucacaaggucaggagaucuagacuauccuggcuaacacggugaaaccccgucucuacuaaaaauauaaaaaauuagccggggccgggcgcgguggcucacgccuguaaucccagcacuuugggaggccgaggcggguggaucacgaggucaggagaucgagaccauccuggcuaacacggugaaaccccgucucuacuaaaaauacaaaaaauuagccgggcgugauggcgggcgccuguagucccagcuacucgggaggcugaggcaggagaauggcgugaacccgggaagcggagcuugcagugagccgagaucgcgccacugcacuccagccugggcgacagagcgagacuccgucucaaaaaaaaaaaaaaaaaaaaaaaaaaaaaaauuagccgggcgugguggcgggugccugcagucccagcugcucuggaggcugaggcaggagaauggcgugaacccgggaggcggagcuugcagugagccuagauggcgccacugcacuccagccugggcgacagagcgagacucugucucaaaaacaaacaaacaaacaaaaaacaaauaagacucgccgacccaugccauagauugacgacccuugaagguggcucguguacccagguuaagccacgugucucuaaaauguucauuuaggcggcgcuguguuaccugcgggaauccccgaccugcggcuccugaccacgggccaccccgcccagacccugcaggcgggcucuccacgagggucugcgcagccccgcggggguccugacaggccgagcgacugcaguaggagggggcgggcccggcucucgguccgcccccacgccgggcucggggugggggcucggggccuauuacgggauggaagcuccgggugucgcgggggcgggaggaauuaagggagggagagaggcgcgcgggugaaaggcgcauugaugcagccugcggcggccucggagcgcggcggagccagacgcugaccacguuccucuccucggucuccuccgccuccagcuccgcgcugcccggcagccgggagccaugcgaccccagggccccgccgccuccccgcagcggcuccgcggccuccugcugcuccugcugcugcagcugcccgcgccgucgagcgccucugagauccccaaggggaagcaaaaggcgcagcuccggcagagggaggugguggaccuggugaguccgagggagccgagccgggaccgccgcgcugguggaggggaccuggccgcgcgccccacgggcagggcgucagucuggcuguugggggugucugucuguacagcugugugucgugugucuugcugcgccggggugucaugcuuuuuauuuacaggugaagaaggaccugguuaugcgugcagugagucuuggaacucagaggggagaccaaaaugggaggccaucguggagcggacaugcgauaugggcccggugggucuccccgaaguacagggagucccccaauaauuucuggccccagggggaccccuugggaagggugggagggauagggcggcagugagaguaggaugaggagcuuggguacguccgaaguggaccugggaaaaacccuggccucgcugaucacauggaccugggccugggccagggcggugcaacguguccuuuguuggggcugguggccacgucugccugcgagagagaauaacaacccccacaaagcauccguccaacucuuuguaacuugaagacuaugagucacguugggucaucuuccuagggaguaugggcugcaauuuacuuuguuggacaaccacagcuggggcuaggaaugguucagaagguuuaaggccggaaagggaaaugaaggggcccggcgcuaacccucuaaggaccuguuuugcuucuguuuaaaccaaaugggcagucugucauuacacacacccugggucuucauauguggccgccagguaggagcaucacagucaagcuacgggagaaaacaguuuccaggaaacuggaaaugaacggcccgagugcuuuccaggggcucaucugugggaagguauguuugcuuaaaauccuucccucuaaaaaucaacaaacccaguggagggcggagagguucucuggccugugguaugagggagccuuucagagcuaccguaguccuuggcauauuauaaacuucagucucacuugcagacaaacaugauuuacaggcauugcaagacauaaguuggggcauuuuuuuuuaauuaaaaagaaaguuuugaauuuguuaagcugccauuuuaaacugagcuaauauaccaaguucccuggcagcuaguucuguauuggauucaaaagugcugggaaaaaaauucccgccauuucacacagcacuuuuuggugguaggcuguguaauuuugauccacaaaaggggacuauguguucaggcaacaguucuauuuuaaguguccaaauuauuaaaacugugccaaaugaguaugguucauguguaguuugcauuuuaugagucuguaguuaugauacacaaaauacccauuuuuccugugaagcuugcuauuuuccccccuucaaggauuuacaguaccugugguuucccacaacucuagccagacuuggaaaagauuuugcagucaggcucaggugcauccuguagguuggauuugguuuugcugacagaagaaguccacagucauuaagguuucaacagauucuauaaagcaacuucuuuguauaggaucuuucaaagcguuccuuucaagcuuccacaaagcucugcccccugguggccagugaaagaaacaggggcguauaaaagugcgcuucccuucacaucuuuuuuuuuucauuccacagacauuuauugagaguacuaagcauauguuggguuagcauuuuaaaguagaagacugauguaacaccugcggaaucgagucaaguaaaguuauauagucuuugaaauguaucuuuuagaugaaaaggugaauaaaaauucccaauauggcacaauggacauguugggccagauaauucuuguggggacuuguccuguccguugucgcguguuuagcagcaucguuuguacauacuagaugccaguagcaauccccucucccaaguugugacaaccaaaaaugucucuagacauagccaaguguccccuggaggacaaaauuguccccaguugagauccacugauauauaaugaaguaaaauuuagucuguguagcaucuugcccugaggggaauaauagugaaaaaaaucaaagaauaucagaagcagucuuauucccauuugaaauguaugucuaaacauuguauauaucugcuugugagagugaauuaaauuacuaaaauaaaaauaaagucuaaaacacaccaaacuauuuugaaauauuuugcacuuuuaaaaugcuuuacuuuuugugucuuugaauacuuuuguaauuguuaaaugcuuuuucuuuucuuuuuuuuaacuauuucucugacaguaaauaaguaguagugucuuuuucuucuuacagucaggaaaauggcgaugucaaagacuuaaaaagucauuuaucaaaccaaaacucaaacuggcgauggagacacaaauugauuagcaagcaucagucuaauuauauaggauucuucccagacaacuauuggauuuuaucauccaaucccagauacuguagucaaaagauaagcuuugaaguuacuuuaauaucuaagaaacuuuguuuuuuguuuucauugggaaauauaguuauacagaauaauacuaggc

SEQ ID NO: 20108 - RNA, 4034 nt, Homo sapiens
gccuaguauuauucuguauaacuauauuucccaaugaaaacaaaaaacaaaguuucuuagauauuaaaguaacuucaaagcuuaucuuuugacuacaguaucugggauuggaugauaaaauccaauaguugucugggaagaauccuauauaauuagacugaugcuugcuaaucaauuugugucuccaucgccaguuugaguuuugguuugauaaaugacuuuuuaagucuuugacaucgccauuuuccugacuguaagaagaaaaagacacuacuacuuauuuacugucagagaaauaguuaaaaaaaagaaaagaaaaagcauuuaacaauuacaaaaguauucaaagacacaaaaaguaaagcauuuuaaaagugcaaaauauuucaaaauaguuugguguguuuuagacuuuauuuuuauuuuaguaauuuaauucacucucacaagcagauauauacaauguuuagacauacauuucaaaugggaauaagacugcuucugauauucuuugauuuuuuucacuauuauuccccucagggcaagaugcuacacagacuaaauuuuacuucauuauauaucaguggaucucaacuggggacaauuuuguccuccaggggacacuuggcuaugucuagagacauuuuugguugucacaacuugggagaggggauugcuacuggcaucuaguauguacaaacgaugcugcuaaacacgcgacaacggacaggacaaguccccacaagaauuaucuggcccaacauguccauugugccauauugggaauuuuuauucaccuuuucaucuaaaagauacauuucaaagacuauauaacuuuacuugacucgauuccgcagguguuacaucagucuucuacuuuaaaaugcuaacccaacauaugcuuaguacucucaauaaaugucuguggaaugaaaaaaaaaagaugugaagggaagcgcacuuuuauacgccccuguuucuuucacuggccaccagggggcagagcuuuguggaagcuugaaaggaacgcuuugaaagauccuauacaaagaaguugcuuuauagaaucuguugaaaccuuaaugacuguggacuucuucugucagcaaaaccaaauccaaccuacaggaugcaccugagccugacugcaaaaucuuuuccaagucuggcuagaguugugggaaaccacagguacuguaaauccuugaaggggggaaaauagcaagcuucacaggaaaaauggguauuuuguguaucauaacuacagacucauaaaaugcaaacuacacaugaaccauacucauuuggcacaguuuuaauaauuuggacacuuaaaauagaacuguugccugaacacauaguccccuuuuguggaucaaaauuacacagccuaccaccaaaaagugcugugugaaauggcgggaauuuuuuucccagcacuuuugaauccaauacagaacuagcugccagggaacuugguauauuagcucaguuuaaaauggcagcuuaacaaauucaaaacuuucuuuuuaauuaaaaaaaaaugccccaacuuaugucuugcaaugccuguaaaucauguuugucugcaagugagacugaaguuuauaauaugccaaggacuacgguagcucugaaaggcucccucauaccacaggccagagaaccucuccgcccuccacuggguuuguugauuuuuagagggaaggauuuuaagcaaacauaccuucccacagaugagccccuggaaagcacucgggccguucauuuccaguuuccuggaaacuguuuucucccguagcuugacugugaugcuccuaccuggcggccacauaugaagacccaggguguguguaaugacagacugcccauuugguuuaaacagaagcaaaacagguccuuagaggguuagcgccgggccccuucauuucccuuuccggccuuaaaccuucugaaccauuccuagccccagcugugguuguccaacaaaguaaauugcagcccauacucccuaggaagaugacccaacgugacucauagucuucaaguuacaaagaguuggacggaugcuuuguggggguuguuauucucucucgcaggcagacguggccaccagccccaacaaaggacacguugcaccgcccuggcccaggcccagguccaugugaucagcgaggccaggguuuuucccagguccacuucggacguacccaagcuccucauccuacucucacugccgcccuaucccucccacccuucccaaggggucccccuggggccagaaauuauugggggacucccuguacuucggggagacccaccgggcccauaucgcauguccgcuccacgauggccucccauuuuggucuccccucugaguuccaagacucacugcacgcauaaccagguccuucuucaccuguaaauaaaaagcaugacaccccggcgcagcaagacacacgacacacagcuguacagacagacacccccaacagccagacugacgcccugcccguggggcgcgcggccagguccccuccaccagcgcggcggucccggcucggcucccucggacucaccagguccaccaccucccucugccggagcugcgccuuuugcuuccccuuggggaucucagaggcgcucgacggcgcgggcagcugcagcagcaggagcagcaggaggccgcggagccgcugcggggaggcggcggggcccuggggucgcauggcucccggcugccgggcagcgcggagcuggaggcggaggagaccgaggagaggaacguggucagcgucuggcuccgccgcgcuccgaggccgccgcaggcugcaucaaugcgccuuucacccgcgcgccucucucccucccuuaauuccucccgcccccgcgacacccggagcuuccaucccguaauaggccccgagcccccaccccgagcccggcgugggggcggaccgagagccgggcccgcccccuccuacugcagucgcucggccugucaggacccccgcggggcugcgcagacccucguggagagcccgccugcagggucugggcgggguggcccguggucaggagccgcaggucggggauucccgcagguaacacagcgccgccuaaaugaacauuuuagagacacguggcuuaaccuggguacacgagccaccuucaagggucgucaaucuauggcaugggucggcgagucuuauuuguuuuuuguuuguuuguuuguuuuugagacagagucucgcucugucgcccaggcuggagugcaguggcgccaucuaggcucacugcaagcuccgccucccggguucacgccauucuccugccucagccuccagagcagcugggacugcaggcacccgccaccacgcccggcuaauuuuuuuuuuuuuuuuuuuuuuuuuuuuuuugagacggagucucgcucugucgcccaggcuggagugcaguggcgcgaucucggcucacugcaagcuccgcuucccggguucacgccauucuccugccucagccucccgaguagcugggacuacaggcgcccgccaucacgcccggcuaauuuuuuguauuuuuaguagagacgggguuucaccguguuagccaggauggucucgaucuccugaccucgugauccacccgccucggccucccaaagugcugggauuacaggcgugagccaccgcgcccggccccggcuaauuuuuuauauuuuuaguagagacgggguuucaccguguuagccaggauagucuagaucuccugaccuugugauccgcccgccucggccucccaaagugcugggauuacaggcgugagccaccgcgcccugccuuauuuguuuuuuggaggugacauuuuuggaggcuggaagguggggguggggcggaggcaggaagaaaccauagguaucaucagguuuuccaagagucccaugacccaaaugauauauaaacgcuguuuucauaagugcuaacacuuacuaagcucuggcacauugcaaaaccuugcacgcguacucuguccuc

SEQ ID NO: 20109 - RNA, 2663 nt, Homo sapiens
aaagcaaaagccaacaccuccacccaugcacagucuauuaccucgcccgaaacucaaccugcugguucacaggagaauggggcagaagacccagagccauccacuucaucccaugugcauauuucaacuccucccaccugccaggcgcugggccaggggccagguuacagggcagggcaggcaaauccuccuccuugcccagaugcagugggagacacggucccacaaagcuaagaagucacaggucaggggaacacccaguuuuccauccacaccaaaacccucucucucccuuacaccuuccuucauccccgacacugugccaccccagccuggggcuggcucugccgccacacacaccacacagaaccggucugcgucuccagccgugugucuuccccaccagaaggcagcccuuccaagaaaggcgcugggguuugcccccucuguaccuugcuuauuucaaucacauuugugaaacucaauaagaacgccagaauuucucaacaggaagagucuagacugaaaaauucgccuugaaacuacauuucugcagcaagaacaggggguuuguauuuagauauguucuuuugaggcagcuuaggagaaggucccgugcagcugauggguauuauaaggaugucuaccgcccuccugccuggccacuggcugacuucugaauauuagauauuucccaguagcuuaaagaaaccaaacaaacugaagugcccccagcguccgugaggaagggguguucuuggaugggcauaagauaaccaagggcccugccucccccacccacugccaggcaucucccacuuccaagccacagaggcgugcuguucaggacccccagggacagcagggacaacaggcgggggauaugggggagggguggguaaggaaccgacccacuaaaucccagcuccagcuacuaauuugacagaggcgugacagcguguuucccccagaaccagccgcauuccccaagcccagcccgaaaucuccucccgaggcugaaucagagaccgcggcggaucccccaggaacgucgaaguaauuccagcuguuuucccccguggagggcaggagcggccagcaccagaggcaggggaggggaggaaagcgggggagggugggcggaggcgaaaaugacgccacuccuagcuccagccagcucaaggggccgccaaauguccgcgagaccccucucgcccaggucacuucucccacgccgccgaugcgccaaucccggguuccuccgggggcgcacccugcccaguggcgcucgcagacacuugcuccggcucgcguguugcacugugacacacccuggacccuccccccacacacacgcuuacacucacacaugcacaccgcccugugugugcuacgggacugaagcgccaccagccucucggauccacacccguucccgacccagucugcaagccagacacacccacgccccccucuccagccuccuugccagcgccacucaccucuaccaaccccucaucuacacacucgcgcgcaaucucuccguucccagacacagacacacacacacacacacacacacacacacacacacacucaccuagucccuucugcacccacguccagcgcgcaccccugccagcggcgccagcugggauucggagacgacgccaggaaacgcuauccugguauuuuuucggaccgucucaucgcccccuucccgaccuccagaaccccaauccccagcuaggggggagaugaaugggacccugucuuuuuuuccucccuuuccguaauugaaccccccacuucagcggugucugcacccaaagcccccucgcgcccgcgccccggggugaccgcgcacuugcagcuccggggcgcuuacuccuggaguacgcggggcuacaaagggcgguccuggcgcuccagcggcaccgcacgggcggccccuuucugcuccgcgucgcgccugggagaagagggcgcgggcuuaccuaacgcgagggagaaaggaaaggacggugccgaggcuggcggcccagcgccccgcggaagccgagggcggauggugaacugacgagcuucagcaccagcugggagccaggcgagguuuguuuacguccgggcggagggcgacuuuauaggcgccgcggccccgcccccgcgccucgccccucccagacccucgcagucccagcacgcagccgggacacaccccuuccccgcucccugcucccuccucccgggcgcgccgggcugggcugggcuccggcagcgcgcggcgggcgcccacuggagccgccgccuguugcgcaagcagucguaggggcgcggccgggaggggcaucggggcccggguugugggucggcucugcaguccccuccgaguccagggccucggccugugcagcgggcgcgugugcccugcccggaggaggcguuugugugcuugugcguguucaugugcgcgcucgugcgugugcauguggacuuccuugugucuccguaugggcggaggccccccaucucugccucagaguuucuucuaagagucucguugcgccacgcccugagcgacucccuucacuuccuguaggucucaccagcucggcucuccagccggauucggcugccugcccagcagccgccuucgcuuucgc

SEQ ID NO: 20110 - RNA, 2663 nt, Homo sapiens
gcgaaagcgaaggcggcugcugggcaggcagccgaauccggcuggagagccgagcuggugagaccuacaggaagugaagggagucgcucagggcguggcgcaacgagacucuuagaagaaacucugaggcagagauggggggccuccgcccauacggagacacaaggaaguccacaugcacacgcacgagcgcgcacaugaacacgcacaagcacacaaacgccuccuccgggcagggcacacgcgcccgcugcacaggccgaggcccuggacucggaggggacugcagagccgacccacaacccgggccccgaugccccucccggccgcgccccuacgacugcuugcgcaacaggcggcggcuccagugggcgcccgccgcgcgcugccggagcccagcccagcccggcgcgcccgggaggagggagcagggagcggggaaggggugugucccggcugcgugcugggacugcgagggucugggaggggcgaggcgcgggggcggggccgcggcgccuauaaagucgcccuccgcccggacguaaacaaaccucgccuggcucccagcuggugcugaagcucgucaguucaccauccgcccucggcuuccgcggggcgcugggccgccagccucggcaccguccuuuccuuucucccucgcguuagguaagcccgcgcccucuucucccaggcgcgacgcggagcagaaaggggccgcccgugcggugccgcuggagcgccaggaccgcccuuuguagccccgcguacuccaggaguaagcgccccggagcugcaagugcgcggucaccccggggcgcgggcgcgagggggcuuugggugcagacaccgcugaagugggggguucaauuacggaaagggaggaaaaaaagacagggucccauucaucuccccccuagcuggggauugggguucuggaggucgggaagggggcgaugagacgguccgaaaaaauaccaggauagcguuuccuggcgucgucuccgaaucccagcuggcgccgcuggcaggggugcgcgcuggacgugggugcagaagggacuaggugagugugugugugugugugugugugugugugugugugugucugugucugggaacggagagauugcgcgcgaguguguagaugagggguugguagaggugaguggcgcuggcaaggaggcuggagaggggggcgugggugugucuggcuugcagacugggucgggaacggguguggauccgagaggcugguggcgcuucagucccguagcacacacagggcggugugcaugugugaguguaagcguguguguggggggaggguccagggugugucacagugcaacacgcgagccggagcaagugucugcgagcgccacugggcagggugcgcccccggaggaacccgggauuggcgcaucggcggcgugggagaagugaccugggcgagaggggucucgcggacauuuggcggccccuugagcuggcuggagcuaggaguggcgucauuuucgccuccgcccacccucccccgcuuuccuccccuccccugccucuggugcuggccgcuccugcccuccacgggggaaaacagcuggaauuacuucgacguuccugggggauccgccgcggucucugauucagccucgggaggagauuucgggcugggcuuggggaaugcggcugguucugggggaaacacgcugucacgccucugucaaauuaguagcuggagcugggauuuagugggucgguuccuuacccaccccucccccauaucccccgccuguugucccugcugucccuggggguccugaacagcacgccucuguggcuuggaagugggagaugccuggcagugggugggggaggcagggcccuugguuaucuuaugcccauccaagaacaccccuuccucacggacgcugggggcacuucaguuuguuugguuucuuuaagcuacugggaaauaucuaauauucagaagucagccaguggccaggcaggagggcgguagacauccuuauaauacccaucagcugcacgggaccuucuccuaagcugccucaaaagaacauaucuaaauacaaacccccuguucuugcugcagaaauguaguuucaaggcgaauuuuucagucuagacucuuccuguugagaaauucuggcguucuuauugaguuucacaaaugugauugaaauaagcaagguacagagggggcaaaccccagcgccuuucuuggaagggcugccuucugguggggaagacacacggcuggagacgcagaccgguucugugugguguguguggcggcagagccagccccaggcugggguggcacagugucggggaugaaggaagguguaagggagagagaggguuuugguguggauggaaaacuggguguuccccugaccugugacuucuuagcuuugugggaccgugucucccacugcaucugggcaaggaggaggauuugccugcccugcccuguaaccuggccccuggcccagcgccuggcaggugggaggaguugaaauaugcacaugggaugaaguggauggcucugggucuucugccccauucuccugugaaccagcagguugaguuucgggcgagguaauagacugugcauggguggagguguuggcuuuugcuuu

SEQ ID NO: 20111 - RNA, 8477 nt, Homo sapiens
uuaggggguggaaugaaugucgugagggcgaguaaggagguaccggcuggggcugaaaaugcgcacggggaccaugagcgugauucgcccugagccgcugcgaacgcccugcgagcugggguggcccuggagguccuggagcagaagcuagguucccgcagaguccgcugcagcgccgcuggcgaucgggcugggucccauuuuccacgaaaagucccgcggcuucggccgcggaggugcuggagccuuugcgcucagacgaagggccgaacggccagggccaggccgcgucuucagagccuggcgagggucucgcgcugcugggaaggcggagacgccggggcgcgcgugcacccucgcgccugcagcgccgcgcacggccgccaggugccgcuguggcgcucagcgcgccgcccgccccgccccagggaacgcgaaaguggcgcgggccuggacggcgggacggaccacguagggcgcugagaaggucgcgccacggugggcggggcuccgggccccucccccucggccgcccucgcgcugugguucgcuccgggcgcgcugcgcucgugaguucccaggaggccuggcgggcaccguaaccagcgccgcggacaccggcaccggcgccacggacuccgcaggaccccgcgcccgccgccgccgcuaugcuggggcugcugguggcguugcuggcccuggggcucgcugucuuugcgcugcuggacgucugguaccuggugcgccuuccgugcgccgugcugcgcgcgcgccugcugcagccgcgcguccgugaccugcuagcugagcagcgcuucccgggccgcgugcugcccucggacuuggaccugcugcugcacaugaacaacgcgcgcuaccugcgcgaggccgacuuugcgcgcgucgcgcaccugacccgcugcggggugcucggggcgcugagggaguugcgggcgcacacggugcuggcggccucgugcgcgcgccaccgccgcucgcugcgccugcuggagcccuucgaggugcgcacccgccugcugggcugggacgaccgcgcguucuaccuggaggcgcgcuuugucagccugcgggacggcuucgugugcgcgcugcugcgcuuccggcagcaccugcugggcaccucacccgagcgcgucgugcagcaccugugccagcgcagggugagcggcccccgccccuggccccggagcacggccuuugugggaccuccgggggcuccuccuagucccuggcccccuccccuagggaaggcccgcugccugcaccucuuucggauacugcuggaguccugccucuuaccgcucccgccccucccucucuaccgggggcauuccucacugaugccuuuguucguggggguuccuaggguccccgaaucaacucuucauagucgggcuuagcgugcuucccuccugccauuucuuaaccuggccccucacgguuucguguucaccccucuccucucuccugguacucuguucuguggcuggaguguugaccucucugguccuugguccugaauauagguuggagaggugaucaguuagaagagguuccuaggaguucccgaggaccugagccccccuuucacacagcuuagagcugaagggcuggguucuggucaccuggguuugggguugagguauugagccgaguagcugaaagccuucuggccuuucugcaguuggagagaggagggccaugcaccucccagggcucgcuccucccagcagggcagaaccgccccugcagcauggcaccuggggcccuggggacggccaccaggccgauguggccagaccaguugccagaaaaguugccuggagcguccgugcaggaagccagggccugugcaccccuggugugcccuuagggcacugcccucuccggucucggacaggugccucccgagcagacgagggucaacgucucaucucaguccugauguuacaggaaagggauucagauccagaccucaagggaggguucuuggaucuuguguaagaaagaacucagggcgagucugcagcgcacagugaaagcaaguuuauuaagguaaagcggugaaagaauagcugguccguagacccaguagcauguuccuguaagaggaggaacgcguccacccuaggugcaaugcuuguauauauggggagaugugaucugcuacaaggguuugugauaaaggaguaauuuucuuaauuacuauauuuugcaagaaucaauauuacuauuuucuuuuuuuuuuuuuuuuuuuucagacggauucucacucugucgcccaggcuggagugcaguggcgugaucucggcucacugcaaccuccgccuuccggguucacgccauucuccugcuucagccuccccacuagcugggacuacggcgccagccaccacgcccggcuaauuuuuuguauuuuuaguagagacgggguuucaaaaucaggaaugccuuuguucuccagacaucgggauaucuggacacucccaagucugggucucuuuaguaaacauuauuaauuuguucccuuaacuguguuugaaacgcuuguuccccggugccguaaagaaauagcacgugaacauaaauuuaauuuccucagcaaggccauuuuuacuuccugcagaaaggguacacucgccagcagcuuugccaugagaguacaccgaacaaaggagacaggcucauuuauaaccugauguguaacaaucgcuuuuauuuaaagugcgaacggaauauuuaauccauuucagccagggauuugcaucuugauacucucucgauggcuaaggucuguuuuagaucucuuauuuuuacaauagacacccuaguuuuauuauuagauguagaagcaaccggugugagaucuagaacugaggcuacugaagaagggggagaugggggaauaaugcguauuuaaaaaauaccuagggggucuuuuccauuuaugucaauccccauaccacagaagcgacugagggcaggucuagaguuaguuaagguggagguggugauagagaaggacaggguuacacugauaaggcugacaguucgaaaggguaguccuuucagugaaauagaugagggguuuuagaucugcacagaccuuuuucuuggaaguuuaacuuugcuccugagcaguugaauguguauagucccguuuacuacaaaguuggcaggcuauaggagcagaacauuggcaucuuggcugcaggucauuacgauaaugagagcuagggguaaccauguccaucagagggcugggacguaagcauuugugugaaaaggcuagcuguuguugaucuuuuacauuuccgcaagguaugacagaacaagcauucaaggcgguggucugaggugaguuaguuacaguaauaacaaaggcgcuaguaacaauaaggaaaggaagcaauaugaagguacaggaaaauuaagcuuucuuuaacuuuaacuuaguaggauugguccuaguacagucauccaugauucugagagaaagauguuuucuugacuggaguguggucguuuuuuucuuggcucugcggauggcagucucagugguuaacagcauaaaauaggguucuucccaggcuggcucaaguuuuuucuuucugucuuuugaugaggacgugguuuucaggcuggugcugguguacuggaaauucuaggggugguaccuagaacuaaaagucuuuuaguucugagggaagggaaacuggaagauaaauuaaguauaucauuuuugcugcauauccuggggcuugaggccccauggugaugccucccgcuccauuccugcucagcgccgcccaggggacacugcggcccugccuccucuuaagcucuuggccuucuuggggccuucacugccccugugcacuguggccuuggacaugaggggccuugugacuuaccuggccaccuucaggccuuaagaaagcuaaacaccauuuuauauuugacagugcuuuuuguaugauuuuauaccagauaaguuaaauuuuaccuuuauacuaaugugcuauuaauguuaaacuuaauaaaaucuuuuuuuuuuuuuuuugagacagagucuugcucugucgcccaggcuggagugcaguggcgcaaucucagcucaccgcaagcuccgccucccggguucacgccauucuccugccucagccuccugaguagcugggacuacaggcgcccgccaccaugcccagcuaauuuuuuguauuuuuuaguggagaugggguuucaccguguuagccaggauagucucgaucuccugaccucgugauccgcccgccucagccuuccaaagugcugggauuacaggcgugagccaccgugcccggccaaacuuaauaaaaucuuguagacauuauuuauucaauuuuaaugucugacuauaggguaagauuuuuauagacucuuuuuaagcuuuuauaauuuuuguuaaagagcggguuagugcuuuaagaaaaaucuauugugcuuuuaacauccaguucacagaaaaacugcaugauaccccuuuagcuuuagccaauauguuuacacacagaauuuccuuuacaauuaacauuuuaaaacuugcuuaaaccuuuaaaacaaaauauauuuuuuaaccuuuuaauguagguaaaaauccauauuaugucuccuuauaauccuguuauuaaaaguauuauuuuauuuuucugacauaccuuguauauaaacuguuuuuuuuuaaauaauuuuacauucaggaggccuaauuacuuuuaaauuauacacuauuucuugcauaaauucccuuuuauagcuuuucuuacaacuuucacaaucuucaacaugucuuaacuuucugccugccuuuuacgcuauuucuuuuucucaguuucacccucuaugucuuccuuugauuucugucucuuccaguuucucucuuauucuuucccucuguauuuuaaucucuuucugucucuucucucucuucacucucuucauccccugcuuccuucuucccuccugaguucucccgcuccugcagcagcagggccgggcaauggcaccagccccugggcaugcacugccgucaguuucucuauccacccccaccauuccccuuuuuacuuuuuuuccccuuucuuccuacacuuaguuucucgggcugggugggauuugcauggcugcaguccggccccggcagcccagaggcuuggcagaugccugccacaaauugcaagaauuaugcccucucaccuccucugcucucuuccuggcgccgcugugcuugcuguuuuugcuuucuuuuuuucugacuuccucuccuaguucuuuuuccugucugcuggucuuuccuuugucucugccagccaccuaugcugcuguuuuccccccucuccuuccccuuccccugggggaccaaccagcgggagugaagcuuagccuuuuucuuucccugugaagaggggaaaagggaguuuugaauauauauauauauauauauauauauauauauauauauauauauauuuuaacuacuggagguuugugugagguucaacccccugaaauuaauggaagacuuaaccccucaaaccaggggugucuugccuugccugcccugggagguugaccuguuuccuccuuuccccccaaaggucccuugcauacuucccacuuguguuguccucucuggucgcccccccaagggagaauuaggccccucuuaguguaggcgugcugguauaaaucccacagcaggaccugcccuaagccauaugaggucacuacagaaccggaaccauggaggggacccacucacuguccagcaggaggacuugucaccguccacacaaaccacacugcaagcaggguugucugugaucauucacacauacacacauucagcccuccagaauuucaccaccaaggaaguacuuuaccagcuucuguggcuucuccuuccuuggucugugcacagaguugcagcccugguaugugagcauccuuuaccuuagguugcuggccaguuucuuuuuuuuuuuuuuuucugcauugcugagaguccggguuuauucgucacaccaggugggucucaauuucucaucccugaggccacugcagugaggcagaggagcgugcucccucaugagagaggaacagagaccgcccccgcaggagaauguagcccuguacggauugccaccaaauuguuugaaaugcuuguuccccggugccguaaagaaacagcaguugaacauaaauuuaauuuacucagcaaggacauuuuuacuuccugcagaaaggacacacuugccaucagcuuugccacaagaguucacccaacaaaggaaacagggucauuuauaaccugacgcguccacccuauugccgucucugguuuccauugacugggaugggaccucacauucuguaucugucccgauuggcuagcaacguacaacuuuuuaaaagaggcaaaggcagaggagaacaaaggaaggaaguaauuuguggaaugcugagaaagguaaaaacaccuucaaauaaggaagaggaacaggcuaugaccuaaugcccgcuuggaccaguauaagcaugccagggcaaauauuuaggcuaaauugugggagcuaagaaccuaaaguaguacauugcuuucuuuauuacugcuagcagauauuuaauaauguuagcacaggucuuugaauaaauuuugcuucuaagagaaguuacuauuuauuccuaauuagaucgguaggaaagucuuugaagaggaaccucuacuuuacaacuaaacaucuagaggcucggaaugccucuuucuggggaugcagcccagcaggccccagccucauuucccagcccucacucaaaauggagucgcucugguuccagcgccucugacacugagaggucaugucaggaauggggaaacugaggcucagaggagcuauggcacugcacaaagcuacacggcucccuggucuucuguuucuguugagucaugugaaccaaaaaguaucggagauaugucucagucaauuuagaaaguuuacuuugccaaggauaaggacucaccaguccugacaacaugugcccaagguggucggggcacagcuugcuuuuauacaucucagggaggcacaauacaucugucaguacauguaagauucacauugaugccaucuggaaggggggcuuucaggucaugguagauguaaaaguuuucugauuggcaguugguugaaagagcuauuaucaguagaaaggcaugucuggguuaagauacugguuguggagaccuagguuuuauuaugcagaugaagccuccaggcugcaggcuucagagggaauagaucauaaauguuucuugucggacuuaaggucuguguuguuaaugcuggagggcauaacaggccugucccacacccucuucuaucauggccugggcuagucuuucugguuaaauguggagggcccuggccuauuggaggaaguucauucagaugguuggggguaccuuccgauguuauuuuugguuuacagucaggaacccccuaaaaggccuagaucucucucuguccccaggugcuggacucuaugucuuucaugcaucuagaguccagaggcaaaggccaccaaggcugagagccgggcacggaggccgaggagauggggagccaggguugcuuuucugggaaagagggagugauaaaaucaggcaugggcugguuggugaggucccugugggaggugaaggcugggacccagaacagcagagacucugucgaugauguggaaagaccgcggcugcaguuugggcaggcugagccaggguugggucuugcauguugagaggcuggccugcggugauguggccaaagaggaagagcugggcuggggugaguguuggucacaugguugaaacuagguggggaggggagugguccaggggagaguccaggcccagcucugcugggacuugccaugggggucacgacucaucugcagggaaggucugggcuuuaucucugagcaccucugugugcugcucacccugaagugggggugggccugugccuggccuguccccucauccugggagcucccaaugcccaucugcaaggcuguggaccccucaggaguggccuggagccuggcucccauugccacaugguggcuguguguguggagaggguugauaguggaguggucaggcccaggcugcccugggggaugaagugccauccucugggugcccuggagaaagaagagaacucagugagcccugucugguacuuuccuggaggagggcucccaugcuggcccuccaccccucuguccccugucacccugaggccucuggauuuccucucugcccuucccaaccugccaacuucacggguuucuggcuggguucuggggauggccccuaggggagacgggccaggcacaagcggggcugugucaaggug

SEQ ID NO: 20112 - RNA, 8477 nt, Homo sapiens
caccuugacacagccccgcuugugccuggcccgucuccccuaggggccauccccagaacccagccagaaacccgugaaguuggcagguugggaagggcagagaggaaauccagaggccucagggugacaggggacagagggguggagggccagcaugggagcccuccuccaggaaaguaccagacagggcucacugaguucucuucuuucuccagggcacccagaggauggcacuucaucccccagggcagccugggccugaccacuccacuaucaacccucuccacacacacagccaccauguggcaaugggagccaggcuccaggccacuccugagggguccacagccuugcagaugggcauugggagcucccaggaugaggggacaggccaggcacaggcccacccccacuucagggugagcagcacacagaggugcucagagauaaagcccagaccuucccugcagaugagucgugacccccauggcaagucccagcagagcugggccuggacucuccccuggaccacuccccuccccaccuaguuucaaccaugugaccaacacucaccccagcccagcucuuccucuuuggccacaucaccgcaggccagccucucaacaugcaagacccaacccuggcucagccugcccaaacugcagccgcggucuuuccacaucaucgacagagucucugcuguucugggucccagccuucaccucccacagggaccucaccaaccagcccaugccugauuuuaucacucccucuuucccagaaaagcaacccuggcuccccaucuccucggccuccgugcccggcucucagccuugguggccuuugccucuggacucuagaugcaugaaagacauagaguccagcaccuggggacagagagagaucuaggccuuuuaggggguuccugacuguaaaccaaaaauaacaucggaagguacccccaaccaucugaaugaacuuccuccaauaggccagggcccuccacauuuaaccagaaagacuagcccaggccaugauagaagagggugugggacaggccuguuaugcccuccagcauuaacaacacagaccuuaaguccgacaagaaacauuuaugaucuauucccucugaagccugcagccuggaggcuucaucugcauaauaaaaccuaggucuccacaaccaguaucuuaacccagacaugccuuucuacugauaauagcucuuucaaccaacugccaaucagaaaacuuuuacaucuaccaugaccugaaagccccccuuccagauggcaucaaugugaaucuuacauguacugacagauguauugugccucccugagauguauaaaagcaagcugugccccgaccaccuugggcacauguugucaggacuggugaguccuuauccuuggcaaaguaaacuuucuaaauugacugagacauaucuccgauacuuuuugguucacaugacucaacagaaacagaagaccagggagccguguagcuuugugcagugccauagcuccucugagccucaguuuccccauuccugacaugaccucucagugucagaggcgcuggaaccagagcgacuccauuuugagugagggcugggaaaugaggcuggggccugcugggcugcauccccagaaagaggcauuccgagccucuagauguuuaguuguaaaguagagguuccucuucaaagacuuuccuaccgaucuaauuaggaauaaauaguaacuucucuuagaagcaaaauuuauucaaagaccugugcuaacauuauuaaauaucugcuagcaguaauaaagaaagcaauguacuacuuuagguucuuagcucccacaauuuagccuaaauauuugcccuggcaugcuuauacugguccaagcgggcauuaggucauagccuguuccucuuccuuauuugaagguguuuuuaccuuucucagcauuccacaaauuacuuccuuccuuuguucuccucugccuuugccucuuuuaaaaaguuguacguugcuagccaaucgggacagauacagaaugugaggucccaucccagucaauggaaaccagagacggcaauaggguggacgcgucagguuauaaaugacccuguuuccuuuguugggugaacucuuguggcaaagcugauggcaaguguguccuuucugcaggaaguaaaaauguccuugcugaguaaauuaaauuuauguucaacugcuguuucuuuacggcaccggggaacaagcauuucaaacaauuugguggcaauccguacagggcuacauucuccugcgggggcggucucuguuccucucucaugagggagcacgcuccucugccucacugcaguggccucagggaugagaaauugagacccaccuggugugacgaauaaacccggacucucagcaaugcagaaaaaaaaaaaaaaaagaaacuggccagcaaccuaagguaaaggaugcucacauaccagggcugcaacucugugcacagaccaaggaaggagaagccacagaagcugguaaaguacuuccuugguggugaaauucuggagggcugaauguguguaugugugaaugaucacagacaacccugcuugcagugugguuuguguggacggugacaaguccuccugcuggacagugaguggguccccuccaugguuccgguucuguagugaccucauauggcuuagggcagguccugcugugggauuuauaccagcacgccuacacuaagaggggccuaauucucccuugggggggcgaccagagaggacaacacaagugggaaguaugcaagggaccuuuggggggaaaggaggaaacaggucaaccucccagggcaggcaaggcaagacaccccugguuugagggguuaagucuuccauuaauuucaggggguugaaccucacacaaaccuccaguaguuaaaauauauauauauauauauauauauauauauauauauauauauauauucaaaacucccuuuuccccucuucacagggaaagaaaaaggcuaagcuucacucccgcugguuggucccccaggggaaggggaaggagaggggggaaaacagcagcauagguggcuggcagagacaaaggaaagaccagcagacaggaaaaagaacuaggagaggaagucagaaaaaaagaaagcaaaaacagcaagcacagcggcgccaggaagagagcagaggaggugagagggcauaauucuugcaauuuguggcaggcaucugccaagccucugggcugccggggccggacugcagccaugcaaaucccacccagcccgagaaacuaaguguaggaagaaaggggaaaaaaaguaaaaaggggaaugguggggguggauagagaaacugacggcagugcaugcccaggggcuggugccauugcccggcccugcugcugcaggagcgggagaacucaggagggaagaaggaagcaggggaugaagagagugaagagagagaagagacagaaagagauuaaaauacagagggaaagaauaagagagaaacuggaagagacagaaaucaaaggaagacauagagggugaaacugagaaaaagaaauagcguaaaaggcaggcagaaaguuaagacauguugaagauugugaaaguuguaagaaaagcuauaaaagggaauuuaugcaagaaauaguguauaauuuaaaaguaauuaggccuccugaauguaaaauuauuuaaaaaaaaacaguuuauauacaagguaugucagaaaaauaaaauaauacuuuuaauaacaggauuauaaggagacauaauauggauuuuuaccuacauuaaaagguuaaaaaauauauuuuguuuuaaagguuuaagcaaguuuuaaaauguuaauuguaaaggaaauucuguguguaaacauauuggcuaaagcuaaagggguaucaugcaguuuuucugugaacuggauguuaaaagcacaauagauuuuucuuaaagcacuaacccgcucuuuaacaaaaauuauaaaagcuuaaaaagagucuauaaaaaucuuacccuauagucagacauuaaaauugaauaaauaaugucuacaagauuuuauuaaguuuggccgggcacgguggcucacgccuguaaucccagcacuuuggaaggcugaggcgggcggaucacgaggucaggagaucgagacuauccuggcuaacacggugaaaccccaucuccacuaaaaaauacaaaaaauuagcugggcaugguggcgggcgccuguagucccagcuacucaggaggcugaggcaggagaauggcgugaacccgggaggcggagcuugcggugagcugagauugcgccacugcacuccagccugggcgacagagcaagacucugucucaaaaaaaaaaaaaaaagauuuuauuaaguuuaacauuaauagcacauuaguauaaagguaaaauuuaacuuaucugguauaaaaucauacaaaaagcacugucaaauauaaaaugguguuuagcuuucuuaaggccugaagguggccagguaagucacaaggccccucauguccaaggccacagugcacaggggcagugaaggccccaagaaggccaagagcuuaagaggaggcagggccgcaguguccccugggcggcgcugagcaggaauggagcgggaggcaucaccauggggccucaagccccaggauaugcagcaaaaaugauauacuuaauuuaucuuccaguuucccuucccucagaacuaaaagacuuuuaguucuagguaccaccccuagaauuuccaguacaccagcaccagccugaaaaccacguccucaucaaaagacagaaagaaaaaacuugagccagccugggaagaacccuauuuuaugcuguuaaccacugagacugccauccgcagagccaagaaaaaaacgaccacacuccagucaagaaaacaucuuucucucagaaucauggaugacuguacuaggaccaauccuacuaaguuaaaguuaaagaaagcuuaauuuuccuguaccuucauauugcuuccuuuccuuauuguuacuagcgccuuuguuauuacuguaacuaacucaccucagaccaccgccuugaaugcuuguucugucauaccuugcggaaauguaaaagaucaacaacagcuagccuuuucacacaaaugcuuacgucccagcccucugauggacaugguuaccccuagcucucauuaucguaaugaccugcagccaagaugccaauguucugcuccuauagccugccaacuuuguaguaaacgggacuauacacauucaacugcucaggagcaaaguuaaacuuccaagaaaaaggucugugcagaucuaaaaccccucaucuauuucacugaaaggacuacccuuucgaacugucagccuuaucaguguaacccuguccuucucuaucaccaccuccaccuuaacuaacucuagaccugcccucagucgcuucugugguauggggauugacauaaauggaaaagacccccuagguauuuuuuaaauacgcauuauucccccaucucccccuucuucaguagccucaguucuagaucucacaccgguugcuucuacaucuaauaauaaaacuagggugucuauuguaaaaauaagagaucuaaaacagaccuuagccaucgagagaguaucaagaugcaaaucccuggcugaaauggauuaaauauuccguucgcacuuuaaauaaaagcgauuguuacacaucagguuauaaaugagccugucuccuuuguucgguguacucucauggcaaagcugcuggcgaguguacccuuucugcaggaaguaaaaauggccuugcugaggaaauuaaauuuauguucacgugcuauuucuuuacggcaccggggaacaagcguuucaaacacaguuaagggaacaaauuaauaauguuuacuaaagagacccagacuugggaguguccagauaucccgaugucuggagaacaaaggcauuccugauuuugaaaccccgucucuacuaaaaauacaaaaaauuagccgggcgugguggcuggcgccguagucccagcuaguggggaggcugaagcaggagaauggcgugaacccggaaggcggagguugcagugagccgagaucacgccacugcacuccagccugggcgacagagugagaauccgucugaaaaaaaaaaaaaaaaaaaagaaaauaguaauauugauucuugcaaaauauaguaauuaagaaaauuacuccuuuaucacaaacccuuguagcagaucacaucuccccauauauacaagcauugcaccuaggguggacgcguuccuccucuuacaggaacaugcuacugggucuacggaccagcuauucuuucaccgcuuuaccuuaauaaacuugcuuucacugugcgcugcagacucgcccugaguucuuucuuacacaagauccaagaacccucccuugaggucuggaucugaaucccuuuccuguaacaucaggacugagaugagacguugacccucgucugcucgggaggcaccuguccgagaccggagagggcagugcccuaagggcacaccaggggugcacaggcccuggcuuccugcacggacgcuccaggcaacuuuucuggcaacuggucuggccacaucggccugguggccguccccagggccccaggugccaugcugcaggggcgguucugcccugcugggaggagcgagcccugggaggugcauggcccuccucucuccaacugcagaaaggccagaaggcuuucagcuacucggcucaauaccucaaccccaaacccaggugaccagaacccagcccuucagcucuaagcugugugaaaggggggcucagguccucgggaacuccuaggaaccucuucuaacugaucaccucuccaaccuauauucaggaccaaggaccagagaggucaacacuccagccacagaacagaguaccaggagagaggagaggggugaacacgaaaccgugaggggccagguuaagaaauggcaggagggaagcacgcuaagcccgacuaugaagaguugauucggggacccuaggaacccccacgaacaaaggcaucagugaggaaugcccccgguagagagggaggggcgggagcgguaagaggcaggacuccagcaguauccgaaagaggugcaggcagcgggccuucccuaggggagggggccagggacuaggaggagcccccggaggucccacaaaggccgugcuccggggccaggggcgggggccgcucacccugcgcuggcacaggugcugcacgacgcgcucgggugaggugcccagcaggugcugccggaagcgcagcagcgcgcacacgaagccgucccgcaggcugacaaagcgcgccuccagguagaacgcgcggucgucccagcccagcaggcgggugcgcaccucgaagggcuccagcaggcgcagcgagcggcgguggcgcgcgcacgaggccgccagcaccgugugcgcccgcaacucccucagcgccccgagcaccccgcagcgggucaggugcgcgacgcgcgcaaagucggccucgcgcagguagcgcgcguuguucaugugcagcagcagguccaaguccgagggcagcacgcggcccgggaagcgcugcucagcuagcaggucacggacgcgcggcugcagcaggcgcgcgcgcagcacggcgcacggaaggcgcaccagguaccagacguccagcagcgcaaagacagcgagccccagggccagcaacgccaccagcagccccagcauagcggcggcggcgggcgcgggguccugcggaguccguggcgccggugccgguguccgcggcgcugguuacggugcccgccaggccuccugggaacucacgagcgcagcgcgcccggagcgaaccacagcgcgagggcggccgagggggaggggcccggagccccgcccaccguggcgcgaccuucucagcgcccuacgugguccgucccgccguccaggcccgcgccacuuucgcguucccuggggcggggcgggcggcgcgcugagcgccacagcggcaccuggcggccgugcgcggcgcugcaggcgcgagggugcacgcgcgccccggcgucuccgccuucccagcagcgcgagacccucgccaggcucugaagacgcggccuggcccuggccguucggcccuucgucugagcgcaaaggcuccagcaccuccgcggccgaagccgcgggacuuuucguggaaaaugggacccagcccgaucgccagcggcgcugcagcggacucugcgggaaccuagcuucugcuccaggaccuccagggccaccccagcucgcagggcguucgcagcggcucagggcgaaucacgcucaugguccccgugcgcauuuucagccccagccgguaccuccuuacucgcccucacgacauucauuccacccccuaa

SEQ ID NO: 20113 - RNA, 3135 nt, Homo sapiens
uccgggaaucagcaccaggugggggaugggagggguggggggggggugggaggggugcgggggugggggaagauugcuggcaggguggaagagcccgggugaguucuggaggaaggaugcuuggaguagguucagggcaggcagcaggaugcaggggaaggaucugaggggacagggagccucccggaaaaggagagugcccagccuguccuauaacccccaugacccccacaagggggucagccuggaucuggucucuggcagccaggaggagagcugggcuguggggaugcaggcccuaagagaaggaggggcaccucuuaucuggcuguuagaaggucugagggauggcacugagcagcaggagaggggacucaccuuucuggucucagagucaaagggcucuggcgucggggucuuggccuuuuggaccuccuccggggguggggccagcacacggggcagccccaggggucgaguggcugcaaaguucaucaguggguagauuccauuccuggggacacaacaggguggcuggggguucaggccugacagcugccuggcccccaaccuuacaucaguucucaccugacauccuccaggaauuuguccagcuccaugaaggagacuuccgaguaccuggcauggaagugggaggcacaugaggggcuggccggggcgaggggaggggaggugcggggaggggagguguggggaggggaggcuucugggugcugacugcucaccgccacugcagcgggggccugcggggccggggaagcuccgccaagaccgcgugcagguccauggccuuggucuucuccuccaccacauucucaggcaugaggucugcggccacaagagcaucaaggcggugugcucaggccguggguccugcagggccccuuccacgucccaaccuccaccuccccagccaccccccgggccggccugcugcucacacuggugcuggaugaagcagugggcugccaggagcuucagcgagugcaccucgaagagcacgcgguggaagaggaggcugugggcagagggccggcgggcagggucccgggccaggcagcaaaggaugaacuccuggggcacagggaggagaggcugguggugugcaagggcucucugcucuggccccgcaguucgaggagagguggccccugaguuccccaugucccuccucagggacacacaggacaugcagggaugcccauagggaggagucccagcagcagcagccaggccaggaccugguccucugagcuugaggacagcuggguucugggauuggagcaccaugcucugcuucccucgacccccaaaaaaucguggggagaagccaugauccuaaagucacaccugcaagccuccuacccauggccuuuugaucggcucagcucgggcccaacacuggagacgaccuugauggguccccacucuguccacauccgugcccagcccggcuccagcucgccaccagccccgaccaggcacccccaucuccugaggccauggaguuaagucuagacuccgagcagagggggcuguggaugcagcuuccaucccauaccucuuuuugccugcuuggcacccaccauguccccccacaagcuggagccucaucaccuccuggaagcuuaaagucaaggacuuggagugaagcagacccaggugcagauguuggcuccaccacucacucuaaagccuugggcaaaggacucaucuccucugaaccuugguuucuuuauaaaacgggcauggugauggcagccacagagggagggucucucuugccuucuuguccuuagaaugugcugaccccuuagggccuucaggccuggaaccaguaugugcucccacugagguccucuuugggaggggugcagucagcugguauaccccucaacugcacaaacugugauguucucccaggucugccuggagcaccuugcuagcccuagcugagcacggugagccagcuggggaggggcagggcaagcugcuuacccgcauguuggggucacucagcgagugccuggcgcgagcaauggccuccucugugacccggguguccccauuggucuggauuuccaguacagccaucuggggcacagagccaggucaggcauggggaagggaccacacaggugagccaggcagggcacaguuaggaggagggcagagcacaagguggagggcgggggcaguaccuccagcgcacacaucccaaaggagaagauguccacagcggucccaucggccaccucugaacagaagagagcacaggacacguaggagagaagcgcaggguaggcacggggcacccggacccagcaccacucaccuccauacucuggggggaagaagugcagguuccgaaguuccucucgcucagcgcggauggggcuucggagaucaucuggaagugcugugggagggcgcagagcugagcgggcggggaccucuccaggaccccguccccccaaaguccgcacuuaccauuggagaagauucggugccacacugccaaggggcgggagaaagaguggaguuagcugcuggggcaucagaacuccucugcccuuggcuccaggcaccuuccccugccccguucccccacccagcccugccccgccagcaccggagccgaucuugaugaggccguugugcugaaugaagauggugucgcuggucagguucccguggaugauuggggggcugcaggcgugcaggaagcugcagacguuggggaggggagaguaggaggagccggucaggaggcucuggagagaugggggcucgguggcgccgcgcccaggccagcccaggcccucaccugagcgcagacaggaucugcgugcaccagcgcuuccaggccuggcggcggacgcacgacuccgucggucgggugggcgcaggagaggcggcugggccugcggagcccgccccgcauccucgcccagccccuguccgaggccgccgggcacccccucaccaucccaguccccgaggcugccccaaccccguccuguccccguggcugccccagcccgcuccccauacccgggcguucauggccuugugguucuucuuggucuuuuugaggaauugcuugaggcugcc

SEQ ID NO: 20114 - RNA, 3135 nt, Homo sapiens
ggcagccucaagcaauuccucaaaaagaccaagaagaaccacaaggccaugaacgcccggguauggggagcgggcuggggcagccacggggacaggacgggguuggggcagccucggggacugggauggugagggggugcccggcggccucggacaggggcugggcgaggaugcggggcgggcuccgcaggcccagccgccucuccugcgcccacccgaccgacggagucgugcguccgccgccaggccuggaagcgcuggugcacgcagauccugucugcgcucaggugagggccugggcuggccugggcgcggcgccaccgagcccccaucucuccagagccuccugaccggcuccuccuacucuccccuccccaacgucugcagcuuccugcacgccugcagccccccaaucauccacgggaaccugaccagcgacaccaucuucauucagcacaacggccucaucaagaucggcuccggugcuggcggggcagggcugggugggggaacggggcaggggaaggugccuggagccaagggcagaggaguucugaugccccagcagcuaacuccacucuuucucccgccccuuggcaguguggcaccgaaucuucuccaaugguaagugcggacuuuggggggacgggguccuggagagguccccgcccgcucagcucugcgcccucccacagcacuuccagaugaucuccgaagccccauccgcgcugagcgagaggaacuucggaaccugcacuucuuccccccagaguauggaggugaguggugcuggguccgggugccccgugccuacccugcgcuucucuccuacguguccugugcucucuucuguucagagguggccgaugggaccgcuguggacaucuucuccuuugggaugugugcgcuggagguacugcccccgcccuccaccuugugcucugcccuccuccuaacugugcccugccuggcucaccuguguggucccuuccccaugccugaccuggcucugugccccagauggcuguacuggaaauccagaccaauggggacacccgggucacagaggaggccauugcucgcgccaggcacucgcugagugaccccaacaugcggguaagcagcuugcccugccccuccccagcuggcucaccgugcucagcuagggcuagcaaggugcuccaggcagaccugggagaacaucacaguuugugcaguugagggguauaccagcugacugcaccccucccaaagaggaccucagugggagcacauacugguuccaggccugaaggcccuaaggggucagcacauucuaaggacaagaaggcaagagagacccucccucuguggcugccaucaccaugcccguuuuauaaagaaaccaagguucagaggagaugaguccuuugcccaaggcuuuagagugagugguggagccaacaucugcaccugggucugcuucacuccaaguccuugacuuuaagcuuccaggaggugaugaggcuccagcuuguggggggacauggugggugccaagcaggcaaaaagagguaugggauggaagcugcauccacagcccccucugcucggagucuagacuuaacuccauggccucaggagaugggggugccuggucggggcugguggcgagcuggagccgggcugggcacggauguggacagaguggggacccaucaaggucgucuccaguguugggcccgagcugagccgaucaaaaggccauggguaggaggcuugcaggugugacuuuaggaucauggcuucuccccacgauuuuuugggggucgagggaagcagagcauggugcuccaaucccagaacccagcuguccucaagcucagaggaccagguccuggccuggcugcugcugcugggacuccucccuaugggcaucccugcauguccugugugucccugaggagggacauggggaacucaggggccaccucuccucgaacugcggggccagagcagagagcccuugcacaccaccagccucuccucccugugccccaggaguucauccuuugcugccuggcccgggacccugcccgccggcccucugcccacagccuccucuuccaccgcgugcucuucgaggugcacucgcugaagcuccuggcagcccacugcuucauccagcaccagugugagcagcaggccggcccgggggguggcuggggagguggagguugggacguggaaggggcccugcaggacccacggccugagcacaccgccuugaugcucuuguggccgcagaccucaugccugagaaugugguggaggagaagaccaaggccauggaccugcacgcggucuuggcggagcuuccccggccccgcaggcccccgcugcaguggcggugagcagucagcacccagaagccuccccuccccacaccuccccuccccgcaccuccccuccccucgccccggccagccccucaugugccucccacuuccaugccagguacucggaagucuccuucauggagcuggacaaauuccuggaggaugucaggugagaacugauguaagguugggggccaggcagcugucaggccugaacccccagccacccuguuguguccccaggaauggaaucuacccacugaugaacuuugcagccacucgaccccuggggcugccccgugugcuggccccacccccggaggagguccaaaaggccaagaccccgacgccagagcccuuugacucugagaccagaaaggugaguccccucuccugcugcucagugccaucccucagaccuucuaacagccagauaagaggugccccuccuucucuuagggccugcauccccacagcccagcucuccuccuggcugccagagaccagauccaggcugacccccuugugggggucauggggguuauaggacaggcugggcacucuccuuuuccgggaggcucccuguccccucagauccuuccccugcauccugcugccugcccugaaccuacuccaagcauccuuccuccagaacucacccgggcucuuccacccugccagcaaucuucccccacccccgcaccccucccaccccccccccaccccucccaucccccaccuggugcugauucccgga

SEQ ID NO: 20115 - RNA, 2551 nt, Homo sapiens
aagccaggacugccggcccagggaccccgucugucccaccucuccgggguccuggccggcucucccucuggccugcagaacgugcgcuccauuuugauguugacccccucuggccuucugguuccuccaacaagcccugaagacgucucccucccccaguucccuccggccucaccagcaccucccucagcucuccggccacccacuggacuugacccugcccucccugcuccuccaugcacucugcuucuccuccgaacucccucucaccauccugcacccuuggguccuacccuguucaacauugcccucuccugcucacacccuaaccccuuucagggccuucccaagccccugaacugugcagagagggccagggcguccacuuucacagggacgagcugcaggagggcagcaucacuuauaccgguagcugcaguugcuccccaggcacaagauggaucucauaaccucaaagucacaaaugcacgccccucgcgacgcucugccuccuucagggcuacacccagucucccagcaugaucagcccuugugugcccucacagggugggcugcacacugaugugccgaacucaccaccuccucacucacgcagggucacacaugcagucaccccggacacacucucaagucacauggugcacagcggccucagagucacauggucccauguaguggcacacaggcaagcacacacacacacagggucacacacaagcgcacacggucacauggccacacacagucacauggacccacacaggcucacacuccugcaggucacacuugcucugccaccccaugcugcuggcacuccugucccccucuccugcaugcugacaguuguccuugaacuugggcacccuuacacaaagagccucccccugccucccacaccuugggcgucccuugcucacagccuccucccugcuuccucucccugacccaggcuucagggaagagacugcugcugccucugcuggcccucugcucugacaggugggcggcccuguuggacccccugccuacucccuggagcucccugcauuccccagcuaacccuagcagguguccuggugcagucaaggaagaggagaggguggcgaggcggcccuggucucuugaguguaggucugugugugccggcauggcugggucccgucauggcagcgcccaugcggcugugucugucccagcaugggucaggauguggguccaugugugcguuuggguaccucaguuccugauccucuuccccacccucuguccaacgucgacacucucccugcccagccuuggccucuguguuccccuuccuccccucuaccguccaggcuccagccacagacucuugccguuucugguucccuucagucuguuuccccgggcccugcccuccgcccccacacucuggcccuccaccgcuuccagcaaagccccaggccccgcgcccuggucucagaccagcgcucaccuuuaucgugcaguggcgcgccgaggucgcugcgggcgcguccguaggcgcucuccaggucggccgaagagaacgcgucaaguuugaccuucuugaccaggaaggaccugggcaugauuccugcggggcuccggcgcugugggccugcggagccggggcuugggggggcugcggcggcagggccccgucaccauccgaggagcggcggaggcagcgcggguccccacucuggccuuuggaugcugccgcgcgagugguguccucucuccuugcugcccugcgucuccuccguugccccuccggaucccucuucuuccuccuuccuucaauccuuccuuccuuccuucaauccuuccuuccuucucuccucuucucuccucuccucuuccuuccuucccuccucuggucccggcuucccagcccgcagugccgccccuggacaggcgggggaggaggcugggggggcggagagggggggagcggcuccgucccgggccuggaggcugcgagugggugcagggcuggcccggcucgguggcccccuuccccuccccccccccgccgccgcggcggagccucagucagcggccccccaugcccccgggggcggcggcgccgggcccggagaacgcgguggcagcggcagcgccggcagcuucagcaccgcggccagcgccggccugggcagcaccgcggccagcgcccgggcgcgcucaaccggcgcgggcggagaggggcgguccgcggggguuuggccgccgggcagggguccucggcgggggucucugggaggcuugcuuuauuguucugcagccggagcgagcggcaguggcgacggcggcggcggcggcggcggcggcggcgggcggggggcggggguccuggggggaggggugcgcagggagggcgggccgagggagggagggagggagggacaggggcuccgggggcggggcucggcgcucggacugcuccugggcccggccuccagagcccgcagccgccucugccugcggcccggcccagccucuggcuuuuaaagcccaggagcugggg

SEQ ID NO: 20116 - RNA, 2551 nt, Homo sapiens
ccccagcuccugggcuuuaaaagccagaggcugggccgggccgcaggcagaggcggcugcgggcucuggaggccgggcccaggagcaguccgagcgccgagccccgcccccggagccccugucccucccucccucccucccucggcccgcccucccugcgcaccccuccccccaggacccccgccccccgcccgccgccgccgccgccgccgccgccgccgucgccacugccgcucgcuccggcugcagaacaauaaagcaagccucccagagacccccgccgaggaccccugcccggcggccaaacccccgcggaccgccccucuccgcccgcgccgguugagcgcgcccgggcgcuggccgcggugcugcccaggccggcgcuggccgcggugcugaagcugccggcgcugccgcugccaccgcguucuccgggcccggcgccgccgcccccgggggcauggggggccgcugacugaggcuccgccgcggcggcggggggggggaggggaagggggccaccgagccgggccagcccugcacccacucgcagccuccaggcccgggacggagccgcucccccccucuccgcccccccagccuccucccccgccuguccaggggcggcacugcgggcugggaagccgggaccagaggagggaaggaaggaagaggagaggagagaagaggagagaaggaaggaaggauugaaggaaggaaggaaggauugaaggaaggaggaagaagagggauccggaggggcaacggaggagacgcagggcagcaaggagagaggacaccacucgcgcggcagcauccaaaggccagaguggggacccgcgcugccuccgccgcuccucggauggugacggggcccugccgccgcagcccccccaagccccggcuccgcaggcccacagcgccggagccccgcaggaaucaugcccagguccuuccuggucaagaaggucaaacuugacgcguucucuucggccgaccuggagagcgccuacggacgcgcccgcagcgaccucggcgcgccacugcacgauaaaggugagcgcuggucugagaccagggcgcggggccuggggcuuugcuggaagcgguggagggccagagugugggggcggagggcagggcccggggaaacagacugaagggaaccagaaacggcaagagucuguggcuggagccuggacgguagaggggaggaaggggaacacagaggccaaggcugggcagggagagugucgacguuggacagaggguggggaagaggaucaggaacugagguacccaaacgcacacauggacccacauccugacccaugcugggacagacacagccgcaugggcgcugccaugacgggacccagccaugccggcacacacagaccuacacucaagagaccagggccgccucgccacccucuccucuuccuugacugcaccaggacaccugcuaggguuagcuggggaaugcagggagcuccagggaguaggcaggggguccaacagggccgcccaccugucagagcagagggccagcagaggcagcagcagucucuucccugaagccugggucagggagaggaagcagggaggaggcugugagcaagggacgcccaaggugugggaggcagggggaggcucuuuguguaagggugcccaaguucaaggacaacugucagcaugcaggagagggggacaggagugccagcagcaugggguggcagagcaagugugaccugcaggagugugagccuguguggguccaugugacuguguguggccaugugaccgugugcgcuugugugugacccugugugugugugugcuugccugugugccacuacaugggaccaugugacucugaggccgcugugcaccaugugacuugagaguguguccggggugacugcaugugugacccugcgugagugaggagguggugaguucggcacaucagugugcagcccacccugugagggcacacaagggcugaucaugcugggagacuggguguagcccugaaggaggcagagcgucgcgaggggcgugcauuugugacuuugagguuaugagauccaucuugugccuggggagcaacugcagcuaccgguauaagugaugcugcccuccugcagcucgucccugugaaaguggacgcccuggcccucucugcacaguucaggggcuugggaaggcccugaaagggguuagggugugagcaggagagggcaauguugaacaggguaggacccaagggugcaggauggugagagggaguucggaggagaagcagagugcauggaggagcagggagggcagggucaaguccaguggguggccggagagcugagggaggugcuggugaggccggagggaacugggggagggagacgucuucagggcuuguuggaggaaccagaaggccagagggggucaacaucaaaauggagcgcacguucugcaggccagagggagagccggccaggaccccggagaggugggacagacggggucccugggccggcaguccuggcuu

SEQ ID NO: 20117 - RNA, 2090 nt, Homo sapiens
uuuacauaaaaaacuauacaucuguguaugucagacauaugucugaaaacaguaucacgaagaaagagccaucuuaagcauguggcucugaacuuggaauaacggcacuagcacccagccccacccucagccuaccguggggcccugggcaagccccuucagccucuccaugccucaguuucccuuacuguucaacaggcauagugggagcgccucccuaacagggauggggaaaggagccugugcacuggaguccgaggugccagcauccaccgcagauccacucaccgaggaucauggagcagcgcugggcggguuccuggcccgugagcagcgugaaguguucgggguaguagaacuccagggcuuccaggaaggccucauagccccucuugccacggcagcgcaagauguccaucaggcgcccuacagaguaguggggggauguacccagggucuaggggaaggccuccccaggugccugguugcuucugcccccaccaugcuccaggcccacguuccccagauuuuugagccagugacacacacaggggccugucccaacacaucagggaagagaagagagccauucugccacagccaggggagcacauucccucaugacuccugggcucccagagcuccccaacaccccccacagacacagaugccggcccgcaaaugcagccugccuuuucaauggcacagagaagcccccucuauccccagaagcaaagaaaauacuucucccauuggccaugccugaaauuccaccauuaaagaccauuccaucaugccuuuuugaguucugguucaaaggcacacccugugggaguggggacccacguaaagcugagacggaucuugacacuugaaaaaggacucccccaggaguguauggugcacagaggaggggacagacagaacucggagaucaaagagcgcaggaaaggugccaaguccaccggcugugaccgggaggucccaggcccagccggcccuggcagccacauccaaccuucugcucuaauguggacccaggaagugggagagaaccccaagagacaaaacucugaccccggugugggcaacgcggaccgccaaggcgcagugguggguggggaggaggcaggcuggugggcauacccagccggcccacucuacugaugcggagaccgagccccagggcagcagagcccuagcuucgcgcuacacggcugugggcgcugcgccccagggcacggccggcccaggucguggcccacucgggacccgcggcucaccggugcgguugacgcggcacgggaagcgguaggugcucagcaccuccuccucguccugcucgucgaugacccggcacuggcgcagauacggcgugagcuuggccggguucagggcgcgagccagccgaugccggacgcccucgauucgcucccacagcgcguccuccuccgccucagaccccgagccggccccggccuccuccucggccucccccgccuccgcccggcccggcauggccguguccucagggucugcgggcaagaggcgcacgggggucgaccagggcucccuagggcuagaugugcggccaagcacccccggggcgucguccgcagacccgccgucgggggcgcgccccgagcuccccgcgacucaccccgcacgcuacagucgccucgggcucccggguccgcacucgggcggcggcuccgccggcgcaggggggcggugcccguggcgcccccggcuccgcccccguccccgcagccuccugggcugcccgggccuccccacauugccgcccgccccgggucgugcguccggcccccggccaccccgcgcguccgucugcacgcccucccucccggccguccggcugcgccucccccugcuuccuguuucccgccggcucuccagcccggcucggcgggguccuggccgcccgcccacaccugcccggccucugggcggggcgggggcgggcaggcgcgcucacaccccccgcgcgccgcgacacaccuuccccgggccacgcgcaucgccuccccacgcccacagcgcgcccgcccgugcggggcuagccgcuc

SEQ ID NO: 20118 - RNA, 2090 nt, Homo sapiens
gagcggcuagccccgcacgggcgggcgcgcugugggcguggggaggcgaugcgcguggcccggggaaggugugucgcggcgcgcggggggugugagcgcgccugcccgcccccgccccgcccagaggccgggcaggugugggcgggcggccaggaccccgccgagccgggcuggagagccggcgggaaacaggaagcagggggaggcgcagccggacggccgggagggagggcgugcagacggacgcgcgggguggccgggggccggacgcacgacccggggcgggcggcaauguggggaggcccgggcagcccaggaggcugcggggacgggggcggagccgggggcgccacgggcaccgccccccugcgccggcggagccgccgcccgagugcggacccgggagcccgaggcgacuguagcgugcggggugagucgcggggagcucggggcgcgcccccgacggcgggucugcggacgacgccccgggggugcuuggccgcacaucuagcccuagggagcccuggucgacccccgugcgccucuugcccgcagacccugaggacacggccaugccgggccgggcggaggcgggggaggccgaggaggaggccggggccggcucggggucugaggcggaggaggacgcgcugugggagcgaaucgagggcguccggcaucggcuggcucgcgcccugaacccggccaagcucacgccguaucugcgccagugccgggucaucgacgagcaggacgaggaggaggugcugagcaccuaccgcuucccgugccgcgucaaccgcaccggugagccgcgggucccgagugggccacgaccugggccggccgugcccuggggcgcagcgcccacagccguguagcgcgaagcuagggcucugcugcccuggggcucggucuccgcaucaguagagugggccggcuggguaugcccaccagccugccuccuccccacccaccacugcgccuuggcgguccgcguugcccacaccggggucagaguuuugucucuugggguucucucccacuuccuggguccacauuagagcagaagguuggauguggcugccagggccggcugggccugggaccucccggucacagccgguggacuuggcaccuuuccugcgcucuuugaucuccgaguucugucuguccccuccucugugcaccauacacuccugggggaguccuuuuucaagugucaagauccgucucagcuuuacguggguccccacucccacagggugugccuuugaaccagaacucaaaaaggcaugauggaauggucuuuaaugguggaauuucaggcauggccaaugggagaaguauuuucuuugcuucuggggauagagggggcuucucugugccauugaaaaggcaggcugcauuugcgggccggcaucugugucugugggggguguuggggagcucugggagcccaggagucaugagggaaugugcuccccuggcuguggcagaauggcucucuucucuucccugauguguugggacaggccccugugugugucacuggcucaaaaaucuggggaacgugggccuggagcauggugggggcagaagcaaccaggcaccuggggaggccuuccccuagacccuggguacauccccccacuacucuguagggcgccugauggacaucuugcgcugccguggcaagaggggcuaugaggccuuccuggaagcccuggaguucuacuaccccgaacacuucacgcugcucacgggccaggaacccgcccagcgcugcuccaugauccucggugaguggaucugcgguggaugcuggcaccucggacuccagugcacaggcuccuuuccccaucccuguuagggaggcgcucccacuaugccuguugaacaguaagggaaacugaggcauggagaggcugaaggggcuugcccagggccccacgguaggcugaggguggggcugggugcuagugccguuauuccaaguucagagccacaugcuuaagauggcucuuucuucgugauacuguuuucagacauaugucugacauacacagauguauaguuuuuuauguaaa

SEQ ID NO: 20119 - RNA, 1936 nt, Homo sapiens
cgauuuuacaggugagaaaauugagaccaagagagaggaaggcccaccgacccaggcugcagccgaggucagucugauucugcugcugaguggugugccauuaccauuguccaccugcagcaagaucgggucccgaccggguggacaaccaaauuaacagacggagguggggacuccgcuuccggcucgccccgccccaccccacucucccagggagggagcuccagcuccgggaagaugaggacaauagcaggaaucgccccacaggguacuuccacgugcuggcuccugccaagcgcuggcaccaguguuauggggccuguguacagaugaggaaacugaggcagagauuggggcuugguggcaggccuccaguuucugcggagggaaggcagagggcacuuggggcaugggcgacaugggucguggcgggcacccggcgcacacggcagccgggcgcaggccagaagcccccccgcgucgccgggccgcccaguccgggagccgggcgcugggaugggcgggaggcgggaucuccgggccgcgccgcuuccuggcuccccacccugcgccggcggccgcccuggccacgucaccgcccggccaagagugcgugggcggcggcgcgcgggugcgaucgcggagcugugaggcgcaggcagggcucuggggcaccuagagaccggggccggagacguggcagccgcccugcccgccagaaaguuuccuagaaguuugcugggcgcgggcgcacgacugacuggcuggaccaugaacguguuccgaauccucggcgaccugagccaccuccuggccaugaucuugcugcuggggaagaucuggagguccaagugcugcaagggugaggggcgccuggcagggaggugcgggacccccucucuggccagccucaugccccugcgugcagggcagggcgcuccaggugucugcucaggguggggacuccggcguggggguccuugaaacuuugcggagcuccacuuccaaaaacaauguaaaguuguauaaaaucagaggaggaggaccccucgagaugaugggaggcggguggguuuguuccugcacagacgcccccucagguuggcagugucacugcugguuggaagaggggguuauaagggaggugacaaccccucccucccaccaguuacacccauuguuccuuccaccaucgacuguggggagaagcagauaugcacucaggaacggcccacgauucucaaggucuucucuucccugccccuucccagaccccaccccgccccccaaagugagcccucgucccuccccugccugcauguguggcaccgguggcugugauguggcaggagggcaccagccgggcucaggcggguauggagcugccucuaaacggaagccggggaaggcuggagggguccccuguuugcauucuggcugcccugcuggggguuuggagaagcuuggaggcuggacucgcggucgccaacagauccagagccacgaaaggcugccagagccuccuccagccaucuuuguccaccggcauccucguggugcccucccugugccuggcacugggugugcagaggcaggagugagcucaggcuccucguggggcugaggaggcugagaaggcugagagugggccccgaaggcccuguggaaggagcagcuccgugcuggucccggaggacgagcaggugucaauccaggaagugugugcuguggagggcuccggggaugaagaggcauggaggucaccaagcaccgggcaucccccgggaagggugggcagccagauuugggguggucuggagggagaugaguccaggagggaggcugguccagaugugaaagggccuuuucugccaggccagggaguugggucuggggagcccuucaugguuugggagccgggaaggggccuggaagg

SEQ ID NO: 20120 - RNA, 1936 nt, Homo sapiens
ccuuccaggccccuucccggcucccaaaccaugaagggcuccccagacccaacucccuggccuggcagaaaaggcccuuucacaucuggaccagccucccuccuggacucaucucccuccagaccaccccaaaucuggcugcccacccuucccgggggaugcccggugcuuggugaccuccaugccucuucauccccggagcccuccacagcacacacuuccuggauugacaccugcucguccuccgggaccagcacggagcugcuccuuccacagggccuucggggcccacucucagccuucucagccuccucagccccacgaggagccugagcucacuccugccucugcacacccagugccaggcacagggagggcaccacgaggaugccgguggacaaagauggcuggaggaggcucuggcagccuuucguggcucuggaucuguuggcgaccgcgaguccagccuccaagcuucuccaaacccccagcagggcagccagaaugcaaacaggggaccccuccagccuuccccggcuuccguuuagaggcagcuccauacccgccugagcccggcuggugcccuccugccacaucacagccaccggugccacacaugcaggcaggggagggacgagggcucacuuuggggggcgggguggggucugggaaggggcagggaagagaagaccuugagaaucgugggccguuccugagugcauaucugcuucuccccacagucgaugguggaaggaacaauggguguaacuggugggagggagggguugucaccucccuuauaacccccucuuccaaccagcagugacacugccaaccugagggggcgucugugcaggaacaaacccacccgccucccaucaucucgagggguccuccuccucugauuuuauacaacuuuacauuguuuuuggaaguggagcuccgcaaaguuucaaggacccccacgccggaguccccacccugagcagacaccuggagcgcccugcccugcacgcaggggcaugaggcuggccagagagggggucccgcaccucccugccaggcgccccucacccuugcagcacuuggaccuccagaucuuccccagcagcaagaucauggccaggagguggcucaggucgccgaggauucggaacacguucaugguccagccagucagucgugcgcccgcgcccagcaaacuucuaggaaacuuucuggcgggcagggcggcugccacgucuccggccccggucucuaggugccccagagcccugccugcgccucacagcuccgcgaucgcacccgcgcgccgccgcccacgcacucuuggccgggcggugacguggccagggcggccgccggcgcaggguggggagccaggaagcggcgcggcccggagaucccgccucccgcccaucccagcgcccggcucccggacugggcggcccggcgacgcgggggggcuucuggccugcgcccggcugccgugugcgccgggugcccgccacgacccaugucgcccaugccccaagugcccucugccuucccuccgcagaaacuggaggccugccaccaagccccaaucucugccucaguuuccucaucuguacacaggccccauaacacuggugccagcgcuuggcaggagccagcacguggaaguacccuguggggcgauuccugcuauuguccucaucuucccggagcuggagcucccucccugggagagugggguggggcggggcgagccggaagcggaguccccaccuccgucuguuaauuugguuguccacccggucgggacccgaucuugcugcagguggacaaugguaauggcacaccacucagcagcagaaucagacugaccucggcugcagccugggucggugggccuuccucucucuuggucucaauuuucucaccuguaaaaucg

SEQ ID NO: 20121 - RNA, 2507 nt, Homo sapiens
cccaagcuaugugcacaguuuccucuggacucugccauguggcccagccacccauaccuggaauaggggcuaagccaagcugcucucuccuccaaagggaggcagccugugugcuuuguccguuugccuuugcagagaccucgaucuucacgcaaggcaagcagcagccccuguaagcacacgagacaaucccaagugucagugggaaggagaucccuuuccugauggggcugccuguguccagucccucccagcuuccccagggcccuggggcucugcaggcauucagaaguggaagccagccacagccugggacugaagagguuaaugugcaucugccuccgaauguuaaugugucuaggugaugucagugggagccaugaagaagggaguggggagggcaguugggcuuggaggcggcagcggcugccaggcuacggaggaagacccccuucccaacugcggggcuugcgcuccgggacaagguggcaggcgcuggaggcugccgcagccugcguggguggaggggagcucagcucgguugugggagcaggcgaccggcacuggcuggauggaccuggaagccucgcugcugcccacuggucccaacgccagcaacaccucugauggccccgauaaccucacuucggcaggugaguugacugggagcccucccuccucugggcuguggguggaaaaugggaagguuucaccccugagccaaacugcuugggaaacuuuaucacaguucuuggggacaagaucuguggucugcuuugcucugaggggcaggagaaaagggggcaaugguccgcaggggcagacgggcaggagcagagcagggggcgaaggcauauucagaauggcaaggaaggggggccagccgugagacagcaggggaaggcucgcugcuggguuccaaagaugcuuggcagaaaaaauuccaggcuggaaaagcaagcgagagaagcuggagggugguaugugggagacagcugggggcucacuccugcacuguuagccucagcuuuuuacucccacuuggaugaugaggucugagacauccuuacugccaccugggagaggcccugggaagggaagacuucacagagccaugaggggauuaacuuuucuggugaauuaagcuuccugacauuuccagagcugcggugcccugggauuccagcuuugaaggagaaaggaaggaaggaaaagaggaaaggcuuauguagauaauuuuuccaggcugcugagcuccaacagacaguuucugucucugcuucacucaagaagcccaggcucagaagauaccaaucaaggaaauccccgcuaggaagccugggguagggagagcugcuggcuugaccagggcacagccggcaaaagccucuacaagacagucacccacagauaugcccaagaaucaguacacaguuuccaaccagagaucuccaaaaugaaacacucagggcuacacauaggaaaagcacgcacacacacacacacacacauacacagacacuuacuuuuguguccuucuggcuaugcugacgaguuuuccuggugaagcccggggcucacagaguaaucucugcagacaacugugguucuugccucuggugccugcaggaggcaggcauguuguguccuuccaagacagauggcucagggcacucugguaggauucaccaggaaacucauggagaagggaaaagggacaagauuagcaacagugaagggagggagaauggugggagaggauuccagaugaacggugggucgcuggaggcugagcaugccagcaggaugucaguucucagagcaaagcccaugucaaacagccaacgcuugcuccuucuguccccaggaucaccuccucgcacggggagcaucuccuacaucaacaucaucaugccuucgguguucggcaccaucugccuccugggcaucaucgggaacuccacggucaucuucgcggucgugaagaaguccaagcugcacuggugcaacaacguccccgacaucuucaucaucaaccucucgguaguagaucuccucuuucuccugggcaugcccuucaugauccaccagcucaugggcaaugggguguggcacuuuggggagaccaugugcacccucaucacggccauggaugccaauagucaguucaccagcaccuacauccugaccgccauggccauugaccgcuaccuggccacuguccaccccaucucuuccacgaaguuccggaagcccucuguggccacccuggugaucugccuccugugggcccucuccuucaucagcaucaccccuguguggcuguaugccagacucauccccuucccaggaggugcagugggcugcggcauacgccugcccaacccagacacugaccucuacugguucacccuguaccaguuuuuccuggccuuugcccugccuuuuguggucaucacagccgcauacgugaggauccugcagcgcaugacguccucaguggcccc

SEQ ID NO: 20122 - RNA, 2507 nt, Homo sapiens
ggggccacugaggacgucaugcgcugcaggauccucacguaugcggcugugaugaccacaaaaggcagggcaaaggccaggaaaaacugguacagggugaaccaguagaggucagugucuggguugggcaggcguaugccgcagcccacugcaccuccugggaaggggaugagucuggcauacagccacacaggggugaugcugaugaaggagagggcccacaggaggcagaucaccaggguggccacagagggcuuccggaacuucguggaagagaugggguggacaguggccagguagcggucaauggccauggcggucaggauguaggugcuggugaacugacuauuggcauccauggccgugaugagggugcacauggucuccccaaagugccacaccccauugcccaugagcugguggaucaugaagggcaugcccaggagaaagaggagaucuacuaccgagagguugaugaugaagaugucggggacguuguugcaccagugcagcuuggacuucuucacgaccgcgaagaugaccguggaguucccgaugaugcccaggaggcagauggugccgaacaccgaaggcaugaugauguugauguaggagaugcuccccgugcgaggaggugauccuggggacagaaggagcaagcguuggcuguuugacaugggcuuugcucugagaacugacauccugcuggcaugcucagccuccagcgacccaccguucaucuggaauccucucccaccauucucccucccuucacuguugcuaaucuugucccuuuucccuucuccaugaguuuccuggugaauccuaccagagugcccugagccaucugucuuggaaggacacaacaugccugccuccugcaggcaccagaggcaagaaccacaguugucugcagagauuacucugugagccccgggcuucaccaggaaaacucgucagcauagccagaaggacacaaaaguaagugucuguguaugugugugugugugugugugcgugcuuuuccuauguguagcccugaguguuucauuuuggagaucucugguuggaaacuguguacugauucuugggcauaucugugggugacugucuuguagaggcuuuugccggcugugcccuggucaagccagcagcucucccuaccccaggcuuccuagcggggauuuccuugauugguaucuucugagccugggcuucuugagugaagcagagacagaaacugucuguuggagcucagcagccuggaaaaauuaucuacauaagccuuuccucuuuuccuuccuuccuuucuccuucaaagcuggaaucccagggcaccgcagcucuggaaaugucaggaagcuuaauucaccagaaaaguuaauccccucauggcucugugaagucuucccuucccagggccucucccagguggcaguaaggaugucucagaccucaucauccaagugggaguaaaaagcugaggcuaacagugcaggagugagcccccagcugucucccacauaccacccuccagcuucucucgcuugcuuuuccagccuggaauuuuuucugccaagcaucuuuggaacccagcagcgagccuuccccugcugucucacggcuggccccccuuccuugccauucugaauaugccuucgcccccugcucugcuccugcccgucugccccugcggaccauugcccccuuuucuccugccccucagagcaaagcagaccacagaucuuguccccaagaacugugauaaaguuucccaagcaguuuggcucaggggugaaaccuucccauuuuccacccacagcccagaggagggagggcucccagucaacucaccugccgaagugagguuaucggggccaucagagguguugcuggcguugggaccagugggcagcagcgaggcuuccagguccauccagccagugccggucgccugcucccacaaccgagcugagcuccccuccacccacgcaggcugcggcagccuccagcgccugccaccuugucccggagcgcaagccccgcaguugggaagggggucuuccuccguagccuggcagccgcugccgccuccaagcccaacugcccuccccacucccuucuucauggcucccacugacaucaccuagacacauuaacauucggaggcagaugcacauuaaccucuucagucccaggcuguggcuggcuuccacuucugaaugccugcagagccccagggcccuggggaagcugggagggacuggacacaggcagccccaucaggaaagggaucuccuucccacugacacuugggauugucucgugugcuuacaggggcugcugcuugccuugcgugaagaucgaggucucugcaaaggcaaacggacaaagcacacaggcugccucccuuuggaggagagagcagcuuggcuuagccccuauuccagguauggguggcugggccacauggcagaguccagaggaaacugugcacauagcuuggg

SEQ ID NO: 20123 - RNA, 2638 nt, Homo sapiens
uaauauucgucagugacucaccauuaccuuccauuaaaauccagcuuccaaggcugcgugcggacuucuccagccucuuauuuagcucuacacaccugucuggaauuuucucugcuucagcgacaccaaggacucugggcuguccaccagcaccacgcagcucucaccucuggagacccucaccucugcuguccucucuuugcagaauaccucucccuuuccauucuucccuuccacucccauuugccuuuccaucuggcccucaucuccuccaagaagucuuccaagcccccucuccccagggugcccaccugccugcacccucaguucccugugugcaccccggccccugcauuaggacauuccaucuuccugucuccuccacuagacccagaaccuucgaggggagggaugguuguccucaccccugugaggcaauaugcuguccauuaguauccacugaaugcgugaaauuuuuuucuaaugggcaaacugaggcucagagaaguuccugucuggcucaagguuauugguucaucauucuggagcagggccuggaacccgggccccugacucggcucuacaggcacccgcgcaacaccccagcccccgcgugacucacgcgcgcucacggccgcccgcagcugccacugguccccugcgccccuccgcccguccccgccgcagcccaguggguaaggggcggggagcagguccagcggggagagacgggacugggaugcaggcaccuuuccgggccuggcaccuggagcccgcgggggcggcuccuggaccgcccgcagcguggacccgggaccaguucccgcuugcgggcgcgggcgccgcgggaaggggaggggcccucggcggggccgacgggcgcgcggucacguggugcggguggcagcggcggcggcuggcggcggcggcaacggugcgcgcggacaggggcggcgcggcgccgagcgagccgaggcgaggucccggggagggcgcggcggcgcggggcgcaggggcggcgcggcggggccgcgggccgggcgggugggaggagagcgcgaaggggcgaggcccguuugcaggggccgcucggcccggggaagcccgcgccccgcucagccuugcagccccgcgcccggagcaucucccuggaggaacggagacaaaggaggauucauguccaaagguagggcggccggccaggccaccggcacccgccaggaggaggcugcggccccggccagcgcggcuggaggcgcuccugggggaggguuuccgcgccgaggagcccacgcgcggugacagaugcgcggacacacgcacacacgguggcacccaccucgagagagacaaucuuggagagaggcagacauaggacgcggggagacgcagggacccacggacacgcaagcagggacccagaugcgcacagaaagccccaugcuggaguacaccaagacacgcacacacacacacaccacgcacaggugccagggccaugccagccggaugagagaccugugcacugauacauacguccccucccccgcaaccccuacaggcacacgcugagacaggcaccagcugguggucuccaagggaacccguuggccuccagaggacugggaugggggaacgggugucccagggcccucugcuccugcgaaugggaaaggaccgagagagcuuucgugauuccuuuucccagagccuagggcuggaacuggggugggcuggaauugccuuuguggggggcggugggguccugaaggcugcggggggcugaggaagauccaucuucaggguggaaggaagagggggggccugcacuaagcaggugcuauuuuggaaaaguacccucccccagcugcuaccuuccuaacacagggguggggucccugggccagacaaagccaaagccauucauuugccuguaaaaggaagugccagggucuuugcuuagcaugggaauggaggggcuguuucuuggcugcaaccgagucagguggauggugccucucccuggagcacugauggggcagguagcuucuggcagagggugcugcaggcagaucccccuucuccaggggcccuaggagagccaggagcugaggggggccccaaggaccaucuagccaggauggcagacuugagcugcacccugcugugacccgagcucuuccccacccuuggggagccccccuccaauccuuguugcagaggaaggaggaggucucaacaauucuacucccuugacuguggcggagacaacagccauugcucacuggggggucagcugcucugcauggggagaagcaucugagggaagagaaaggugaugugucugauaccugccucacucugaaguucucauucacucaucauucauucauucacuuauugaggagugccugugguaugcuggguagacuggggcacagagaucaauaagacacggccccgcccuaaagaagggugagaacuaguacguauuugugccagauaauuuacauucuucauucuguauaaccuucauagaaacccagcaagguagguucuauccccaguugucugagcagaaaaugaggcucauaagggucacccagccaggauucaagccugggucaccugcccaucu

SEQ ID NO: 20124 - RNA, 2638 nt, Homo sapiens
agaugggcaggugacccaggcuugaauccuggcugggugacccuuaugagccucauuuucugcucagacaacuggggauagaaccuaccuugcuggguuucuaugaagguuauacagaaugaagaauguaaauuaucuggcacaaauacguacuaguucucacccuucuuuagggcggggccgugucuuauugaucucugugccccagucuacccagcauaccacaggcacuccucaauaagugaaugaaugaaugaugagugaaugagaacuucagagugaggcagguaucagacacaucaccuuucucuucccucagaugcuucuccccaugcagagcagcugaccccccagugagcaauggcuguugucuccgccacagucaagggaguagaauuguugagaccuccuccuuccucugcaacaaggauuggaggggggcuccccaaggguggggaagagcucgggucacagcagggugcagcucaagucugccauccuggcuagaugguccuuggggccccccucagcuccuggcucuccuagggccccuggagaagggggaucugccugcagcacccucugccagaagcuaccugccccaucagugcuccagggagaggcaccauccaccugacucgguugcagccaagaaacagccccuccauucccaugcuaagcaaagacccuggcacuuccuuuuacaggcaaaugaauggcuuuggcuuugucuggcccagggaccccaccccuguguuaggaagguagcagcugggggaggguacuuuuccaaaauagcaccugcuuagugcaggcccccccucuuccuuccacccugaagauggaucuuccucagccccccgcagccuucaggaccccaccgccccccacaaaggcaauuccagcccaccccaguuccagcccuaggcucugggaaaaggaaucacgaaagcucucucgguccuuucccauucgcaggagcagagggcccugggacacccguucccccaucccaguccucuggaggccaacggguucccuuggagaccaccagcuggugccugucucagcgugugccuguagggguugcgggggaggggacguauguaucagugcacaggucucucauccggcuggcauggcccuggcaccugugcguggugugugugugugugcgugucuugguguacuccagcauggggcuuucugugcgcaucugggucccugcuugcguguccgugggucccugcgucuccccgcguccuaugucugccucucuccaagauugucucucucgaggugggugccaccgugugugcguguguccgcgcaucugucaccgcgcgugggcuccucggcgcggaaacccucccccaggagcgccuccagccgcgcuggccggggccgcagccuccuccuggcgggugccgguggccuggccggccgcccuaccuuuggacaugaauccuccuuugucuccguuccuccagggagaugcuccgggcgcggggcugcaaggcugagcggggcgcgggcuuccccgggccgagcggccccugcaaacgggccucgccccuucgcgcucuccucccacccgcccggcccgcggccccgccgcgccgccccugcgccccgcgccgccgcgcccuccccgggaccucgccucggcucgcucggcgccgcgccgccccuguccgcgcgcaccguugccgccgccgccagccgccgccgcugccacccgcaccacgugaccgcgcgcccgucggccccgccgagggccccuccccuucccgcggcgcccgcgcccgcaagcgggaacuggucccggguccacgcugcgggcgguccaggagccgcccccgcgggcuccaggugccaggcccggaaaggugccugcaucccagucccgucucuccccgcuggaccugcuccccgccccuuacccacugggcugcggcggggacgggcggaggggcgcaggggaccaguggcagcugcgggcggccgugagcgcgcgugagucacgcgggggcugggguguugcgcgggugccuguagagccgagucaggggcccggguuccaggcccugcuccagaaugaugaaccaauaaccuugagccagacaggaacuucucugagccucaguuugcccauuagaaaaaaauuucacgcauucaguggauacuaauggacagcauauugccucacaggggugaggacaaccaucccuccccucgaagguucugggucuaguggaggagacaggaagauggaauguccuaaugcaggggccggggugcacacagggaacugagggugcaggcaggugggcacccuggggagagggggcuuggaagacuucuuggaggagaugagggccagauggaaaggcaaaugggaguggaagggaagaauggaaagggagagguauucugcaaagagaggacagcagaggugagggucuccagaggugagagcugcguggugcugguggacagcccagaguccuuggugucgcugaagcagagaaaauuccagacagguguguagagcuaaauaagaggcuggagaaguccgcacgcagccuuggaagcuggauuuuaauggaagguaauggugagucacugacgaauauua

SEQ ID NO: 20125 - RNA, 1671 nt, Homo sapiens
gggugggcuaugcguccuccauguuuaccaaagucacucuucuccucauccggagggccucugcggggcaaguagccaacccguggcacggaaaccaauucccccaucccgagcagggagcacaccccacagaaagucaggggccccuucuuuaacuucuuaacaggaaguccucacccugcaagggcgccucucagguuucggaucccugcuaaagaaaagcaucuguucuuggaguaaacugcaaugcgcgcgguggggagcgccuggcacccccccucgggauccauccacaguccgucuuguccagaggugcccugcggacagaccgcaccgggggccacgaccccgcgccccgggucccaccuccccgcggggauggggcgccggccuccccuccacugcgcggcgcuuuguccucggguucccggagcagacggcggcgcacagcccggccccuggccccggccucccucccgccugccccgaccccucccuggcgccugcgcucccagggcccccggccuuaccacagccgcucgcucccugcacccgguccccccagccgggucccccaagccgcccccgcucccuggccagguccggccgaacccgggcggcggcgacacucacccgcgccgggggcgccggcuccgggccccgggcuccgccaccagcgcagcagagcccgcgcgggcuccaggcucacggcgcagcgcugcugcuucacccacagcacggauugcagcggcuccgccgcccccgucgcccccaucuccgccgccgggcucguccgccaggcugggggcgcgcggacgccgaggggcgccggaccguuagcggccccugcaguggcccgggcggcgggcggcgggcggcgggaggcggcgcugcgucaccccguacgcgggcggcggggaccgcggaggggacgggcggggcgggggcgaggaggaggcguggguagaggaggggccgggagccagggagagacggggggacccgagaaggggagaagagggaggaggaaggggccgggauggggcuggccgaggccagggcgcuggggccgggaggcggcugccuuucucuccucucuucuccggcgggugccgggugcugaaucuggcgcucccgcggccggccgggacucaguggcgccuuccgcgcgggccucgguucaggcgggguccgggcggcguggaaacgcaguccuggcgaucgggcgcggcggggggcgggccuggaugggggcgccacgggcgacgugaccuugggcggcgggugcccucuacgauccuggcguccugucggccugggagggggccugcagcugggccccgacaggcagguaaggcuuucaggaggcggaggucuuuuuagggggcgggggcgcuggcccuuugaacugcucuggggccugaagccacagagcagacagcugagcagccgcccccgagcuggcccuaggaaccggagccugggccccagacuuggagagacacggccccuguggccccaauucaccgccuccccaggaaggccuccuugaccccacagcugaaggaaucaccagccugcagggacuccagcccugccuucagagcacgccgugcgccuucaugcaagcuccagucucugcguccgcagugcuuaacacagccccauagg

SEQ ID NO: 20126 - RNA, 1671 nt, Homo sapiens
ccuauggggcuguguuaagcacugcggacgcagagacuggagcuugcaugaaggcgcacggcgugcucugaaggcagggcuggagucccugcaggcuggugauuccuucagcuguggggucaaggaggccuuccuggggaggcggugaauuggggccacaggggccgugucucuccaagucuggggcccaggcuccgguuccuagggccagcucgggggcggcugcucagcugucugcucuguggcuucaggccccagagcaguucaaagggccagcgcccccgcccccuaaaaagaccuccgccuccugaaagccuuaccugccugucggggcccagcugcaggcccccucccaggccgacaggacgccaggaucguagagggcacccgccgcccaaggucacgucgcccguggcgcccccauccaggcccgccccccgccgcgcccgaucgccaggacugcguuuccacgccgcccggaccccgccugaaccgaggcccgcgcggaaggcgccacugagucccggccggccgcgggagcgccagauucagcacccggcacccgccggagaagagaggagagaaaggcagccgccucccggccccagcgcccuggccucggccagccccaucccggccccuuccuccucccucuucuccccuucucggguccccccgucucucccuggcucccggccccuccucuacccacgccuccuccucgcccccgccccgcccguccccuccgcgguccccgccgcccgcguacggggugacgcagcgccgccucccgccgcccgccgcccgccgcccgggccacugcaggggccgcuaacgguccggcgccccucggcguccgcgcgcccccagccuggcggacgagcccggcggcggagaugggggcgacgggggcggcggagccgcugcaauccgugcugugggugaagcagcagcgcugcgccgugagccuggagcccgcgcgggcucugcugcgcugguggcggagcccggggcccggagccggcgcccccggcgcgggugagugucgccgccgcccggguucggccggaccuggccagggagcgggggcggcuugggggacccggcuggggggaccgggugcagggagcgagcggcugugguaaggccgggggcccugggagcgcaggcgccagggaggggucggggcaggcgggagggaggccggggccaggggccgggcugugcgccgccgucugcuccgggaacccgaggacaaagcgccgcgcaguggaggggaggccggcgccccauccccgcggggaggugggacccggggcgcggggucguggcccccggugcggucuguccgcagggcaccucuggacaagacggacuguggauggaucccgagggggggugccaggcgcuccccaccgcgcgcauugcaguuuacuccaagaacagaugcuuuucuuuagcagggauccgaaaccugagaggcgcccuugcagggugaggacuuccuguuaagaaguuaaagaaggggccccugacuuucuguggggugugcucccugcucgggaugggggaauugguuuccgugccacggguuggcuacuugccccgcagaggcccuccggaugaggagaagagugacuuugguaaacauggaggacgcauagcccaccc

SEQ ID NO: 20127 - RNA, 2228 nt, Homo sapiens
caccagcuuccugagcccacccucccuuugcaggugacccucaucccacccucccaugucccacugcccucagcccugcuaaaggaaaggccuuugcacagccuguucccucuggcugauacuugcuucuucucucccucccacuucugucucuugggauccugucucagagcaaguggaggcugaggccaccccccaugcccacacaaggggagcaggagcggcuccugcugggucugggaugcucaugggcgcaggucgaggugccuggggcagccaugcucccagccuaugaccagggaaaggugcuccugagguggugaggggaguggcccugcacguggggcagcaaguucuuuuggccaauugcaucugugcggucaggugacagggaauuggcaccuggcccgcagccuuggcaguggaacuaagaaaaugggccaggggugcaaggggggagaccaggccucacucagagaaccggacaccucucagcaacucccagacggcgaguccagccaugacccacccuaguccccuauggccacucccacaccgucccagacccucuuccugcccuucaggucucaaagaggaagacagaucugugcuggcaugauggcuagaaugacccaccuacagcuucugauggaaggcuagggaccacaccagaagacagccugcccugggacccccggccccugaugccggcuccugagcuccaaaucuggugggccuagaggucccacuuccaaccugcaagugccuggggcagagcucugcccuggcugccucugccuuugcgccccaccaggaccccccagugggcagcagcuaagcggcauuggccauggugaggacucagcugcaccucucaaagccuguacccaugaucagccucccagucaacauggaggcugaaacuuaggacucccgguaacuaccucacccuaagccccuccagcccuggcuacccgggucuaacagagaccuuggcccaguugaccccccucccccacccagacucugucgucuuccugggccccaggccagguccucuggccccagggccuaagugggguuuguggucugagggggagucugaggccaucccagggggagagaucuuggcuuccgggagcggggcuucccuuuucagacaauagcccccagcccgggcgggggagggucauccgcuagaccccggggggcugccugacccgacucagugaaucucaggugggugcucagacguuuaggggcccggacaucaggguggcucggggcucggucgcgugagacccacccucacgccagcugugaccucccaggccucaggccugguggggagcaguccgaaucgggagaggccggaggaccccccucccucccgguaacggcgucugcuuggaaaguuucuuuacgccgccacccccgcccccccauucauuccucagauccgcuuggcgcccgggggcggaggcagggcgaggccccuccccacgccgagaaccucgcgcgggcgaggaggggacgcgcucuccggcccggcccggcccccacccagcaccccuucugccccgccccuaccagacggagccguaggcgccggagcccaccgggcgcagccccugcagccgcugcggcaccucccacacggucuuguucagcuccugccgguagaagccggcgcgagggcccgacauguccggagcagccgccgcuccgcccgggcccagccccgcgccccgcgcccgcgcccgagccgagcccgagccgagcggagcggagggcggcggaggcggcggcggcggcgggcggggcggggcuccggggcggggccgggaggcccgggcggauuucccgggcuggguggccggggcguggggggguucccggagacaaaugcgcugcuuccugcgccucggaggcgguggcagagcggaaaccagcccuccccuucccggggggggcgccgagggcggacaccucccuccggcucucaccucuugggggccgcgcgcuucuccagacuugcgcccgcgucugggcucggcccgggcuucccuaccccggcggcgcccuccccaacgagggagaaccgucaaaagcgaagaagccagggguaaaccaugggaaguauuuuucaagacagaaauaugaauagcaccuucuaaagacucggcacuggauaggaaaauaagccgaaaggcguugggacagggccg

SEQ ID NO: 20128 - RNA, 2228 nt, Homo sapiens
cggcccugucccaacgccuuucggcuuauuuuccuauccagugccgagucuuuagaaggugcuauucauauuucugucuugaaaaauacuucccaugguuuaccccuggcuucuucgcuuuugacgguucucccucguuggggagggcgccgccgggguagggaagcccgggccgagcccagacgcgggcgcaagucuggagaagcgcgcggcccccaagaggugagagccggagggagguguccgcccucggcgccccccccgggaaggggagggcugguuuccgcucugccaccgccuccgaggcgcaggaagcagcgcauuugucuccgggaacccccccacgccccggccacccagcccgggaaauccgcccgggccucccggccccgccccggagccccgccccgcccgccgccgccgccgccuccgccgcccuccgcuccgcucggcucgggcucggcucgggcgcgggcgcggggcgcggggcugggcccgggcggagcggcggcugcuccggacaugucgggcccucgcgccggcuucuaccggcaggagcugaacaagaccgugugggaggugccgcagcggcugcaggggcugcgcccggugggcuccggcgccuacggcuccgucugguaggggcggggcagaaggggugcugggugggggccgggccgggccggagagcgcguccccuccucgcccgcgcgagguucucggcguggggaggggccucgcccugccuccgcccccgggcgccaagcggaucugaggaaugaaugggggggcggggguggcggcguaaagaaacuuuccaagcagacgccguuaccgggagggagggggguccuccggccucucccgauucggacugcuccccaccaggccugaggccugggaggucacagcuggcgugagggugggucucacgcgaccgagccccgagccacccugauguccgggccccuaaacgucugagcacccaccugagauucacugagucgggucaggcagccccccggggucuagcggaugacccucccccgcccgggcugggggcuauugucugaaaagggaagccccgcucccggaagccaagaucucucccccugggauggccucagacucccccucagaccacaaaccccacuuaggcccuggggccagaggaccuggccuggggcccaggaagacgacagagucugggugggggaggggggucaacugggccaaggucucuguuagacccggguagccagggcuggaggggcuuagggugagguaguuaccgggaguccuaaguuucagccuccauguugacugggaggcugaucauggguacaggcuuugagaggugcagcugaguccucaccauggccaaugccgcuuagcugcugcccacugggggguccugguggggcgcaaaggcagaggcagccagggcagagcucugccccaggcacuugcagguuggaagugggaccucuaggcccaccagauuuggagcucaggagccggcaucaggggccgggggucccagggcaggcugucuucugguguggucccuagccuuccaucagaagcuguaggugggucauucuagccaucaugccagcacagaucugucuuccucuuugagaccugaagggcaggaagagggucugggacggugugggaguggccauaggggacuagggugggucauggcuggacucgccgucugggaguugcugagagguguccgguucucugagugaggccuggucuccccccuugcaccccuggcccauuuucuuaguuccacugccaaggcugcgggccaggugccaauucccugucaccugaccgcacagaugcaauuggccaaaagaacuugcugccccacgugcagggccacuccccucaccaccucaggagcaccuuucccuggucauaggcugggagcauggcugccccaggcaccucgaccugcgcccaugagcaucccagacccagcaggagccgcuccugcuccccuugugugggcaugggggguggccucagccuccacuugcucugagacaggaucccaagagacagaagugggagggagagaagaagcaaguaucagccagagggaacaggcugugcaaaggccuuuccuuuagcagggcugagggcagugggacaugggagggugggaugagggucaccugcaaagggagggugggcucaggaagcuggug

SEQ ID NO: 20129 - RNA, 2880 nt, Homo sapiens
ucuggcugcauauaggauuccguccgcaggaaccagcugcucacucugacccacgauacagcagcccgccugguccagcagcacuugcaucuggucagacauccccuguucucagugacuuaugguaaaugacuuagcagcuuuuuuuuuuuuuuuuuuuuuuucugugaagagucuuccucuguugcccaggcuggagugcaguuggcacaauuucggcucauugugaccucugccuccugggcuuaagugauccucccaccucagcuucccaguagcugggacuacaggugcgcaccaccacacgcggcuuuuuuuuuucuucuuuuuuuuguagagaucaaguuucacuauauuacccaggcugaucuccaacugggcuccucugccucccagagugcugggacagggucucacucuguugcccaggcuggagugcaguggcaucgucccggcucacugcagccuagaccucccaggcucaagugauccuccugccucagccuccugaguagcuggaaccacaugcgugcaccaccacacgcagcgaacuauuuuguagagaugggguuuugccguguuauccaggcugguuuugaacuccuggguucaagggaucugcccucuucggccuccccaagugcuaggacuacaggugugagccaccgugccccgccagccaucugugauuuugaccaacuucccauuuuaugauccuaaucaaaguuccacugaugauuucggcccaggcccagugacucaugaguaaccuugaccaguguucucauuagugacccuaaugauccaccagugaucuuuuagugauucuggccagggucuccaucaucaaccuggauuaaugacugauccguggcgccccguaccugcucugggcucuggaugacauugaauccaggaauagacuccagcuuauccaaggugccuccugugugccccagaccacguccgcugaucauuggcaccugguggucagggaugcugaguacccugcacaguaccccucccccaccucugugcaucccuucaccuucccuggcuaggagugcagcuggauuuggaaaguauuuaagcagcuauaggggugcccagcuggugagggaauggaaaggaaguuuucuugguugagaagugucaguaggggaggagguugguaccuguccuuggggaaacaaggcuuggggcagagggaggaaaguccucagcuccucccuugggggagcugucuggggacccaaggggaaaggggucugaauuccaucaguggaucuuuuuccugcuccaaggggccuggucuggagccagaggggccccaagcgcugugcuggggaacgggguggggagaacugugcuggggagcaggguggggagaagccuugguagggucuuggaggcuuugggccaggcuugagguugggagcugccuguggauggacugguugcugcaugugcgguauaggcucccgucuggaaaggaggugguuucuaaccuugcagccacaugccgccagggcaggugcgaggaccaggcugaccuugucacccacacccccuguggaaugcuuguccacaagcugcuggcgccaggccucuggccacuccagcugcugucccgacugagccagggccugggucagcaccgaggucuccuccagauccaugccccgaagucggauggccaucagcauggccccugguauguggggguacgcgugaggguggcagcccacagcgguggggcacccuggggccggugcugguaguggggcaccgucgcacccccagggacccaaagucucucgggcugaccucccagucggggucaggaacgcccaacccuccccacgcaccgaucugugcgcccugcgcgcucccauucaccacagcggccacgaagccccugauguccgcuucgcucaggcggccuccgucucgcuucaugcggaucagcuccgggagcugcuugggcucuggcgaagggucgggaagucccuggcucccuuccccggagaagucaccaggcgcggguggggccccgguucccggggucaucaaggcugccaucgcuccgggccugcggggaugccugacacguccggggucugcggccucccggcgucggugucugagccacgugcuccugucccgaccccuuucccgugucucuccgguguccgccccucggucccgugucugugucgcccucguccgugucugccucccgcuuccccgccucgcgacuugagccccgcccguaccugcuuagggcgcugcccucgcccgcuugcuccggaucccagcccagguacccggccucgcccgcgggucgggaccguaggguucaggguucgcgcacagcgguccacugccggcggcggggcggcggcgccccaggacggcaggcggguggggccgccuggagggcggagcucggcagucgccgcccccgggaagccuugcacgccgcgccccggccaaucccccggugcccccggacacgcggaacuuccgggccgucggggcccggggccgucggcgggggugaucccuggccggucccgcccggcgugggucucgggcgucuguggcucccgagagucccccucccgcccucgguggggucucgacguucggacgcggcgcagcgcuggggucccggccucgcccgacgcucgggccccgccccgcuggguucggaguugggacacggccccagccguggcuccaccccaggccuugcgccaggacgcgcagagagagagagagagaggcggacacgaugcggacucgcagacuuuaagcaaacacguguggggccgcucccgccuggcgggucaguuguccgcgucggucaccagcggg

SEQ ID NO: 20130 - RNA, 2880 nt, Homo sapiens
cccgcuggugaccgacgcggacaacugacccgccaggcgggagcggccccacacguguuugcuuaaagucugcgaguccgcaucguguccgccucucucucucucucucugcgcguccuggcgcaaggccugggguggagccacggcuggggccgugucccaacuccgaacccagcggggcggggcccgagcgucgggcgaggccgggaccccagcgcugcgccgcguccgaacgucgagaccccaccgagggcgggagggggacucucgggagccacagacgcccgagacccacgccgggcgggaccggccagggaucacccccgccgacggccccgggccccgacggcccggaaguuccgcguguccgggggcaccgggggauuggccggggcgcggcgugcaaggcuucccgggggcggcgacugccgagcuccgcccuccaggcggccccacccgccugccguccuggggcgccgccgccccgccgccggcaguggaccgcugugcgcgaacccugaacccuacggucccgacccgcgggcgaggccggguaccugggcugggauccggagcaagcgggcgagggcagcgcccuaagcagguacgggcggggcucaagucgcgaggcggggaagcgggaggcagacacggacgagggcgacacagacacgggaccgaggggcggacaccggagagacacgggaaaggggucgggacaggagcacguggcucagacaccgacgccgggaggccgcagaccccggacgugucaggcauccccgcaggcccggagcgauggcagccuugaugaccccgggaaccggggccccacccgcgccuggugacuucuccggggaagggagccagggacuucccgacccuucgccagagcccaagcagcucccggagcugauccgcaugaagcgagacggaggccgccugagcgaagcggacaucaggggcuucguggccgcuguggugaaugggagcgcgcagggcgcacagaucggugcguggggaggguugggcguuccugaccccgacugggaggucagcccgagagacuuugggucccugggggugcgacggugccccacuaccagcaccggccccagggugccccaccgcugugggcugccacccucacgcguacccccacauaccaggggccaugcugauggccauccgacuucggggcauggaucuggaggagaccucggugcugacccaggcccuggcucagucgggacagcagcuggaguggccagaggccuggcgccagcagcuuguggacaagcauuccacagggggugugggugacaaggucagccugguccucgcaccugcccuggcggcauguggcugcaagguuagaaaccaccuccuuuccagacgggagccuauaccgcacaugcagcaaccaguccauccacaggcagcucccaaccucaagccuggcccaaagccuccaagacccuaccaaggcuucuccccacccugcuccccagcacaguucuccccaccccguuccccagcacagcgcuuggggccccucuggcuccagaccaggccccuuggagcaggaaaaagauccacugauggaauucagaccccuuuccccuuggguccccagacagcucccccaagggaggagcugaggacuuuccucccucugccccaagccuuguuuccccaaggacagguaccaaccuccuccccuacugacacuucucaaccaagaaaacuuccuuuccauucccucaccagcugggcaccccuauagcugcuuaaauacuuuccaaauccagcugcacuccuagccagggaaggugaagggaugcacagaggugggggagggguacugugcaggguacucagcaucccugaccaccaggugccaaugaucagcggacguggucuggggcacacaggaggcaccuuggauaagcuggagucuauuccuggauucaaugucauccagagcccagagcagguacggggcgccacggaucagucauuaauccagguugaugauggagacccuggccagaaucacuaaaagaucacugguggaucauuagggucacuaaugagaacacuggucaagguuacucaugagucacugggccugggccgaaaucaucaguggaacuuugauuaggaucauaaaaugggaaguuggucaaaaucacagauggcuggcggggcacgguggcucacaccuguaguccuagcacuuggggaggccgaagagggcagaucccuugaacccaggaguucaaaaccagccuggauaacacggcaaaaccccaucucuacaaaauaguucgcugcgugugguggugcacgcaugugguuccagcuacucaggaggcugaggcaggaggaucacuugagccugggaggucuaggcugcagugagccgggacgaugccacugcacuccagccugggcaacagagugagacccugucccagcacucugggaggcagaggagcccaguuggagaucagccuggguaauauagugaaacuugaucucuacaaaaaaaagaagaaaaaaaaaagccgcgugugguggugcgcaccuguagucccagcuacugggaagcugaggugggaggaucacuuaagcccaggaggcagaggucacaaugagccgaaauugugccaacugcacuccagccugggcaacagaggaagacucuucacagaaaaaaaaaaaaaaaaaaaaaaagcugcuaagucauuuaccauaagucacugagaacaggggaugucugaccagaugcaagugcugcuggaccaggcgggcugcuguaucgugggucagagugagcagcugguuccugcggacggaauccuauaugcagccaga

SEQ ID NO: 20131 - RNA, 2832 nt, Homo sapiens
ugcaguauccuucagggguuccaaaaacaccacucuuuuaccugcaccugccuuccguucaucagcggaggcaucacuagcggggccaggacugagaaucgaugaaugggcauugcuuugguguagcauauuuuucugucucuugguuuuacacuugcaggggcauggagucagauagagguacaaaaguaccaaaacgauacuggccacgcaagcagcaagagugguaaaagcuguguuaaaugccucaugagcaugggaucugcuuacagugaaauugcucacauuuauugugacguccacaguuucauuuaacaggcguugcuuauucauugcgauacaagaauacacuccagcauccucaaaacgagggcuuucuauaaccagacuuccauugugaaacacguaaaaguuuuccaucucuuuauccggcucuagcagucuguuaucuggacccacccagaugaaauccguauuugcauuaccugucuugcugucacaguggaccaucagucuuuccccgaccugagccucaugaauaaagccaagcgcacgaaaggaaccauugaugaugcugucagagcaauucauaaagcuauccuggagcagaaguaccugacgcgagugccuggagucagaccacaggcgacagguguaaucguucuuaaaauccaucacugagcuaaagugccuacgauaccaaaagaccagcaaggaguacagggaacagucacagacaaauggguuuccaugaagguagaugccucucagcuguuuuccuggcacuaaauuuauguggugcauuggcauggaaggaauucgguuauaagaaacaucuaaaaacaucaguucugccagcuugaaccuuccaacauacaaauccaucggaaacugugugagaaaauuuccacuuaaguagaguuucugcaacugggagagcccuccaaacgcugaaggaucgagauaggauaugugauuguuguaaagcagaagcacuuccagaaccuucaacucuuggaauacagcauuuuucaccgucuucagcuuauuggacgauaagucaagacacuucaaauuuggaguuguggaaaaacugcccguggaaaugcuggugauguuguuaugacgaagaauuaggguguucagcuuugcaaacgauacuggaauccacucagaauccagaagcccaauucuguuauaacucagguccagucucuuaaucagucugaaaagguucccaggcaccuuggacagguuuuuguuggugcagcugacgaugucaguggcacagaugcaagcgguggggcacaccccagaggcaccagggcccacagucacugugaucaucagcaaacacagcagcucccugcagcccggucugacgacggcuccaagcagggugggcagaguguguacacguaacgacauuauggucgccucugagucucuucccggugucuuuuccaccggcucagccucccaccagugaaccuggcaaacaauuaauaauucagagggaguaaaaagcagaaacugacuaccacuaguuaacccauaagagccauaccuuacuuucuuuccaauaacuuuugaaauggguuuuauuucacaauagggagcucuguguugccucuucacuguuaaauguauuuuuuccucuuuccuggguuaguccugcuuauaaaaauguacagucacauucucuccauacaacccaccgucucacccaccaucagaaacucaauuuuuuccuaaggugcauccugcguuguuguuguuguuguuguuguuuuaaacucccuccaacagacacaacuauacgcaaacguacgcuacaaacaauuaaacggaaauacuuagcaaccacccauccaggaaaaaacucacggugcuggggagccucgugggcuccggggaggcugccuacgcagugccuuccgaaggucugcgcguccgucuguccgugucugucacucuugcaccuuccgacuuccuuucccuccggcucccggcgggcggcacccucuagccggcucucaacuuugaggaguuucaagcagccgcggcggcagcagcagcccuggacgcagcagccaagcucuucgcuggcucccgggggcucucccggguuccucucauugcaggcugaagguaccgccucggcgcucuggccgccgugugcccgcgcgcggggcgccccgcucccagagccggggccgcgggagggggcgcaggcagccgggcggcagcgggcggccccgccucuccgcacucgggaggcugcaggacccgggguucccgcgcgcccggggccgggagacgggcuggggcgccggucccaccccugcgcguccugccuccugcgggcagcagcucggagccugcgggagggagcaggcugggcgcgugguggggggcgcgcgaugcggagggggcggcggcgcagccaauccgagaggcggccggcgcccccucauaccgccccgcggccucgccgccuccucccgcuuuccuccuccagcucccacccggaccucuagaacggccgcgcagagcggggagggggcagggguccacaccagaggcccagacucugguccuugagucaagaugcccaacccacucgccuaccaauuacgucccuucguccagcuccaagccgggcgguaaugggguccaggaaggcuaaaggggacacgcccagccaccgagggaggggucucacccuuggagacccacuucgcggcggccgcacaggucacgucucucuccccacccaggccaaggaauccccggaccucuuagagcuuugcuuuggggcaagggccaagg

SEQ ID NO: 20132 - RNA, 2832 nt, Homo sapiens
ccuuggcccuugccccaaagcaaagcucuaagagguccggggauuccuuggccuggguggggagagagacgugaccugugcggccgccgcgaagugggucuccaagggugagaccccucccucgguggcugggcguguccccuuuagccuuccuggaccccauuaccgcccggcuuggagcuggacgaagggacguaauugguaggcgaguggguugggcaucuugacucaaggaccagagucugggccucugguguggaccccugcccccuccccgcucugcgcggccguucuagagguccgggugggagcuggaggaggaaagcgggaggaggcggcgaggccgcggggcgguaugagggggcgccggccgccucucggauuggcugcgccgccgcccccuccgcaucgcgcgccccccaccacgcgcccagccugcucccucccgcaggcuccgagcugcugcccgcaggaggcaggacgcgcaggggugggaccggcgccccagcccgucucccggccccgggcgcgcgggaaccccggguccugcagccucccgagugcggagaggcggggccgcccgcugccgcccggcugccugcgcccccucccgcggccccggcucugggagcggggcgccccgcgcgcgggcacacggcggccagagcgccgaggcgguaccuucagccugcaaugagaggaacccgggagagcccccgggagccagcgaagagcuuggcugcugcguccagggcugcugcugccgccgcggcugcuugaaacuccucaaaguugagagccggcuagagggugccgcccgccgggagccggagggaaaggaagucggaaggugcaagagugacagacacggacagacggacgcgcagaccuucggaaggcacugcguaggcagccuccccggagcccacgaggcuccccagcaccgugaguuuuuuccuggaugggugguugcuaaguauuuccguuuaauuguuuguagcguacguuugcguauaguugugucuguuggagggaguuuaaaacaacaacaacaacaacaacaacgcaggaugcaccuuaggaaaaaauugaguuucugauggugggugagacgguggguuguauggagagaaugugacuguacauuuuuauaagcaggacuaacccaggaaagaggaaaaaauacauuuaacagugaagaggcaacacagagcucccuauugugaaauaaaacccauuucaaaaguuauuggaaagaaaguaagguauggcucuuauggguuaacuagugguagucaguuucugcuuuuuacucccucugaauuauuaauuguuugccagguucacuggugggaggcugagccgguggaaaagacaccgggaagagacucagaggcgaccauaaugucguuacguguacacacucugcccacccugcuuggagccgucgucagaccgggcugcagggagcugcuguguuugcugaugaucacagugacugugggcccuggugccucuggggugugccccaccgcuugcaucugugccacugacaucgucagcugcaccaacaaaaaccuguccaaggugccugggaaccuuuucagacugauuaagagacuggaccugaguuauaacagaauugggcuucuggauucugaguggauuccaguaucguuugcaaagcugaacacccuaauucuucgucauaacaacaucaccagcauuuccacgggcaguuuuuccacaacuccaaauuugaagugucuugacuuaucguccaauaagcugaagacggugaaaaaugcuguauuccaagaguugaagguucuggaagugcuucugcuuuacaacaaucacauauccuaucucgauccuucagcguuuggagggcucucccaguugcagaaacucuacuuaaguggaaauuuucucacacaguuuccgauggauuuguauguuggaagguucaagcuggcagaacugauguuuuuagauguuucuuauaaccgaauuccuuccaugccaaugcaccacauaaauuuagugccaggaaaacagcugagaggcaucuaccuucauggaaacccauuugucugugacuguucccuguacuccuugcuggucuuuugguaucguaggcacuuuagcucagugauggauuuuaagaacgauuacaccugucgccuguggucugacuccaggcacucgcgucagguacuucugcuccaggauagcuuuaugaauugcucugacagcaucaucaaugguuccuuucgugcgcuuggcuuuauucaugaggcucaggucggggaaagacugaugguccacugugacagcaagacagguaaugcaaauacggauuucaucuggguggguccagauaacagacugcuagagccggauaaagagauggaaaacuuuuacguguuucacaauggaagucugguuauagaaagcccucguuuugaggaugcuggaguguauucuuguaucgcaaugaauaagcaacgccuguuaaaugaaacuguggacgucacaauaaaugugagcaauuucacuguaagcagaucccaugcucaugaggcauuuaacacagcuuuuaccacucuugcugcuugcguggccaguaucguuuugguacuuuuguaccucuaucugacuccaugccccugcaaguguaaaaccaagagacagaaaaauaugcuacaccaaagcaaugcccauucaucgauucucaguccuggccccgcuagugaugccuccgcugaugaacggaaggcaggugcagguaaaagagugguguuuuuggaaccccugaaggauacugca

SEQ ID NO: 20133 - RNA, 3052 nt, Homo sapiens
caauuaauaauucagagggaguaaaaagcagaaacugacuaccacuaguuaacccauaagagccauaccuuacuuucuuuccaauaacuuuugaaauggguuuuauuucacaauagggagcucuguguugccucuucacuguuaaauguauuuuuuccucuuuccuggguuaguccugcuuauaaaaauguacagucacauucucuccauacaacccaccgucucacccaccaucagaaacucaauuuuuuccuaaggugcauccugcguuguuguuguuguuguuguuguuuuaaacucccuccaacagacacaacuauacgcaaacguacgcuacaaacaauuaaacggaaauacuuagcaaccacccauccaggaaaaaacucacggugcuggggagccucgugggcuccggggaggcugccuacgcagugccuuccgaaggucugcgcguccgucuguccgugucugucacucuugcaccuuccgacuuccuuucccuccggcucccggcgggcggcacccucuagccggcucucaacuuugaggaguuucaagcagccgcggcggcagcagcagcccuggacgcagcagccaagcucuucgcuggcucccgggggcucucccggguuccucucauugcaggcugaagguaccgccucggcgcucuggccgccgugugcccgcgcgcggggcgccccgcucccagagccggggccgcgggagggggcgcaggcagccgggcggcagcgggcggccccgccucuccgcacucgggaggcugcaggacccgggguucccgcgcgcccggggccgggagacgggcuggggcgccggucccaccccugcgcguccugccuccugcgggcagcagcucggagccugcgggagggagcaggcugggcgcgugguggggggcgcgcgaugcggagggggcggcggcgcagccaauccgagaggcggccggcgcccccucauaccgccccgcggccucgccgccuccucccgcuuuccuccuccagcucccacccggaccucuagaacggccgcgcagagcggggagggggcagggguccacaccagaggcccagacucugguccuugagucaagaugcccaacccacucgccuaccaauuacgucccuucguccagcuccaagccgggcgguaaugggguccaggaaggcuaaaggggacacgcccagccaccgagggaggggucucacccuuggagacccacuucgcggcggccgcacaggucacgucucucuccccacccaggccaaggaauccccggaccucuuagagcuuugcuuuggggcaagggccaaggaggcuuugccugcgccaagugcaguugacugucuggguuuacaaaauaaacccagaagcagccugacgucuccgcucguuucuagggaggaggucgcggggagggaagucgggaacguuuccucuccacagggauaucugcugggaggaaguaaccgggaaaucgccacggggacaccccucaccucccugggaaaguucuaucccuuuccugacucaggaggcggcaacagggaugguguccaauucaagaaggaggagggcaggaaagaaggcuuggagccgaccuuccggcuggaaugcaaagauaagaguauuaacccaaauaauaauaauaaucccagagcagaccuuuuuuucuuuuuucucucuucuccuuccccucuucucucucccucucucucucccucucucuccuuucucuuucguucucucucucucauuuccucugucucuguccccgccaccuccccgucuuuugcaagcgugcucguggcgcgugcgggacagggaaguaaggggcgugugcgcggaggcucuucaucccuuccggagaugccgcggccgaccagcgcgcuuugguucagcaagcacagaaggugcaagccgaacaaggccauucagaaaugagguggagacuaugaggcugaugagcucuacgauuaaaaauccauuuuuguuuaauuccaagauaaguuuuaacgaugggauuugagugagucagaucgcccauuuggccauuauauccggauuaaaagaaauaaauuacugccuugacaaaagaugccaaccacaguggaaugaaaagcaaccaaauugaggaaacaguuggggcaggauagauaacuuguaauauuacuuaaaaauaaaaaugaugaggacaaccaacucuuccuccccucccccgcgcaccuuuucacuugagcaaucuugaauuuagugaaaguuguuuccuacaugguccgugagucauugcuguggucaggcagauuuguuagaccaacaccuaauuuaaauagaauuguuuguggaauaaagccgggcuagcacuaauaaaucuaggcauuuucagaugaggacaacuugauucagauuaauuuauuucaugaaaguugaauuuuaucauaagaacacagccuaaaaugcuucaugcaagcauuucuuacuguguacuuaaaggggagaggcagaaguugagauuuucuaguauuaggccacacuuccugggauucucaaaagcuuggucuccaggacuucaauuuuauagaguuagaauaguuaauacagaggaauagaauuaaaaucgcucagaggaauauuuuuuaaaugacuaauaaaugaccagguuuuugcaggauuuuacuaauuaacaucguauuuuaaggaaaccaugaaggcagaagaaagaccuguauuuaaugcaaaaauagucuaaaaagaauaagugauucaaaaaaauggaaacaggaagguuauauuauuauaacuacaggcauauuguagaaacauuaugcagagauuacacagcaaaaguaaacuaaaugcacucaaaauccauagacaaggcuauuuauccauuugaagaccugauuugggggauuucacauguuugugaaagggaagaacguuguaaaaggauugaguuuacuagcugggaggaaagaaagauaagaguugaucuuaagguauaagacgugaccuuauuuuguggaggauaaca

SEQ ID NO: 20134 - RNA, 3052 nt, Homo sapiens
uguuauccuccacaaaauaaggucacgucuuauaccuuaagaucaacucuuaucuuucuuuccucccagcuaguaaacucaauccuuuuacaacguucuucccuuucacaaacaugugaaaucccccaaaucaggucuucaaauggauaaauagccuugucuauggauuuugagugcauuuaguuuacuuuugcuguguaaucucugcauaauguuucuacaauaugccuguaguuauaauaauauaaccuuccuguuuccauuuuuuugaaucacuuauucuuuuuagacuauuuuugcauuaaauacaggucuuucuucugccuucaugguuuccuuaaaauacgauguuaauuaguaaaauccugcaaaaaccuggucauuuauuagucauuuaaaaaauauuccucugagcgauuuuaauucuauuccucuguauuaacuauucuaacucuauaaaauugaaguccuggagaccaagcuuuugagaaucccaggaaguguggccuaauacuagaaaaucucaacuucugccucuccccuuuaaguacacaguaagaaaugcuugcaugaagcauuuuaggcuguguucuuaugauaaaauucaacuuucaugaaauaaauuaaucugaaucaaguuguccucaucugaaaaugccuagauuuauuagugcuagcccggcuuuauuccacaaacaauucuauuuaaauuagguguuggucuaacaaaucugccugaccacagcaaugacucacggaccauguaggaaacaacuuucacuaaauucaagauugcucaagugaaaaggugcgcgggggaggggaggaagaguugguuguccucaucauuuuuauuuuuaaguaauauuacaaguuaucuauccugccccaacuguuuccucaauuugguugcuuuucauuccacugugguuggcaucuuuugucaaggcaguaauuuauuucuuuuaauccggauauaauggccaaaugggcgaucugacucacucaaaucccaucguuaaaacuuaucuuggaauuaaacaaaaauggauuuuuaaucguagagcucaucagccucauagucuccaccucauuucugaauggccuuguucggcuugcaccuucugugcuugcugaaccaaagcgcgcuggucggccgcggcaucuccggaagggaugaagagccuccgcgcacacgccccuuacuucccugucccgcacgcgccacgagcacgcuugcaaaagacggggagguggcggggacagagacagaggaaaugagagagagagaacgaaagagaaaggagagagagggagagagagagggagagagaagaggggaaggagaagagagaaaaaagaaaaaaaggucugcucugggauuauuauuauuauuuggguuaauacucuuaucuuugcauuccagccggaaggucggcuccaagccuucuuuccugcccuccuccuucuugaauuggacaccaucccuguugccgccuccugagucaggaaagggauagaacuuucccagggaggugagggguguccccguggcgauuucccgguuacuuccucccagcagauaucccuguggagaggaaacguucccgacuucccuccccgcgaccuccucccuagaaacgagcggagacgucaggcugcuucuggguuuauuuuguaaacccagacagucaacugcacuuggcgcaggcaaagccuccuuggcccuugccccaaagcaaagcucuaagagguccggggauuccuuggccuggguggggagagagacgugaccugugcggccgccgcgaagugggucuccaagggugagaccccucccucgguggcugggcguguccccuuuagccuuccuggaccccauuaccgcccggcuuggagcuggacgaagggacguaauugguaggcgaguggguugggcaucuugacucaaggaccagagucugggccucugguguggaccccugcccccuccccgcucugcgcggccguucuagagguccgggugggagcuggaggaggaaagcgggaggaggcggcgaggccgcggggcgguaugagggggcgccggccgccucucggauuggcugcgccgccgcccccuccgcaucgcgcgccccccaccacgcgcccagccugcucccucccgcaggcuccgagcugcugcccgcaggaggcaggacgcgcaggggugggaccggcgccccagcccgucucccggccccgggcgcgcgggaaccccggguccugcagccucccgagugcggagaggcggggccgcccgcugccgcccggcugccugcgcccccucccgcggccccggcucugggagcggggcgccccgcgcgcgggcacacggcggccagagcgccgaggcgguaccuucagccugcaaugagaggaacccgggagagcccccgggagccagcgaagagcuuggcugcugcguccagggcugcugcugccgccgcggcugcuugaaacuccucaaaguugagagccggcuagagggugccgcccgccgggagccggagggaaaggaagucggaaggugcaagagugacagacacggacagacggacgcgcagaccuucggaaggcacugcguaggcagccuccccggagcccacgaggcuccccagcaccgugaguuuuuuccuggaugggugguugcuaaguauuuccguuuaauuguuuguagcguacguuugcguauaguugugucuguuggagggaguuuaaaacaacaacaacaacaacaacaacgcaggaugcaccuuaggaaaaaauugaguuucugauggugggugagacgguggguuguauggagagaaugugacuguacauuuuuauaagcaggacuaacccaggaaagaggaaaaaauacauuuaacagugaagaggcaacacagagcucccuauugugaaauaaaacccauuucaaaaguuauuggaaagaaaguaagguauggcucuuauggguuaacuagugguagucaguuucugcuuuuuacucccucugaauuauuaauug

SEQ ID NO: 20135 - RNA, 2770 nt, Homo sapiens
aaccaccugauguaguagccaccugauguagcccacucggucccaggccuuucuccauucacagccugggcuuuggacaccugcuaucuguucuggggguagaguguagggguucaggagguccucucggagcuuccucuggggcuuaguuacaaaagagaucaguuuugaggucaaauaggggaagaauacugagaaaccauaaacacaaacuaucagggcaccccaaacagcacccgaccuuccauaauguuuauacaaacaaagucugauggccucugccgaagaggaguaaaggguugggaaggcuuucuaacucucauuuuuuccccuccuuucuuaccccauuuucuagucccuccuuuagcuugguaaggguccaagucacagcugaucaagaccagccaaacccaaagccaugggacccagccagagcauagacugugaauuccccagcuuuuugcaguuugagucagccccacagcuggauuggccucccaggacucuucucaaauagguccagagaggcugcugagugggggccacggacucugcagggagggcuacuucuguucaacgaucucuagcacccaaaacaaaagccagggagaaaugugcagucuuacuaccuucuggucuggcugcaugccagcccugagacuguuucagaaagacucacaguucccuccagcacuuggacagggaagggacggcaggucucucaacacacaacacucuuaguccauagaauugaggcuccaauguucagauaacccauuucuaccucagcaaaucacccucacucccuagccugaguuaaagccuucuuugccaacaccaugacuucucuggccccagacuuuccuaauuucuuuugcucacccccuucacuagcagagaugggcugcuaaugagaccacuaggcagaaauggaaggaagggcuggaaaagccugcagugcugggaugcaccuccuuaucccaggagaaagaugagauguagauuuaucauaaagccacuaucccuucacggucaccuccugcuagaaucaucucauagccauuccauaagcacugcuguguuggguaucugagccccugcccaugaggaagaccaccuuccagcagggagcuggagcagagcugaacucugcccaggagagcuucugcaaugcucagaaaaugccugcccaacugcuugccugggcucuggccccuuuggcugcaacugagcccagacaggaggcugacucacucaccgcacgcauagaggaggaggaggaacaagaggaggaggaggaggaggaggagaaggaggaggaacugugagaagggucugggcuuggagaccuaaggcucccccagcccaggcuaggucucagacucuggucccugggugaagagaaggaggggcaguuguacacuggcccuggagaccacaggcuguucccuccuagauacuucugaaucuuccucaccaccacccacagauccagggcaccucacuuuucaaacagaaacuacuccuugagccccuuccucauuuaaaugcuugccccugaguuccucugaacaucuauugacaggcuguccugaaaaaaaauagggccaauuaggucuaaacucauugguaguucaaagaaaaguaaaaaaaaaaaaaaaaaaaaaaaaauuacuuaaaagacccaacuccaccaucacaggugaccauaccugggcccuguaagacaauaaauaagguuacacacccuccacuccagcaguucugagcaccaucgacagccaaucgcuccuuuucuuauuccuccacuccaugccaaggcgccccgacagaagaaggaaacaaauacuucuuguugcccaagugcuaagcacuguguuagcggagcauuucuccuaagcgccgaggaugucgcugcuccccucgccagccuggcacgaacuucagcuuucucaaaccucagugccccuuagugucccagccucauggcacgacagcccggaccucaguagccaaguuuaccgcugagacuuagacucuaaugcucgcagccgggcgcucaggccccgguaucccagacgccccgaccccgagucccuauccugagacccccuuucccgcugcucccggguucgcaccugguccggccggcggguggacaagcuguuccgcgcucccggcgcacacggcuccgcugccgccuuuugacaagcagagacagcccagcaccuggccccgccucucggucaggccccgccccggccccgccccgccccuccgccccgcccacagguccaguccucucuugccaggagcuccguuggcgcugcaaccaucuugacuuggaaucaaccacccuauaggccacgcuguagccuuagauacucuaacucgugaaauuuucaucgaccgucguccauagggcaaggcacgcuucugcccucugugggacagaguugucgaugauuauaggugcggauacccgcuucagccuguguuaaucggggaugcagccccccacccuuccugccgugguucuacccagccugcugcggacgccugagccaggugcgucacccccaccugggcugaccaggccaggacuucgucguccgcgggacgcuggggggcgccugccgacuggcaccggcggcuagcuccgcacgaaugggaaaucccgggcuccgcucgccaaccuguuacugcugcagaacgccaggaagcucagccugaucccacagauuaggguaaaauaucccggggggccgaa

SEQ ID NO: 20136 - RNA, 2770 nt, Homo sapiens
uucggccccccgggauauuuuacccuaaucugugggaucaggcugagcuuccuggcguucugcagcaguaacagguuggcgagcggagcccgggauuucccauucgugcggagcuagccgccggugccagucggcaggcgccccccagcgucccgcggacgacgaaguccuggccuggucagcccaggugggggugacgcaccuggcucaggcguccgcagcaggcuggguagaaccacggcaggaaggguggggggcugcauccccgauuaacacaggcugaagcggguauccgcaccuauaaucaucgacaacucugucccacagagggcagaagcgugccuugcccuauggacgacggucgaugaaaauuucacgaguuagaguaucuaaggcuacagcguggccuauagggugguugauuccaagucaagaugguugcagcgccaacggagcuccuggcaagagaggacuggaccugugggcggggcggaggggcggggcggggccggggcggggccugaccgagaggcggggccaggugcugggcugucucugcuugucaaaaggcggcagcggagccgugugcgccgggagcgcggaacagcuuguccacccgccggccggaccaggugcgaacccgggagcagcgggaaagggggucucaggauagggacucggggucggggcgucugggauaccggggccugagcgcccggcugcgagcauuagagucuaagucucagcgguaaacuuggcuacugagguccgggcugucgugccaugaggcugggacacuaaggggcacugagguuugagaaagcugaaguucgugccaggcuggcgaggggagcagcgacauccucggcgcuuaggagaaaugcuccgcuaacacagugcuuagcacuugggcaacaagaaguauuuguuuccuucuucugucggggcgccuuggcauggaguggaggaauaagaaaaggagcgauuggcugucgauggugcucagaacugcuggaguggaggguguguaaccuuauuuauugucuuacagggcccagguauggucaccugugaugguggaguugggucuuuuaaguaauuuuuuuuuuuuuuuuuuuuuuuuuacuuuucuuugaacuaccaaugaguuuagaccuaauuggcccuauuuuuuuucaggacagccugucaauagauguucagaggaacucaggggcaagcauuuaaaugaggaaggggcucaaggaguaguuucuguuugaaaagugaggugcccuggaucugugggugguggugaggaagauucagaaguaucuaggagggaacagccuguggucuccagggccaguguacaacugccccuccuucucuucacccagggaccagagucugagaccuagccugggcugggggagccuuaggucuccaagcccagacccuucucacaguuccuccuccuucuccuccuccuccuccuccuccucuuguuccuccuccuccucuaugcgugcggugagugagucagccuccugucugggcucaguugcagccaaaggggccagagcccaggcaagcaguugggcaggcauuuucugagcauugcagaagcucuccugggcagaguucagcucugcuccagcucccugcuggaagguggucuuccucaugggcaggggcucagauacccaacacagcagugcuuauggaauggcuaugagaugauucuagcaggaggugaccgugaagggauaguggcuuuaugauaaaucuacaucucaucuuucuccugggauaaggaggugcaucccagcacugcaggcuuuuccagcccuuccuuccauuucugccuaguggucucauuagcagcccaucucugcuagugaagggggugagcaaaagaaauuaggaaagucuggggccagagaagucaugguguuggcaaagaaggcuuuaacucaggcuagggagugagggugauuugcugagguagaaauggguuaucugaacauuggagccucaauucuauggacuaagaguguuguguguugagagaccugccgucccuucccuguccaagugcuggagggaacugugagucuuucugaaacagucucagggcuggcaugcagccagaccagaagguaguaagacugcacauuucucccuggcuuuuguuuugggugcuagagaucguugaacagaaguagcccucccugcagaguccguggcccccacucagcagccucucuggaccuauuugagaagaguccugggaggccaauccagcuguggggcugacucaaacugcaaaaagcuggggaauucacagucuaugcucuggcugggucccauggcuuuggguuuggcuggucuugaucagcugugacuuggacccuuaccaagcuaaaggagggacuagaaaaugggguaagaaaggaggggaaaaaaugagaguuagaaagccuucccaacccuuuacuccucuucggcagaggccaucagacuuuguuuguauaaacauuauggaaggucgggugcuguuuggggugcccugauaguuuguguuuaugguuucucaguauucuuccccuauuugaccucaaaacugaucucuuuuguaacuaagccccagaggaagcuccgagaggaccuccugaaccccuacacucuacccccagaacagauagcagguguccaaagcccaggcugugaauggagaaaggccugggaccgagugggcuacaucagguggcuacuacaucaggugguu

SEQ ID NO: 20137 - RNA, 2563 nt, Homo sapiens
ggagggugcaggggagacaaaaaucucuccccuuauggagcuuucauucucaaaacuuaagcacuuggccuccccaucugggacaaacucccagagaccugcguaggagcgguagggucucauaaaggagggagucccauccuucccccgcuccggugauuucuauagcuagagggcugauuuacugcagaaaccuccguagcgcccuccuccugccucugcaccgucaggcccgguggguccggcuccagagcgccaccgugccccagcucaacucugggaucauuagcaacagccucucuacccucuccgcuuuccugcgcaucgcuggaggacagggaggcaggacucgacuuuagcgccauccucugagaaaggaaugcgggcuggaaaaaucuuuccagggcagucucgcugggucucauaccccggcuaggggagggacgaucucucccggacuuggagguuucugcagcagacggcucucucauacuucccuauuaaacauugcgaccacacgcucuuuccagccuuggccgaagccacuguagcguccccucuccuccccccaccccgcuaguccagacuccagagccccacugcagcuuccagccauccucccuuuuucuucgccacuuccugguuaccauggagacacacgucauuuacgugccgugcgucgccuuggaaacagaggagcauccgcgacacccccgggagacccaccccagcugcugcugccacacucgcgggcgcugcccgguaauggccugggggagucccgaguccgacgcgccgcuggccucagccuggacgcggaccccuccgcgagcgcgucugugacccacggaaccggcaggcgcucucugcuuguggcgcccagagggcggcgcugacacgggcgcgauccgggaggcgaggcagggcagggcacuuucgucccggggcgaucccaagagacgccggcucugggacccucgccggguccucgucccgcagccucuucucggccucccgcgauccugccugcgcccucugcccaggacucgucucucacgucggcuccccgccagucucgggagccuccgcuucccucggcucccgcuagccccucccgggaccucucccccuccacccccucccccaccccggaggccgggcuggacgcgacccagagccuccgccacccgcuucugccacucaauggaggacggucugcuggagaucaugaccaaggacggcggcgacaugccggcgccccuggagguguccaccgugccggcagugggggacgugaucuccggggaguacaacggcggcaugaaggaacugauggagcaccugaaagcccagcugcaagcccuguuugaggacgugagggccaugaggggggcccuggacgagcaggccucgcacauccaggugcucucggacgacgugugcgccaaccagcgagccaucgucuccaugugccagauuaugaccacugcgccccgccagggcggcuugggcguggucggcggcaaggggagcuuccagagcgacccccaagagccggagacuccuucgccugggaucggggacagcggcuugcugggucgcgaucccgaggacgaggaggaagaggaagaagagaaggagaugcccagccccgccacacccuccagucacugugagcgccccgaaagccccugugcuggucuccuugggggggacgggccacuuguggagccccucgacaugcccgacauuacccugcugcaacuggagggcgaggccucccugugaggggacuccguggggcacuaccuucccgggcugucuuuggguuuccgagugcaugacgcgagggggacugaacggcgcggugcggcaugcuucacuuggacagcugcucuugugggucaggcagagagagacucccucgaggaaggauuuguagggugaaggacuuugggagcaucgagaauucuuucugcccaacuaagcgaauuauagcgaacugcggaaaggugaggcuccgggagaggaagcgcccaucucuggacucccauccaucccuauccuguccuuucccccuucccagacaacaggagaacccgugaauuguguaaauaaaauucugcuuuuucuauucugaaaaaggacuuaccuaggaccauggcaaauaaucucuaacaauuuaccuggaaauuaaggaauuggggguauuuuguucuggcaacaggaaauuuacccuucugcugaaauccaagauauucagugcucugcagaagccucucccccucacagaucucugcggcugcugauugguaaaggaagcuugaggagggaacugcagcccuaggaaucugggugaaugggguuccaagggccccugggcugggaggagcuggcuaugaaugugcaugaagacauaauagcucaaccucuaggauuuugcaugcagagcggauccugccuugucacugacuucaucugggauugcuuuuccacucccuggggcuuagagaacaaagagcccgguucacaggcagagacucgggggugcucagcagcagcc

SEQ ID NO: 20138 - RNA, 2563 nt, Homo sapiens
ggcugcugcugagcacccccgagucucugccugugaaccgggcucuuuguucucuaagccccagggaguggaaaagcaaucccagaugaagucagugacaaggcaggauccgcucugcaugcaaaauccuagagguugagcuauuaugucuucaugcacauucauagccagcuccucccagcccaggggcccuuggaaccccauucacccagauuccuagggcugcaguucccuccucaagcuuccuuuaccaaucagcagccgcagagaucugugagggggagaggcuucugcagagcacugaauaucuuggauuucagcagaaggguaaauuuccuguugccagaacaaaauacccccaauuccuuaauuuccagguaaauuguuagagauuauuugccaugguccuagguaaguccuuuuucagaauagaaaaagcagaauuuuauuuacacaauucacggguucuccuguugucugggaagggggaaaggacaggauagggauggaugggaguccagagaugggcgcuuccucucccggagccucaccuuuccgcaguucgcuauaauucgcuuaguugggcagaaagaauucucgaugcucccaaaguccuucacccuacaaauccuuccucgagggagucucucucugccugacccacaagagcagcuguccaagugaagcaugccgcaccgcgccguucagucccccucgcgucaugcacucggaaacccaaagacagcccgggaagguagugccccacggaguccccucacagggaggccucgcccuccaguugcagcaggguaaugucgggcaugucgaggggcuccacaaguggcccgucccccccaaggagaccagcacaggggcuuucggggcgcucacagugacuggaggguguggcggggcugggcaucuccuucucuucuuccucuuccuccucguccucgggaucgcgacccagcaagccgcuguccccgaucccaggcgaaggagucuccggcucuugggggucgcucuggaagcuccccuugccgccgaccacgcccaagccgcccuggcggggcgcaguggucauaaucuggcacauggagacgauggcucgcugguuggcgcacacgucguccgagagcaccuggaugugcgaggccugcucguccagggccccccucauggcccucacguccucaaacagggcuugcagcugggcuuucaggugcuccaucaguuccuucaugccgccguuguacuccccggagaucacgucccccacugccggcacgguggacaccuccaggggcgccggcaugucgccgccguccuuggucaugaucuccagcagaccguccuccauugaguggcagaagcggguggcggaggcucugggucgcguccagcccggccuccggggugggggaggggguggagggggagaggucccgggaggggcuagcgggagccgagggaagcggaggcucccgagacuggcggggagccgacgugagagacgaguccugggcagagggcgcaggcaggaucgcgggaggccgagaagaggcugcgggacgaggacccggcgagggucccagagccggcgucucuugggaucgccccgggacgaaagugcccugcccugccucgccucccggaucgcgcccgugucagcgccgcccucugggcgccacaagcagagagcgccugccgguuccgugggucacagacgcgcucgcggagggguccgcguccaggcugaggccagcggcgcgucggacucgggacucccccaggccauuaccgggcagcgcccgcgaguguggcagcagcagcuggggugggucucccgggggugucgcggaugcuccucuguuuccaaggcgacgcacggcacguaaaugacgugugucuccaugguaaccaggaaguggcgaagaaaaagggaggauggcuggaagcugcaguggggcucuggagucuggacuagcgggguggggggaggagaggggacgcuacaguggcuucggccaaggcuggaaagagcguguggucgcaauguuuaauagggaaguaugagagagccgucugcugcagaaaccuccaaguccgggagagaucgucccuccccuagccgggguaugagacccagcgagacugcccuggaaagauuuuuccagcccgcauuccuuucucagaggauggcgcuaaagucgaguccugccucccuguccuccagcgaugcgcaggaaagcggagaggguagagaggcuguugcuaaugaucccagaguugagcuggggcacgguggcgcucuggagccggacccaccgggccugacggugcagaggcaggaggagggcgcuacggagguuucugcaguaaaucagcccucuagcuauagaaaucaccggagcgggggaaggaugggacucccuccuuuaugagacccuaccgcuccuacgcaggucucugggaguuugucccagauggggaggccaagugcuuaaguuuugagaaugaaagcuccauaaggggagagauuuuugucuccccugcacccucc

SEQ ID NO: 20139 - RNA, 3281 nt, Homo sapiens
cucauugucugucuaaccauucccuagccccaaucuuuucagaccucagaauuagagcaugggaacaacagcuguugaaggagcaggacagcauauuuauuauauguagcaggaaacaccuagugauuuacggucccuuuuuaaacucagccugaauaugcauuuuuggggagggguggauuuuauuuucuuucucuuauucccggcuuuuacuccuuaauuaugacucugagccagucuauugaaaaaggucugggguaaagagauaaugggaaggggucagaaucaaggcaaaggauagccuagcacuaagggcuuggggcugagaggcuggaaaaacauuguuucuacauucuagagagacagggcauauucuaccucaccccaguagagggaaaacagucagagccaaccuccccucugcccugccggccacuauucacaacugacuaugcccuauauuaagccaucucccccaacuuccaaaacaucgaugaugcauugcuucauccccgagcugcagcggugugacgaguggggcugagcugcggcaggaggacagcaguggcccaagauggaaugcaggagacaaaacugagucugagcaaccuuuccccaaagcagacuugucucuccgccccaaccacgcugccuccagcagcacugccucuugccucuuauuuggcuuugcucuggggaaguaaaaggugugugugugugugugugugugugugugugugcgcgcgcgcgcgugugugugcauguguguacgcgugcauguugggugguagggaauggaaauggagaaguccuguuuuacugcccacccccaggacuauucaugggucccuucaccucaccaucccagcccucuaaaggguggaaccagacccagggaagagaguggcuccugggguucacccacucugcacccuuggaccaugcaacugaguccaccaacugucagcccuccccacaacuaaugagucuucagauccucuuuuuucacuucuccccaccaaaggggaaaacaauuucuaaaagacagcagcuacacagcagaccaguaggggugggaaagggguauuuggagcagaauucuuaccugagguaucccagagacuaagcuccacccucuguuccucugucuccaaacaggcuguguaauuuucgaacacggugggcacauaggucugugaaaagagaggaaacauucaccccaugcaccccuacccucagauccccugguuagugcuggcuacacacgcacucaccagagagacaguaaagucacaggagacaagaaaccagaggagaugccuggggcaggagggaagggacuguggaggaccaggcacuuugcucugcagcagugagaaaugugaaugacacccccccacaccaccacaccagggguaagccccccauauccuaggcgaucagggacacacacacacacagauuccucccauccccagauuuguguuucccaauuugagagagccacaggccaaagccaauccuagcucaucuccucucaaaccccucccggccaggugaacagaggggcugcagaagccugccugaaggcacaggcauagagccuuugaggagcaggugagcggauaggcagggauuacgucaagaagaaaccccagacuuucaaaugccuccagugcccucaccugagagcagacuccagggacgcaggaagguggaggggaucugauggguccucugggugaagaggugaggaggagccagcggggcggcagaaguggaacaggucucaggggaagcuaaggcagggcaguccuccagccaaaaagcagcugaggaugguaaagccucagaaagcggcugaggaugggcuggggcugggggagccacgucuccugagcagguggaaaucuaccccaaggcgggcaggcagggagaaaagccggccagcgggcgggcgggcagcucaccucuggauagcaauccuucgcuaacacuugcaacaucgcggucuucccacacugcacguccccgaccagaacgagcuuacaucuggccacgacuggcuggggggcccgucucuccuucaugguugcaguguccgcgggacuugaacuucgauucagaagggaggguugcgccaggugcgucucagcacgccaaucaagccagauucccugccucccuccaacugaggaggaggccggcacagccgccuuuuauuuuucuggcugagccaaucacaagaggaggcggacucuguuacgcccaaucccugaggugggauucccuccagcagccaauggaucugaggaucugagucagcgcccccuuccucccuucucuuucucuuaaagcugcaccguuguuucccccugaaaggggauucccagguuguuuugcauuuguauuaggaaguggaaaggguacuggaagcaaaaugaaaugaucuggagugucuaccaauaagugucagaaaaacaaacuagcuauggaagcaggaagugaggucaggcuggaguugcagggacugucccggguggguuacaaaagcaggaccugcuuagacuauagacagguguguguguguguguguguuuuggaggaguaggggaugggggagguggcccagaacuucucugacauuuuuuuucuuuuuuuuccuuacaucuuuuguuuuaaauagagacaggggucucaccauguuauccaggcuggucuugaacuucugggcucaagcaauccgccugucucagccucccaaagugcugggacuacagacaugagccacagcgccuggccugaugucugacuuuuuuguuuuuucuaauucccauccaaaccaguucuuacuucccuuuauuuccccucccaauaucagcuccugcuguaccucuuuuauuuauuuauuuauuuauuuauuuauuuauuuauuuauuuauuuauuuauuuugagauggaguuucgcucuuguugcccaggcuggagugcaauggcacgaucucagcucacugcaaccuccaucucccggauucaagcgauucuccugccucagccucccgaguagcugggauuacaggcaugcaccaccaugcccagcuaauguuguauuuuuaguagagacgggguuucuccauguuggucaggcuggucucgaacucccgaccucaggcgauccgcccgccuuggccucccaaagugcugggauuauaggcgucagccaccgugcccggccugugccccuuuuaaagccuucucuucuucaagaaucaccuucacca

SEQ ID NO: 20140 - RNA, 3281 nt, Homo sapiens
uggugaaggugauucuugaagaagagaaggcuuuaaaaggggcacaggccgggcacgguggcugacgccuauaaucccagcacuuugggaggccaaggcgggcggaucgccugaggucgggaguucgagaccagccugaccaacauggagaaaccccgucucuacuaaaaauacaacauuagcugggcaugguggugcaugccuguaaucccagcuacucgggaggcugaggcaggagaaucgcuugaauccgggagauggagguugcagugagcugagaucgugccauugcacuccagccugggcaacaagagcgaaacuccaucucaaaauaaauaaauaaauaaauaaauaaauaaauaaauaaauaaauaaauaaauaaaagagguacagcaggagcugauauugggaggggaaauaaagggaaguaagaacugguuuggaugggaauuagaaaaaacaaaaaagucagacaucaggccaggcgcuguggcucaugucuguagucccagcacuuugggaggcugagacaggcggauugcuugagcccagaaguucaagaccagccuggauaacauggugagaccccugucucuauuuaaaacaaaagauguaaggaaaaaaaagaaaaaaaaugucagagaaguucugggccaccucccccauccccuacuccuccaaaacacacacacacacacacaccugucuauagucuaagcagguccugcuuuuguaacccacccgggacagucccugcaacuccagccugaccucacuuccugcuuccauagcuaguuuguuuuucugacacuuauugguagacacuccagaucauuucauuuugcuuccaguacccuuuccacuuccuaauacaaaugcaaaacaaccugggaauccccuuucagggggaaacaacggugcagcuuuaagagaaagagaagggaggaagggggcgcugacucagauccucagauccauuggcugcuggagggaaucccaccucagggauugggcguaacagaguccgccuccucuugugauuggcucagccagaaaaauaaaaggcggcugugccggccuccuccucaguuggagggaggcagggaaucuggcuugauuggcgugcugagacgcaccuggcgcaacccucccuucugaaucgaaguucaagucccgcggacacugcaaccaugaaggagagacgggccccccagccagucguggccagauguaagcucguucuggucggggacgugcagugugggaagaccgcgauguugcaaguguuagcgaaggauugcuauccagaggugagcugcccgcccgcccgcuggccggcuuuucucccugccugcccgccuugggguagauuuccaccugcucaggagacguggcucccccagccccagcccauccucagccgcuuucugaggcuuuaccauccucagcugcuuuuuggcuggaggacugcccugccuuagcuuccccugagaccuguuccacuucugccgccccgcuggcuccuccucaccucuucacccagaggacccaucagauccccuccaccuuccugcgucccuggagucugcucucaggugagggcacuggaggcauuugaaagucugggguuucuucuugacguaaucccugccuauccgcucaccugcuccucaaaggcucuaugccugugccuucaggcaggcuucugcagccccucuguucaccuggccgggagggguuugagaggagaugagcuaggauuggcuuuggccuguggcucucucaaauugggaaacacaaaucuggggaugggaggaaucugugugugugugugucccugaucgccuaggauauggggggcuuaccccuggugugguggugugggggggugucauucacauuucucacugcugcagagcaaagugccugguccuccacagucccuucccuccugccccaggcaucuccucugguuucuugucuccugugacuuuacugucucucuggugagugcguguguagccagcacuaaccaggggaucugaggguaggggugcauggggugaauguuuccucucuuuucacagaccuaugugcccaccguguucgaaaauuacacagccuguuuggagacagaggaacagaggguggagcuuagucucugggauaccucagguaagaauucugcuccaaauaccccuuucccaccccuacuggucugcuguguagcugcugucuuuuagaaauuguuuuccccuuugguggggagaagugaaaaaagaggaucugaagacucauuaguuguggggagggcugacaguugguggacucaguugcaugguccaagggugcagagugggugaaccccaggagccacucucuucccugggucugguuccacccuuuagagggcugggauggugaggugaagggacccaugaauaguccugggggugggcaguaaaacaggacuucuccauuuccauucccuaccacccaacaugcacgcguacacacaugcacacacacgcgcgcgcgcgcacacacacacacacacacacacacacacacaccuuuuacuuccccagagcaaagccaaauaagaggcaagaggcagugcugcuggaggcagcgugguuggggcggagagacaagucugcuuuggggaaagguugcucagacucaguuuugucuccugcauuccaucuugggccacugcuguccuccugccgcagcucagccccacucgucacaccgcugcagcucggggaugaagcaaugcaucaucgauguuuuggaaguugggggagauggcuuaauauagggcauagucaguugugaauaguggccggcagggcagaggggagguuggcucugacuguuuucccucuacuggggugagguagaauaugcccugucucucuagaauguagaaacaauguuuuuccagccucucagccccaagcccuuagugcuaggcuauccuuugccuugauucugaccccuucccauuaucucuuuaccccagaccuuuuucaauagacuggcucagagucauaauuaaggaguaaaagccgggaauaagagaaagaaaauaaaauccaccccuccccaaaaaugcauauucaggcugaguuuaaaaagggaccguaaaucacuagguguuuccugcuacauauaauaaauaugcuguccugcuccuucaacagcuguuguucccaugcucuaauucugaggucugaaaagauuggggcuagggaaugguuagacagacaaugag

SEQ ID NO: 20141 - RNA, 2749 nt, Homo sapiens
cuccaccgcuaggcuccuuuugguuagcucacccccacaacucauccccgggauuucccugaccacagccgcacucacgcccccgucuccccuuuuuccuucucuguccagccaucggggguuccugggcgguuaagcaucuccccggagucgcugcccagaaccacagcuuuccuuccgacacucaggaugggggagagaggggacgucggaggggcccggggugacgucgaggggacaaccccaccgcgggcggcgaggcgggcugggccccuggcgggcucuccccgcagcacacucucgccgcgcccccuggcggaugcuaguccucgacgggcuccggacgcucagcugagugaggcgggcgcgcgugggagggugucccaaggggagggguccgcggccagugcaggcccggaggcgggggccaccgggcagggggcgggggugagccccgacggccaacccgucagcucucggcucagacgggcgggaaccacagccccgcucgcugcccauugucugcgccccuaaccggugcgcccuggugccacagugcggcccggaggggcagccuccucccgucacuucagccagcgccgcaacuauaagaggcggugccgcccgccguggccgccucagcccaccagccgggaccgcgagccaugcuguccgccgcccgcccccaggguuguuaaagccagacugcgaacucucgccacugccgccaccgccgcgucccgucccaccgucgcgggcaacaaccaaagucgccgcaacugcagcacagagcgggcaaagccaggcaggccauggggcucugggcgcuguugccuggcuggguuucugcuacgcugcugcuggcgcuggccgcucugcccgcagcccuggcugccaacagcaguggccgauggugguaagugagcuggugcggggucgccacuugucccgcggcacagagccaggggccaacccuacccagcucccacgcucugggauccgucugccgacaggcucccuccccgcucugacuucccuccgcgacaccgaagggcgaucuggcaugaaacugccccagacuccagcucuguacaaguggggcgaaugauccgcccgcggaggccuaagauaccccaggcagggagcccacucucaucuagcaccgcccuuccccuuugagcgccaacuccagccucacggcgguggcucaccacagguuuccccaccucgggaagugaagggccaggaguucgccuagaaaggaggggagaagagggugggacuccuaagcauuucacgccuugggugggcaagaacugcaggccaugauuaucucgcucaggcugaccggaagaggcucggagauccaagguagacacucggucuccggguaccuccucuguccagucuccggaccuagggcucaggcgagcagcccugggacuacugggcacacacaagucuggacgcccaguucuuucaaauuagugagccugggagagcggguauuauuaaucucccgccauucucuccagccacauacccccaggaagaggaccggguggcacaguuuuuaugguuagggugcggauccccuuccugagccugagcuaucauacgucccaccagggguauugugaacguagccuccuccacgaaccugcuuacagacuccaagagucugcaacugguacucgagcccagucugcagcuguugagccgcaaacagcggcgucugauacgccaaaauccggggauccugcacagcgugaguggggggcugcagagugccgugcgcgagugcaaguggcaguuccggaaucgccgcuggaacugucccacugcuccagggccccaccucuucggcaagaucgucaaccgaggugggugcccaggaaggcgacgcuuccgggagcaggggaaacgcggggucacccccagggcaugggcgggcgaguucagagaaggugucccaggcgccuggagggucacacaaucaaccuugccaagugccucgugcccagcgccagcucggggccagacuucuaccaggcguuuuccagccgugcacccuggaaacgaagcuuaacuuuucugagcuacugccccagauaaagaaaguuucgggucgcggacgccggcugaccgccgcuuucccccagccucucucaaaagcgccugggaagcugcucucugcaggcgugugucuggccucucgcccagcaaggcuugcaccgccaaaaugggccgaaaguuuugggcugcgaagaagucuuggggauguaugguucuuccgcuccccucucuucgguuugucucucuggggcugcuccacuuccgcuaucgagccaaaaugcgcccuagaaucucccaguaaggugugauuacgcccguggacguggcugcgugcccacgcaccugcuuucucuacuagcccuagagaccagcuuuccagcacugccggcccuggcucucaggacucaaagugcggagucgggggugggauuccggucccaagcccuucaugagggugcuggccgcgccccgcguacccccucgcugauccccgcucccuucucccacaggcugucgagaaacggcguuuaucuucgcuaucaccuccgccggggucacccauucgguggcgcgcuccugcucagaagguuccaucgaauccugcacgugugacuaccggcggcgcggccccgggggccccgacuggcacugggggggcugcagcgacaacauu

SEQ ID NO: 20142 - RNA, 2749 nt, Homo sapiens
aauguugucgcugcagcccccccagugccagucggggcccccggggccgcgccgccgguagucacacgugcaggauucgauggaaccuucugagcaggagcgcgccaccgaaugggugaccccggcggaggugauagcgaagauaaacgccguuucucgacagccugugggagaagggagcggggaucagcgaggggguacgcggggcgcggccagcacccucaugaagggcuugggaccggaaucccacccccgacuccgcacuuugaguccugagagccagggccggcagugcuggaaagcuggucucuagggcuaguagagaaagcaggugcgugggcacgcagccacguccacgggcguaaucacaccuuacugggagauucuagggcgcauuuuggcucgauagcggaaguggagcagccccagagagacaaaccgaagagaggggagcggaagaaccauacauccccaagacuucuucgcagcccaaaacuuucggcccauuuuggcggugcaagccuugcugggcgagaggccagacacacgccugcagagagcagcuucccaggcgcuuuugagagaggcugggggaaagcggcggucagccggcguccgcgacccgaaacuuucuuuaucuggggcaguagcucagaaaaguuaagcuucguuuccagggugcacggcuggaaaacgccugguagaagucuggccccgagcuggcgcugggcacgaggcacuuggcaagguugauugugugacccuccaggcgccugggacaccuucucugaacucgcccgcccaugcccugggggugaccccgcguuuccccugcucccggaagcgucgccuuccugggcacccaccucgguugacgaucuugccgaagagguggggcccuggagcagugggacaguuccagcggcgauuccggaacugccacuugcacucgcgcacggcacucugcagccccccacucacgcugugcaggauccccggauuuuggcguaucagacgccgcuguuugcggcucaacagcugcagacugggcucgaguaccaguugcagacucuuggagucuguaagcagguucguggaggaggcuacguucacaauaccccuggugggacguaugauagcucaggcucaggaaggggauccgcacccuaaccauaaaaacugugccacccgguccucuuccuggggguauguggcuggagagaauggcgggagauuaauaauacccgcucucccaggcucacuaauuugaaagaacugggcguccagacuugugugugcccaguagucccagggcugcucgccugagcccuagguccggagacuggacagaggagguacccggagaccgagugucuaccuuggaucuccgagccucuuccggucagccugagcgagauaaucauggccugcaguucuugcccacccaaggcgugaaaugcuuaggagucccacccucuucuccccuccuuucuaggcgaacuccuggcccuucacuucccgagguggggaaaccuguggugagccaccgccgugaggcuggaguuggcgcucaaaggggaagggcggugcuagaugagagugggcucccugccugggguaucuuaggccuccgcgggcggaucauucgccccacuuguacagagcuggagucuggggcaguuucaugccagaucgcccuucggugucgcggagggaagucagagcggggagggagccugucggcagacggaucccagagcgugggagcuggguaggguuggccccuggcucugugccgcgggacaaguggcgaccccgcaccagcucacuuaccaccaucggccacugcuguuggcagccagggcugcgggcagagcggccagcgccagcagcagcguagcagaaacccagccaggcaacagcgcccagagccccauggccugccuggcuuugcccgcucugugcugcaguugcggcgacuuugguuguugcccgcgacggugggacgggacgcggcgguggcggcaguggcgagaguucgcagucuggcuuuaacaacccugggggcgggcggcggacagcauggcucgcggucccggcuggugggcugaggcggccacggcgggcggcaccgccucuuauaguugcggcgcuggcugaagugacgggaggaggcugccccuccgggccgcacuguggcaccagggcgcaccgguuaggggcgcagacaaugggcagcgagcggggcugugguucccgcccgucugagccgagagcugacggguuggccgucggggcucacccccgcccccugcccgguggcccccgccuccgggccugcacuggccgcggaccccuccccuugggacacccucccacgcgcgcccgccucacucagcugagcguccggagcccgucgaggacuagcauccgccagggggcgcggcgagagugugcugcggggagagcccgccaggggcccagcccgccucgccgcccgcggugggguuguccccucgacgucaccccgggccccuccgacguccccucucucccccauccugagugucggaaggaaagcugugguucugggcagcgacuccggggagaugcuuaaccgcccaggaacccccgauggcuggacagagaaggaaaaaggggagacgggggcgugagugcggcuguggucagggaaaucccggggaugaguugugggggugagcuaaccaaaaggagccuagcgguggag

SEQ ID NO: 20143 - RNA, 2474 nt, Homo sapiens
aauguuccacggccaaggaggaaagaaggaaugccccuuuucccaucucuagguaggaggaaggcuucagggcagaagcaaaaggaauuauuucuucccuggacagguuuuccuaacaaaguaaccuggaaaacuauggcaauuaaucagaggaaauccguaccccucccucuccccccaccuccccacuccauacacaauuaggugguguaauggaaaguauauagggcuuagaaucaggaguccugaauucuagucccagccaugccacuuuaaauugugagaguuuaaauugcuuuuccuccugggggaaguccagcucucagauguaaaaugaggguggcaguggggguggggaggguuggaggaaugucaucucucaaguuuucuuucaguucuaacauucaagaucacuggccaggcuggaugaaguggcucacaccuguaauccagcacuuugggaggccgaggugggaggaucccuugagcucaggaguucaagacuagccuaggcaacauggcaagaccccgucucuacaaaaaauaaaaaauaaaucacucgccagaggugguccuucucuuccaccucacucuaggugguuccaaugcucaaaaaugguaguugaauuuauccuaauuauguaauuccaaggaaagccccugagauaggcagagcuuggaagacuuaggagcccucugauucucagguggguccaucuguuauucucacugaggauuacuuuuuaaccccaagauuaucguuuagacccuaggauagcccuagaauagacccuagaauagauguguccugguucuaggacacguuucccaugccaaaagcaaugucugcccagccccuccucagguagauggucuggugaccugacccuuggccaccccugucccagcccuuuucagucucuucuuuucggcccacagagcuuuucuacaaucaggucaggagccaggcuucugucugcuaccuagccagcuccuggcccccagcucaccccagcccuuccugccuggcuggguggcugacccccgguccacgccucagccauuucccgucucgccugccgccauccuccuuuccccgcccucgcugccucuaccagcuucacucucacuagucagucccuccuccccuccccaucccagacuauucuagucgggagccguccuaauuacucuguccagacugcaaggauuuuuccccccccuggggcuggugacaagggaaaucucuaaggcuaaacucucuguaggugaagcuggacucacccaccugggcugccauaggaaaacggaggagcuggcagugccccggcgcagguagggagaggcccuccuuaccucggucaucaggcggucggcuccacuguucuccucauccuugaagaugaugucgggguuguaguugggcacgaggucccggaagcgcucggagccccuugccacccuccccuccgcuggcccacuggcgcccaggguccgcucuggcacgccgggcacaaauugcuuguagaguagcggcacgagcugcuugcgcgcauagcggcgccggccaaccggcccccggcccggcccgcagcucugggcuggcagcgccagaagugccaagcagcacaggggcaguagauuggucaggagagccauggauacagcggaccucggccaaaagggagcguucuuguccucacuaacucuccugucaguuaggcaucuccacaggcaccagagagggcagcaggcacagcugcccccagagugcccuagagcucuuguggcuccgugcaccuggcugcugcuagcucugcccacgugccccgggagcgggcggggggugucuaggaccugcuacugacaaaccaucauagcagggaaggggggucgugggugagugccagcccagcccgucucugcugcaggacucuggugcugccagaacgcccggacuccggacuccgccuuaaguggccccuggccccgcccuccgcccuucucccaagaccgucccacccccucccacccgggcgggggaucuagccggucacugcugguccauuuugcgacugaagugugucccauccuggaaaccaggcagacaccugccuaggaaauacuuguagcuuuacaguccuuggcugccuaaacauccuucuaccuccaagcuuaaacuuggaaccaaaccacccuccucugauacuugaauuggaauuuuuacucucucaaagccuacccuggcaggccaugcccuccgcugucauccaggaaguauggguuccaauuucugcccaagaccagccaagcccuuugggcauacaaccagagccucccuucucuguaguccuccccagaucuccccgacuuccaucucuccucacauucagcauuaagcaggacugggaggugaggauaccaggggcccauuucucuacuaacuuugcagucuccuuuggaacuuccccaga

SEQ ID NO: 20144 - RNA, 2474 nt, Homo sapiens
ucuggggaaguuccaaaggagacugcaaaguuaguagagaaaugggccccugguauccucaccucccaguccugcuuaaugcugaaugugaggagagauggaagucggggagaucuggggaggacuacagagaagggaggcucugguuguaugcccaaagggcuuggcuggucuugggcagaaauuggaacccauacuuccuggaugacagcggagggcauggccugccaggguaggcuuugagagaguaaaaauuccaauucaaguaucagaggagggugguuugguuccaaguuuaagcuuggagguagaaggauguuuaggcagccaaggacuguaaagcuacaaguauuuccuaggcaggugucugccugguuuccaggaugggacacacuucagucgcaaaauggaccagcagugaccggcuagaucccccgcccgggugggagggggugggacggucuugggagaagggcggagggcggggccaggggccacuuaaggcggaguccggaguccgggcguucuggcagcaccagaguccugcagcagagacgggcugggcuggcacucacccacgaccccccuucccugcuaugaugguuugucaguagcagguccuagacaccccccgcccgcucccggggcacgugggcagagcuagcagcagccaggugcacggagccacaagagcucuagggcacucugggggcagcugugccugcugcccucucuggugccuguggagaugccuaacugacaggagaguuagugaggacaagaacgcucccuuuuggccgagguccgcuguauccauggcucuccugaccaaucuacugccccugugcugcuuggcacuucuggcgcugccagcccagagcugcgggccgggccgggggccgguuggccggcgccgcuaugcgcgcaagcagcucgugccgcuacucuacaagcaauuugugcccggcgugccagagcggacccugggcgccagugggccagcggaggggaggguggcaaggggcuccgagcgcuuccgggaccucgugcccaacuacaaccccgacaucaucuucaaggaugaggagaacaguggagccgaccgccugaugaccgagguaaggagggccucucccuaccugcgccggggcacugccagcuccuccguuuuccuauggcagcccaggugggugaguccagcuucaccuacagagaguuuagccuuagagauuucccuugucaccagccccaggggggggaaaaauccuugcagucuggacagaguaauuaggacggcucccgacuagaauagucugggauggggaggggaggagggacugacuagugagagugaagcugguagaggcagcgagggcggggaaaggaggauggcggcaggcgagacgggaaauggcugaggcguggaccgggggucagccacccagccaggcaggaagggcuggggugagcugggggccaggagcuggcuagguagcagacagaagccuggcuccugaccugauuguagaaaagcucugugggccgaaaagaagagacugaaaagggcugggacagggguggccaagggucaggucaccagaccaucuaccugaggaggggcugggcagacauugcuuuuggcaugggaaacguguccuagaaccaggacacaucuauucuagggucuauucuagggcuauccuagggucuaaacgauaaucuugggguuaaaaaguaauccucagugagaauaacagauggacccaccugagaaucagagggcuccuaagucuuccaagcucugccuaucucaggggcuuuccuuggaauuacauaauuaggauaaauucaacuaccauuuuugagcauuggaaccaccuagagugagguggaagagaaggaccaccucuggcgagugauuuauuuuuuauuuuuuguagagacggggucuugccauguugccuaggcuagucuugaacuccugagcucaagggauccucccaccucggccucccaaagugcuggauuacaggugugagccacuucauccagccuggccagugaucuugaauguuagaacugaaagaaaacuugagagaugacauuccuccaacccuccccacccccacugccacccucauuuuacaucugagagcuggacuucccccaggaggaaaagcaauuuaaacucucacaauuuaaaguggcauggcugggacuagaauucaggacuccugauucuaagcccuauauacuuuccauuacaccaccuaauuguguauggaguggggagguggggggagagggagggguacggauuuccucugauuaauugccauaguuuuccagguuacuuuguuaggaaaaccuguccagggaagaaauaauuccuuuugcuucugcccugaagccuuccuccuaccuagagaugggaaaaggggcauuccuucuuuccuccuuggccguggaacauu

SEQ ID NO: 20145 - RNA, 2680 nt, Homo sapiens
gggcaggcuggcacggugcccacuuuucccaaaacgccagccuuccaagcccagaagcucgcccggcccaggccgggagcggcccacgucggacggccggaccgcccugcaggacccagcccggccgcccgcccccgccgccggcggugagggaggugagcggcgccgaccugcgggacgagcaucacuccgacccagccgggggugaggcgggucaggaugcuccggucgcaggaggaaaaggaggagcuggaccaaaagcccgaagagaagaaaaggggaaggccgcgcacggagcgcgguaaaggccggcggagcuagacgccccgaggucggagugaagcgccgggaccgagccccgucucccagggaguccggggcgcacggcaccgaggagagcgcgggagccaaccugggcgcaucaugcgcagggcccgggacgcugggccggucuacaccgccgccugggucacguggcccggacgggccggcggcugccccggccggggggcgggggucgcgccgggguugcgcuggacgacggagagcggcgggcccgcagcggccuggagccucccaacccgcgcgccgcgcuggcccccgagcguaggagccgcccccugcccccccgcgccggccccgcgcccggccgcccgcccccuauauagcgcgccccagcagggcccgcgccaggccgccagccucggagugggcgcgggacagugcgcggcgccccgcagccaggcccccgcccccgccgcauccaccuccuccgccgccugcgacccaacgggcgccccccgccgcggcagcugccgccgggcccccgcggccaccaugaagaaggaggugugcuccguggccuuccucaaggccguguucgcagaguucuuggccacccucaucuucgucuucuuuggccugggcucggcccucaaguggccgucggcgcugccuaccauccugcagaucgcgcuggcguuuggccuggccauaggcacgcuggcccaggcccugggacccgugagcggcggccacaucaaccccgccaucacccuggcccucuuggugggcaaccagaucucgcugcuccgggcuuucuucuacguggcggcccagcuggugggcgccauugccggggcuggcauccucuacgguguggcaccgcucaaugcccggggcaaucuggccgucaacgcggugagugcccuggggggggggugggagccucgacccuggggugggcucaggaccaggccucuuaccccaccuggaaaaaaggggugccgcagagugggccagcccacacccuucaccaggaaggcaagagccucccaaggccaggaaggcaacucuccaggcugauaugugcucccuuccugcccaccuccucucccccuccccucaugcuggcccacccuggucucucuccaaugccugcuaccccuccucuccugccagaaacuucugccuccuccugucucaccuuugagcuccaccuuccuccugggccccucaccucucccaucaccucaguggagcgguugaguagaaccaccagagaaaagcgggcugucaucacggcuuugggugacccuggccugucugugcuucauuguucucagcgccuccauggggaugguugugucugccacagcaggugucaaggggcucacauuuagaaaccguagauaggaacccccuaauguggggccagugcagagcaguuucuguugaguauugguucccucuuuccccaaccugugcuccuccccucaaccccgcaccccugccucccucccaccuccugcagccccagagucagcccccaaccccaugcaaacuggguucauuaaucaaacacagaggaggauuugcuuggccauugucaagcugugagucagccgcacuggagagacggguuuaaggcuggcacuggcauggggccaggcacgggcaggaggccgggauggggugugaggcaggcaaaccgggcagcugcccacaggauggaggguaaaugccagcuuaugggggcuggggguugggcagagccauugauaggcccguguccaggaaaagcuacccugacgcucugcccuuuggccacaggccugagcuucaagccugugcaaacuaugaaauguacagugucuuuaacaaauggcuucgcuggggcgauguccacaggacuuggcuuccaggugccaaggugcucuaagugucccuggaggccaaaagcccuacuccccgagccccuggcuauacagccagaagguggccgggguccuaacccgcuauccccuugcagcucaacaacaacacaacgcagggccaggccauggugguggagcugauucugaccuuccagcuggcacucugcaucuucgccuccacugacucccgccgcaccagcccugugggcuccccagcccuguccauuggccugucugucacccugggccaccuugucggagugagcaguaccgacauugggcuggggugaggguggggcaggcacucaaggcaaauaauggagcccuggagcggagcccacuucagauggaugaguccagcagaguuuaaggccuggauuuagggcuccuggacucuggcccuacugggccccagaauugauccccccaaaaccucugggcugaggaaagaugggaguaaguag

SEQ ID NO: 20146 - RNA, 2680 nt, Homo sapiens
cuacuuacucccaucuuuccucagcccagagguuuuggggggaucaauucuggggcccaguagggccagaguccaggagcccuaaauccaggccuuaaacucugcuggacucauccaucugaagugggcuccgcuccagggcuccauuauuugccuugagugccugccccacccucaccccagcccaaugucgguacugcucacuccgacaagguggcccagggugacagacaggccaauggacagggcuggggagcccacagggcuggugcggcgggagucaguggaggcgaagaugcagagugccagcuggaaggucagaaucagcuccaccaccauggccuggcccugcguuguguuguuguugagcugcaaggggauagcggguuaggaccccggccaccuucuggcuguauagccaggggcucggggaguagggcuuuuggccuccagggacacuuagagcaccuuggcaccuggaagccaaguccuguggacaucgccccagcgaagccauuuguuaaagacacuguacauuucauaguuugcacaggcuugaagcucaggccuguggccaaagggcagagcgucaggguagcuuuuccuggacacgggccuaucaauggcucugcccaacccccagcccccauaagcuggcauuuacccuccauccugugggcagcugcccgguuugccugccucacaccccaucccggccuccugcccgugccuggccccaugccagugccagccuuaaacccgucucuccagugcggcugacucacagcuugacaauggccaagcaaauccuccucuguguuugauuaaugaacccaguuugcaugggguugggggcugacucuggggcugcaggaggugggagggaggcaggggugcgggguugaggggaggagcacagguuggggaaagagggaaccaauacucaacagaaacugcucugcacuggccccacauuaggggguuccuaucuacgguuucuaaaugugagccccuugacaccugcuguggcagacacaaccauccccauggaggcgcugagaacaaugaagcacagacaggccagggucacccaaagccgugaugacagcccgcuuuucucuggugguucuacucaaccgcuccacugaggugaugggagaggugaggggcccaggaggaagguggagcucaaaggugagacaggaggaggcagaaguuucuggcaggagaggagggguagcaggcauuggagagagaccagggugggccagcaugaggggagggggagaggaggugggcaggaagggagcacauaucagccuggagaguugccuuccuggccuugggaggcucuugccuuccuggugaagggugugggcuggcccacucugcggcaccccuuuuuuccaggugggguaagaggccugguccugagcccaccccagggucgaggcucccaccccccccccagggcacucaccgcguugacggccagauugccccgggcauugagcggugccacaccguagaggaugccagccccggcaauggcgcccaccagcugggccgccacguagaagaaagcccggagcagcgagaucugguugcccaccaagagggccagggugauggcgggguugauguggccgccgcucacgggucccagggccugggccagcgugccuauggccaggccaaacgccagcgcgaucugcaggaugguaggcagcgccgacggccacuugagggccgagcccaggccaaagaagacgaagaugaggguggccaagaacucugcgaacacggccuugaggaaggccacggagcacaccuccuucuucaugguggccgcgggggcccggcggcagcugccgcggcggggggcgcccguugggucgcaggcggcggaggagguggaugcggcgggggcgggggccuggcugcggggcgccgcgcacugucccgcgcccacuccgaggcuggcggccuggcgcgggcccugcuggggcgcgcuauauagggggcgggcggccgggcgcggggccggcgcgggggggcagggggcggcuccuacgcucgggggccagcgcggcgcgcggguugggaggcuccaggccgcugcgggcccgccgcucuccgucguccagcgcaaccccggcgcgacccccgccccccggccggggcagccgccggcccguccgggccacgugacccaggcggcgguguagaccggcccagcgucccgggcccugcgcaugaugcgcccagguuggcucccgcgcucuccucggugccgugcgccccggacucccugggagacggggcucggucccggcgcuucacuccgaccucggggcgucuagcuccgccggccuuuaccgcgcuccgugcgcggccuuccccuuuucuucucuucgggcuuuugguccagcuccuccuuuuccuccugcgaccggagcauccugacccgccucacccccggcugggucggagugaugcucgucccgcaggucggcgccgcucaccucccucaccgccggcggcgggggcgggcggccgggcuggguccugcagggcgguccggccguccgacgugggccgcucccggccugggccgggcgagcuucugggcuuggaaggcuggcguuuugggaaaagugggcaccgugccagccugccc

SEQ ID NO: 20147 - RNA, 2521 nt, Homo sapiens
uuacgggcacgguguggugucagcccauuuggaagcaaagccuagauauggagggggccagacgaacaggaccugggaaugcacaggacccccugaagcaggccggggaucugagugaucuugcuguaucuaagcugacauuggaacaugaacagucugaaaucccaugagccccgcugcccugcaccugcgacccucaggcuagaccuuggacugucuacaacacgagucaggcccaacccgcccuggaaaucaucguaggagguuccagcucagugcccagagacagcccccacaucccaccccaucaggucagcucaggcuggagcaggcauaugagcaacaccccucauuccacccccauacacaugcauaagcccauccgccugcgcccugccagucugaccagcacaguccuggggacaggagcgugguggaggagcugcaggugggggccagagaagccuccacagagagcaaaagccagggucagccagagacaggacaccagaagagacaggagaucagagaccagaggaacagagaagaggccccagagcaaggcaaggaacggccaaggcaccaggacauggaugcaguggagccagggggacguggcugggccagcauguuggcgugcaggcuuuggaaagccaucagcagggcgcuguuugcagaguuccuggccacggggcuguauguguucuuuggcgugggcucagucaugcgcuggcccacagcacuucccuccgugcuacagauugccaucaccuucaaccuggucaccgccauggcugugcaggucaccuggaaggccagcggggcccacgccaaccccgccgugacgcuggccuuccucguaggcucccacaucucucugccccgugcuguggccuauguggcugcccagcuggugggggccacggugggggcugcucugcuuuauggggucaugccgggagacauccgagagacccuugggaucaacgugguaggugcagggaggggcaccuggagggccaggaggcgggaaugcgcacaaguggugaagguggaggccaggacggaggcgagggagcaaaggaggaaacaagucagcugcaggcuccacauccucccgggcugggccccaggacccagaggacugagacuuugaccucagucuaggcagaauagaaaugggauaguggcgcgaagaacagguggagaaggaagaggccacauaaaggagaaggaauagaaggaccaggcguuuaaggguagaugcggccaagggagugcggggccuguggguagagaaggggaccccacggggacuucauuuuucucccaggcuccacccacguccucugcucuccgacuguucccaaguucuucccuccaccucgaggccugccucacucgccccuucuccauuucguaaccaucuguguuccaccuucuucccccaaaucuccuccuuccacaccugcugccagucuccucucaagcaagccuccugaaccacuggccccaaccaacccacugguggggugggaggagcaccacucacuucugcagggagcaaggguccagagcagauauggaccccucugcacaggccucccgaaguccugaagcugggcggcagugaggugucaccccccuccagcugaggagaccaggcccaguggcagggguuucucugucuguccgugggcagagcccgcgucugguccagaguaacucccucuguccagguccggaacagugucucaacuggccaggcgguggcaguggagcugcuucugacccugcagcuggugcucugugucuucgcuuccaccgacagccgucagacaucaggcuccccggccaccaugauugggaucucuguggcacugggccaccucauugggguaaggaacagaggggacaccgugcacaugcacacaccggguccguccccggggaaacuguggagcccugaaggccaggcagugucccucccugagccccucgugccuuggagccaaagugguacccccugcacucuaggcccaggauauggcacuacagaggccguggcuggggcuaaggcucugagccaggacugagaaaugguccccucucaggccugccuuaaaccuucucccacccugacccugcacuugcuccccagauccacuucacuggcugcuccaugaauccagcccgcuccuucggcccugccaucaucauugggaaguucacaguccacugggugagccccucugcuggcagcccuggggagggaagggagccugaguugccuguagacgguggguuucacuugcagcuucccuaagcucagaaggccagggugaaugucuuggcugagacuuccuuucuuuucggcuucaguugcccaggauacccaguggacuggcaagaaaugggccagggcaggagcugcagccuuggcccagacuuuuaaguccuggcuguuuccuuauucacuuucuccagcuggaccaauuuucaaacuuggauaaagaaaaag

SEQ ID NO: 20148 - RNA, 2521 nt, Homo sapiens
cuuuuucuuuauccaaguuugaaaauugguccagcuggagaaagugaauaaggaaacagccaggacuuaaaagucugggccaaggcugcagcuccugcccuggcccauuucuugccaguccacuggguauccugggcaacugaagccgaaaagaaaggaagucucagccaagacauucacccuggccuucugagcuuagggaagcugcaagugaaacccaccgucuacaggcaacucaggcucccuucccuccccagggcugccagcagaggggcucacccaguggacugugaacuucccaaugaugauggcagggccgaaggagcgggcuggauucauggagcagccagugaaguggaucuggggagcaagugcagggucagggugggagaagguuuaaggcaggccugagaggggaccauuucucaguccuggcucagagccuuagccccagccacggccucuguagugccauauccugggccuagagugcaggggguaccacuuuggcuccaaggcacgaggggcucagggagggacacugccuggccuucagggcuccacaguuuccccggggacggacccggugugugcaugugcacgguguccccucuguuccuuaccccaaugagguggcccagugccacagagaucccaaucaugguggccggggagccugaugucugacggcugucgguggaagcgaagacacagagcaccagcugcagggucagaagcagcuccacugccaccgccuggccaguugagacacuguuccggaccuggacagagggaguuacucuggaccagacgcgggcucugcccacggacagacagagaaaccccugccacugggccuggucuccucagcuggaggggggugacaccucacugccgcccagcuucaggacuucgggaggccugugcagagggguccauaucugcucuggacccuugcucccugcagaagugaguggugcuccucccaccccaccaguggguugguuggggccagugguucaggaggcuugcuugagaggagacuggcagcagguguggaaggaggagauuugggggaagaagguggaacacagaugguuacgaaauggagaaggggcgagugaggcaggccucgagguggagggaagaacuugggaacagucggagagcagaggacguggguggagccugggagaaaaaugaaguccccgugggguccccuucucuacccacaggccccgcacucccuuggccgcaucuacccuuaaacgccugguccuucuauuccuucuccuuuauguggccucuuccuucuccaccuguucuucgcgccacuaucccauuucuauucugccuagacugaggucaaagucucaguccucuggguccuggggcccagcccgggaggauguggagccugcagcugacuuguuuccuccuuugcucccucgccuccguccuggccuccaccuucaccacuugugcgcauucccgccuccuggcccuccaggugccccucccugcaccuaccacguugaucccaagggucucucggaugucucccggcaugaccccauaaagcagagcagcccccaccguggcccccaccagcugggcagccacauaggccacagcacggggcagagagaugugggagccuacgaggaaggccagcgucacggcgggguuggcgugggccccgcuggccuuccaggugaccugcacagccauggcggugaccagguugaaggugauggcaaucuguagcacggagggaagugcugugggccagcgcaugacugagcccacgccaaagaacacauacagccccguggccaggaacucugcaaacagcgcccugcugauggcuuuccaaagccugcacgccaacaugcuggcccagccacgucccccuggcuccacugcauccauguccuggugccuuggccguuccuugccuugcucuggggccucuucucuguuccucuggucucugaucuccugucucuucugguguccugucucuggcugacccuggcuuuugcucucuguggaggcuucucuggcccccaccugcagcuccuccaccacgcuccuguccccaggacugugcuggucagacuggcagggcgcaggcggaugggcuuaugcauguguauggggguggaaugagggguguugcucauaugccugcuccagccugagcugaccugauggggugggaugugggggcugucucugggcacugagcuggaaccuccuacgaugauuuccagggcggguugggccugacucguguuguagacaguccaaggucuagccugagggucgcaggugcagggcagcggggcucaugggauuucagacuguucauguuccaaugucagcuuagauacagcaagaucacucagauccccggccugcuucaggggguccugugcauucccagguccuguucgucuggcccccuccauaucuaggcuuugcuuccaaaugggcugacaccacaccgugcccguaa

SEQ ID NO: 20149 - RNA, 2302 nt, Homo sapiens
gugugccaccagaggaagcagcagcaagaggcaggagcaucgauccgaaggagacagcgcggggagagggacgcuaggggcagacacccucccuccugcgcgcacacacgcgcgcgcgcacacacaccacacacagagucauacacacaagccauagggccucgcaggcagggagacggcuccgggacuggagagaggcagcgccgccgaaagcggccgcgaggaggggcgaggcggcgcggggagcccugggucccgcucccggauccggggccccgcgcgcacaccagcccagagacagccucgcagacacucguaggcgcgcacgcgcacccucuccccucccccuccccucccgccgccucccggccggacgauggaucccugcagaucccagggcugagagcaccgcgcaccgcgccgagcccgggcagaccgagccgaggcgagcgagccagcgagccagcgcgcgcgggcgggcggacagaucggagccgagcggggccgggcggggcgcucccugcagggcucugcgcggcgugccgcggcggccgcgggcuccggccccgggccaugagccccuccgcgacucggcgcugagcccgccaccgguccagcgccccaggacccgccgccggcugccggcuugccgaagcccccucagguggguuuccgauaccccugccuuuggccgcgaggcuccucgguaccccgaagccgggacucuccucccucuggauuucccuugcugcuggggcggcucgguggcuggggaggggggcgggggccgagcuggggaucugacugcgacgagaagcuggacuggggggggcugcguccggggcggggacagcucgcugucauagggaaccgcgcccccccuccauacauccaccucgggcagcccgccaccccccacucccaacauacacacagccugcgcuuaugugagaacuggagacacccgcaggugaggacucaggcugggccccucccuagauguagccaccucccuggggguuuucuggccccaguuuagcccuuaggaccacagccccguccagggaauacccgugaccaggacaggagcuccuuaccccggggucagcccaucugggugaguuuucaucuccaggaugggguggauauucuugucccagagugaccccacaucuggagggaacuccugcgccugccuaugggugcaucaggacuucccccucaaccucggaugacuauaucuggggucuccccgggccugggaagcuucucuggggagcauucucuuggccugaccugacccccugugccucuguauuuggaggaacccuggaugugucccuuggucagccaccucugggcuugcaaagcagggaagucuucugcccgaggaguggugaccucuggagaugaggauucuggaugggcacauguggaggggcuccauguguacuuucaucccaggacaaugauagacugucccucccuccucccccaggauccccucaacaaggauggaacugaaggccgaggaggaggagguggguggcguccagccggugagcauccaggccuucgccagcagcuccacacugcacggccuggcccacaucuucuccuacgagcggcugucucugaagcgggcacugugggcccugugcuuccugggcucccuggcugugcugcugugugugugcacggagcgugugcaguacuacuuccacuaccaccaugucaccaagcucgacgagguggcugccucucagcuuaccuucccugcugucacgcugugcaaccucaacgaguuccgcuuuagccaagucuccaagaaugaccuguaucaugcuggggagcugcuggcccugcucaacaacagguggguggcucccacccucccucagcccugcuccuggaguugcuugaguuccagucaggaugucugccucccugacccaccauagagcccagccaacccugcccuuuaacccacccccacccccaaaccugccacucacagcagaggaguuagggugcugcugagcacccaguuaagggcacccagccuccgaucccagcauaguccagaacagcucgacccccacccagccugagguaugagacauugucacccucucuggagugagcuuuaccuucauucuggccacucugucuugaccuucucgucaguugggggauggggacagaacaucuuuaaaggguagaaacuacaguauaaaagccacagccccugccuugucucucugcccaccuuauccaugcuuccucucacccaugugcuggg

SEQ ID NO: 20150 - RNA, 2302 nt, Homo sapiens
cccagcacaugggugagaggaagcauggauaaggugggcagagagacaaggcaggggcuguggcuuuuauacuguaguuucuacccuuuaaagauguucuguccccaucccccaacugacgagaaggucaagacagaguggccagaaugaagguaaagcucacuccagagagggugacaaugucucauaccucaggcugggugggggucgagcuguucuggacuaugcugggaucggaggcugggugcccuuaacugggugcucagcagcacccuaacuccucugcugugaguggcagguuuggggguggggguggguuaaagggcaggguuggcugggcucuauggugggucagggaggcagacauccugacuggaacucaagcaacuccaggagcagggcugagggagggugggagccacccaccuguuguugagcagggccagcagcuccccagcaugauacaggucauucuuggagacuuggcuaaagcggaacucguugagguugcacagcgugacagcagggaagguaagcugagaggcagccaccucgucgagcuuggugacauggugguaguggaaguaguacugcacacgcuccgugcacacacacagcagcacagccagggagcccaggaagcacagggcccacagugcccgcuucagagacagccgcucguaggagaagaugugggccaggccgugcaguguggagcugcuggcgaaggccuggaugcucaccggcuggacgccacccaccuccuccuccucggccuucaguuccauccuuguugaggggauccugggggaggagggagggacagucuaucauuguccugggaugaaaguacacauggagccccuccacaugugcccauccagaauccucaucuccagaggucaccacuccucgggcagaagacuucccugcuuugcaagcccagagguggcugaccaagggacacauccaggguuccuccaaauacagaggcacagggggucaggucaggccaagagaaugcuccccagagaagcuucccaggcccggggagaccccagauauagucauccgagguugagggggaaguccugaugcacccauaggcaggcgcaggaguucccuccagauguggggucacucugggacaagaauauccaccccauccuggagaugaaaacucacccagaugggcugaccccgggguaaggagcuccuguccuggucacggguauucccuggacggggcugugguccuaagggcuaaacuggggccagaaaacccccagggagguggcuacaucuagggaggggcccagccugaguccucaccugcgggugucuccaguucucacauaagcgcaggcuguguguauguugggagugggggguggcgggcugcccgagguggauguauggagggggggcgcgguucccuaugacagcgagcuguccccgccccggacgcagccccccccaguccagcuucucgucgcagucagauccccagcucggcccccgccccccuccccagccaccgagccgccccagcagcaagggaaauccagagggaggagagucccggcuucgggguaccgaggagccucgcggccaaaggcagggguaucggaaacccaccugagggggcuucggcaagccggcagccggcggcggguccuggggcgcuggaccgguggcgggcucagcgccgagucgcggaggggcucauggcccggggccggagcccgcggccgccgcggcacgccgcgcagagcccugcagggagcgccccgcccggccccgcucggcuccgaucuguccgcccgcccgcgcgcgcuggcucgcuggcucgcucgccucggcucggucugcccgggcucggcgcggugcgcggugcucucagcccugggaucugcagggauccaucguccggccgggaggcggcgggaggggagggggaggggagagggugcgcgugcgcgccuacgagugucugcgaggcugucucugggcuggugugcgcgcggggccccggauccgggagcgggacccagggcuccccgcgccgccucgccccuccucgcggccgcuuucggcggcgcugccucucuccagucccggagccgucucccugccugcgaggcccuauggcuuguguguaugacucuguguguggugugugugcgcgcgcgcgugugugcgcgcaggagggagggugucugccccuagcgucccucuccccgcgcugucuccuucggaucgaugcuccugccucuugcugcugcuuccucugguggcacac

SEQ ID NO: 20151 - RNA, 1591 nt, Homo sapiens
gcaaagcagggcagugaggucagugcucccagccugugcaggagcaucaggaagagucugugucccccuccccugccgguaugaagccauucugcuucccuccccagcugccuugugucagcagaguuccagggaggcuccauuccccaccucuaucuaaagcuccauuugcuggggugggggcccugccuggaaggggaagguccaaggcugcucccagcgugucccuccauccugacugucccuggcggggcgggggugucuuugucacccagcugcacaacggccaggaagggcucaaaccauccucagggcuaacccaaggccguccucugggccuguauaccccugugcugagugcggaucgggagaggcugcugaagacaggaggggacaaaugggggacgaaggggcccgagggaggggacugaaggauuugggccaagucgggaguucccgagggcggagucaaaacgcaucuggauuuugcuagccccaaacucugcccucauugcugcaagccuccuagaccgaggacccccgggcugagggugggguaaggauagguagugucccuccccgucccacccccgccugucccuuccucgguggccccuucccggcgccccgauuccaggcggccccuccgcugcugccagccgaucccccucuacccccacccacuacuccggccgccagacguugccuacagucucggcucugucucccacggcuguggguccggaccccacgggaccccuaugggacccccacaggacccccacggccugaguccaaggcccgcccccucggggaggcggaugugggaggcccggcccgggugcgggccagcgacccgggagcugcgggcggcugggaggggaggccgcccugaggggcugggagcggcgcgggggugggucccgguccugcagccccagcgaggggcgagcggcggccagucggcgagcugggcaauaaggaaacgguuuauuaggagggagugguggagcugggccaggcaggaagacgcuggaauaagaaacauuuuugcuccagcccccaucccagucccgggaggcugccgcgccagcugcgccgagcgagccccuccccggcuccagcccgguccggggccgcgcccggaccccagcccgccguccagcgcuggcggugcaacugcggccgcgcgguggaggggagguggccccgguccgccgaaggcuagcgccccgccacccgcagagcgggcccagaggugagucgagguccgcggacgggaccggguggcgggcggccugacccccgcuucagugggcccuuccuucgggcggaccccagagucaccgcagaguggucgcgggaggcucagucccagcucauuagaaaggcaagcugcuccuggcugaccacgcacagcucccaugacccuaccugagacuuggaggggaauggacgagacuggacuggaaaucagaaacuugguucuagucgggugaccuggggucagugacuucacuucucuguucuccuacccucuucauaaaaugggcagugggauuccugucuugcucuacucacauagaaggga

SEQ ID NO: 20152 - RNA, 1591 nt, Homo sapiens
ucccuucuaugugaguagagcaagacaggaaucccacugcccauuuuaugaagaggguaggagaacagagaagugaagucacugaccccaggucacccgacuagaaccaaguuucugauuuccaguccagucucguccauuccccuccaagucucagguagggucaugggagcugugcguggucagccaggagcagcuugccuuucuaaugagcugggacugagccucccgcgaccacucugcggugacucugggguccgcccgaaggaagggcccacugaagcgggggucaggccgcccgccacccggucccguccgcggaccucgacucaccucugggcccgcucugcggguggcggggcgcuagccuucggcggaccggggccaccuccccuccaccgcgcggccgcaguugcaccgccagcgcuggacggcgggcugggguccgggcgcggccccggaccgggcuggagccggggaggggcucgcucggcgcagcuggcgcggcagccucccgggacugggaugggggcuggagcaaaaauguuucuuauuccagcgucuuccugccuggcccagcuccaccacucccuccuaauaaaccguuuccuuauugcccagcucgccgacuggccgccgcucgccccucgcuggggcugcaggaccgggacccacccccgcgccgcucccagccccucagggcggccuccccucccagccgcccgcagcucccgggucgcuggcccgcacccgggccgggccucccacauccgccuccccgagggggcgggccuuggacucaggccguggggguccugugggggucccauaggggucccgugggguccggacccacagccgugggagacagagccgagacuguaggcaacgucuggcggccggaguaguggguggggguagagggggaucggcuggcagcagcggaggggccgccuggaaucggggcgccgggaaggggccaccgaggaagggacaggcgggggugggacggggagggacacuaccuauccuuaccccacccucagcccggggguccucggucuaggaggcuugcagcaaugagggcagaguuuggggcuagcaaaauccagaugcguuuugacuccgcccucgggaacucccgacuuggcccaaauccuucaguccccucccucgggccccuucgucccccauuuguccccuccugucuucagcagccucucccgauccgcacucagcacagggguauacaggcccagaggacggccuuggguuagcccugaggaugguuugagcccuuccuggccguugugcagcugggugacaaagacacccccgccccgccagggacagucaggauggagggacacgcugggagcagccuuggaccuuccccuuccaggcagggcccccaccccagcaaauggagcuuuagauagagguggggaauggagccucccuggaacucugcugacacaaggcagcuggggagggaagcagaauggcuucauaccggcaggggagggggacacagacucuuccugaugcuccugcacaggcugggagcacugaccucacugcccugcuuugc

SEQ ID NO: 20153 - RNA, 2653 nt, Homo sapiens
acaccaccagacccccaaauuucuuuuuucuuuuuuuuuuuuuuuuuuuuugagacagagucucacucugucgccaggcugcaguggcgcgaucucggcucacugcaaccuccgccucccagguucaagcgauuccccuuccucagccucccaaguagcugagacuacaggcgugcaccaucacguccggcuaauuuuuuguauuuuaguagagaggggguuucaccauguuggcuaggauggucucgaucuccugaccucgugauccgcccaccuaggccucccaaagugcugagauuacaggcgugagccacugcgcccggucaagacucccaaauuucaaacucgccagcaccuccuccaccugggggagaagagcauaauaacgucauuuccugcccugaaagcagccucgagggccaacaacaccugcuguccguguccaugcccgguuggccaccccguuucuggggggugagcggggcuuggcagggcugcgcggagggcgcggggguggggcccggggcggagcggcccggggcggagggcgcgggcuccgagccguccaccuguggcuccggcuuccgaagcggcuccggggcgggggcggggccucacucugcgauauaacucgggucgcgcggcucgcgcaggccgccaccgucguccgcaaagccugaguccuguccuuucucucuccccggacagcaugagcuucaccacucgcuccaccuucuccaccaacuaccggucccugggcucuguccaggcgcccagcuacggcgcccggccggucagcagcgcggccagcgucuaugcaggcgcugggggcucugguucccggaucuccgugucccgcuccaccagcuucaggggcggcaugggguccgggggccuggccaccgggauagccgggggucuggcaggaaugggaggcauccagaacgagaaggagaccaugcaaagccugaacgaccgccuggccucuuaccuggacagagugaggagccuggagaccgagaaccggaggcuggagagcaaaauccgggagcacuuggagaagaagggaccccaggucagagacuggagccauuacuucaagaucaucgaggaccugagggcucagguaagggguaggagggaccucaacucccagccuugucugacccuccaauuauacacuccuuugccucuuuccgucauuccauaaccacccaaccccuacuccaccgggaggggguugggcauaccuggauuuccauccgcgcaccuagccacagggucccuaagagcagcagcuaggcaugggagggcucuuucccaggagagagggggaaggggacaggguugagagcuuuacagaggaaguggacagcauggagggagguaaggaaaggccuguaaagaggaggagacacuggcucuggcggaauggggacuauuggaggguuaagcggauguggcuaaggcugagucaucuaggaguaaacaagaggccuuccuuugggaggagccaauccaggguguagggggcccagagugaccaggugcacuagggaaaaaaugccaggagagggccaggaagaggacuuguuaguagcgacucacuucugggcaggcaggccagccagcuagccagccugcugaggcuucccaagaggggcagagugcugggaucugggaauccaggaaaggagggaaugggguggggcuagaugaaaagggauagguguccagggagagccucuggcuauuccugggaccaggaaguuuucacuaggauacauaacacuuuuuacacacucaccccacccaucccuggcuuucuauucauggaacaaccucucucuacaaucccuccagaucuucgcaaauacuguggacaaugcccgcaucguucugcagauugacaaugcccgucuugcugcugaugacuuuagagucaaguaaguuugggggcuagagagcuggggguccagggguggagcuaagaaggaucugcuccccaggcugggucaguuaggggcucacagugggauccuguuagguguggguggaugagagucaggguccaucaguguauucauuuaacuguucauuuguauaaccccguuuaagaauacuguccuccaagugccaagaauggugcucaggggauuaccaccuaauugcugacucaaguugcugguuugcaaugggcacagaacuucucuuaguagguggcaugaguugagaagguucuggaucagagauaggggccccucugaucaccuccacuccuauagguaugagacagagcuggccaugcgccagucuguggagaacgacauccaugggcuccgcaaggucauugaugacaccaauaucacacgacugcagcuggagacagagaucgaggcucucaaggaggagcugcucuucaugaagaagaaccacgaagaggcaagcaggggccacuggccaggccagggauugaggggccaagagaagucugggucggagaauagacaagacaaaccaacugcaaguagccuugcuaagacguuuagaaauagcagccugggcucuucuuaaauaagaccguucugaugaagagcauucucagggggucgaguacacccuggcucaccugaauuacaggucaaaaugauau

SEQ ID NO: 20154 - RNA, 2653 nt, Homo sapiens
auaucauuuugaccuguaauucaggugagccaggguguacucgacccccugagaaugcucuucaucagaacggucuuauuuaagaagagcccaggcugcuauuucuaaacgucuuagcaaggcuacuugcaguugguuugucuugucuauucuccgacccagacuucucuuggccccucaaucccuggccuggccaguggccccugcuugccucuucgugguucuucuucaugaagagcagcuccuccuugagagccucgaucucugucuccagcugcagucgugugauauuggugucaucaaugaccuugcggagcccauggaugucguucuccacagacuggcgcauggccagcucugucucauaccuauaggaguggaggugaucagaggggccccuaucucugauccagaaccuucucaacucaugccaccuacuaagagaaguucugugcccauugcaaaccagcaacuugagucagcaauuaggugguaauccccugagcaccauucuuggcacuuggaggacaguauucuuaaacgggguuauacaaaugaacaguuaaaugaauacacugauggacccugacucucauccacccacaccuaacaggaucccacugugagccccuaacugacccagccuggggagcagauccuucuuagcuccaccccuggacccccagcucucuagcccccaaacuuacuugacucuaaagucaucagcagcaagacgggcauugucaaucugcagaacgaugcgggcauuguccacaguauuugcgaagaucuggagggauuguagagagagguuguuccaugaauagaaagccagggauggguggggugaguguguaaaaaguguuauguauccuagugaaaacuuccuggucccaggaauagccagaggcucucccuggacaccuaucccuuuucaucuagccccaccccauucccuccuuuccuggauucccagaucccagcacucugccccucuugggaagccucagcaggcuggcuagcuggcuggccugccugcccagaagugagucgcuacuaacaaguccucuuccuggcccucuccuggcauuuuuucccuagugcaccuggucacucugggcccccuacacccuggauuggcuccucccaaaggaaggccucuuguuuacuccuagaugacucagccuuagccacauccgcuuaacccuccaauaguccccauuccgccagagccagugucuccuccucuuuacaggccuuuccuuaccucccuccaugcuguccacuuccucuguaaagcucucaacccuguccccuucccccucucuccugggaaagagcccucccaugccuagcugcugcucuuagggacccuguggcuaggugcgcggauggaaauccagguaugcccaacccccucccgguggaguagggguugggugguuauggaaugacggaaagaggcaaaggaguguauaauuggagggucagacaaggcugggaguugaggucccuccuaccccuuaccugagcccucagguccucgaugaucuugaaguaauggcuccagucucugaccuggggucccuucuucuccaagugcucccggauuuugcucuccagccuccgguucucggucuccaggcuccucacucuguccagguaagaggccaggcggucguucaggcuuugcauggucuccuucucguucuggaugccucccauuccugccagacccccggcuaucccgguggccaggcccccggaccccaugccgccccugaagcugguggagcgggacacggagauccgggaaccagagcccccagcgccugcauagacgcuggccgcgcugcugaccggccgggcgccguagcugggcgccuggacagagcccagggaccgguaguugguggagaagguggagcgaguggugaagcucaugcuguccggggagagagaaaggacaggacucaggcuuugcggacgacgguggcggccugcgcgagccgcgcgacccgaguuauaucgcagagugaggccccgcccccgccccggagccgcuucggaagccggagccacagguggacggcucggagcccgcgcccuccgccccgggccgcuccgccccgggccccacccccgcgcccuccgcgcagcccugccaagccccgcucaccccccagaaacgggguggccaaccgggcauggacacggacagcagguguuguuggcccucgaggcugcuuucagggcaggaaaugacguuauuaugcucuucucccccagguggaggaggugcuggcgaguuugaaauuugggagucuugaccgggcgcaguggcucacgccuguaaucucagcacuuugggaggccuaggugggcggaucacgaggucaggagaucgagaccauccuagccaacauggugaaacccccucucuacuaaaauacaaaaaauuagccggacgugauggugcacgccuguagucucagcuacuugggaggcugaggaaggggaaucgcuugaaccugggaggcggagguugcagugagccgagaucgcgccacugcagccuggcgacagagugagacucugucucaaaaaaaaaaaaaaaaaaaaagaaaaaagaaauuugggggucugguggugu

SEQ ID NO: 20155 - RNA, 2250 nt, Homo sapiens
cggcccuucccccauuggcuuaccccagucugguuccccucgggccccuuuucuccauagucuuaccucaagggugcuuucucuuacuccuuucccaauuuugcccuuccucuccucugcccuguucuacuucucccaucagcaguagaauuucccaagaccccguuauccacccucuccaucuuuucucugucccuccacauuugcccacuccucuugugauccacacacaccaucucuucucaguucccuuucagcccccgucuucucacuccccaccgggucccugcaugccccucgucguccuacacauacacacuaaguggauugcacucccguccuccccuucuuccgcuccuccccacccuccagucccuccagccagcuguacagcucccaaauuccgggccgagauucccgggaacaaagcaagaaaaaucagagcaauuugggaaguaaacagaaacuggaaagggagagggaaagaagaguggggaggacccagguugggggggcccucuccagucccacccaguuuagggaaugccccugcccucucccccaccccccuucaccuggcucuuaaagggcccggccccuggccggcggcuacuuaagacagaggggcggcggcgggcagcagcugcgcugcgacugcucuggaaggagaggacggggcacaaacccugaccaugaccccccacaggcugcugccaccgcugcugcugcugcuagcucugcugcucgcugccagcccaggaggcgccuuggcgcggugcccaggcugcgggcaaggggugcaggcggguuguccagggggcugcguggaggaggaggauggggggucgccagccgagggcugcgcggaagcugagggcugucucaggagggaggggcaggagugcggggucuacaccccuaacugcgccccaggacugcagugccauccgcccaaggacgacgaggcgccuuugcgggcgcugcugcucggccgaggccgcugccuuccggcccgcgcgccugcuggugaguccgcgccccgccccugccccgcccacgugagacccgcguccuccaggcaggguccuggggagacgggaguggguggcccggcaagccuuuccgcccuggcccuugacgcuuccgacuuuggggggcacauuugugugggggagaaggggcaagugcaggaagcugaggugcagccaggggaccuggugauacagcagaaggugucugcgcucucggccuucuuuuuugcuccauuuauuuucccuugauggagugugcgugcaggugggaacuugggggaggcagggggagaaaugggaggguuuuagggccaucccaugggcuccagcaggcccagcuccuacaacccuagacggccaagcuggggaaaggacccaaauguuguucucagcuuccacuuggagaaaaggggaggggaaccccagacucugaaauucugcacacacugagaaaugacuccuuuccuccuaauaccgguguucgaagcaccuaaacaggaggcgucuagaaccgaagaggccccaaauccaggguuguauuagacuugaguagggacugagggcaggcuagggcguagguuaggggagaggggagaaagaguaggggaaagagggaaucugccaaaucaggguuaugauuuaaaccugcucagaaucguucacccauccuaccccacccugcuccagggaggagagcagaagcugagucacugggugggugggacagaagugaaucagccgugaaaacauggggggcagcggggagauggggagggcaggaaaugcaaacugcgcaucccagaggcucuggguuccuuccacgggaggggauggagaauucacuuggaguuucuuucaguuccaaaugcccgagugcaggcuucugggcguccuccuaaaagguggucuggguggaugagaggaggcaguuuggaacuaaaugguugggugcuaaauguagggaaugaaggagaaggucuggggaggggugggcauccugaggaagaaggaucagacucaggauugcaggggaaaugucuccuggguugugagugguaguuagcugggagcuugucuuuaggcacagaggaagaggaucccuucagggguucugauaucugauuagauguuaggcaaauuccaagcagucaguacaugcuccccuuucugccuuuuccugucccugacuuauuuccucaccccuucccaguccugagcu

SEQ ID NO: 20156 - RNA, 2250 nt, Homo sapiens
agcucaggacugggaaggggugaggaaauaagucagggacaggaaaaggcagaaaggggagcauguacugacugcuuggaauuugccuaacaucuaaucagauaucagaaccccugaagggauccucuuccucugugccuaaagacaagcucccagcuaacuaccacucacaacccaggagacauuuccccugcaauccugagucugauccuucuuccucaggaugcccaccccuccccagaccuucuccuucauucccuacauuuagcacccaaccauuuaguuccaaacugccuccucucauccacccagaccaccuuuuaggaggacgcccagaagccugcacucgggcauuuggaacugaaagaaacuccaagugaauucuccauccccucccguggaaggaacccagagccucugggaugcgcaguuugcauuuccugcccuccccaucuccccgcugccccccauguuuucacggcugauucacuucugucccacccacccagugacucagcuucugcucuccucccuggagcagggugggguaggaugggugaacgauucugagcagguuuaaaucauaacccugauuuggcagauucccucuuuccccuacucuuucuccccucuccccuaaccuacgcccuagccugcccucagucccuacucaagucuaauacaacccuggauuuggggccucuucgguucuagacgccuccuguuuaggugcuucgaacaccgguauuaggaggaaaggagucauuucucagugugugcagaauuucagagucugggguuccccuccccuuuucuccaaguggaagcugagaacaacauuuggguccuuuccccagcuuggccgucuaggguuguaggagcugggccugcuggagcccaugggauggcccuaaaacccucccauuucucccccugccucccccaaguucccaccugcacgcacacuccaucaagggaaaauaaauggagcaaaaaagaaggccgagagcgcagacaccuucugcuguaucaccagguccccuggcugcaccucagcuuccugcacuugccccuucucccccacacaaaugugccccccaaagucggaagcgucaagggccagggcggaaaggcuugccgggccacccacucccgucuccccaggacccugccuggaggacgcgggucucacgugggcggggcaggggcggggcgcggacucaccagcaggcgcgcgggccggaaggcagcggccucggccgagcagcagcgcccgcaaaggcgccucgucguccuugggcggauggcacugcaguccuggggcgcaguuagggguguagaccccgcacuccugccccucccuccugagacagcccucagcuuccgcgcagcccucggcuggcgaccccccauccuccuccuccacgcagcccccuggacaacccgccugcaccccuugcccgcagccugggcaccgcgccaaggcgccuccugggcuggcagcgagcagcagagcuagcagcagcagcagcgguggcagcagccuguggggggucauggucaggguuugugccccguccucuccuuccagagcagucgcagcgcagcugcugcccgccgccgccccucugucuuaaguagccgccggccaggggccgggcccuuuaagagccaggugaaggggggugggggagagggcaggggcauucccuaaacugggugggacuggagagggcccccccaaccuggguccuccccacucuucuuucccucucccuuuccaguuucuguuuacuucccaaauugcucugauuuuucuugcuuuguucccgggaaucucggcccggaauuugggagcuguacagcuggcuggagggacuggaggguggggaggagcggaagaaggggaggacgggagugcaauccacuuaguguguauguguaggacgacgaggggcaugcagggacccgguggggagugagaagacgggggcugaaagggaacugagaagagaugguguguguggaucacaagaggagugggcaaauguggagggacagagaaaagauggagaggguggauaacggggucuugggaaauucuacugcugaugggagaaguagaacagggcagaggagaggaagggcaaaauugggaaaggaguaagagaaagcacccuugagguaagacuauggagaaaaggggcccgaggggaaccagacugggguaagccaaugggggaagggccg

SEQ ID NO: 20157 - RNA, 2493 nt, Homo sapiens
ucacucccacccuccuggugcugcucacagagaggaggcaagacccccauacaugagagcccuccuccuucccccaauccugggggaaaaaagagcagcagcuagaaaaaaauacaauuaccccuucccagccaccacccucgcccaucccaccgcccaccccaccccaacccucucucuccuccuuugcucgugcugugguauggagagaaggggagugacgagagaaaaacgaauacaaaucugcaauugauuuucauaauguuucugcgguguuugcaaaccaaucgccugaacguccccgaucuuaccuaagagagaaccccuccuacgucugcgaagugcuccgaacugauauaugacaauaucuacuuuggaucacgugcucagagagagagagacuaagacggauaacgcgucaucucgccuucccaaauuuuccccccucgcuagaccggguccaaaaccuccauccggagccggcaggagaggagaacgauguuuaacucggucaaccugggcaacuucugcucuccgucgcgcaaggagaggggcgcagauuucggcgagcgagggagcugcgccuccaaccucuaucugcccaguugcacuuacuacaugcccgaguucuccacggucuccuccuuccugccccaggcccccucucgucagaucuccuaucccuacucggcccaagugcccccgguccgggaggucuccuacggccuggagccauccggcaaguggcaccaucggaacagcuacuccuccugcuaugcggcggccgacgagcuuaugcaccgggagugccugccuccuuccaccgucaccgagauccucaugaaaaacgaaggcuccuacggcggccaccaccaccccagcgccccgcacgcaacccccgccggcuucuacuccucagucaacaagaacagcguccugccucaagccuucgaccguuucuucgacaacgccuacugcgguggcggcgacccgcccgccgagccccccugcuccggcaagggcgaggccaagggggagcccgaggcacccccggccucgggacuggcgucccgggcugaggcgggugccgaggcggaggcugaggaggagaacacaaaucccagcucguccgguucagcccacuccguggccaaggagccggccaaaggagccgcccccaguagguagcagcggccggggaacgggcgggcagcgagggagggagcgagagagggagggcgagagaaggggggaggcaaggggagcggggacggccucguguuuugggucaguccgauuuuauguggaguuuuauaagcauucaaaggauuuuauuauaaccuacaaagcccucucucccaacgacucgacuuuuuacgauggagaagggguggggagggagggaaaagggcucuuuggaaaagccgggugaaccccccucccccguuaucucccucggucugugaaauuuuuaaaagcgcaaccauugcgggcgauauuaacuuugaucgugaacuuagaggagcauuuaaggaaguauggggagccgggcugccgaggaguggggaggaggggagggguggagggggagaaaggggagggcgagggaaagacagggagagauccagagagggggagaggugggggagaggagcaauggagcagaaccugagaccggagaggcaagccaggaccgcuaugauccuucuuaaaacuaguuuugaaaauguucaaacuauguguucgcggguccucgagcagaaacccaagcaacucuggggucagcggcgacaggggaauggggcgaggcggcgcaggacuccacugcguuccaggcgggggucugggcguuucucccggguccgcggccuuagugcuugccuagaacugcgguguggaaggcgcugccccgcgggcuucccggggcgccagggccccggaagcggcucucuggugucucggugccugcuggccggcuuccuccccgccucccgacugcucucgccagauuucacugcuucgcgccuguucucagcuuuccccccagauuucugggggagggguugggcuuuccgaaccacuaggagggcggcccaggaagggcccgagggcggagggggagcagacagggggcccgaggggacgcacguguaccuggagggcuuuccuucugucccagacccugucagccgcggcucucgccugagaacuggggacgggguggcgcaguggcggggggguggggacccgcuagaccuggcagggggucgaggcuugcccgggugcugcggcugcaggagagccagccgccuggcgggagggcugcccgcggugggcuaggagaagggccgcugagcgcucagcgggcuggggucgcccgggucucacgugucucucuccccccucuccucgcacuugcccccuccccucccuccagacgccccccgcacccgcaagaagcgcugcccuuauucgaaauuccagauccgggaa

SEQ ID NO: 20158 - RNA, 2493 nt, Homo sapiens
uucccggaucuggaauuucgaauaagggcagcgcuucuugcgggugcggggggcgucuggagggaggggagggggcaagugcgaggagaggggggagagagacacgugagacccgggcgaccccagcccgcugagcgcucagcggcccuucuccuagcccaccgcgggcagcccucccgccaggcggcuggcucuccugcagccgcagcacccgggcaagccucgacccccugccaggucuagcggguccccacccccccgccacugcgccaccccguccccaguucucaggcgagagccgcggcugacagggucugggacagaaggaaagcccuccagguacacgugcguccccucgggcccccugucugcucccccuccgcccucgggcccuuccugggccgcccuccuagugguucggaaagcccaaccccucccccagaaaucuggggggaaagcugagaacaggcgcgaagcagugaaaucuggcgagagcagucgggaggcggggaggaagccggccagcaggcaccgagacaccagagagccgcuuccggggcccuggcgccccgggaagcccgcggggcagcgccuuccacaccgcaguucuaggcaagcacuaaggccgcggacccgggagaaacgcccagacccccgccuggaacgcaguggaguccugcgccgccucgccccauuccccugucgccgcugaccccagaguugcuuggguuucugcucgaggacccgcgaacacauaguuugaacauuuucaaaacuaguuuuaagaaggaucauagcgguccuggcuugccucuccggucucagguucugcuccauugcuccucucccccaccucucccccucucuggaucucucccugucuuucccucgcccuccccuuucucccccuccaccccuccccuccuccccacuccucggcagcccggcuccccauacuuccuuaaaugcuccucuaaguucacgaucaaaguuaauaucgcccgcaaugguugcgcuuuuaaaaauuucacagaccgagggagauaacgggggagggggguucacccggcuuuuccaaagagcccuuuucccucccuccccaccccuucuccaucguaaaaagucgagucguugggagagagggcuuuguagguuauaauaaaauccuuugaaugcuuauaaaacuccacauaaaaucggacugacccaaaacacgaggccguccccgcuccccuugccuccccccuucucucgcccucccucucucgcucccucccucgcugcccgcccguuccccggccgcugcuaccuacugggggcggcuccuuuggccggcuccuuggccacggagugggcugaaccggacgagcugggauuuguguucuccuccucagccuccgccucggcacccgccucagcccgggacgccagucccgaggccgggggugccucgggcucccccuuggccucgcccuugccggagcaggggggcucggcgggcgggucgccgccaccgcaguaggcguugucgaagaaacggucgaaggcuugaggcaggacgcuguucuuguugacugaggaguagaagccggcggggguugcgugcggggcgcugggguggugguggccgccguaggagccuucguuuuucaugaggaucucggugacgguggaaggaggcaggcacucccggugcauaagcucgucggccgccgcauagcaggaggaguagcuguuccgauggugccacuugccggauggcuccaggccguaggagaccucccggaccgggggcacuugggccgaguagggauaggagaucugacgagagggggccuggggcaggaaggaggagaccguggagaacucgggcauguaguaagugcaacugggcagauagagguuggaggcgcagcucccucgcucgccgaaaucugcgccccucuccuugcgcgacggagagcagaaguugcccagguugaccgaguuaaacaucguucuccucuccugccggcuccggauggagguuuuggacccggucuagcgaggggggaaaauuugggaaggcgagaugacgcguuauccgucuuagucucucucucucugagcacgugauccaaaguagauauugucauauaucaguucggagcacuucgcagacguaggagggguucucucuuagguaagaucggggacguucaggcgauugguuugcaaacaccgcagaaacauuaugaaaaucaauugcagauuuguauucguuuuucucucgucacuccccuucucuccauaccacagcacgagcaaaggaggagagagaggguugggguggggugggcggugggaugggcgagggugguggcugggaagggguaauuguauuuuuuucuagcugcugcucuuuuuucccccaggauugggggaaggaggagggcucucauguaugggggucuugccuccucucugugagcagcaccaggagggugggaguga

SEQ ID NO: 20159 - RNA, 2601 nt, Homo sapiens
ccagagggacagagucuucugggucucucugccugaggcccuggagggagagaagguagggagaucggcgcccgccgggccuggcaaagaggccucgggaaauguugaaccuguaugugaucucaggcucacacucauguugugggucugucugccucaggagaugcgguuugccuuucugucugagacgccccaaacccugagcucuccuucccaaggcuggaaaaaaaaucgggaaaaacggcggaauuugcacuuucauucauuggguuaucugcaacugagaggggcugguuaaggcguccccaaguuggaagggcgcuuugcuucuguuuucuggaugcagaguccucugacucccucugccacgggcugaguuuccggcuccagguucgcgugucgcccugagguuugaggccagacagcucgcagucgggcagggagggcgggggagagacgagcggcucuggccccuuaauuguacuucgggcucguauugucucuccuuucgccaccuccgcuuccucagucugggcuccaaagucacugcaaauuuccuugcgacacauacaucacacaaaagaucagguaacaaggcgcucagggccacuggggcuccgggcagggcagggagcggcucuagcucuggggcggcucccccuccagccacucccaggcuggaaaaccagaccgcguugggggagccggaaauagccccgcuugcugcggagcgucagggcgggggcgccggcgggaaugcaggcccggcaggccguggcuuugagagagccacguucacaggcccuggggauuucacuccugcugggccucgggaccugacuccugguguguagggaucccagauacccaccuugggugggggcaggacgcggguuuccucgcggcaggccaagagaacucaguuucugcuuccagcgcaggccuuagcuaggaggaguuguguguggguguguuuuucccaacaaagagggaucaggagagagaaggggggaaaguagaggggaaccagggagggggcggggaggggaagagggcaguggagaggugaaaugagcccauuucagggggagaaggaaaaugaaagcaaauggaguacggccuucuccgcgcagggcgggugcugacgagccgggagcgggcucccugccugcggcagccgggauggcccgcuggggacaccggagaaagccuguuuuaaauuuaauccgaacuugacgguguggauugaaccggagggaauuuaaaucacuaaaaggaaggcgcggggcagggggaggggacgacucuaaccugucuaucuuucugucuguccuucccacggugcuaguuugguuguggccgcagcugcccagguuucaggugauggaguaagggugccccucccccucaggggucucuccugugcccagugaagucuuuugggggugggagggaacucuaagaaccagagugaaugcacagcugcgagcuaaagcugggguuucccccuccccaacaagaacucccaguggccuccagucccuggguuugccccagcggugcugaggaaaauugaagggaguaugugggugaggggaagucuggaguauggcagaagauucagaaggaguaacugaaccccaggaagacagaccuuccuucuuggugccccuauauccuuugugccccgccccccgcaccuacaaaccuggauuugagggaaaucugcagguccgcuucaaagcccuggucugccacccacaccccuccaaauguggagaaugggggcuacaggccacaugcaguuguggaccugcggaaccuccgcccaguggacuccggaacucccagccucuucuagccccccuccccaaggccgccucucuccgaagggcgcagggaaaaugaggcauuggcugggaaggggcugugggcgaggccugcuuccugauccacagccgugccugccucugagugggaagaguucggaggucauagucccagaaaauaaaauaaaauaaaggaaagcgacaaucuccuugguuucacaggggauuucacggcagcagggaucccgccggugagccucacugcccgcugcugccgccuccgcagagugggcaggcagggugcgcaggcagcucaagaguugaaaagaaggcgguguucaaaggggguaggagagaagggggcaucucuuuacggccccaaugucuauuugaggaacucucccaaauagcagaggcccauaggggaggcuccuuagggacucuuuccuccaggaaagcugaggcuggggcagcuggccuugucgcuuggagaagacgcaaaggaagagcaggggugaaaccucuuuccucuucuguuucuucgcuccuugaauagagcagggcucagcccccagcugccuaagcggcugucuggaccaauaugggguucuauaucccugaggccuagaguacccauccgagcaagucuccugggaggggcaggagaggagcccucuuccgccuuuguguccagacagaaguggccgccgcgcccggagccggucccgcggcaaaggcccggcaagccagcgggcugcacaaugccacggcu

SEQ ID NO: 20160 - RNA, 2601 nt, Homo sapiens
agccguggcauugugcagcccgcuggcuugccgggccuuugccgcgggaccggcuccgggcgcggcggccacuucugucuggacacaaaggcggaagagggcuccucuccugccccucccaggagacuugcucggauggguacucuaggccucagggauauagaaccccauauugguccagacagccgcuuaggcagcugggggcugagcccugcucuauucaaggagcgaagaaacagaagaggaaagagguuucaccccugcucuuccuuugcgucuucuccaagcgacaaggccagcugccccagccucagcuuuccuggaggaaagagucccuaaggagccuccccuaugggccucugcuauuugggagaguuccucaaauagacauuggggccguaaagagaugcccccuucucuccuacccccuuugaacaccgccuucuuuucaacucuugagcugccugcgcacccugccugcccacucugcggaggcggcagcagcgggcagugaggcucaccggcgggaucccugcugccgugaaauccccugugaaaccaaggagauugucgcuuuccuuuauuuuauuuuauuuucugggacuaugaccuccgaacucuucccacucagaggcaggcacggcuguggaucaggaagcaggccucgcccacagccccuucccagccaaugccucauuuucccugcgcccuucggagagaggcggccuuggggaggggggcuagaagaggcugggaguuccggaguccacugggcggagguuccgcagguccacaacugcauguggccuguagcccccauucuccacauuuggagggguguggguggcagaccagggcuuugaagcggaccugcagauuucccucaaauccagguuuguaggugcggggggcggggcacaaaggauauaggggcaccaagaaggaaggucugucuuccugggguucaguuacuccuucugaaucuucugccauacuccagacuuccccucacccacauacucccuucaauuuuccucagcaccgcuggggcaaacccagggacuggaggccacugggaguucuuguuggggagggggaaaccccagcuuuagcucgcagcugugcauucacucugguucuuagaguucccucccacccccaaaagacuucacugggcacaggagagaccccugagggggaggggcacccuuacuccaucaccugaaaccugggcagcugcggccacaaccaaacuagcaccgugggaaggacagacagaaagauagacagguuagagucguccccucccccugccccgcgccuuccuuuuagugauuuaaauucccuccgguucaauccacaccgucaaguucggauuaaauuuaaaacaggcuuucuccgguguccccagcgggccaucccggcugccgcaggcagggagcccgcucccggcucgucagcacccgcccugcgcggagaaggccguacuccauuugcuuucauuuuccuucucccccugaaaugggcucauuucaccucuccacugcccucuuccccuccccgcccccucccugguuccccucuacuuuccccccuucucucuccugaucccucuuuguugggaaaaacacacccacacacaacuccuccuagcuaaggccugcgcuggaagcagaaacugaguucucuuggccugccgcgaggaaacccgcguccugcccccacccaagguggguaucugggaucccuacacaccaggagucaggucccgaggcccagcaggagugaaauccccagggccugugaacguggcucucucaaagccacggccugccgggccugcauucccgccggcgcccccgcccugacgcuccgcagcaagcggggcuauuuccggcucccccaacgcggucugguuuuccagccugggaguggcuggagggggagccgccccagagcuagagccgcucccugcccugcccggagccccaguggcccugagcgccuuguuaccugaucuuuugugugauguaugugucgcaaggaaauuugcagugacuuuggagcccagacugaggaagcggagguggcgaaaggagagacaauacgagcccgaaguacaauuaaggggccagagccgcucgucucucccccgcccucccugcccgacugcgagcugucuggccucaaaccucagggcgacacgcgaaccuggagccggaaacucagcccguggcagagggagucagaggacucugcauccagaaaacagaagcaaagcgcccuuccaacuuggggacgccuuaaccagccccucucaguugcagauaacccaaugaaugaaagugcaaauuccgccguuuuucccgauuuuuuuuccagccuugggaaggagagcucaggguuuggggcgucucagacagaaaggcaaaccgcaucuccugaggcagacagacccacaacaugagugugagccugagaucacauacagguucaacauuucccgaggccucuuugccaggcccggcgggcgccgaucucccuaccuucucucccuccagggccucaggcagagagacccagaagacucugucccucugg

SEQ ID NO: 20161 - RNA, 2566 nt, Homo sapiens
acccccuaggaagcccaucuuuuggguuaggggcccugcucuggcuugcagguauucauccccuuggaggucuuauaccuguugagguaaccuggguugaccugcuggcucagguaucucucucucucugagaagaaggaaaagagaagcgaggcugggggcgagaggcaccuucacaucuaaauucguacccuggaaaacuggccccagccauuagcuggggcuggcucaccaccccccuacacacaccacacacccccaucccucccccucuccuccccuccccuuccuccagguccccccagcccuguaccccucaacccccgccaucucucucucucucucucucucucucucucucucucucucucucucucucucucucucgccugucuucaugucguggauugaugaacgcgaaucgcguguaagcgccgccaccgccgggagucugaggaauucgccugggcuguuagaggaaagagcuaagugagagagcgcgagcucuaccuaccgacagugaggagcgccgccgccgccgccgccgcccgcucgccgcccgccgccgccgccgcccgcgccccagccccgggagcucugcugauccggccgagcucagcaccgaggcgccccccaaccugcccagcccccagcccaccagcccagcccagucccggggagccagcuggccugggguucggucccggggggaggggaguuucggggguacugggcgggguacucgugagccagaggggagggggccgcggguuuucauguacccagcaugagcuccuacuucgucaacccccuguucuccaaauacaaagccggcgagucccuggaaccggccuauuacgacugccgguucccucagagcgugggcaggagccaugcgcugguguacgggcccggcggcucggcgcccggcuuccagcacgcuucgcaccacguucaagacuucuuccaccacggcaccuccggcaucuccaacucaggcuaccagcagaacccgugcucgcuuagcugccacggagacgccuccaaauucuauggcuacgaggcgcuccccagacagucccuuuauggggcucagcaagaggcgagcguggugcaauaucccgacuguaaauccuccgccaacacuaacaguagcgaaggacaaggccacuuaaaucaaaacucgucucccagccucauguuuccauggaugagaccccacggugagaagccuuuucucuuucccccuuggucucccgcgcuccaggguuucccccccucccucgccuccuuuuugucugcccucgcuuuuucuccuggcuuuggggucucucccgccccacccccgugccugugccugggugguuuucucgaaguugggaaggcuccgcuggggcggggcagggagggggugccuagaacauuuaggggauuggggugaaggugagagaaagcugguguguggccgcaaaggguuaaaaaucguuuucuccaucucugucugucugucucucucugacucucccacuccccaucucuaaagucaaaguuggggagguggcugggaaugguacccugaguacccugagacugucagccuuuggaacaaaccaguuucuccagaggcagggagccuggaguccaggacacuggccaggcugucuuggggcaaagggagacagaccccuguugcucugcccuagccagaguguggugagacucuaaggacaggcucucuggcucucuagggcacccauaaccuccucucagagaaccagccugagggccacuaccccaacuuuuuuauacuucccccaguugggagaagacgggggagccugagaggagggggaaaaaagagugcucaaaaggagagaggccauagagauuagggguuccugagguccagaagacccuagccgcccccccaaucaaggacuuguggggucucccugagaccugcagaguagcuuaggucaugagccccuccaaggguggccccucauggcccaauuucgaaguacagggggaagcgauaaagcgacaaguuccggcggggauggcccaugauuuauuugcuggucuccaguuagcaaucaggcggagcggugacacauuccagcagaucaauuauuuuucuuauuggaaaagcauuaggcagagagagacaaggagagggcagugggcagagccccucuucuuuacccccagcuuuuuuuccuuucuuuuggaaacagucuguccccagccucgcucacuaaaugcccugcugcacuuguaaacaaagcugcaaaggccaguuccuaggauuacaggccuggugggggggauucuacagggcuccccagccccugaaaggccccaguuuccaaacagacccuagcccccacccccaccccaccucccaaggugaagccaaacaaaaacaaucccccaacuuuucugcccuugucugccuucugcucuagccuuuuccauagaggggaggcgaacugaggagaucagagaggggaguuuagaguaggaagaguggcaaaggaaaaccaagcccccauccaaacguaac

SEQ ID NO: 20162 - RNA, 2566 nt, Homo sapiens
guuacguuuggaugggggcuugguuuuccuuugccacucuuccuacucuaaacuccccucucugaucuccucaguucgccuccccucuauggaaaaggcuagagcagaaggcagacaagggcagaaaaguugggggauuguuuuuguuuggcuucaccuugggagguggggugggggugggggcuagggucuguuuggaaacuggggccuuucaggggcuggggagcccuguagaaucccccccaccaggccuguaauccuaggaacuggccuuugcagcuuuguuuacaagugcagcagggcauuuagugagcgaggcuggggacagacuguuuccaaaagaaaggaaaaaaagcuggggguaaagaagaggggcucugcccacugcccucuccuugucucucucugccuaaugcuuuuccaauaagaaaaauaauugaucugcuggaaugugucaccgcuccgccugauugcuaacuggagaccagcaaauaaaucaugggccauccccgccggaacuugucgcuuuaucgcuucccccuguacuucgaaauugggccaugaggggccacccuuggaggggcucaugaccuaagcuacucugcaggucucagggagaccccacaaguccuugauugggggggcggcuagggucuucuggaccucaggaaccccuaaucucuauggccucucuccuuuugagcacucuuuuuucccccuccucucaggcucccccgucuucucccaacugggggaaguauaaaaaaguugggguaguggcccucaggcugguucucugagaggagguuaugggugcccuagagagccagagagccuguccuuagagucucaccacacucuggcuagggcagagcaacaggggucugucucccuuugccccaagacagccuggccaguguccuggacuccaggcucccugccucuggagaaacugguuuguuccaaaggcugacagucucaggguacucaggguaccauucccagccaccuccccaacuuugacuuuagagauggggagugggagagucagagagagacagacagacagagauggagaaaacgauuuuuaacccuuugcggccacacaccagcuuucucucaccuucaccccaauccccuaaauguucuaggcacccccucccugccccgccccagcggagccuucccaacuucgagaaaaccacccaggcacaggcacggggguggggcgggagagaccccaaagccaggagaaaaagcgagggcagacaaaaaggaggcgagggagggggggaaacccuggagcgcgggagaccaagggggaaagagaaaaggcuucucaccguggggucucauccauggaaacaugaggcugggagacgaguuuugauuuaaguggccuuguccuucgcuacuguuaguguuggcggaggauuuacagucgggauauugcaccacgcucgccucuugcugagccccauaaagggacugucuggggagcgccucguagccauagaauuuggaggcgucuccguggcagcuaagcgagcacggguucugcugguagccugaguuggagaugccggaggugccgugguggaagaagucuugaacguggugcgaagcgugcuggaagccgggcgccgagccgccgggcccguacaccagcgcauggcuccugcccacgcucugagggaaccggcagucguaauaggccgguuccagggacucgccggcuuuguauuuggagaacaggggguugacgaaguaggagcucaugcuggguacaugaaaacccgcggcccccuccccucuggcucacgaguaccccgcccaguacccccgaaacuccccuccccccgggaccgaaccccaggccagcuggcuccccgggacugggcugggcuggugggcugggggcugggcagguuggggggcgccucggugcugagcucggccggaucagcagagcucccggggcuggggcgcgggcggcggcggcggcgggcggcgagcgggcggcggcggcggcggcggcgcuccucacugucgguagguagagcucgcgcucucucacuuagcucuuuccucuaacagcccaggcgaauuccucagacucccggcgguggcggcgcuuacacgcgauucgcguucaucaauccacgacaugaagacaggcgagagagagagagagagagagagagagagagagagagagagagagagagagagagagauggcggggguugagggguacagggcuggggggaccuggaggaaggggaggggaggagagggggagggaugggggugugugguguguguagggggguggugagccagccccagcuaauggcuggggccaguuuuccaggguacgaauuuagaugugaaggugccucucgcccccagccucgcuucucuuuuccuucuucucagagagagagagauaccugagccagcaggucaacccagguuaccucaacagguauaagaccuccaaggggaugaauaccugcaagccagagcagggccccuaacccaaaagaugggcuuccuagggggu

SEQ ID NO: 20163 - RNA, 2888 nt, Homo sapiens
ccuagggugaaaaaugggcugguugauccucccuguuaauuaccuguugcgggaaauuggggagucugugcacauaugcaugugguuuuagcuccuacuacgaagauauuaugugagaggcagagaaaagauacugaggugaaacauucacuuccguuccaggaagaaaggauuuaagugccauuacuggggugaggguggagaagcgggggcgguuugcuaaauggaugugcuccauagccacaauaaaacgccaccaagcccuuuuagccccucauuagcuagacccuaaucugggguggugccagccagagcgggugcacccccuccuccagcccgagguggggcagugucagccccaagccucacccuccucacagggacgcuuccgccuggcccugcccucacccacucagcuggucgacuccgugguuuccaacacaaacacauucucuggauuucaggcgcaccucaaucucuccacuugaggggcagaggaggcuccaggcuauguggccagcccucugccuccuacucgacucccuggcuccccaugggauggagguggugagauccaaaaacccucagugggaaaacagguucugcaccuuccugccaccuccacgccucucccugggcuguagucuuggcauuugccaaggcccccgugggcauccacgcccuguuuuccccagaagggucuccccucauucccugcaaaccagcagggcaucuccagguggaaagaaggggagggcuugggaggcagauggagguucaaggucuaguucuuugcauuuaccagcucaguggccuugagcaaaccgacuuagaucucuagccuguuuccccacuugcaacaggagagcgugcuggaaacagcucaggggugaggcucccagggagaaacggagauggagggcgagcaccagccaacugcaaaccuccagcagcucaggucgccauccuuccccuugugugacuccugggaaaccaggaccccgucccuuccucguccucuuuaagcuuucuuaacugaaggccgaauuccaggaagaggugcccagcaauaaugugucgguucuuagauuucucucugauucagacuggagugcagagguggcuaaaggcggcuuuuaaaaaauuuuuaugauaaaauaugcauaacaucauaaucaucauuuuaaccgaugauaagcauacaacucaguggcauuaaauaccuucacgauacuguguaaccauugccacuauguauacccaaaacuuuuucauccuccccaagaaaaacucugucccauuaaacaguaacucccgguucccagguacccccaggcccuggcaaccaucauucuacuuucugucuauaaaauuugccuauucuaggugucucauaaaaguggaaucacacuguauuugaacuggaggcuucuuaagucccucuccaagccccuuacuuagacacagcugaauuauaagaucaaggugcacacacacacacacacacacacacacacacccucaaagcuugggaggggcagugcucccuuccccaaaacugaagcuggccuggagggagagcuuugcccuguggugucuucggaguccccauguccagccccacaucuucaccuaaaagaccucccuggagcgugcucagaucucuggauuuggggagggcguagaauacacacuacgagcugcagccucuccuaccucuggaacacaugggugcggucucgccucuuuaaagccccccaagcccuucuagaguuggcagggagagaggugucaucccagcagcgccucccggcuccuccaccguuccugacccccaagaagucgcuccucgccgcucgggggcgcgacggagcagcggcgggggccuagagggguacgcagcccaggaggacccgcuggcccggccuggcgcaccaguccugcccgcgaggcgagucuggggacgcugcccgggaaucccucacgcgaccuggggaucucccuggacuccaagagccccggguguaaguccggcggggcgaggggaggcgcccugacuccuccccaaacuuuucccgccugcuucggcucaaaaggcgugggaagcugucccgggauggcgaaguggaauucuggggccggagcgagcguggcgcagaccagaggucggcggcauggguggcaccucggcccucccguuacugucaccaauuccgggggcugcucccgguccaguaaguggaggggucgcgucccugcugcccgggcguacacgaucccggggcccccccgaugucgccccgcgcccugggugcgcccacaacucacccggcgcuggcggcugcgcuggcagcuggaucgacggacuggcugggggugcgaggcgaggccgccgggcuguuuugaagcucugggcugggacugcgcgcccucccuccacccucuaggcggcggggccccuccuuccccgaucccgccucccgggccgugacgccaggagccgggagagccgagugggaggggccgccggcgaaaggagggggcccuggagggaaaggccgaggccgggagcgcccuggcgcccccgcaccaccguucccgcccgccucccugcggcucuguggccagcuuuggggcggagccgguggcacgggcccgggggaaaagggagaaagggaggcucccgggagcaagggucuucccuucucugcagguuuccacaucccucucauucucuuuccucuccucuucuccccuuuucuuccucuucccuaaggaguuuuggaauccgggcucccugcucuagaaccccuucucuggccuuuuaugaacuuccugagcucguccauaaucuccccugucucaguuuccucuucugggaaugggag

SEQ ID NO: 20164 - RNA, 2888 nt, Homo sapiens
cucccauucccagaagaggaaacugagacaggggagauuauggacgagcucaggaaguucauaaaaggccagagaagggguucuagagcagggagcccggauuccaaaacuccuuagggaagaggaagaaaaggggagaagaggagaggaaagagaaugagagggauguggaaaccugcagagaagggaagacccuugcucccgggagccucccuuucucccuuuucccccgggcccgugccaccggcuccgccccaaagcuggccacagagccgcagggaggcgggcgggaacgguggugcgggggcgccagggcgcucccggccucggccuuucccuccagggcccccuccuuucgccggcggccccucccacucggcucucccggcuccuggcgucacggcccgggaggcgggaucggggaaggaggggccccgccgccuagaggguggagggagggcgcgcagucccagcccagagcuucaaaacagcccggcggccucgccucgcacccccagccaguccgucgauccagcugccagcgcagccgccagcgccgggugaguugugggcgcacccagggcgcggggcgacaucgggggggccccgggaucguguacgcccgggcagcagggacgcgaccccuccacuuacuggaccgggagcagcccccggaauuggugacaguaacgggagggccgaggugccacccaugccgccgaccucuggucugcgccacgcucgcuccggccccagaauuccacuucgccaucccgggacagcuucccacgccuuuugagccgaagcaggcgggaaaaguuuggggaggagucagggcgccuccccucgccccgccggacuuacacccggggcucuuggaguccagggagauccccaggucgcgugagggauucccgggcagcguccccagacucgccucgcgggcaggacuggugcgccaggccgggccagcggguccuccugggcugcguaccccucuaggcccccgccgcugcuccgucgcgcccccgagcggcgaggagcgacuucuugggggucaggaacgguggaggagccgggaggcgcugcugggaugacaccucucucccugccaacucuagaagggcuuggggggcuuuaaagaggcgagaccgcacccauguguuccagagguaggagaggcugcagcucguaguguguauucuacgcccuccccaaauccagagaucugagcacgcuccagggaggucuuuuaggugaagauguggggcuggacauggggacuccgaagacaccacagggcaaagcucucccuccaggccagcuucaguuuuggggaagggagcacugccccucccaagcuuugagggugugugugugugugugugugugugugugugcaccuugaucuuauaauucagcugugucuaaguaaggggcuuggagagggacuuaagaagccuccaguucaaauacagugugauuccacuuuuaugagacaccuagaauaggcaaauuuuauagacagaaaguagaaugaugguugccagggccuggggguaccugggaaccgggaguuacuguuuaaugggacagaguuuuucuuggggaggaugaaaaaguuuuggguauacauaguggcaaugguuacacaguaucgugaagguauuuaaugccacugaguuguaugcuuaucaucgguuaaaaugaugauuaugauguuaugcauauuuuaucauaaaaauuuuuuaaaagccgccuuuagccaccucugcacuccagucugaaucagagagaaaucuaagaaccgacacauuauugcugggcaccucuuccuggaauucggccuucaguuaagaaagcuuaaagaggacgaggaagggacgggguccugguuucccaggagucacacaaggggaaggauggcgaccugagcugcuggagguuugcaguuggcuggugcucgcccuccaucuccguuucucccugggagccucaccccugagcuguuuccagcacgcucuccuguugcaaguggggaaacaggcuagagaucuaagucgguuugcucaaggccacugagcugguaaaugcaaagaacuagaccuugaaccuccaucugccucccaagcccuccccuucuuuccaccuggagaugcccugcugguuugcagggaaugaggggagacccuucuggggaaaacagggcguggaugcccacgggggccuuggcaaaugccaagacuacagcccagggagaggcguggagguggcaggaaggugcagaaccuguuuucccacugaggguuuuuggaucucaccaccuccaucccauggggagccagggagucgaguaggaggcagagggcuggccacauagccuggagccuccucugccccucaaguggagagauugaggugcgccugaaauccagagaauguguuuguguuggaaaccacggagucgaccagcugagugggugagggcagggccaggcggaagcgucccugugaggagggugaggcuuggggcugacacugccccaccucgggcuggaggagggggugcacccgcucuggcuggcaccaccccagauuagggucuagcuaaugaggggcuaaaagggcuugguggcguuuuauuguggcuauggagcacauccauuuagcaaaccgcccccgcuucuccacccucaccccaguaauggcacuuaaauccuuucuuccuggaacggaagugaauguuucaccucaguaucuuuucucugccucucacauaauaucuucguaguaggagcuaaaaccacaugcauaugugcacagacuccccaauuucccgcaacagguaauuaacagggaggaucaaccagcccauuuuucacccuagg

SEQ ID NO: 20165 - RNA, 2663 nt, Homo sapiens
ggaaauaagagcccgugccucacaggguugugccucucuuuauaggauuaaguaaauuuaaguaugcaaagcacagaauuagggcuggcacgcacaaagugcucaaacgcgagcugcugucuuaccggacacacgccaaaacuagaccaaccguuucucucccuggagaguuguggguggaaccgugagggaugcccagccacagggcaggccccguacaccaccugcagcccagcaggucagccuuaggacccucuccccuggaccuguucagaaccaaguuaaacuuuuggccaaagcacacucgcuagaaaacuuauuuuuuuuuaaaaaaaaaacuuucauaauaaaguuuauuaccuaaacugacuuuaaaaaauauaaaauaggauucugcacagcagaaaaauaaagccagagacccucccccaaccccugguuugugcaaagauacuggguauauguaaacaugaagagguaggaggugcgaguucagguccuggcuccagauacaguuaagcugcuacaacaaccagggggacccagagggagcaccaggagggggaggacccccucaagaggugagaaggggucugcggccucgucuccagccgagggcgggaggcgccucgccccuacacccauccgcucccuccaacccaggccggggaggguacccacaugguuccaggcaaguaauaacaaaauaacacggcaucccaguuaaugcugcgugcacggcgggcgcugccggucaaaucuggaaggggaaggagcucagguagucgcggaggacgggguugagggggaugcgagccagguucucgcggcccacgguggccacgaugcgcuggcggcacagcuccugcagcggccgcacgcggcgcuggcgcagcggggcccccagcaugcggcgcggcgccgccacguagugcuccagcagcucgaagaggcagucgaagcucucgcggcugccauccaggugaaagcggccggccugaaagugcacgcggaugcucgugggucccgaggccaucuucacgcuaagggcgaaaaagcaguuccgcuggcggcugucgcgcaccaggaaggugcccacgggcucggcgcgcagccgcucgugcgccccgugcacgcucaggggcccccaguagaauccgcaggcguccaggagcgcgcuggcgcgcgugaugcgccgguaaucggcgugcgaacggaaugugcggaagugcgugucgccgggggccggggccgggaccgcggggcacggccgcgggcgcgcgggggccgcgggcgaggaggaggaagaggaggaagguucuggccgccgucggggcucugcugcuguggagacugcauugucggcugccaccugguugugugcuaccauccuacagaaggggccagccggaggggugggccauagcguccgggggugcgcugcgggagagacaaagaggugagcuggggcgcugcggggccgggcaggugugcgccggccggacaacuccggagggcggcgcucccggcggacccggcccuagggggcgagcacggagcaccaaguccgcgcggauccguucagccucaguggacacagcuagaaaaugggcucuguacuccgcggagcucuucccggcgggugggggcucgguggaggcggaguccggccuccgggcagcaccgagaggggggcguggagagcagccgguucuggcuccagccguccggccccggcucgccgccccgcgcccgccgccugcuggccaggcugggauccgcgccuggucugggcgauuugggcuagggccggagaaaggcugugcugcgggagccccgcgcgcggggggcggccuggguggggccggcgagggucaggggcaucgcggccgcgaccccauucugcagcccccgaggcucgcccgacuccuggcugcccuggacuccccucccuccucccucccgccuccucgcccagggcccggcucaccuggcggcggggcgcgggacgccgcgggcgggacggcggggggcuccggggcgcuccggggcggcucucgcgcaugcuccggggccaggagccgugcagcugccacggccgcagcucgcucuguucggcgcccgccccugcgccagucuuuuaaaccggcucggaggcggggcuggcgacggcgggaggccccgcccccugccggccccgcccccagcuccacuuuugguuucucuuuccgcgguggcguccggcgaggaccgcuucggcccuguuucccucucuucuggacccucccgcggggcccucugcccgccuguucgcaccugccccagcacccgccucucgaggggcucuggccccgacccugcgccuuccggccacuucucggaccccuccuucggacuuggcgaccccgauuuugccccgcuaccucggguuccacuuucugccgccaggcccucuugggacgcgcccugacacacccuccuccgccccagcugucuccacacccgccgggggcagagcccuguccucuccuccccugcagccagaucccccuaggaggccacagaagguguccccaacccugagccugaccccacccguagacccccuccuagccccugcuccacccgccgucgacgcccucagucgcccgcccugcuguccc

SEQ ID NO: 20166 - RNA, 2663 nt, Homo sapiens
gggacagcagggcgggcgacugagggcgucgacggcggguggagcaggggcuaggagggggucuacggguggggucaggcucaggguuggggacaccuucuguggccuccuagggggaucuggcugcaggggaggagaggacagggcucugcccccggcggguguggagacagcuggggcggaggagggugugucagggcgcgucccaagagggccuggcggcagaaaguggaacccgagguagcggggcaaaaucggggucgccaaguccgaaggagggguccgagaaguggccggaaggcgcagggucggggccagagccccucgagaggcgggugcuggggcaggugcgaacaggcgggcagagggccccgcgggaggguccagaagagagggaaacagggccgaagcgguccucgccggacgccaccgcggaaagagaaaccaaaaguggagcugggggcggggccggcagggggcggggccucccgccgucgccagccccgccuccgagccgguuuaaaagacuggcgcaggggcgggcgccgaacagagcgagcugcggccguggcagcugcacggcuccuggccccggagcaugcgcgagagccgccccggagcgccccggagccccccgccgucccgcccgcggcgucccgcgccccgccgccaggugagccgggcccugggcgaggaggcgggagggaggagggaggggaguccagggcagccaggagucgggcgagccucgggggcugcagaauggggucgcggccgcgaugccccugacccucgccggccccacccaggccgccccccgcgcgcggggcucccgcagcacagccuuucuccggcccuagcccaaaucgcccagaccaggcgcggaucccagccuggccagcaggcggcgggcgcggggcggcgagccggggccggacggcuggagccagaaccggcugcucuccacgccccccucucggugcugcccggaggccggacuccgccuccaccgagcccccacccgccgggaagagcuccgcggaguacagagcccauuuucuagcuguguccacugaggcugaacggauccgcgcggacuuggugcuccgugcucgcccccuagggccggguccgccgggagcgccgcccuccggaguuguccggccggcgcacaccugcccggccccgcagcgccccagcucaccucuuugucucucccgcagcgcacccccggacgcuauggcccaccccuccggcuggccccuucuguaggaugguagcacacaaccagguggcagccgacaaugcagucuccacagcagcagagccccgacggcggccagaaccuuccuccucuuccuccuccucgcccgcggcccccgcgcgcccgcggccgugccccgcggucccggccccggcccccggcgacacgcacuuccgcacauuccguucgcacgccgauuaccggcgcaucacgcgcgccagcgcgcuccuggacgccugcggauucuacugggggccccugagcgugcacggggcgcacgagcggcugcgcgccgagcccgugggcaccuuccuggugcgcgacagccgccagcggaacugcuuuuucgcccuuagcgugaagauggccucgggacccacgagcauccgcgugcacuuucaggccggccgcuuucaccuggauggcagccgcgagagcuucgacugccucuucgagcugcuggagcacuacguggcggcgccgcgccgcaugcugggggccccgcugcgccagcgccgcgugcggccgcugcaggagcugugccgccagcgcaucguggccaccgugggccgcgagaaccuggcucgcaucccccucaaccccguccuccgcgacuaccugagcuccuuccccuuccagauuugaccggcagcgcccgccgugcacgcagcauuaacugggaugccguguuauuuuguuauuacuugccuggaaccauguggguacccuccccggccuggguuggagggagcggauggguguaggggcgaggcgccucccgcccucggcuggagacgaggccgcagaccccuucucaccucuugaggggguccucccccuccuggugcucccucugggucccccugguuguuguagcagcuuaacuguaucuggagccaggaccugaacucgcaccuccuaccucuucauguuuacauauacccaguaucuuugcacaaaccagggguugggggagggucucuggcuuuauuuuucugcugugcagaauccuauuuuauauuuuuuaaagucaguuuagguaauaaacuuuauuaugaaaguuuuuuuuuuaaaaaaaaauaaguuuucuagcgagugugcuuuggccaaaaguuuaacuugguucugaacagguccaggggagaggguccuaaggcugaccugcugggcugcaggugguguacggggccugcccuguggcugggcaucccucacgguuccacccacaacucuccagggagagaaacgguuggucuaguuuuggcguguguccgguaagacagcagcucgcguuugagcacuuugugcgugccagcccuaauucugugcuuugcauacuuaaauuuacuuaauccuauaaagagaggcacaacccugugaggcacgggcucuuauuucc

SEQ ID NO: 20167 - RNA, 2478 nt, Homo sapiens
acugggcggaugaaugauacauaaaugaauucgcgaacgacugaugcccagcuuccucccgaagcaaggucauucaccucagcggucgcgccucuccccugccccugccccggauuccccgccgcucucagcucucgaggaguaugcagcacucuuccgugcagcgugccucaguuuccuccgcuguaagcaggcgggaccaaggcagccugccggggucaggaugaggcuggcagaggaagggcgccuguaguggggccccguacccacgggcgcccaauccgcgcucgccagggccgagcccgcccgccgcgcgcagcccccgccccaccgccugccggccccgagcacacgugacuccgccccggcccgccccgccccgccgucccagcgcgggcucccauuggccuuucugggaggccccguccccagccggggaggagccgggccccgcccgccgcagcgcggggcuccugcgucccgagugcgcggcggccggaccgggcgggcggagccgggcccgcggggcugcugcggggcgaucgggccgggccgcugccgcgccauggugagccgggcggggcaggccgcgcgcucgggccgggcgggggcgccggggcccgggggcgggaagggggaggccaggacgaggaggggcgcgcgcggcggcggggccgggccggggucugcgggcgggggaggggcggcccggcgggcgcggcucgggggaggguccguuccaggggccgcgcccgcgggcugggguucuuugucagcggcgcugcggcgagauccggacaaaggaggcggcggggggcggaggccgcuuuguggggaucgcggggcgcucgcccccgcccgugcagcccccgcccguccucagcuacgcucccgccuucccccggcauuucgggguucuucaaaauucugggagcuccggggagggcuccggggauagggguccaggugacguccggcgcccgucucgcggguagggaaacugaggccgggccgcagcguucggcgcccgguuccgugggcagcggcugcgcggcgugggcaugccuagcuccccugguccccgucccacaccccgccuccgucgggccgauucgagcuaccuccccagcugccguccccucuccagcugucgcccccugggccgagcccccuccucccuggagccucgcuuugcuccuccguggagugggggagacgccggcgccgccgggcaggguggaacgggagggugcgcggagcgcgccuggcaccgcgccugccacgccgcccgcgcucagcacucgggagccgccggggcgcugucaccccuaaguccccagcacccagcccaggucgcccagcccgccccagcgagggccacacugggguucaccuguccgcggccccucaggcacgcgggagaggagguagggagaauguggcauuuuagagucagggucgaaaugcgggauuuuggaugcagguugccuggguuugaaucccugcgcgucuacuuuugagcugugugaccuugggcaauggacuuaacuucucugagccaccaauuucuguaucugccaagagggaacaguaauagcucaacugcccuguugucuugaggcagaaaggagacaucugcgugagcuguuuaucucagugucuggcacauauaauugccaccaacuuucuccggcaucuacaagcaaaguuguuuggccaaacaggccaacccuggggcagccugugaaaaugaccagcgggugauucacagggugggggcaugagccucuggccuggcccgaggaagaccccgacugaccuuggggcagucccgguucagagcucugcgggcucccgcuuccucuuuugccacuggggaaccuaggggauucuggagcgaguuuccucuucugaggaugggggugucauggguggggguggaggaugagauaacacuggccagagagcugggcacagccccaucagugucagucccacuggcauccggccguucuugguccuggcuucuggagggcuggggccuugugugaugcguccuugugucccacuggcugcuggaggcccagggcagaacggacgucccgccucguccuggcuguguccagcagugcccucuucucccuacaacccuguuuucccagucagaaccuggggcaggaaacguuucugguuugugacccgggguucgcugaagaguuuguuggcacccuuggcagguggcuuuauggggggaggcaguacugaaagccccguagggauggcugguccccuguaagcagggcagcccuccuggcgucugucaaggagccucaggagguggcggcugcaaggcggggguguuuugcugguggugagcccggcaaugcucaugaugugcccgguugaguuaggaggaggcagcgugucccuggggaagggguguuuguggcacugggccugggccaggcucugugcccu

SEQ ID NO: 20168 - RNA, 2478 nt, Homo sapiens
agggcacagagccuggcccaggcccagugccacaaacaccccuuccccagggacacgcugccuccuccuaacucaaccgggcacaucaugagcauugccgggcucaccaccagcaaaacacccccgccuugcagccgccaccuccugaggcuccuugacagacgccaggagggcugcccugcuuacaggggaccagccaucccuacggggcuuucaguacugccuccccccauaaagccaccugccaagggugccaacaaacucuucagcgaaccccgggucacaaaccagaaacguuuccugccccagguucugacugggaaaacaggguuguagggagaagagggcacugcuggacacagccaggacgaggcgggacguccguucugcccugggccuccagcagccagugggacacaaggacgcaucacacaaggccccagcccuccagaagccaggaccaagaacggccggaugccagugggacugacacugauggggcugugcccagcucucuggccaguguuaucucauccuccacccccacccaugacacccccauccucagaagaggaaacucgcuccagaauccccuagguuccccaguggcaaaagaggaagcgggagcccgcagagcucugaaccgggacugccccaaggucagucggggucuuccucgggccaggccagaggcucaugcccccacccugugaaucacccgcuggucauuuucacaggcugccccaggguuggccuguuuggccaaacaacuuugcuuguagaugccggagaaaguugguggcaauuauaugugccagacacugagauaaacagcucacgcagaugucuccuuucugccucaagacaacagggcaguugagcuauuacuguucccucuuggcagauacagaaauugguggcucagagaaguuaaguccauugcccaaggucacacagcucaaaaguagacgcgcagggauucaaacccaggcaaccugcauccaaaaucccgcauuucgacccugacucuaaaaugccacauucucccuaccuccucucccgcgugccugaggggccgcggacaggugaaccccaguguggcccucgcuggggcgggcugggcgaccugggcugggugcuggggacuuaggggugacagcgccccggcggcucccgagugcugagcgcgggcggcguggcaggcgcggugccaggcgcgcuccgcgcacccucccguuccacccugcccggcggcgccggcgucucccccacuccacggaggagcaaagcgaggcuccagggaggagggggcucggcccagggggcgacagcuggagaggggacggcagcuggggagguagcucgaaucggcccgacggaggcggggugugggacggggaccaggggagcuaggcaugcccacgccgcgcagccgcugcccacggaaccgggcgccgaacgcugcggcccggccucaguuucccuacccgcgagacgggcgccggacgucaccuggaccccuauccccggagcccuccccggagcucccagaauuuugaagaaccccgaaaugccgggggaaggcgggagcguagcugaggacgggcgggggcugcacgggcgggggcgagcgccccgcgauccccacaaagcggccuccgccccccgccgccuccuuuguccggaucucgccgcagcgccgcugacaaagaaccccagcccgcgggcgcggccccuggaacggacccucccccgagccgcgcccgccgggccgccccucccccgcccgcagaccccggcccggccccgccgccgcgcgcgccccuccucguccuggccucccccuucccgcccccgggccccggcgcccccgcccggcccgagcgcgcggccugccccgcccggcucaccauggcgcggcagcggcccggcccgaucgccccgcagcagccccgcgggcccggcuccgcccgcccgguccggccgccgcgcacucgggacgcaggagccccgcgcugcggcgggcggggcccggcuccuccccggcuggggacggggccucccagaaaggccaaugggagcccgcgcugggacggcggggcggggcgggccggggcggagucacgugugcucggggccggcaggcgguggggcgggggcugcgcgcggcgggcgggcucggcccuggcgagcgcggauugggcgcccguggguacggggccccacuacaggcgcccuuccucugccagccucauccugaccccggcaggcugccuuggucccgccugcuuacagcggaggaaacugaggcacgcugcacggaagagugcugcauacuccucgagagcugagagcggcggggaauccggggcaggggcaggggagaggcgcgaccgcugaggugaaugaccuugcuucgggaggaagcugggcaucagucguucgcgaauucauuuauguaucauucauccgcccagu

SEQ ID NO: 20169 - RNA, 2802 nt, Homo sapiens
uuaauuugcacgcggccgcgcugccccuggcuucgcggaagcccugaguagcgcagcgcccucgccgcacgcaaggcugcagucccgcuccaggccagagucccaggagagcguccuccgcgcucacaggcgccuuugucuucccgcuucccccuuccuuuuucaaaagccaagagguaauuauuuggucuuugugcaaggcaaaccucuccagaugccacuuccaaauauaggcucucauuaacaccagaggcuggccugguguggugcagggcggcccuuccuucuccuggcggacacuguguccccgcgcgcuggcgcugcaccacaucuggaagccaggcgggcagggcagagaccccggcuccugcgccccuccuagcucccagagagcguggaucgcgggcggggcucaccgagcgagguuaccucucuugaaaauacuuaaacacuuuuuuuccucuccacugaaaucucaaaaaacagcccauuuugaaccagaauaauuuagucugacaacagauucuuccucuguucacagcugucccagagggaggagcugaaaucugaaccucucagcugugauuggaucuuucuugcaaaagagaggaaaaaaaaacccucccagccaaaacgggcucaguucguaaaggagccgggugacuucagaggcgccggcccguccgucugccgcaccugagcacggccccugcccgagccuggcccgccgcgaugcuguagggaccgccguguccucccgccggaccguuauccgcgccgggcgcccgccagacccgcuggcaagaugccgcgcuccuuccuggucaagaagcauuucaacgccuccaaaaagccaaacuacagcgaacuggacacacauacagguaaaaagagaaaaauauaucuagaacuacguaucuagagcuuugcaaauaugaaucuacguauuacccuucaaauaccauuacaaaagagccaaagauucaacuguuuuccuuuuuaacaguguccugaaagggagcuuacauucuuuugaucauuuaggguucguuuuaauucaaaacuuuuaaaauucuugacuaacaaggaacauuucauucaaaucucgcagcuucguuugcuaaagccuguguauacaugcauaaugaguaugugaaagaugagcaacauaaggauugaauuacugcguuuuucaugcacuaagucuccuuuccuuuagaaggcggcuugaugcaggcauaucuuuguacucacggucguaauacaccuaaauagcccauacguaacauggaaaacaacuuuucuguauguuuaaaaauaauguugaggcucuccuuccucaauggggacggcgaaggcacuggcuuggcugcacugucugacuucagagcaccuauagcuccgugcagcugucagccuaugugugcauuaaguacaguaacuccguaggugccaggguggaaaugaaacauuuuaccaguguguaugcccuccuaaaugggucuaucuucuuccuaagaaaaucacguguguguugcuaaauaucuuuccaguguguguauacuugcguguggauuuauuuuuaauuauuuuugccuuaaucuucucucccucccuuuucuuucccagugauuauuuccccguaucucuaugagaguuacuccaugccugucauaccacaaccagagauccucagcucaggagcauacagccccaucacuguguggacuaccgcugcuccauuccacgcccagcuacccaauggccucucuccucuuuccggauacuccucaucuuuggggcgagugagucccccuccuccaucugacaccuccuccaaggaccacaguggcucagaaagccccauuagugaugaagaggaaagacuacaguccaagcuuucagacccccaugccauugaagcugaaaaguuucagugcaauuuaugcaauaagaccuauucaacuuuuucugggcuggccaaacauaagcagcugcacugcgaugcccagucuagaaaaucuuucagcuguaaauacugugacaaggaauaugugagccugggcgcccugaagaugcauauucggacccacacauuaccuuguguuugcaagaucugcggcaaggcguuuuccagacccugguugcuucaaggacacauuagaacucacacggguaagagaaaaaccauaggcaggaauguuacucugagauacaaugaagcccugggcuggcuguuggauuugcaugaaguugugacauagugcuuuuaaugauggacagucauugauagcuacuuccugacuacucaaaaaguuguuagggcacaaagugcuccauuucuugcuaacaaccucugcuccagggacugcaaacagcauguagacuuuggaaaguagauucagaagguuuggucucaaagaucaguuagaaaaucaggaaagaugugcuugaauguguguucugugaaacugcccccaguaaucagcaaauacaaauguugcuaucuuaaucaauugauuugguuaauagaugaaggcuuuuccuacaguuuucuguuaguuacauucuugcucugauauuugucacccgugggugacuuggauaguugaaacuaaauuuacuuugccucucuugcuuuguuuggggauuuuuugcuccuuaauuucuuauucguaucacagaauuauucugcaggguaucauggcacuuagaccaccuuaaucauaguacagaaagagggaaaaggggaaauauugggaaauguugggaggugcucaacauuagcugcaucugcuaaag

SEQ ID NO: 20170 - RNA, 2802 nt, Homo sapiens
cuuuagcagaugcagcuaauguugagcaccucccaacauuucccaauauuuccccuuuucccucuuucuguacuaugauuaagguggucuaagugccaugauacccugcagaauaauucugugauacgaauaagaaauuaaggagcaaaaaauccccaaacaaagcaagagaggcaaaguaaauuuaguuucaacuauccaagucacccacgggugacaaauaucagagcaagaauguaacuaacagaaaacuguaggaaaagccuucaucuauuaaccaaaucaauugauuaagauagcaacauuuguauuugcugauuacugggggcaguuucacagaacacacauucaagcacaucuuuccugauuuucuaacugaucuuugagaccaaaccuucugaaucuacuuuccaaagucuacaugcuguuugcagucccuggagcagagguuguuagcaagaaauggagcacuuugugcccuaacaacuuuuugaguagucaggaaguagcuaucaaugacuguccaucauuaaaagcacuaugucacaacuucaugcaaauccaacagccagcccagggcuucauuguaucucagaguaacauuccugccuaugguuuuucucuuacccgugugaguucuaauguguccuugaagcaaccagggucuggaaaacgccuugccgcagaucuugcaaacacaagguaauguguggguccgaauaugcaucuucagggcgcccaggcucacauauuccuugucacaguauuuacagcugaaagauuuucuagacugggcaucgcagugcagcugcuuauguuuggccagcccagaaaaaguugaauaggucuuauugcauaaauugcacugaaacuuuucagcuucaauggcaugggggucugaaagcuuggacuguagucuuuccucuucaucacuaauggggcuuucugagccacugugguccuuggaggaggugucagauggaggagggggacucacucgccccaaagaugaggaguauccggaaagaggagagaggccauuggguagcugggcguggaauggagcagcgguaguccacacagugauggggcuguaugcuccugagcugaggaucucugguugugguaugacaggcauggaguaacucucauagagauacggggaaauaaucacugggaaagaaaagggagggagagaagauuaaggcaaaaauaauuaaaaauaaauccacacgcaaguauacacacacuggaaagauauuuagcaacacacacgugauuuucuuaggaagaagauagacccauuuaggagggcauacacacugguaaaauguuucauuuccacccuggcaccuacggaguuacuguacuuaaugcacacauaggcugacagcugcacggagcuauaggugcucugaagucagacagugcagccaagccagugccuucgccguccccauugaggaaggagagccucaacauuauuuuuaaacauacagaaaaguuguuuuccauguuacguaugggcuauuuagguguauuacgaccgugaguacaaagauaugccugcaucaagccgccuucuaaaggaaaggagacuuagugcaugaaaaacgcaguaauucaauccuuauguugcucaucuuucacauacucauuaugcauguauacacaggcuuuagcaaacgaagcugcgagauuugaaugaaauguuccuuguuagucaagaauuuuaaaaguuuugaauuaaaacgaacccuaaaugaucaaaagaauguaagcucccuuucaggacacuguuaaaaaggaaaacaguugaaucuuuggcucuuuuguaaugguauuugaaggguaauacguagauucauauuugcaaagcucuagauacguaguucuagauauauuuuucucuuuuuaccuguauguguguccaguucgcuguaguuuggcuuuuuggaggcguugaaaugcuucuugaccaggaaggagcgcggcaucuugccagcgggucuggcgggcgcccggcgcggauaacgguccggcgggaggacacggcggucccuacagcaucgcggcgggccaggcucgggcaggggccgugcucaggugcggcagacggacgggccggcgccucugaagucacccggcuccuuuacgaacugagcccguuuuggcugggaggguuuuuuuuuccucucuuuugcaagaaagauccaaucacagcugagagguucagauuucagcuccucccucugggacagcugugaacagaggaagaaucuguugucagacuaaauuauucugguucaaaaugggcuguuuuuugagauuucaguggagaggaaaaaaaguguuuaaguauuuucaagagagguaaccucgcucggugagccccgcccgcgauccacgcucucugggagcuaggaggggcgcaggagccggggucucugcccugcccgccuggcuuccagauguggugcagcgccagcgcgcggggacacaguguccgccaggagaaggaagggccgcccugcaccacaccaggccagccucugguguuaaugagagccuauauuuggaaguggcaucuggagagguuugccuugcacaaagaccaaauaauuaccucuuggcuuuugaaaaaggaagggggaagcgggaagacaaaggcgccugugagcgcggaggacgcucuccugggacucuggccuggagcgggacugcagccuugcgugcggcgagggcgcugcgcuacucagggcuuccgcgaagccaggggcagcgcggccgcgugcaaauuaa

SEQ ID NO: 20171 - RNA, 2304 nt, Homo sapiens
ugacugcucugaucucucuggcccuaucaaggcuuggaguucaggaagucaucaccuucucuugucaggggugaguuuggcugaccucaggacuggccucgagagcccugguuagguaccaguugggggccagggauggccuguaaccuccuguuuuccuucugguugguagcauuucuggggaccaacagcuggccgaggcucagggauagagacggcugcuccagcuaaaggucaguugugauguacauugccuguuggcacugucuagggaaugggccucagcuccccgagucccagagagcuuggcugagcccugguguucccaccuccucagagccaugaggcaggaauguucuccuuaugugacuaggcacagguuccaaauggggaggggacuggcucagcauccggagccaaaacaggaauagaacugggagcugagccuggagcgguucugggcuuuugguucucugcaucaacacagccagcaugccuaugauuucugugcugggcaaaauguuucuguggcagcgugaagggccuggaggacgauggacuugucagacaagucgcagaggugagaccagggaucauggaugugaucugggagaugaugggaagcugagcaguagggugcuuagguggaaaaggaaaauuacucuggcuuagauauuaagaaccaggcugaaacagggagaaccaggcuggggccagacagggcaucaggaaacggcuucaggggacaggggugaaaaucagaaaaaauaucaugaguucgucagaaaagaagaguaaagagcuguggaccagcugaggcuggcgagaggaaagaaggcagcaggaagagagaaggaaggcaacccuccugcaaaggguccaggguggcgguggugggggggacagugauggcggaagaacucagugugcuuuccaagaggaauggguaggcugggaaacgggaaggagagucagaauuuaucauuguuugguuucacccuaggguuuugaggcaaaauuuauccagagcaggaagguggcaagugggcugccacagaauggccccaggggcccgagggucagugaugugugggaugggggcuuuuagaguugaggagagcacucagugggcgcuggucuucuggaaggugggggaggggccgagaaaugauacggcaauacuggaugaaaauggggaucucugcagaaguaggggcacagcucaacagccuuuccccuuccucucaguguccucggaccccgcuugggcuguggaguggaucgaacuuccucggggucucucucuauccucuuugggaucugcucgaacccuccgaggcuggagcagguccucccgcccuuccucgguggacagucaggacuugccagaggugcugggccccuggugguggggggaaggaggacgucauccauauaaaggggaucugcagcccccacccacgccuggccagccagcuucuggcucccuuuuccggcgggcggaggcgcuauccggcggcgggccgggaggccgcccccgugccggucugcucugcucggcgcugugccagcaggcggagagcucgcgccuuccgcgcugacgucagcgcaucccgggccguaucccgggagacccuguugcguggugauggguugccagggagacauacaccuuuucucugggccugggccgcagcugcgcggagcgccgggcacggauggcggcggcugaggggagcgaagcgagggagggagagcaagcuaagaaacacccagcaggugcucccccgccuaggccuggcuggaggcuacuggcgccacccugggggcccugucagccagguacccaaggggagggaucgagggugggccucaggucaaggggcaguguuggcugcccuugugagggacgggaacgugauagaagagagcugggcaaugccggggagggaugugugccuccaacuucauuaagugagggaaacauuugcuggggcuugucagggagcccugagccagguacaggguggaguuaggaacuuacgugcaucagacuuaggccuugccauccugagcucccucgggagacagacaagggcaaugaugggggcggggugugucagagaaaagaagaggcugucggcugaaagcauuauuugcaggugacacuugagaugggccuuaagugauggcaagcauuuuuucacguaaggauggcauucuuggcccagaggaaagcugaguuccuuuuccuggaggcaggcgggcugcuugcugacagggauugguggagaaggguuuuug

SEQ ID NO: 20172 - RNA, 2304 nt, Homo sapiens
caaaaacccuucuccaccaaucccugucagcaagcagcccgccugccuccaggaaaaggaacucagcuuuccucugggccaagaaugccauccuuacgugaaaaaaugcuugccaucacuuaaggcccaucucaagugucaccugcaaauaaugcuuucagccgacagccucuucuuuucucugacacaccccgcccccaucauugcccuugucugucucccgagggagcucaggauggcaaggccuaagucugaugcacguaaguuccuaacuccacccuguaccuggcucagggcucccugacaagccccagcaaauguuucccucacuuaaugaaguuggaggcacacaucccuccccggcauugcccagcucucuucuaucacguucccgucccucacaagggcagccaacacugccccuugaccugaggcccacccucgaucccuccccuuggguaccuggcugacagggcccccaggguggcgccaguagccuccagccaggccuaggcgggggagcaccugcuggguguuucuuagcuugcucucccucccucgcuucgcuccccucagccgccgccauccgugcccggcgcuccgcgcagcugcggcccaggcccagagaaaagguguaugucucccuggcaacccaucaccacgcaacagggucucccgggauacggcccgggaugcgcugacgucagcgcggaaggcgcgagcucuccgccugcuggcacagcgccgagcagagcagaccggcacgggggcggccucccggcccgccgccggauagcgccuccgcccgccggaaaagggagccagaagcuggcuggccaggcgugggugggggcugcagauccccuuuauauggaugacguccuccuuccccccaccaccaggggcccagcaccucuggcaaguccugacuguccaccgaggaagggcgggaggaccugcuccagccucggaggguucgagcagaucccaaagaggauagagagagaccccgaggaaguucgauccacuccacagcccaagcgggguccgaggacacugagaggaaggggaaaggcuguugagcugugccccuacuucugcagagauccccauuuucauccaguauugccguaucauuucucggccccucccccaccuuccagaagaccagcgcccacugagugcucuccucaacucuaaaagcccccaucccacacaucacugacccucgggccccuggggccauucuguggcagcccacuugccaccuuccugcucuggauaaauuuugccucaaaacccuagggugaaaccaaacaaugauaaauucugacucuccuucccguuucccagccuacccauuccucuuggaaagcacacugaguucuuccgccaucacugucccccccaccaccgccacccuggacccuuugcaggaggguugccuuccuucucucuuccugcugccuucuuuccucucgccagccucagcugguccacagcucuuuacucuucuuuucugacgaacucaugauauuuuuucugauuuucaccccuguccccugaagccguuuccugaugcccugucuggccccagccugguucucccuguuucagccugguucuuaauaucuaagccagaguaauuuuccuuuuccaccuaagcacccuacugcucagcuucccaucaucucccagaucacauccaugaucccuggucucaccucugcgacuugucugacaaguccaucguccuccaggcccuucacgcugccacagaaacauuuugcccagcacagaaaucauaggcaugcuggcuguguugaugcagagaaccaaaagcccagaaccgcuccaggcucagcucccaguucuauuccuguuuuggcuccggaugcugagccaguccccuccccauuuggaaccugugccuagucacauaaggagaacauuccugccucauggcucugaggaggugggaacaccagggcucagccaagcucucugggacucggggagcugaggcccauucccuagacagugccaacaggcaauguacaucacaacugaccuuuagcuggagcagccgucucuaucccugagccucggccagcuguugguccccagaaaugcuaccaaccagaaggaaaacaggagguuacaggccaucccuggcccccaacugguaccuaaccagggcucucgaggccaguccugaggucagccaaacucaccccugacaagagaaggugaugacuuccugaacuccaagccuugauagggccagagagaucagagcaguca

SEQ ID NO: 20173 - RNA, 2651 nt, Homo sapiens
aaagacaagucuucauccuucgggcggaaccggguccucgcucacagagcgguccaggccucaggccuagccucugccccucccuagccugaggcucccuuccugggcuggacaccgaccuccugguccagccgcccuguggccgccagcagcggggggcuccgggcccgccucuccucccccucuucgcgcccccuggucccuccccucccccucccccgcucccccuuccccucccgccccucccuccuccccugcccggucccagccccucccuccccucccccacccgcgauccgggccgcugcugcugggucggaccccccgggcucagcccggccccucgccgagcugccgccgccgccccguuugcugaggaggaggcccccggccggggcgucgggcgcggggcauaaaacgggccggagccggcgcccggggcaguagagccgcguacggcccgggucagcgcccgcccgcccgcgcuccucccggccgcuccucccgccccgcccggcccggcgccgacucugcggccgcccgacgagccccucgcggcacugccccggccccggccccggccccggcccccucccgccgcaccgcccccggcccggcccuccgcccuccgcacucccgccucccucccuccgcccgcucccgcgcccuccucccucccuccuccccagcugucccguucgcgucaugccgagccucccggccccgccggccccgcugcugcuccucgggcugcugcugcucggcucccggccggcccgcggcgccggcccagagccccccgugcugcccauccguucugagaaggagccgcugcccguucggggagcggcagguaggugggcgcccgggggaggcgcgggcggggagucgggcucggggcgagucagcgccagcccggagggggcgcggggcgcagguggcucggcgcggcgggcggcccggagggugggcgggggcagaagggcgcggugccugggacccgggacccgcgggcagcccccggggcggcacacggcgcgagcugggcagcggccuccagccaagcccguccccgcaggcugcaccuucggcgggaaggucuaugccuuggacgagacguggcacccggaccuaggggagccauucggggugaugcgcugcgugcugugcgccugcgaggcggugagugcaccccgcggccggcccgggcccuggcggguggggagcgccgggucgcgcgggcgucggaguggacucggagcugcugagaaggagcccagucggcagauguuggggauauuuuucugguggaggaaggggaaucagccccuccaauucuuaggugcuguuacugaucgcccacucugugugaggcucugugccaacuccguuucguucccugcucaucuaacucucauggcagccuugcuagauagagaguauuauuauccccauuuuccagacagggaccuugaggcccagagagaugaaguagcuugucuagggucacgcagcuuguaaguggcagagcuggcugacucugcgggacauccuugccugggggggucucaucaguuggcaucuugcacucacuuggguuucccgccuuuuccgggagcagccucaguggggucgccguaccaggggcccuggcagggucagcugcaagaacaucaaaccagagugcccaaccccggccugugggcagccgcgccagcugccgggacacugcugccagaccugcccccaggguaagucuugcuccgcccugcggggagggaggcagggccacgauacuaggucccgggccacuuggauggggcgucggacuggccuuucccauggccagcugaagcccguguucuuacccccccgcccgcagagcgcagcaguucggagcggcagccgagcggccuguccuucgaguauccgcgggacccggagcaucgcaguuauagcgaccgcggggagccaggcgcugaggagcgggcccguggugacggccacacggguagggggcuggcgaacagcgggguugugguugaggcugggccaccaaagcggcguuugacagugcucaggccaucuuccucccgucccagacuucguggcgcugcugacagggccgaggucgcaggcgguggcacgagcccgagucucgcugcugcgcucuagccuccgcuucucuaucuccuacaggcggugagaaaggggaaggagcaaggaggggucagcugccggggcccgggagggaaacugggagagcugggaggggcugcuuuuggcucaguccggccucacccgaccucucauucccaggcuggaccgcccuaccaggauccgcuucucagacuccaauggcaguguccuguuugagcacccugcagcccccacccaagauggccuggugagaugaugccauuuaugagcacuugcccagucugggcacugugccgagagcaugcucugcauugccucccgugguccucaccacagcccagugggaggaaggcacugacauuaugaugcccauuuuacagaagggggaacugaggcucaguaggauaaugugauuuguucaaggucacacagcuaguaaguggugcagccaggauuggaacccaagcaucuggcuccagcguucuuucuua

SEQ ID NO: 20174 - RNA, 2651 nt, Homo sapiens
uaagaaagaacgcuggagccagaugcuuggguuccaauccuggcugcaccacuuacuagcugugugaccuugaacaaaucacauuauccuacugagccucaguucccccuucuguaaaaugggcaucauaaugucagugccuuccucccacugggcuguggugaggaccacgggaggcaaugcagagcaugcucucggcacagugcccagacugggcaagugcucauaaauggcaucaucucaccaggccaucuugggugggggcugcagggugcucaaacaggacacugccauuggagucugagaagcggauccugguagggcgguccagccugggaaugagaggucgggugaggccggacugagccaaaagcagccccucccagcucucccaguuucccucccgggccccggcagcugaccccuccuugcuccuuccccuuucucaccgccuguaggagauagagaagcggaggcuagagcgcagcagcgagacucgggcucgugccaccgccugcgaccucggcccugucagcagcgccacgaagucugggacgggaggaagauggccugagcacugucaaacgccgcuuugguggcccagccucaaccacaaccccgcuguucgccagcccccuacccguguggccgucaccacgggcccgcuccucagcgccuggcuccccgcggucgcuauaacugcgaugcuccgggucccgcggauacucgaaggacaggccgcucggcugccgcuccgaacugcugcgcucugcgggcggggggguaagaacacgggcuucagcuggccaugggaaaggccaguccgacgccccauccaaguggcccgggaccuaguaucguggcccugccucccuccccgcagggcggagcaagacuuacccugggggcaggucuggcagcagugucccggcagcuggcgcggcugcccacaggccgggguugggcacucugguuugauguucuugcagcugacccugccagggccccugguacggcgaccccacugaggcugcucccggaaaaggcgggaaacccaagugagugcaagaugccaacugaugagacccccccaggcaaggaugucccgcagagucagccagcucugccacuuacaagcugcgugacccuagacaagcuacuucaucucucugggccucaaggucccugucuggaaaauggggauaauaauacucucuaucuagcaaggcugccaugagaguuagaugagcagggaacgaaacggaguuggcacagagccucacacagagugggcgaucaguaacagcaccuaagaauuggaggggcugauuccccuuccuccaccagaaaaauauccccaacaucugccgacugggcuccuucucagcagcuccgaguccacuccgacgcccgcgcgacccggcgcuccccacccgccagggcccgggccggccgcggggugcacucaccgccucgcaggcgcacagcacgcagcgcaucaccccgaauggcuccccuagguccgggugccacgucucguccaaggcauagaccuucccgccgaaggugcagccugcggggacgggcuuggcuggaggccgcugcccagcucgcgccgugugccgccccgggggcugcccgcgggucccgggucccaggcaccgcgcccuucugcccccgcccacccuccgggccgcccgccgcgccgagccaccugcgccccgcgcccccuccgggcuggcgcugacucgccccgagcccgacuccccgcccgcgccucccccgggcgcccaccuaccugccgcuccccgaacgggcagcggcuccuucucagaacggaugggcagcacggggggcucugggccggcgccgcgggccggccgggagccgagcagcagcagcccgaggagcagcagcggggccggcggggccgggaggcucggcaugacgcgaacgggacagcuggggaggagggagggaggagggcgcgggagcgggcggagggagggaggcgggagugcggagggcggagggccgggccgggggcggugcggcgggagggggccggggccggggccggggccggggcagugccgcgaggggcucgucgggcggccgcagagucggcgccgggccgggcggggcgggaggagcggccgggaggagcgcgggcgggcgggcgcugacccgggccguacgcggcucuacugccccgggcgccggcuccggcccguuuuaugccccgcgcccgacgccccggccgggggccuccuccucagcaaacggggcggcggcggcagcucggcgaggggccgggcugagcccgggggguccgacccagcagcagcggcccggaucgcgggugggggaggggagggaggggcugggaccgggcaggggaggagggaggggcgggaggggaagggggagcgggggagggggaggggagggaccagggggcgcgaagagggggaggagaggcgggcccggagccccccgcugcuggcggccacagggcggcuggaccaggaggucgguguccagcccaggaagggagccucaggcuagggaggggcagaggcuaggccugaggccuggaccgcucugugagcgaggacccgguuccgcccgaaggaugaagacuugucuuu

SEQ ID NO: 20175 - RNA, 2662 nt, Homo sapiens
cugguccagccgcccuguggccgccagcagcggggggcuccgggcccgccucuccucccccucuucgcgcccccuggucccuccccucccccucccccgcucccccuuccccucccgccccucccuccuccccugcccggucccagccccucccuccccucccccacccgcgauccgggccgcugcugcugggucggaccccccgggcucagcccggccccucgccgagcugccgccgccgccccguuugcugaggaggaggcccccggccggggcgucgggcgcggggcauaaaacgggccggagccggcgcccggggcaguagagccgcguacggcccgggucagcgcccgcccgcccgcgcuccucccggccgcuccucccgccccgcccggcccggcgccgacucugcggccgcccgacgagccccucgcggcacugccccggccccggccccggccccggcccccucccgccgcaccgcccccggcccggcccuccgcccuccgcacucccgccucccucccuccgcccgcucccgcgcccuccucccucccuccuccccagcugucccguucgcgucaugccgagccucccggccccgccggccccgcugcugcuccucgggcugcugcugcucggcucccggccggcccgcggcgccggcccagagccccccgugcugcccauccguucugagaaggagccgcugcccguucggggagcggcagguaggugggcgcccgggggaggcgcgggcggggagucgggcucggggcgagucagcgccagcccggagggggcgcggggcgcagguggcucggcgcggcgggcggcccggagggugggcgggggcagaagggcgcggugccugggacccgggacccgcgggcagcccccggggcggcacacggcgcgagcugggcagcggccuccagccaagcccguccccgcaggcugcaccuucggcgggaaggucuaugccuuggacgagacguggcacccggaccuaggggagccauucggggugaugcgcugcgugcugugcgccugcgaggcggugagugcaccccgcggccggcccgggcccuggcggguggggagcgccgggucgcgcgggcgucggaguggacucggagcugcugagaaggagcccagucggcagauguuggggauauuuuucugguggaggaaggggaaucagccccuccaauucuuaggugcuguuacugaucgcccacucugugugaggcucugugccaacuccguuucguucccugcucaucuaacucucauggcagccuugcuagauagagaguauuauuauccccauuuuccagacagggaccuugaggcccagagagaugaaguagcuugucuagggucacgcagcuuguaaguggcagagcuggcugacucugcgggacauccuugccugggggggucucaucaguuggcaucuugcacucacuuggguuucccgccuuuuccgggagcagccucaguggggucgccguaccaggggcccuggcagggucagcugcaagaacaucaaaccagagugcccaaccccggccugugggcagccgcgccagcugccgggacacugcugccagaccugcccccaggguaagucuugcuccgcccugcggggagggaggcagggccacgauacuaggucccgggccacuuggauggggcgucggacuggccuuucccauggccagcugaagcccguguucuuacccccccgcccgcagagcgcagcaguucggagcggcagccgagcggccuguccuucgaguauccgcgggacccggagcaucgcaguuauagcgaccgcggggagccaggcgcugaggagcgggcccguggugacggccacacggguagggggcuggcgaacagcgggguugugguugaggcugggccaccaaagcggcguuugacagugcucaggccaucuuccucccgucccagacuucguggcgcugcugacagggccgaggucgcaggcgguggcacgagcccgagucucgcugcugcgcucuagccuccgcuucucuaucuccuacaggcggugagaaaggggaaggagcaaggaggggucagcugccggggcccgggagggaaacugggagagcugggaggggcugcuuuuggcucaguccggccucacccgaccucucauucccaggcuggaccgcccuaccaggauccgcuucucagacuccaauggcaguguccuguuugagcacccugcagcccccacccaagauggccuggugagaugaugccauuuaugagcacuugcccagucugggcacugugccgagagcaugcucugcauugccucccgugguccucaccacagcccagugggaggaaggcacugacauuaugaugcccauuuuacagaagggggaacugaggcucaguaggauaaugugauuuguucaaggucacacagcuaguaaguggugcagccaggauuggaacccaagcaucuggcuccagcguucuuucuuaagcuuccuagggcacccuggagguuccuuuccauguuccuuuuucauaagcccugccugggcauccuaauuggccuagccugcacagugucugagcguagggccuucuugucucucugcuccaggucuguggg

SEQ ID NO: 20176 - RNA, 2662 nt, Homo sapiens
cccacagaccuggagcagagagacaagaaggcccuacgcucagacacugugcaggcuaggccaauuaggaugcccaggcagggcuuaugaaaaaggaacauggaaaggaaccuccagggugcccuaggaagcuuaagaaagaacgcuggagccagaugcuuggguuccaauccuggcugcaccacuuacuagcugugugaccuugaacaaaucacauuauccuacugagccucaguucccccuucuguaaaaugggcaucauaaugucagugccuuccucccacugggcuguggugaggaccacgggaggcaaugcagagcaugcucucggcacagugcccagacugggcaagugcucauaaauggcaucaucucaccaggccaucuugggugggggcugcagggugcucaaacaggacacugccauuggagucugagaagcggauccugguagggcgguccagccugggaaugagaggucgggugaggccggacugagccaaaagcagccccucccagcucucccaguuucccucccgggccccggcagcugaccccuccuugcuccuuccccuuucucaccgccuguaggagauagagaagcggaggcuagagcgcagcagcgagacucgggcucgugccaccgccugcgaccucggcccugucagcagcgccacgaagucugggacgggaggaagauggccugagcacugucaaacgccgcuuugguggcccagccucaaccacaaccccgcuguucgccagcccccuacccguguggccgucaccacgggcccgcuccucagcgccuggcuccccgcggucgcuauaacugcgaugcuccgggucccgcggauacucgaaggacaggccgcucggcugccgcuccgaacugcugcgcucugcgggcggggggguaagaacacgggcuucagcuggccaugggaaaggccaguccgacgccccauccaaguggcccgggaccuaguaucguggcccugccucccuccccgcagggcggagcaagacuuacccugggggcaggucuggcagcagugucccggcagcuggcgcggcugcccacaggccgggguugggcacucugguuugauguucuugcagcugacccugccagggccccugguacggcgaccccacugaggcugcucccggaaaaggcgggaaacccaagugagugcaagaugccaacugaugagacccccccaggcaaggaugucccgcagagucagccagcucugccacuuacaagcugcgugacccuagacaagcuacuucaucucucugggccucaaggucccugucuggaaaauggggauaauaauacucucuaucuagcaaggcugccaugagaguuagaugagcagggaacgaaacggaguuggcacagagccucacacagagugggcgaucaguaacagcaccuaagaauuggaggggcugauuccccuuccuccaccagaaaaauauccccaacaucugccgacugggcuccuucucagcagcuccgaguccacuccgacgcccgcgcgacccggcgcuccccacccgccagggcccgggccggccgcggggugcacucaccgccucgcaggcgcacagcacgcagcgcaucaccccgaauggcuccccuagguccgggugccacgucucguccaaggcauagaccuucccgccgaaggugcagccugcggggacgggcuuggcuggaggccgcugcccagcucgcgccgugugccgccccgggggcugcccgcgggucccgggucccaggcaccgcgcccuucugcccccgcccacccuccgggccgcccgccgcgccgagccaccugcgccccgcgcccccuccgggcuggcgcugacucgccccgagcccgacuccccgcccgcgccucccccgggcgcccaccuaccugccgcuccccgaacgggcagcggcuccuucucagaacggaugggcagcacggggggcucugggccggcgccgcgggccggccgggagccgagcagcagcagcccgaggagcagcagcggggccggcggggccgggaggcucggcaugacgcgaacgggacagcuggggaggagggagggaggagggcgcgggagcgggcggagggagggaggcgggagugcggagggcggagggccgggccgggggcggugcggcgggagggggccggggccggggccggggccggggcagugccgcgaggggcucgucgggcggccgcagagucggcgccgggccgggcggggcgggaggagcggccgggaggagcgcgggcgggcgggcgcugacccgggccguacgcggcucuacugccccgggcgccggcuccggcccguuuuaugccccgcgcccgacgccccggccgggggccuccuccucagcaaacggggcggcggcggcagcucggcgaggggccgggcugagcccgggggguccgacccagcagcagcggcccggaucgcgggugggggaggggagggaggggcugggaccgggcaggggaggagggaggggcgggaggggaagggggagcgggggagggggaggggagggaccagggggcgcgaagagggggaggagaggcgggcccggagccccccgcugcuggcggccacagggcggcuggaccag

SEQ ID NO: 20177 - RNA, 2692 nt, Homo sapiens
acaaaaagggaggcaaauuaaacgaacacugaagaaaacaauaaacucagaaacugccucaaaucucuguuuucuaaugagaugcuaaggaagagcccacaggaagcagcaaauacaguccuuccuucccaugcaaaaugaagccaugcaaaaguaacccauugaucaucuccaagucaacuccagagaucaggaucaguuuauguuacccguucacauauauccaccuaucauucuuauuaucuuguuuuuuagaagaggcugacuaggaucaacucaaaaacgucauauaauuuucccaacuagagugcaagcacguacuucagagauugagauauaaaagucacauugaguucagaaccuugaaguccucuguagaccacauaagcccuaagaaaagaaggccuccaaauuaucccuccacaacagaacagguuauuuuauuuuccacuaggugaguuacuuuguagagguaauucaaacuauugcauaaaucuucacuuuauaaaaugaacaugcuauacuaauuggacauaaaauaauagagacuaauagcuccugucuugggaucauaauuauuuuuguauacuccugaaauuuaccacuuuaucaucaucacaaaauaagaaaaugagccuaguauggaguggacaaugucaugaaaacccaacggaaaaugaaacagggucgcuucuucacaaggcuuaaccccaaauuucugagcuaauucugagcccgacuuguccagacuucccaagugucgcccuucauccaauggacccaaccauguacuucauugcuggaaaccaacagcacgccacagucagaguugcaaagagacaaacuagccaacagauuacagggcaggcucccuuuccagacaguauuuccuuccaguuguccacaauagggguagaguaucugcagaaugcaaauggcucugcagccacaacccagaaaaccaacagucugauggaagcacagaucucuccgcaauucugcuuccauucucucaagcuggguacacuggccuggcuugaccuggaaaucaucaugucaaaacuuuggguauccaauuucccuuugcaaguagagacacauccaaaagcaaucaucugcggucggggcugcagaagagaauuagcuucagaaagcccacgccaugaaaaucucugaucaagcugaaguuuucuuuacacuccuugaggccaaacuguguauacugucuuguucccucaaugucucaaaagugugagugugcuaaguaugguaauaggacagaaacguuaaugagcagaguccuuggaaacaaugagagggguuggaagaaaauaauaggaaaaugaagacuguguaaaggaagugaaagagcaugagggaaaaaugaagaggugagaaauugacaagggcgucugaaagaugcaaugccaaguguugcuggaggaagaguuggaaaaauaauaaauuuaaguucaucuggugucuacuaggugucuaucauggauuaugagggauaagggaagggcuguauuaaucuuuagguccucagugggcagcguaaguacuguacucuacagacggauggaugcauggacggauagaugcauggauggauggaugggagagcgggagagagagagaagagaugaaugaaugaauuaaugaaugaaguggucacuccccucaaggacucuacaggcucuuuuggaauaagugcaucuauacauguaauucuucuccuggucaaaccccggacugaucaaaguagaguguuuuugcugaauauggggcaagaagcuauuaacugacagagugguugaaagaagucuggaaaugagagaagaggggucagaauguaaaagaggaauccugguucccuuccacgggggucccgaggugcuuugaggagggagaaagagggcguccccucuggggagcccacucuccgggcuucuacugaccuggucuccgccucaccggccucuugcggccgcugcagaagcgcacuuugcugaacaccccgaggacgugccucucgcacagggagcgcccgucuuugcuggggcuggagcggcgcuuggaggccgacacucggucgcuguuggacucccucgccugccgcuucugccggaucaaggagcuggcuaucgccgcagccauagcugcucagcgagggccucaggccccagccucuacugcgcccuccggcuugcgcuccgccggggcgagggcaggaccugggcggccagggaaagggcagucgcggggaggcagugcuaaaauuugaggaggcugcaguaucgaaaacccggcgcucacaagguuagucaaagucugggcaguggcgacaaaaugugugaaaauccagauguaaacuuccccaaccucuggcggccggggggcggggcggggcggucccaggcccucuugcgaaguagacguuugcaccccaaacuugcaccccaaggcgaucggcguccaaggggcaguggggaguuuagucacacugcguucgggguaccaaguggaaggggaagaacgaugcccaaaauaacaagacgugccucuguuggagaggcgcaagcguuguaagguguccaaaguauaccuacacauacauacauagaaaacccguuuacaaagcagagucuggacccaggcggguagcgcgcccccgguagaaaauacuaaa

SEQ ID NO: 20178 - RNA, 2692 nt, Homo sapiens
uuuaguauuuucuaccgggggcgcgcuacccgccuggguccagacucugcuuuguaaacggguuuucuauguauguauguguagguauacuuuggacaccuuacaacgcuugcgccucuccaacagaggcacgucuuguuauuuugggcaucguucuuccccuuccacuugguaccccgaacgcagugugacuaaacuccccacugccccuuggacgccgaucgccuuggggugcaaguuuggggugcaaacgucuacuucgcaagagggccugggaccgccccgccccgccccccggccgccagagguuggggaaguuuacaucuggauuuucacacauuuugucgccacugcccagacuuugacuaaccuugugagcgccggguuuucgauacugcagccuccucaaauuuuagcacugccuccccgcgacugcccuuucccuggccgcccagguccugcccucgccccggcggagcgcaagccggagggcgcaguagaggcuggggccugaggcccucgcugagcagcuauggcugcggcgauagccagcuccuugauccggcagaagcggcaggcgagggaguccaacagcgaccgagugucggccuccaagcgccgcuccagccccagcaaagacgggcgcucccugugcgagaggcacguccucgggguguucagcaaagugcgcuucugcagcggccgcaagaggccggugaggcggagaccaggucaguagaagcccggagagugggcuccccagaggggacgcccucuuucucccuccucaaagcaccucgggacccccguggaagggaaccaggauuccucuuuuacauucugaccccucuucucucauuuccagacuucuuucaaccacucugucaguuaauagcuucuugccccauauucagcaaaaacacucuacuuugaucaguccgggguuugaccaggagaagaauuacauguauagaugcacuuauuccaaaagagccuguagaguccuugaggggagugaccacuucauucauuaauucauucauucaucucuucucucucucucccgcucucccauccauccauccaugcaucuauccguccaugcauccauccgucuguagaguacaguacuuacgcugcccacugaggaccuaaagauuaauacagcccuucccuuaucccucauaauccaugauagacaccuaguagacaccagaugaacuuaaauuuauuauuuuuccaacucuuccuccagcaacacuuggcauugcaucuuucagacgcccuugucaauuucucaccucuucauuuuucccucaugcucuuucacuuccuuuacacagucuucauuuuccuauuauuuucuuccaaccccucucauuguuuccaaggacucugcucauuaacguuucuguccuauuaccauacuuagcacacucacacuuuugagacauugagggaacaagacaguauacacaguuuggccucaaggaguguaaagaaaacuucagcuugaucagagauuuucauggcgugggcuuucugaagcuaauucucuucugcagccccgaccgcagaugauugcuuuuggaugugucucuacuugcaaagggaaauuggauacccaaaguuuugacaugaugauuuccaggucaagccaggccaguguacccagcuugagagaauggaagcagaauugcggagagaucugugcuuccaucagacuguugguuuucuggguuguggcugcagagccauuugcauucugcagauacucuaccccuauuguggacaacuggaaggaaauacugucuggaaagggagccugcccuguaaucuguuggcuaguuugucucuuugcaacucugacuguggcgugcuguugguuuccagcaaugaaguacaugguuggguccauuggaugaagggcgacacuugggaagucuggacaagucgggcucagaauuagcucagaaauuugggguuaagccuugugaagaagcgacccuguuucauuuuccguuggguuuucaugacauuguccacuccauacuaggcucauuuucuuauuuugugaugaugauaaagugguaaauuucaggaguauacaaaaauaauuaugaucccaagacaggagcuauuagucucuauuauuuuauguccaauuaguauagcauguucauuuuauaaagugaagauuuaugcaauaguuugaauuaccucuacaaaguaacucaccuaguggaaaauaaaauaaccuguucuguuguggagggauaauuuggaggccuucuuuucuuagggcuuauguggucuacagaggacuucaagguucugaacucaaugugacuuuuauaucucaaucucugaaguacgugcuugcacucuaguugggaaaauuauaugacguuuuugaguugauccuagucagccucuucuaaaaaacaagauaauaagaaugauagguggauauaugugaacggguaacauaaacugauccugaucucuggaguugacuuggagaugaucaauggguuacuuuugcauggcuucauuuugcaugggaaggaaggacuguauuugcugcuuccugugggcucuuccuuagcaucucauuagaaaacagagauuugaggcaguuucugaguuuauuguuuucuucaguguucguuuaauuugccucccuuuuugu

SEQ ID NO: 20179 - RNA, 2250 nt, Homo sapiens
cuuaugacagcagccacgggcuacaaacagcccccuucucaggcgggcaccugggaucccaaaguagagagaaauggaucagccccugaucaaagcaucuggaagcagguucuaauuucuguguccaaaagccaagacaggccauaaaucugaagcagcagugacuccuucguggucaggauucagggcagcaaauugccaugugugaucacagucugcuuacuggcaggacugagucgggacagcuccucccccaccccuuauucuccacggcuggaucuauucuaccucgccucaccaccccgccauuuacugagcgagcuaagggaguguucccuagcccugggaagaaccuuccaugaccugacugucugucgaaucuauccagaacuuacccuggccccgaacccucucacaugccugccucaucacugcugagcccgcccagcugacucaagaccacaggcaaauugggcugucuggcccugaauuuacuccagauguucagucucugcagaaugaaggaagugccagccguuagagcacuucuaaauuaaggagccaguggcagcaacacaucugagagcugcccaagguaaagugacgcaucccagauaaccccaaaggagaagcuggcacguggcagacaggcaccuggcaccugcgacuggagcacacgugucaucucagagagagugcagcugcaccgaggugaugcccugggcccgggagguggaauggcucuugcacuuuggcaggggugggagaguccugaaagcucugguuuuccacaguugguuucuuggccccagguccugccucuacguuugagcagagacacgggucaaggugcagccgucacaauuucaaauccacauaccaccucaucacaaauccaucuccugcccugacucccugcucaaagccuccaggcuccacagaggccgacgcuuccagcaggagagaggggaaacugccagcauaguguccccuaagccacacuguuagagccugaacaaugcugagcccauguccgaauuccaaauuggaacugcaaaccagggaccagcacaucugcugaaguuacacuugcaggaguuauccaucuaugcaaagcagacagcucucuugccugggaaacccccaugaaggaaggucuugggcagaaccaaaugcggggcagaccacugggagccaccagggcaagugccaggaaagauggcacaggcgcaaauaaucugaaccuuaaaaagagaaguucuucccccaguggaucuagauuccagaacggucaauccagugacaaggggggugauaauuuaguccacuuucagcccaacuugcuggucucagacaucucagcaccccagguugacaucaugagccgcucagggcaaggggcauaagaggcuguugaggcaucagcagaggggcuggugguccugguguccaggcagugagggagacaggcuugcaccccuccagcacaggcugcuucugucccugucccgagagcauccccaggcacaugucagcucugccccuucuggggucuccgaggggagcagguccagcagaaaugggaaggggcuggccgggcccucuaagcagagaggagggauggggguggcuugccuacuuaccagcagcucggcgcccgcccgccguggacaagagggagccugagaggaggacgagggacggcucaaggcugcagcaugaguguggcucgccuaagcugucccgguauuuaaacuaucccgggcgugagucacugcagagggcaguguuggcccugggaggggggacugugggccacagugcagugccugcaugucccgggcugacacuacaggguacacauagcuggcaucccuaaauguaagggguuugcuucaaccguauuuaaaaacucaggacacauuuuccucuuuccuucuuucccccaguguaucuuuuggauuccuucacugcauuggccaccgugagaggggaguuuacaacgacccgguaaaccccucccuaagugacuguggacccccugcugcccugcccuggccaaggagacaaggaccccgagaaagggauggagcaggauucaggggcguuucuuugcuccuagaaguauuggcaagugcuucucccugugguucuagaaaacuuauucauucuucucuuucuuucuuucuuucuuucuuauuuuaaacuuuuuauuuggcuuuaaauuuacagacaauuaauguguuucau

SEQ ID NO: 20180 - RNA, 2250 nt, Homo sapiens
augaaacacauuaauugucuguaaauuuaaagccaaauaaaaaguuuaaaauaagaaagaaagaaagaaagaaagagaagaaugaauaaguuuucuagaaccacagggagaagcacuugccaauacuucuaggagcaaagaaacgccccugaauccugcuccaucccuuucucgggguccuugucuccuuggccagggcagggcagcaggggguccacagucacuuagggagggguuuaccgggucguuguaaacuccccucucacgguggccaaugcagugaaggaauccaaaagauacacugggggaaagaaggaaagaggaaaauguguccugaguuuuuaaauacgguugaagcaaaccccuuacauuuagggaugccagcuauguguacccuguagugucagcccgggacaugcaggcacugcacuguggcccacaguccccccucccagggccaacacugcccucugcagugacucacgcccgggauaguuuaaauaccgggacagcuuaggcgagccacacucaugcugcagccuugagccgucccucguccuccucucaggcucccucuuguccacggcgggcgggcgccgagcugcugguaaguaggcaagccacccccaucccuccucucugcuuagagggcccggccagccccuucccauuucugcuggaccugcuccccucggagaccccagaaggggcagagcugacaugugccuggggaugcucucgggacagggacagaagcagccugugcuggaggggugcaagccugucucccucacugccuggacaccaggaccaccagccccucugcugaugccucaacagccucuuaugccccuugcccugagcggcucaugaugucaaccuggggugcugagaugucugagaccagcaaguugggcugaaaguggacuaaauuaucaccccccuugucacuggauugaccguucuggaaucuagauccacugggggaagaacuucucuuuuuaagguucagauuauuugcgccugugccaucuuuccuggcacuugcccugguggcucccaguggucugccccgcauuugguucugcccaagaccuuccuucauggggguuucccaggcaagagagcugucugcuuugcauagauggauaacuccugcaaguguaacuucagcagaugugcuggucccugguuugcaguuccaauuuggaauucggacaugggcucagcauuguucaggcucuaacaguguggcuuaggggacacuaugcuggcaguuuccccucucuccugcuggaagcgucggccucuguggagccuggaggcuuugagcagggagucagggcaggagauggauuugugaugaggugguauguggauuugaaauugugacggcugcaccuugacccgugucucugcucaaacguagaggcaggaccuggggccaagaaaccaacuguggaaaaccagagcuuucaggacucucccaccccugccaaagugcaagagccauuccaccucccgggcccagggcaucaccucggugcagcugcacucucucugagaugacacgugugcuccagucgcaggugccaggugccugucugccacgugccagcuucuccuuugggguuaucugggaugcgucacuuuaccuugggcagcucucagauguguugcugccacuggcuccuuaauuuagaagugcucuaacggcuggcacuuccuucauucugcagagacugaacaucuggaguaaauucagggccagacagcccaauuugccuguggucuugagucagcugggcgggcucagcagugaugaggcaggcaugugagaggguucggggccaggguaaguucuggauagauucgacagacagucaggucauggaagguucuucccagggcuagggaacacucccuuagcucgcucaguaaauggcgggguggugaggcgagguagaauagauccagccguggagaauaaggggugggggaggagcugucccgacucaguccugccaguaagcagacugugaucacacauggcaauuugcugcccugaauccugaccacgaaggagucacugcugcuucagauuuauggccugucuuggcuuuuggacacagaaauuagaaccugcuuccagaugcuuugaucaggggcugauccauuucucucuacuuugggaucccaggugcccgccugagaagggggcuguuuguagcccguggcugcugucauaag

SEQ ID NO: 20181 - RNA, 2508 nt, Homo sapiens
acaggcucacauguggaggagaacuugucucaggaugaaucguaucuugaaacucauccauaucugauuuggaugaugauauucagaccagacucuggacuuagacuucugaauugacacugggaugagcuaagacuuuuggggcuauuaggaugaaaucaguguauuuugcaugugagaaggacauaaauuuuagggagccaggaaguaucugugucccuccaaaguucauuauguugaaaccucauucccaaugcaauaguauucagaggugagaccuuaaggaggugauuaggucaugaaggcacagcccucaugaaugagacuugugcccuuauaauagagcccuaugagcuuauucaccccuucugccaugucaugacacaccaagaaggugucaucuaugaggaaaagggcccucaccagacacugaaucugccagugccuugaucuuggauuucugagccucuagaacugugagcaauagauguauauuguuuacaaauuacccagucucagguauuuauuuuaucauagcagccugaacaaauuaagacaggcuaguaagaaaagguagaguuuaaggaaagguaacuuugauuuuagacaauuuuuaaagguaagacuagaacuuagagauaacuaauugggaaucauacagagcagcaggcacgguggaaacacagaggagagggguacagagagagcagaggagaugccucaggggacagccaaggucuccagggcuaggagggaggaagaguuagcaagguuaauggaagagcugcggucuugagugauggugguuauggaaacagcaucauuucuccauucauuagugcaaagugcucuauuuucucaguauagauuucagacuaaaucuaaagaaccuauauucaaagacauccauaaaaaagacuacacaguacacugucaaguaagaacgacaaaggguucacuggguuuuuaauagucaaggcugguacuagacugcagaccccagggaaugcuuuucauggcuguauuaauguaucaaguucuaagucaacaaauuggcaguugcaaugacuuuuuuaaccagaaauaauuauuaaugggaaaagcaaguuuccaacaucccuauccuucccacauuaugacuuccauugacagugauuuuuaaauauauaauuacucagaaaauggauuaaaaccagauuauucacuguccgacaccaaauuuuuucagugauguuaaaaauucucuuuuuggauaguaauuuccaucacuuggaaaauaaaagccaaauacaguaugaucaaucaagaguguugcuggucgcacugaaaacugugaauccaggggagauacaugccuucuggcuggaguuccuccccagaaacaaggggcaagaccaguacuaacagcaggaaaaugaaauuucaacccacaaggcccucuguggucaggugccacccagucccaaguagucagucucuaaaugcugagaccucugagaaggcaggaacuuucuggaacuauuguguucauuuuaaacuuacagauucugcuggcuugcauuuuauuuuauacuaacuugccuacuaucccuuuaaacugccuguucucucccucaucucucuuuaaacgaaaaauaauauccuauaaaacagagcagacagacagcugugcacuacugcguaauccaucuuucuaaaauccucacacuugacacagaagccaacucucauuuuagaugcuuggaaauagaaucaagagcaaauucuagcauucuggguggcuagguugaaaguacacauggcaguucucagaagggugauggggccagcgucaagaaaugcucuguucuuaccgaucacacccuucauccagaucuugacaaucacacaaacaaguagccacgugguucuuuuccccauuccgaucuauguacucgcagcagcacaggggcuccaauucagguucuucgguuuucuuuuucuucacaggcuucauacugcccuucugugucaugauuugcaccugucaccaugaggcguaagaagcccucagaagguaaagguggaaagaacacaacuuacaucucguaaauagguccacgccucucucucucugcuuaaccuccaacgccugagcaaucaaaaaugagaagagagagggggagggggucccguuuucaucaggcuucuguggcuccgccuggccacacagggggcuccaggguucuuggaggucugagcugccuucaccgccccuucccagccugggcaggcgccgucugggcaccagccguuccuauggcgacagccgaccacgcguccgggacagccggggcgcgggcgguugcgcucaccugcgggugcaggcugggagggccgagcggucuccgcuccaagccugggcgcuggugggaacucagccucggggcuauagggaaaggcgaagcauaugcccgcuagcagcggcugacacaccaggcucccuggcagugcucaggggucgcgguc

SEQ ID NO: 20182 - RNA, 2508 nt, Homo sapiens
gaccgcgaccccugagcacugccagggagccuggugugucagccgcugcuagcgggcauaugcuucgccuuucccuauagccccgaggcugaguucccaccagcgcccaggcuuggagcggagaccgcucggcccucccagccugcacccgcaggugagcgcaaccgcccgcgccccggcugucccggacgcguggucggcugucgccauaggaacggcuggugcccagacggcgccugcccaggcugggaaggggcggugaaggcagcucagaccuccaagaacccuggagcccccuguguggccaggcggagccacagaagccugaugaaaacgggacccccucccccucucucuucucauuuuugauugcucaggcguuggagguuaagcagagagagagaggcguggaccuauuuacgagauguaaguuguguucuuuccaccuuuaccuucugagggcuucuuacgccucauggugacaggugcaaaucaugacacagaagggcaguaugaagccugugaagaaaaagaaaaccgaagaaccugaauuggagccccugugcugcugcgaguacauagaucggaauggggaaaagaaccacguggcuacuuguuugugugauugucaagaucuggaugaagggugugaucgguaagaacagagcauuucuugacgcuggccccaucacccuucugagaacugccauguguacuuucaaccuagccacccagaaugcuagaauuugcucuugauucuauuuccaagcaucuaaaaugagaguuggcuucugugucaagugugaggauuuuagaaagauggauuacgcaguagugcacagcugucugucugcucuguuuuauaggauauuauuuuucguuuaaagagagaugagggagagaacaggcaguuuaaagggauaguaggcaaguuaguauaaaauaaaaugcaagccagcagaaucuguaaguuuaaaaugaacacaauaguuccagaaaguuccugccuucucagaggucucagcauuuagagacugacuacuugggacuggguggcaccugaccacagagggccuuguggguugaaauuucauuuuccugcuguuaguacuggucuugccccuuguuucuggggaggaacuccagccagaaggcauguaucuccccuggauucacaguuuucagugcgaccagcaacacucuugauugaucauacuguauuuggcuuuuauuuuccaagugauggaaauuacuauccaaaaagagaauuuuuaacaucacugaaaaaauuuggugucggacagugaauaaucugguuuuaauccauuuucugaguaauuauauauuuaaaaaucacugucaauggaagucauaaugugggaaggauagggauguuggaaacuugcuuuucccauuaauaauuauuucugguuaaaaaagucauugcaacugccaauuuguugacuuagaacuugauacauuaauacagccaugaaaagcauucccuggggucugcagucuaguaccagccuugacuauuaaaaacccagugaacccuuugucguucuuacuugacaguguacuguguagucuuuuuuauggaugucuuugaauauagguucuuuagauuuagucugaaaucuauacugagaaaauagagcacuuugcacuaaugaauggagaaaugaugcuguuuccauaaccaccaucacucaagaccgcagcucuuccauuaaccuugcuaacucuuccucccuccuagcccuggagaccuuggcuguccccugaggcaucuccucugcucucucuguaccccucuccucuguguuuccaccgugccugcugcucuguaugauucccaauuaguuaucucuaaguucuagucuuaccuuuaaaaauugucuaaaaucaaaguuaccuuuccuuaaacucuaccuuuucuuacuagccugucuuaauuuguucaggcugcuaugauaaaauaaauaccugagacuggguaauuuguaaacaauauacaucuauugcucacaguucuagaggcucagaaauccaagaucaaggcacuggcagauucagugucuggugagggcccuuuuccucauagaugacaccuucuuggugugucaugacauggcagaaggggugaauaagcucauagggcucuauuauaagggcacaagucucauucaugagggcugugccuucaugaccuaaucaccuccuuaaggucucaccucugaauacuauugcauugggaaugagguuucaacauaaugaacuuuggagggacacagauacuuccuggcucccuaaaauuuauguccuucucacaugcaaaauacacugauuucauccuaauagccccaaaagucuuagcucaucccagugucaauucagaagucuaaguccagagucuggucugaauaucaucauccaaaucagauauggaugaguuucaagauacgauucauccugagacaaguucuccuccacaugugagccugu

SEQ ID NO: 20183 - RNA, 2541 nt, Homo sapiens
aaaacgaaauucuuuaacucuuaaaacaaccugucuuaacuagcccuaaggugauuccugagccacuuguggguaaaaaucagaagagaaaaaaguucaaugaccuugcaaauuagaaacuaaaaaacuaauggugugauagucuguacagccucaguggaauuacaggaaaacaucugcccggaaauugcuuuuuuucuuuuggaaaauuacuaggaggcugggggaaaagaggggaaaaacggguaaggaagguugcaaauguuaagaugccaaacaggaacccaaccgaaguccgaagugaaauacagccuccucuggcccaacugucaugcaaacaacuucuaagcaucuucagauguaaagaaaaacagucauugugcacaggcguuagcugaauguucgagaguuggaugaauggggaagacuuguuauacaccuagugguggguggauuucacuaggcugcagccuccacacagcuuuucuuugcugcacugcagaggcgccaucuucuccgucuuaaucuucacucaauucgauccuuuuaucugcacccuaaaaaaaagacccuucggacccuccccagcauccugugcccccaggggaacuaaaccagaguccccagagcugccagggaagaggccgcgccuuaaucagacaaacgccuccuuggaugcacaggacagagcccgugccuccccaccauccgccacugcccuuuccagacgcacaucccacucuccgccuuauuuccuccccgccaaggacuuuacagcccagcacagaauuaagccucggaggugauccgagggugggaagcagaggggccccgaggcuccgccagaagccccggcagcgucucugcccccucccaggcggacgcgcagccccgggaagggagccgggcgggagccucgguggcgcacugagacuaacgcggcucggcccacggcgagggcggggugucgcggcuuuuguucccgcggaccuucugccucucagacagagcuuagggugcgagcgaacucccgggacguccagacuuggggaaggcgcgggguggcuaugggucuccgaccccucccauuucucgcaaguuacacaaaagggagacgcggacaugcacaaaguuugccuguggaaggcggugcgcgaccccgacgccggcucgggcuagggucgcacccaggcugccgccgccagcagccgcgaaaagagguuggagcaaggaagggggaugggggugagagaggaaggugaaacgaggcggagaacgcagggaaaagcgaggggcuccuagcuuccugggcugucccgacuccuccuccuccuccccagggcccaagagaaaggaaagggcaacgauucaagagcgaaggacuggcuuuagggacgcugcguuuucgguuuuccccacgugcuccuucccccuuccccccugucugaaugucucucgccucccccgacccccgcuuccaaggcagggacuaagucggggucugggcucagggucgcccccuacccuucucgccccgggcuggcgcggaaccagggagaccagcgccucgcccgcucccucucagcgggccggagcgcgacucccuggggcagggcugggccgaaagcggggaugcgcuggacguccgcaagcgggggcggagaggagaggggucccauugacggacccccggcuucucugcauuaaagacuuggguuaaggucuugggggguaucgcguccccaccgugcagccuccccccgccuuccgaggcgcggcacccaccuccagcgcccgagccguccaggcggccagcaggagcagugccaaaccgggcagcaucgcgacccugcgcggggcaccgagugcgcugcugugcgagugggauccgccgcguccuugcucugcccgcgccgccaccgccgccgucucccggggcccccgcgcacgcuccuccgcgugcucucgccuaccgcugccgaggaaacugacggagcccgagcgcggcggcggggcucagagccaggcgagucagcugauccggcccaccccgcucggcacccgagagagaccccuagcggcgccgccggggaacugcgcccgcucgcgccgggaggggcccucgcgccccgcgcccacaggugcacgcgcccuuggcgccgccugcaccccacgcgcccccuccgcuccccggccgacggcccaccugggcuucgugaacagugggagggagagucuggggccaggagagggacggugcaggaucagggaaaggugaguccuaggacgcugaggcucuagaaaagucgagagcgcuccugcucguccccgugagcuugaaucauccgaccccgcaggccucccgggggugucguauaaaggacugcugcuagggugcguuuuuauccgcauuucguuuuuucucucgguuuggagagguggggcaggcguuucuggaagagaaugagaacgagugaagcuuaaaggaaauaggauuuucuuugcuuguugagacagcaaaaccucauuuuuuaaccccca

SEQ ID NO: 20184 - RNA, 2541 nt, Homo sapiens
uggggguuaaaaaaugagguuuugcugucucaacaagcaaagaaaauccuauuuccuuuaagcuucacucguucucauucucuuccagaaacgccugccccaccucuccaaaccgagagaaaaaacgaaaugcggauaaaaacgcacccuagcagcaguccuuuauacgacacccccgggaggccugcggggucggaugauucaagcucacggggacgagcaggagcgcucucgacuuuucuagagccucagcguccuaggacucaccuuucccugauccugcaccgucccucuccuggccccagacucucccucccacuguucacgaagcccaggugggccgucggccggggagcggagggggcgcguggggugcaggcggcgccaagggcgcgugcaccugugggcgcggggcgcgagggccccucccggcgcgagcgggcgcaguuccccggcggcgccgcuaggggucucucucgggugccgagcggggugggccggaucagcugacucgccuggcucugagccccgccgccgcgcucgggcuccgucaguuuccucggcagcgguaggcgagagcacgcggaggagcgugcgcgggggccccgggagacggcggcgguggcggcgcgggcagagcaaggacgcggcggaucccacucgcacagcagcgcacucggugccccgcgcagggucgcgaugcugcccgguuuggcacugcuccugcuggccgccuggacggcucgggcgcuggaggugggugccgcgccucggaaggcggggggaggcugcacgguggggacgcgauaccccccaagaccuuaacccaagucuuuaaugcagagaagccggggguccgucaaugggaccccucuccucuccgcccccgcuugcggacguccagcgcauccccgcuuucggcccagcccugccccagggagucgcgcuccggcccgcugagagggagcgggcgaggcgcuggucucccugguuccgcgccagcccggggcgagaaggguagggggcgacccugagcccagaccccgacuuagucccugccuuggaagcgggggucgggggaggcgagagacauucagacaggggggaagggggaaggagcacguggggaaaaccgaaaacgcagcgucccuaaagccaguccuucgcucuugaaucguugcccuuuccuuucucuugggcccuggggaggaggaggaggagucgggacagcccaggaagcuaggagccccucgcuuuucccugcguucuccgccucguuucaccuuccucucucacccccaucccccuuccuugcuccaaccucuuuucgcggcugcuggcggcggcagccugggugcgacccuagcccgagccggcgucggggucgcgcaccgccuuccacaggcaaacuuugugcauguccgcgucucccuuuuguguaacuugcgagaaaugggaggggucggagacccauagccaccccgcgccuuccccaagucuggacgucccgggaguucgcucgcacccuaagcucugucugagaggcagaagguccgcgggaacaaaagccgcgacaccccgcccucgccgugggccgagccgcguuagucucagugcgccaccgaggcucccgcccggcucccuucccggggcugcgcguccgccugggagggggcagagacgcugccggggcuucuggcggagccucggggccccucugcuucccacccucggaucaccuccgaggcuuaauucugugcugggcuguaaaguccuuggcggggaggaaauaaggcggagagugggaugugcgucuggaaagggcaguggcggaugguggggaggcacgggcucuguccugugcauccaaggaggcguuugucugauuaaggcgcggccucuucccuggcagcucuggggacucugguuuaguuccccugggggcacaggaugcuggggaggguccgaagggucuuuuuuuuagggugcagauaaaaggaucgaauugagugaagauuaagacggagaagauggcgccucugcagugcagcaaagaaaagcuguguggaggcugcagccuagugaaauccacccaccacuagguguauaacaagucuuccccauucauccaacucucgaacauucagcuaacgccugugcacaaugacuguuuuucuuuacaucugaagaugcuuagaaguuguuugcaugacaguugggccagaggaggcuguauuucacuucggacuucgguuggguuccuguuuggcaucuuaacauuugcaaccuuccuuacccguuuuuccccucuuuucccccagccuccuaguaauuuuccaaaagaaaaaaagcaauuuccgggcagauguuuuccuguaauuccacugaggcuguacagacuaucacaccauuaguuuuuuaguuucuaauuugcaaggucauugaacuuuuuucucuucugauuuuuacccacaaguggcucaggaaucaccuuagggcuaguuaagacagguuguuuuaagaguuaaagaauuucguuuu

SEQ ID NO: 20185 - RNA, 2645 nt, Homo sapiens
cagagccuuccacuccggacugagacccaaccccugcagaaaguccuaaacugggcugcgaccacuuugcucccaggagcagaggagcaggggaaaaggggagaauucuuuaaaaaaugacacgcgagagaguuaaagaaggaaaaaggcaccaaagugaugaaacaaaaagaacuggagaauaagcacugcacagagagaaggccguagcaggaaggaccggcagugacuuucaacagugcuugagagcagaauuauggccgcgagagggagugcaaacugggaggcggggcaaacccgggaaagaccucccaagcagguucugcgaaggggccccaccgccuucagcccgccugggucagccuuauaagggggaaaggggacagaagucugcagaacagagauccuagcguagccgcucaggguaccuucccaggucaccauugcuccucugcccucuccacauccgcccucccgugagcgcaggaugcacgcacaggcagcgguuacaaaacucagcgcaacguugcaacccgcacaaaaggcgcacacaaaaucauuaaaaagaaauacacagaguggaaagaacucgcacaagcuccaacucgcuaaagguggaaggagucagguuacaaacucucccuccccggccuaaaugcuuugcuuuaguuugcagaaaaucguuugucaguuuuuuucuugguuauucauuauucgggcaaaugcaaguauguuuucuagcugaguucaccaauccaaaccucaaaccacauuccuccacuccaggccuccguucuguccgcggacuuaugauccugccugccagcaggagucuacccugaagucgcgugggauagauaaagugaggagaggaggaugaauggacagacaaacgagagcaauucuucuaccugugggcuguccuacgccuugcagugccggguccugcggcgaccacugagccccuucguccucgcccucagucccuucguccucgucuucggucuccgcuuucccagucggccggggcucgucguccacgaccccgcacgugccgccgacgucgcccugccgauuccgccgcaggagguggaacuguaguggugccggcggcuucuccccuggggcggcgguggcgaggcgcucgcuggcggcgggcagcggcuggaugaaauacgccucccccagcagguagaaggcgccgcgcacgcccucgcagaggcugagggcggcagccgagcugggaucgccauucacggugccggaguagaagcagugcgccaggucgguuuccggaagcggcgucucggacccggauuugcgccccacguucuggagcgugaagccgggcgccaaaaagcugcugucgggccgcagcuccagauccagcugcuggucaaaggcgugcaggcggaggcgcguggucccgugucccggggcgcgcuccagcuccggcaccacuagcuccucguccuccucggaggggcgcccgagugcguccgacacggccaguagcgccgcggcgagcagcagcagcguggguacuggcccaaagcuccgagaccccggagcccgcuccgcguuccccaugucgcugcccagcuugcgccuuccgaaccccucgggcacagcucgcugcauuggagccccaggagacaccgcucguagcagcgcacggagcgagggaccuuuaguucgggucgggagagcaaagccucguuggccugcucuggauuguuaaaauuaacaauuucuauuauucguuggaagggcgcgcagagccggcuacagccgaagcucccggagucacuaaaaggaggcgcugcaguucugccggcgcgcgggaaguuuuucuuccagcgcaaaguuggagacacugagaggcaggcgcaggcagaguggcucugcugggacaagaagcgcucuggggcgccuccggggcugaggcaacgcggagauuggugccuggcgccccucuucggccuccgccuuggcugcgauguugcucacucugcucagggcucuccccucuccguccgguagcgcacccuggcuuugcaauagccccuggcucggagccgcuuuccagcgagugcaagaaccgggcagccgagcgguccuuuuauaguggaccagugaaacccccacccccaccccacuccuccccuuuggcccuuuuccaucccaaagacgccgcccccggcuccguuggugcuaaaccgcgcuccgcgcugcgggcucgggagggggagggggcagccuccgcgcuggcuccacgccacugcucgucaaucuaggggcggaaggggcgcugugaccagcacuuuguacugcuggggccgcuccagggagaagacucucccuuccaccgcuuuucucccucgccgguuuccuggaccacccuuccuccccaccgcccgguugcgguaacucaguuaccgcgcugggcugcgguucccaggagggaggguucgguuggagaacgcagucccuucuucaacauuucccuauccuggagcugcccugggucuccuucccuccucccucaguucccucuuccccaaucuaggagaugagcuagggcuacacuuucuagaaaaauaccucaccccacuucuccaccuucccagccugccaggagcucc

SEQ ID NO: 20186 - RNA, 2645 nt, Homo sapiens
ggagcuccuggcaggcugggaagguggagaaguggggugagguauuuuucuagaaaguguagcccuagcucaucuccuagauuggggaagagggaacugagggaggagggaaggagacccagggcagcuccaggauagggaaauguugaagaagggacugcguucuccaaccgaacccucccuccugggaaccgcagcccagcgcgguaacugaguuaccgcaaccgggcgguggggaggaagggugguccaggaaaccggcgagggagaaaagcgguggaagggagagucuucucccuggagcggccccagcaguacaaagugcuggucacagcgccccuuccgccccuagauugacgagcaguggcguggagccagcgcggaggcugcccccucccccucccgagcccgcagcgcggagcgcgguuuagcaccaacggagccgggggcggcgucuuugggauggaaaagggccaaaggggaggagugggguggggguggggguuucacugguccacuauaaaaggaccgcucggcugcccgguucuugcacucgcuggaaagcggcuccgagccaggggcuauugcaaagccagggugcgcuaccggacggagaggggagagcccugagcagagugagcaacaucgcagccaaggcggaggccgaagaggggcgccaggcaccaaucuccgcguugccucagccccggaggcgccccagagcgcuucuugucccagcagagccacucugccugcgccugccucucagugucuccaacuuugcgcuggaagaaaaacuucccgcgcgccggcagaacugcagcgccuccuuuuagugacuccgggagcuucggcuguagccggcucugcgcgcccuuccaacgaauaauagaaauuguuaauuuuaacaauccagagcaggccaacgaggcuuugcucucccgacccgaacuaaaggucccucgcuccgugcgcugcuacgagcggugucuccuggggcuccaaugcagcgagcugugcccgagggguucggaaggcgcaagcugggcagcgacauggggaacgcggagcgggcuccggggucucggagcuuugggccaguacccacgcugcugcugcucgccgcggcgcuacuggccgugucggacgcacucgggcgccccuccgaggaggacgaggagcuaguggugccggagcuggagcgcgccccgggacacgggaccacgcgccuccgccugcacgccuuugaccagcagcuggaucuggagcugcggcccgacagcagcuuuuuggcgcccggcuucacgcuccagaacguggggcgcaaauccggguccgagacgccgcuuccggaaaccgaccuggcgcacugcuucuacuccggcaccgugaauggcgaucccagcucggcugccgcccucagccucugcgagggcgugcgcggcgccuucuaccugcugggggaggcguauuucauccagccgcugcccgccgccagcgagcgccucgccaccgccgccccaggggagaagccgccggcaccacuacaguuccaccuccugcggcggaaucggcagggcgacgucggcggcacgugcggggucguggacgacgagccccggccgacugggaaagcggagaccgaagacgaggacgaagggacugagggcgaggacgaaggggcucaguggucgccgcaggacccggcacugcaaggcguaggacagcccacagguagaagaauugcucucguuugucuguccauucauccuccucuccucacuuuaucuaucccacgcgacuucaggguagacuccugcuggcaggcaggaucauaaguccgcggacagaacggaggccuggaguggaggaaugugguuugagguuuggauuggugaacucagcuagaaaacauacuugcauuugcccgaauaaugaauaaccaagaaaaaaacugacaaacgauuuucugcaaacuaaagcaaagcauuuaggccggggagggagaguuuguaaccugacuccuuccaccuuuagcgaguuggagcuugugcgaguucuuuccacucuguguauuucuuuuuaaugauuuugugugcgccuuuugugcggguugcaacguugcgcugaguuuuguaaccgcugccugugcgugcauccugcgcucacgggagggcggauguggagagggcagaggagcaauggugaccugggaagguacccugagcggcuacgcuaggaucucuguucugcagacuucuguccccuuucccccuuauaaggcugacccaggcgggcugaaggcgguggggccccuucgcagaaccugcuugggaggucuuucccggguuugccccgccucccaguuugcacucccucucgcggccauaauucugcucucaagcacuguugaaagucacugccgguccuuccugcuacggccuucucucugugcagugcuuauucuccaguucuuuuuguuucaucacuuuggugccuuuuuccuucuuuaacucucucgcgugucauuuuuuaaagaauucuccccuuuuccccugcuccucugcuccugggagcaaaguggucgcagcccaguuuaggacuuucugcagggguugggucucaguccggaguggaaggcucug

SEQ ID NO: 20187 - RNA, 2990 nt, Homo sapiens
gcgcggggaaggaggggcuacuagggauuugaaagugcacgggcugcggaguggagcucgcaucuguucccgccgcccgcgagcggauuaaauuucugcaaauucaaacugaauggggcuuucuucugcugccuuccagagggcgccggcagcccgccgcgcgcuucucuccggcgggagcggccgcccagcgcacggcuaggagcgaucgcgggagcccgacccaagcccgugcgggccagacggcggcggcgaggcggaggcugcggaggcacccgggcucccggacccaggcacccggaccccgggacccaggcgccgccggaccgcgccccaccccgcgcgcccgagcagggcgacugucauuagcuuccuggacgggacccggggcgggauccugguguccugaaaggggcccgggcgacccuaagaggaagaacuuuugggggcgggguccccggucccgcguccccugggcagccgcuauugucuacgcgccucgcugggcggcgcggggggcgugaucgcggcggccccgggcucugggugcggagacccaggcggggcugggcccagggcggcggcgggagaagccggggaagccgaagagccuggggaggaggagcugcgagcgcgggagacgagcaggagccgcgcgggccgcggcgagcgcgaugccggcggcggcgggggacgggcuccugggggagccggcggcgccugggggcggcggcggcgcggaggacgcggccaggcccgcggcggccugcgagggaaguuuccugccugccugggugagcggcgugccccgcgagcggcuccgcgacuuccagcaccacaagcgcgugggcaacuaccucaucggcagcaggaagcugggcgagggcuccuuugccaaggugcgcgaggggcugcacgugcugaccggggagaaggugagucucccgggcgccguggggcuggggcacaggggcgggagucggcggccaggaccccgcggggagcacugcacugggagucccagugugcagucccgggccaagcgccuucccccuccgcccggcuuuccuguuggguuaaaacgcgcgcucagcaucucgcagccuuucccgaaggcggccugcgguccgcugcccggggguugggggcuugggaggggacggccuugccccgggaagcgucccgcgcggccguucugcucguggaagggcgccgccuggcgacacuagcgcggggggcgggauggggccccucugcccuucaggccggcaggggcggcggauccguggcgaggcgggaaccagggcuagaggaggugggcucuuaugucggggggcggggggggcaggaaagcuaacagccagccucuggggggagcuuagagucugauccccguccugggcucucggaggaggugggagaaggcugagauccugcauuccuucccaccugugggcuccggcagcuagggaauguuuuuuggcagcuagggaauuuuucgugcucagaggaggguuuuugccuccgcccuccacuuguccaucccucaaccugugcuccucucuauccacucaacccucccaccccugcccccucaucacccaccauucucauccccgccauucucauccccuucucuccguucccccagcuccucugugcccuccagccucagggugggagcugcagugaagacccugcuacuggcaggaacagaacuacagauaccuccccccagagacugggagaugccuucuuaucuuucuagaagaggggaaaggaaaggggaccuccgcgagaccaaaaggggcaccucuccagccuuguuggaaguuagaugguugugaacccuugccaggcgaggggcagguaagauggaagguguaacuuagagcugugagaagaaacccaagagcuuggugacucgcuuuugaggccgggucaccccaggcuggagcugcccgagcucagagccaauccaggcuggagcugucccaagcuccugucaucucgggcucaagacugcccccaggcuggggguggcucaaaccuggagggggaccagcuccuuugugugguccgugggucagggaggcgucagccgcaaggagggaaggcggaguucacuucccaaccgagcagguggccugggagccgagcccucugccuuccgaccugggggccucugcccagccuggggcugcccugugaaaccccuggucacagggccaaccugcccuuccugccugucucuagccucaccccaccuguaguucccuccccaccccauuuccccucuuugucuuggagccuuuugccugugaaugcaggucuccgucacccuugucauuuucccuguguucccuacagccguuuugagugaggcaccgcuuuauuauggguauguggggauagagugaguaguuuuuagaagugccuccugccugaauucccaugcaaaaaaggagcguucaguaugaacuugaguaagucuucaaagaaaaaggaaaaaccuccaaaccucguucuaguccgcaggagcgaggcacacuuacacuccucgauucgauucgauucgauucguagugagcugucugacuuccacacugcggguccguucagggcgcgaggaugcggcuaauuagagugagcucucuucuccuggcccuguguaaauuccuguuggcacuggcgauggaaguuuauuuucauuggaaacguauaggauucaggcugguugugcauauuuccucucuaaacauaacggaaagaagcgagucuuuaugcucacaacgucauggcaaacacugcaaguacauucuucucgccugcccuggugcacagacuucuuuucuggcuucccuccaccuugcuguguugugcugugccucuggcucuguagcagcgcauuuuugcaccauaaaacucuuggcuuuggcugaacugccuggggguggauucagagcucagccagcgcuuggguucuggag

SEQ ID NO: 20188 - RNA, 2990 nt, Homo sapiens
cuccagaacccaagcgcuggcugagcucugaauccacccccaggcaguucagccaaagccaagaguuuuauggugcaaaaaugcgcugcuacagagccagaggcacagcacaacacagcaagguggagggaagccagaaaagaagucugugcaccagggcaggcgagaagaauguacuugcaguguuugccaugacguugugagcauaaagacucgcuucuuuccguuauguuuagagaggaaauaugcacaaccagccugaauccuauacguuuccaaugaaaauaaacuuccaucgccagugccaacaggaauuuacacagggccaggagaagagagcucacucuaauuagccgcauccucgcgcccugaacggacccgcaguguggaagucagacagcucacuacgaaucgaaucgaaucgaaucgaggaguguaagugugccucgcuccugcggacuagaacgagguuuggagguuuuuccuuuuucuuugaagacuuacucaaguucauacugaacgcuccuuuuuugcaugggaauucaggcaggaggcacuucuaaaaacuacucacucuauccccacauacccauaauaaagcggugccucacucaaaacggcuguagggaacacagggaaaaugacaagggugacggagaccugcauucacaggcaaaaggcuccaagacaaagaggggaaaugggguggggagggaacuacagguggggugaggcuagagacaggcaggaagggcagguuggcccugugaccagggguuucacagggcagccccaggcugggcagaggcccccaggucggaaggcagagggcucggcucccaggccaccugcucgguugggaagugaacuccgccuucccuccuugcggcugacgccucccugacccacggaccacacaaaggagcuggucccccuccagguuugagccacccccagccugggggcagucuugagcccgagaugacaggagcuugggacagcuccagccuggauuggcucugagcucgggcagcuccagccuggggugacccggccucaaaagcgagucaccaagcucuuggguuucuucucacagcucuaaguuacaccuuccaucuuaccugccccucgccuggcaaggguucacaaccaucuaacuuccaacaaggcuggagaggugccccuuuuggucucgcggagguccccuuuccuuuccccucuucuagaaagauaagaaggcaucucccagucucuggggggagguaucuguaguucuguuccugccaguagcagggucuucacugcagcucccacccugaggcuggagggcacagaggagcugggggaacggagagaaggggaugagaauggcggggaugagaauggugggugaugagggggcaggggugggaggguugaguggauagagaggagcacagguugagggauggacaaguggagggcggaggcaaaaacccuccucugagcacgaaaaauucccuagcugccaaaaaacauucccuagcugccggagcccacaggugggaaggaaugcaggaucucagccuucucccaccuccuccgagagcccaggacggggaucagacucuaagcuccccccagaggcuggcuguuagcuuuccugccccccccgccccccgacauaagagcccaccuccucuagcccugguucccgccucgccacggauccgccgccccugccggccugaagggcagaggggccccaucccgccccccgcgcuagugucgccaggcggcgcccuuccacgagcagaacggccgcgcgggacgcuucccggggcaaggccguccccucccaagcccccaacccccgggcagcggaccgcaggccgccuucgggaaaggcugcgagaugcugagcgcgcguuuuaacccaacaggaaagccgggcggagggggaaggcgcuuggcccgggacugcacacugggacucccagugcagugcuccccgcgggguccuggccgccgacucccgccccugugccccagccccacggcgcccgggagacucaccuucuccccggucagcacgugcagccccucgcgcaccuuggcaaaggagcccucgcccagcuuccugcugccgaugagguaguugcccacgcgcuuguggugcuggaagucgcggagccgcucgcggggcacgccgcucacccaggcaggcaggaaacuucccucgcaggccgccgcgggccuggccgcguccuccgcgccgccgccgcccccaggcgccgccggcucccccaggagcccgucccccgccgccgccggcaucgcgcucgccgcggcccgcgcggcuccugcucgucucccgcgcucgcagcuccuccuccccaggcucuucggcuuccccggcuucucccgccgccgcccugggcccagccccgccugggucuccgcacccagagcccggggccgccgcgaucacgccccccgcgccgcccagcgaggcgcguagacaauagcggcugcccaggggacgcgggaccggggaccccgcccccaaaaguucuuccucuuagggucgcccgggccccuuucaggacaccaggaucccgccccgggucccguccaggaagcuaaugacagucgcccugcucgggcgcgcgggguggggcgcgguccggcggcgccugggucccgggguccgggugccuggguccgggagcccgggugccuccgcagccuccgccucgccgccgccgucuggcccgcacgggcuugggucgggcucccgcgaucgcuccuagccgugcgcugggcggccgcucccgccggagagaagcgcgcggcgggcugccggcgcccucuggaaggcagcagaagaaagccccauucaguuugaauuugcagaaauuuaauccgcucgcgggcggcgggaacagaugcgagcuccacuccgcagcccgugcacuuucaaaucccuaguagccccuccuuccccgcgc

SEQ ID NO: 20189 - RNA, 2533 nt, Homo sapiens
acacuaaugcauauaacauuacugaacaguacucuaaacauaagacgguaaauuuuauguuaugaauaugugaucacaguuaaaaaaaaauaugagggagguuguuuuugaguagacaguugcuggaggaaggcacgugaguugcagccugaccagugcgaccaguccuccuucaacagccccgcuugccuugaaaaggcgcccuuacuccgcucagggggccugucccgcgcggcuggcacaggcgcucacaauaaccuccuaaagcggugccagccgcaccuccgcgcggccccggcacaagcagccaaugaacacgcggcugcgcccggccucgcgccuccauuggcugcgccccgccacccgcugccccgcagguucccaagccggguuuaaagggguagggcgcgggccagggccccaccaucguuuccccgcgcgcagguccgcggggaggggcggccugccgaccggcccaccccagggcguuccugaagggcguccucggccgcccccaccgccucccagauguacuaugcgguuucccaggcgcgcgugaacgcgguccccgggaccaugcugcggccacagcggcccggagacuugcagcucggggccucccucuacgagcuggugggcuacaggcagccgcccuccuccuccuccuccuccaccuccuccaccuccuccacuuccuccuccuccacgacggccccccuccuccccaaggcugcgcgcgagaagccggaggcgccggccgagccuccaggccccgggcccgggucaggcgcgcacccgggcggcagcgcccggccggacgccaaggaggagcagcagcagcagcugcggcgcaagaucaacagccgcgagcggaagcgcaugcaggaccugaaccuggccauggacgcccugcgcgaggucauccugcccuacucagcggcgcacugccagggcgcgcccggccgcaagcucuccaagauagccacgcugcugcucgcccgcaacuacauccuacugcugggcagcucgcugcaggagcugcgccgcgcgcugggcgagggcgccgggcccgccgcgccgcgccugcugcuggccgggcugccccugcucgccgccgcgcccggcuccgugcugcuggcgcccggcgccguaggaccccccgacgcgcugcgccccgccaaguaccugucgcuggcgcuggacgagccgccgugcggccaguucgcucuccccggcggcggcgcaggcggccccggccucugcaccugcgccgugugcaaguucccgcaccuggucccggccagccugggccuggccgccgugcaggcgcaauucuccaagugagggcgggccugggccuggggcgcgaccucggcccggccucccuucgcucagcuucuccgcgccccugcucccugcgucugggagagcgaggccgagcaaggaaagcauuucgaaccuuccaguccagaggaagggacugucgggcacccccuuccccgcccccaccccugggacguuaaagugaccagagcggauguucgauggcgccucggggcaguuugggguucugggucgguuccagcggcuuuaggcagaaagugcucgcucucacccagcacaucucucuccuugucccuggaguugcgcgcuucgcggggccgauguagaacuuagggcgccuugccgugguuggcgcgccccgggugcagcgagaggccauccccgagcgcuaccuccccggagcggagcacgccggcucccaguacuaggggcugcgcucgagcaguggcgggggcggaggggugguucuuuuccuucuccuccgccagaggccacgggcgcccuuguucccgccggccagguccuaucaaaggaggcugccggaacucaagaggcagaaaaagaccaguuaggcggugcagacggucugggacguggcagacggacggacccucggcggacagguggucggcgucggggugcgguggguaggggcgaggacaacgcagggugcgcuggguugggacguggguccacuuuuguagaccagcuguuuggagagcuguauuuaagacucgcguauccaguguuuugucgcagagaguuuucgcucuuaaauccuggggguuucuuagaaagcaacuuagaacucgagauucaccuuucguuucccuuuccccaaaaguagcguaaccaacauuuaagcuugcuuaaaaacgaaaaccaaccgccuugcauccaguguucccgauuuacuaaaauagguaaccaggcgucucacagucgccguccugucaagagcgcuaaugaacguucucauuaacacgcaggaguaccgggagcccugaaccgcccgcugcucggcggaucccagcugcgguggcgacggcgggaaggcgcuuuccgcuguuccucagcgggccgggcccuugaccagcgcggcccgcaggucuuccuucucgccgucuugcaguugaagagcuacauacguagucaguuucgauuuguuacagacguuaacaaauuccuu

SEQ ID NO: 20190 - RNA, 2533 nt, Homo sapiens
aaggaauuuguuaacgucuguaacaaaucgaaacugacuacguauguagcucuucaacugcaagacggcgagaaggaagaccugcgggccgcgcuggucaagggcccggcccgcugaggaacagcggaaagcgccuucccgccgucgccaccgcagcugggauccgccgagcagcgggcgguucagggcucccgguacuccugcguguuaaugagaacguucauuagcgcucuugacaggacggcgacugugagacgccugguuaccuauuuuaguaaaucgggaacacuggaugcaaggcgguugguuuucguuuuuaagcaagcuuaaauguugguuacgcuacuuuuggggaaagggaaacgaaaggugaaucucgaguucuaaguugcuuucuaagaaacccccaggauuuaagagcgaaaacucucugcgacaaaacacuggauacgcgagucuuaaauacagcucuccaaacagcuggucuacaaaaguggacccacgucccaacccagcgcacccugcguuguccucgccccuacccaccgcaccccgacgccgaccaccuguccgccgaggguccguccgucugccacgucccagaccgucugcaccgccuaacuggucuuuuucugccucuugaguuccggcagccuccuuugauaggaccuggccggcgggaacaagggcgcccguggccucuggcggaggagaaggaaaagaaccaccccuccgcccccgccacugcucgagcgcagccccuaguacugggagccggcgugcuccgcuccggggagguagcgcucggggauggccucucgcugcacccggggcgcgccaaccacggcaaggcgcccuaaguucuacaucggccccgcgaagcgcgcaacuccagggacaaggagagagaugugcugggugagagcgagcacuuucugccuaaagccgcuggaaccgacccagaaccccaaacugccccgaggcgccaucgaacauccgcucuggucacuuuaacgucccaggggugggggcggggaagggggugcccgacagucccuuccucuggacuggaagguucgaaaugcuuuccuugcucggccucgcucucccagacgcagggagcaggggcgcggagaagcugagcgaagggaggccgggccgaggucgcgccccaggcccaggcccgcccucacuuggagaauugcgccugcacggcggccaggcccaggcuggccgggaccaggugcgggaacuugcacacggcgcaggugcagaggccggggccgccugcgccgccgccggggagagcgaacuggccgcacggcggcucguccagcgccagcgacagguacuuggcggggcgcagcgcgucgggggguccuacggcgccgggcgccagcagcacggagccgggcgcggcggcgagcaggggcagcccggccagcagcaggcgcggcgcggcgggcccggcgcccucgcccagcgcgcggcgcagcuccugcagcgagcugcccagcaguaggauguaguugcgggcgagcagcagcguggcuaucuuggagagcuugcggccgggcgcgcccuggcagugcgccgcugaguagggcaggaugaccucgcgcagggcguccauggccagguucagguccugcaugcgcuuccgcucgcggcuguugaucuugcgccgcagcugcugcugcugcuccuccuuggcguccggccgggcgcugccgcccgggugcgcgccugacccgggcccggggccuggaggcucggccggcgccuccggcuucucgcgcgcagccuuggggaggaggggggccgucguggaggaggaggaaguggaggagguggaggagguggaggaggaggaggaggagggcggcugccuguagcccaccagcucguagagggaggccccgagcugcaagucuccgggccgcuguggccgcagcauggucccggggaccgcguucacgcgcgccugggaaaccgcauaguacaucugggaggcggugggggcggccgaggacgcccuucaggaacgcccuggggugggccggucggcaggccgccccuccccgcggaccugcgcgcggggaaacgaugguggggcccuggcccgcgcccuaccccuuuaaacccggcuugggaaccugcggggcagcggguggcggggcgcagccaauggaggcgcgaggccgggcgcagccgcguguucauuggcugcuugugccggggccgcgcggaggugcggcuggcaccgcuuuaggagguuauugugagcgccugugccagccgcgcgggacaggcccccugagcggaguaagggcgccuuuucaaggcaagcggggcuguugaaggaggacuggucgcacuggucaggcugcaacucacgugccuuccuccagcaacugucuacucaaaaacaaccucccucauauuuuuuuuuaacugugaucacauauucauaacauaaaauuuaccgucuuauguuuagaguacuguucaguaauguuauaugcauuagugu

SEQ ID NO: 20191 - RNA, 2357 nt, Homo sapiens
ggcacagggcacauuuguguuuacccacaguugaaugugcucuggagcuaaccuggggccguaaccaucacacaccugguuuccaucagaaaaguguaucugauggaaaguacuuuguggagaucuaagcagcugaugauuauccuuaaguaaugcagggacugcacacaugaaauguugacuuuuugauccgucacuuugcaauuguucaauuauuuauuaaacaaacauuugaauauuguaggaugucuucaugugucuacgacuagaauguaaauugacagugaagauuuaucucauuaauucugaaucucugcuacagugauaaauauauugcuuugcucauaagaauuauuaaagggacuugaugucuaauauuugccauguaaucagcauuauauagcugaaacugaacuauuuugccuguucauagauacuuagguuuugaauuugaaagugacuccucaagggguggcaugaacacuauguaagauucacugagggucauuucuccccucucagcuccagcccgcuuuucucugugaagcaggauguguccggggccgcagagcugcaucuacuggcggugccuuucccgccgucucgaaggcacggagaggcuacaggggauuuucucugaaacgugcagggccuccaccugugacuccggaaggcugccggcucccccaggggaaugcuccuggcuuucgacggacuacauuaaccucggaccaccggagcgccagcugggggagccccgggaugccuggcgcgcgcuccgcccuccgcuguccuggcacuuugcucccauucaacagucggucgugacaccagccgggcacagcccggggccuggcagggccgcguccuuagcgagcgcgcugggcuccuccuccugccggcccggcccgcgucucagcuguggggacccgggggcgccgcgacucgcccacagucggacggcgggaggcgguuccugcaggguccagucccgggagcacccccaggaggaggggagggugggagcgccucucuuugaguccccggguuuggucgcugggaugugaggaagccggagaggccgcggcuggacgcagguggguguggaggggccgcccggacugcggggacccgcuccgcgcacaguggcugagcgcccgccucucuuuccaggggcugaggauccggcggcucggcugcacuaugcccuucccgcccaugccgccgccgcccgcccccgccccgggggcccaagccgcgcgccaguuaccccggaggcccugcgccgcgggggacaagaagaagaggcccccacagcggcccgaggggcuccucuccagcuccuggcccuccgccacgcucaagaggccgccggcccggcgcggccccggccuggacaggacgcagccgccggccccuccgggcgucuccccccaggccuugcccagccgcgcgcgggccccagccacgugcgccccgccccggccggcaggcuccggccacagcccagcgaggaccaccuaugcggcgaccucggcggggacggggaccaccgccgcgggcaccuccucgggggcggggccuuguccagacuccgcugcgcgcuucugccugaaucucacccccgaggccguccuggucauccagaagcgucaucuggagaagcagcugcuggcgcggccccgcaggcccuuccccucacccucggccgaacccaggcgccuacucgccccgugucucccggcuagggccgcgggcccgcggaggggcggccccgccagcgaccccgacgcaccccccaccgccggccagggccgccgcgcgccuccgcccggcgcccagcugcugcacggcggccugcagguuccccagcucagcccgcggcccggggcccugcggccgaugcucaaggugucgcugcucaacgagcggcacagguacgacgacguggaguacgaggaggagccagaggcgguggacgagggccugguacgcaagugcacggaguggcugcgcggcguggaguccgcggcugccgcgcggggccgggcgggggcccuggacucacggcggcaccugagcacgcugugagcccagcgggccugcggggacaggccaggccugaucccaccucacuuccugcacgcgccacuccgccuaggggcccucgggggagaccgcaggcuccucuggccgccagcgcccacuuucgggacaccagugcgcaagcuggcccacguggggcgcagccagacucgcccgacggccacggccccccuccugcccucgccagccggcagcccgggccuuucucguucacaccggugguaucuaccccagaugccugccucugcccc

SEQ ID NO: 20192 - RNA, 2357 nt, Homo sapiens
ggggcagaggcaggcaucugggguagauaccaccggugugaacgagaaaggcccgggcugccggcuggcgagggcaggaggggggccguggccgucgggcgagucuggcugcgccccacgugggccagcuugcgcacuggugucccgaaagugggcgcuggcggccagaggagccugcggucucccccgagggccccuaggcggaguggcgcgugcaggaagugaggugggaucaggccuggccuguccccgcaggcccgcugggcucacagcgugcucaggugccgccgugaguccagggcccccgcccggccccgcgcggcagccgcggacuccacgccgcgcagccacuccgugcacuugcguaccaggcccucguccaccgccucuggcuccuccucguacuccacgucgucguaccugugccgcucguugagcagcgacaccuugagcaucggccgcagggccccgggccgcgggcugagcuggggaaccugcaggccgccgugcagcagcugggcgccgggcggaggcgcgcggcggcccuggccggcgguggggggugcgucggggucgcuggcggggccgccccuccgcgggcccgcggcccuagccgggagacacggggcgaguaggcgccuggguucggccgagggugaggggaagggccugcggggccgcgccagcagcugcuucuccagaugacgcuucuggaugaccaggacggccucgggggugagauucaggcagaagcgcgcagcggagucuggacaaggccccgcccccgaggaggugcccgcggcggugguccccguccccgccgaggucgccgcauaggugguccucgcugggcuguggccggagccugccggccggggcggggcgcacguggcuggggcccgcgcgcggcugggcaaggccuggggggagacgcccggaggggccggcggcugcguccuguccaggccggggccgcgccgggccggcggccucuugagcguggcggagggccaggagcuggagaggagccccucgggccgcugugggggccucuucuucuugucccccgcggcgcagggccuccgggguaacuggcgcgcggcuugggcccccggggcgggggcgggcggcggcggcaugggcgggaagggcauagugcagccgagccgccggauccucagccccuggaaagagaggcgggcgcucagccacugugcgcggagcggguccccgcaguccgggcggccccuccacacccaccugcguccagccgcggccucuccggcuuccucacaucccagcgaccaaacccggggacucaaagagaggcgcucccacccuccccuccuccugggggugcucccgggacuggacccugcaggaaccgccucccgccguccgacugugggcgagucgcggcgcccccggguccccacagcugagacgcgggccgggccggcaggaggaggagcccagcgcgcucgcuaaggacgcggcccugccaggccccgggcugugcccggcuggugucacgaccgacuguugaaugggagcaaagugccaggacagcggagggcggagcgcgcgccaggcaucccggggcucccccagcuggcgcuccggugguccgagguuaauguaguccgucgaaagccaggagcauuccccugggggagccggcagccuuccggagucacagguggaggcccugcacguuucagagaaaauccccuguagccucuccgugccuucgagacggcgggaaaggcaccgccaguagaugcagcucugcggccccggacacauccugcuucacagagaaaagcgggcuggagcugagaggggagaaaugacccucagugaaucuuacauaguguucaugccaccccuugaggagucacuuucaaauucaaaaccuaaguaucuaugaacaggcaaaauaguucaguuucagcuauauaaugcugauuacauggcaaauauuagacaucaagucccuuuaauaauucuuaugagcaaagcaauauauuuaucacuguagcagagauucagaauuaaugagauaaaucuucacugucaauuuacauucuagucguagacacaugaagacauccuacaauauucaaauguuuguuuaauaaauaauugaacaauugcaaagugacggaucaaaaagucaacauuucaugugugcagucccugcauuacuuaaggauaaucaucagcugcuuagaucuccacaaaguacuuuccaucagauacacuuuucugauggaaaccaggugugugaugguuacggccccagguuagcuccagagcacauucaacuguggguaaacacaaaugugcccugugcc

SEQ ID NO: 20193 - RNA, 2647 nt, Homo sapiens
cugugaagaaaacaaacuucaauuuguuaacaagaccaagacuucaaccacacuaggccagcuggguuaauuucuuauuguauuuauuuauuuauuuuugagacagggccuugcucugucgcccagacuagagugcaacucgacucgaucacaacucacugcaaccucgaccugcggggcuaacguuauccuaccaccucagccucccuuaacugggaggacaggagugugccaccgcgcccggcucuaauuuucauauuuuuuguagagacgggguuucgccauguugcugaagcuggccuccaacuccuggacucaagugacccgcccaccucggccuuccaaagugcuggauuccgggcaugagccaccgcgcccaggcgaguuaauuucuuauuuuuggucacagaagccauuauuccaaaaugccuuccucuaaauguuguucucagccugaccucguuuaagcugccaccauuucucuguaucauacuaguuacuggaguaacuauguaucuuaggguagcuaacuggucuuuaaacuagugucacaaacucucccuccauccacccuuccccuuccaaaaaagggagcauaaaaaauaugggccuuuccaaagaguuucuaucgugagaucagccucacccuccuuagacuaauuucugcauguucugaacacaggggugcuaauaaaacuaucucugaugcaugggaaaaauaagaaccccccccauaaacccuaccacaaacuccaaguucagcccaaaguaggcucaacuuuguuucacucugaaaaguaacuuguaaaaguaacuuguaaaaguaacaguaacagggagaaacuguugucuguucaaaacuuuucauccugcuuccuuuuuaccaaaguuuaaaaaaauaaacaaaagcugaauuuuccaucauccuaaacaguccagaaaaggauggucagaaaauuccugaaauucgaaguuccccaggcccuggacugcuagcaguugcgcgaggugaacagcccucgaugggacugauggguuauacaaucaugguucccagagcaagauccacuagaauaauccgccccggagacaaugacaucaugugagcaaccaggcaggaaguugggcucagagaagugaagggucaagucuugaaagcucacacuggacgacacccccugcccccaaucuaaagaagacaaaagucaccgccugcuaaaaauauauauauauauauauucuuuaaagagaaaaugagcccacggggggaaaucaaucagcaaaugaaaccacaaacacucaacuccaggaccauuccugcgggcuccaacgccccggugagccucuccacaccgaggggccucaccggugccccgcuggcgaaacucugaugcaaacgcgcagcgggaacaaagcaaacuggaguuccugccuccaacuuucccggacgcccggccgcgcgagggcaggcgccgaccccaagggccggggcgaccgcuccgcacaaagccacccccgacucagcgacagccacaaguggccggacgcggggcuccaggaccgccacgaccgcgugugcccccgcgccccccgccugcgcacgggacccggcgggacucgcggacaccacgcaggcaacuuucccucgggaacggggcggaccccggcgcggaacggaggcgacuuggagaccccaggagcuccucgagcgcuccccgccccccacgccggccgcucaccccgggcaccgcgagcggagccugcguccgggcgggccacccaccugcacagcucggggaacggggcggccugggccugcguggaccccggggcagcgacgagcagcagcagcugcagcaggagcagagagcgcugcgggcggcgggcgggcgcgggccccaggugggggcuccggccggcggcggcccccaucgcgccgggcccggacugcgcggcgggcgcgaggcuaacggcgcgcgacugcugggggccgcgcccgggacggggucgcgccgccagggcaaaggcggagguggagacggagcgggagcccgaggugagcgcggcucgacugggcucggcgacagcgacagcggcagcggcggccccggaaccgcgucacgugacagccgcccggcaccgcccccccacccccgccccccgcucacgugacucccuuguucaggugacccccgcccgccccggcuccucccaggcccgggucacgugagcgcagcgcgcgggacaggaagcggcgcgggcggggcgcaggcuccaggugccucccggggccugagccucucggcgggcugggcgcggcgggggugccuagccgggccucaguuuccccucccaccgcgcccugcuggaucguggcgggugcuucccagguuagagcaacuguucccaaccucgaucgaccaguaggggaaaauagggaacuuggaucaaagugccagggagguaaaugccuucgcacagccuaguggcagcggauccguggggggugggaacacacuuuaacugcccguggagucaaaucauggggguuuacaaccuuggcccgucagagccucucagaccuucugugggaauguuauuucccaagcgugggcuuccuacagcaaggaaggcagcacaaauccag

SEQ ID NO: 20194 - RNA, 2647 nt, Homo sapiens
cuggauuugugcugccuuccuugcuguaggaagcccacgcuugggaaauaacauucccacagaaggucugagaggcucugacgggccaagguuguaaacccccaugauuugacuccacgggcaguuaaaguguguucccaccccccacggauccgcugccacuaggcugugcgaaggcauuuaccucccuggcacuuugauccaaguucccuauuuuccccuacuggucgaucgagguugggaacaguugcucuaaccugggaagcacccgccacgauccagcagggcgcggugggaggggaaacugaggcccggcuaggcacccccgccgcgcccagcccgccgagaggcucaggccccgggaggcaccuggagccugcgccccgcccgcgccgcuuccugucccgcgcgcugcgcucacgugacccgggccugggaggagccggggcgggcgggggucaccugaacaagggagucacgugagcggggggcgggggugggggggcggugccgggcggcugucacgugacgcgguuccggggccgccgcugccgcugucgcugucgccgagcccagucgagccgcgcucaccucgggcucccgcuccgucuccaccuccgccuuugcccuggcggcgcgaccccgucccgggcgcggcccccagcagucgcgcgccguuagccucgcgcccgccgcgcaguccgggcccggcgcgaugggggccgccgccggccggagcccccaccuggggcccgcgcccgcccgccgcccgcagcgcucucugcuccugcugcagcugcugcugcucgucgcugccccgggguccacgcaggcccaggccgccccguuccccgagcugugcagguggguggcccgcccggacgcaggcuccgcucgcggugcccggggugagcggccggcguggggggcggggagcgcucgaggagcuccuggggucuccaagucgccuccguuccgcgccgggguccgccccguucccgagggaaaguugccugcgugguguccgcgagucccgccgggucccgugcgcaggcggggggcgcgggggcacacgcggucguggcgguccuggagccccgcguccggccacuuguggcugucgcugagucggggguggcuuugugcggagcggucgccccggcccuuggggucggcgccugcccucgcgcggccgggcguccgggaaaguuggaggcaggaacuccaguuugcuuuguucccgcugcgcguuugcaucagaguuucgccagcggggcaccggugaggccccucgguguggagaggcucaccggggcguuggagcccgcaggaaugguccuggaguugaguguuugugguuucauuugcugauugauuuccccccgugggcucauuuucucuuuaaagaauauauauauauauauauuuuuagcaggcggugacuuuugucuucuuuagauugggggcagggggugucguccagugugagcuuucaagacuugacccuucacuucucugagcccaacuuccugccugguugcucacaugaugucauugucuccggggcggauuauucuaguggaucuugcucugggaaccaugauuguauaacccaucagucccaucgagggcuguucaccucgcgcaacugcuagcaguccagggccuggggaacuucgaauuucaggaauuuucugaccauccuuuucuggacuguuuaggaugauggaaaauucagcuuuuguuuauuuuuuuaaacuuugguaaaaaggaagcaggaugaaaaguuuugaacagacaacaguuucucccuguuacuguuacuuuuacaaguuacuuuuacaaguuacuuuucagagugaaacaaaguugagccuacuuugggcugaacuuggaguuugugguaggguuuaugggggggguucuuauuuuucccaugcaucagagauaguuuuauuagcaccccuguguucagaacaugcagaaauuagucuaaggagggugaggcugaucucacgauagaaacucuuuggaaaggcccauauuuuuuaugcucccuuuuuuggaaggggaaggguggauggagggagaguuugugacacuaguuuaaagaccaguuagcuacccuaagauacauaguuacuccaguaacuaguaugauacagagaaaugguggcagcuuaaacgaggucaggcugagaacaacauuuagaggaaggcauuuuggaauaauggcuucugugaccaaaaauaagaaauuaacucgccugggcgcgguggcucaugcccggaauccagcacuuuggaaggccgaggugggcgggucacuugaguccaggaguuggaggccagcuucagcaacauggcgaaaccccgucucuacaaaaaauaugaaaauuagagccgggcgcgguggcacacuccuguccucccaguuaagggaggcugaggugguaggauaacguuagccccgcaggucgagguugcagugaguugugaucgagucgaguugcacucuagucugggcgacagagcaaggcccugucucaaaaauaaauaaauaaauacaauaagaaauuaacccagcuggccuagugugguugaagucuuggucuuguuaacaaauugaaguuuguuuucuucacag

SEQ ID NO: 20195 - RNA, 2651 nt, Homo sapiens
gaguacuugagguccgugcggccgcugcugugcagguccugggaccacuccucgcccaccgucaggugccucuggguggccaggcggcugaugagucuuucuggguuuucuacggggagaagaugcuccugguugguucugaacgagaacccugugacucgggacagagcgggggugggccgagacauucagcacgggaaggaggcccaagcugcuccacccugaacuuucuggggcacgugcagaaugaaagcuguccggguuuggcugggggaugggugggcaaaguccaaugcuauuaacuggggaaagcaguuuugggguuuggguuuuguuuuuaccuguugcgaggucaucaggagaaucuguguggagagcuucaauaaucagagagaaggugcccugggagagaggggagaagacguuagacaacccagaaagguaacgaaaagaaaacggcaaaaagcagucauuccuaacagccaggucagcaacagaggccugaaggcugcaggucuggggcagcgugucuggagagggucuccacgcaccuccugccugcucucaccuucccuaaggaaauggaagaacuuuuuaaagagugguuuccugacguguuuuuucagccuguacuacaggauauuacguuguuuuuuuaauuagagagagagagagaaugcaggcaggaugggguggaagaggcccgagggcccuugucauuuuucuugggggaugggcacgcuccgggugguagcggucgcgcugcgcggguaaucgcgccaccaacgcgucuaggagucgggaaaccagaaccuucccacgugaaggggcgccucugacuggagaccuggcacagaggccggauacggaaaucucccgggcgcgcucggccucuccuccucgccccagcgcgguccccuccugcaggccgcggggccccggggcgagguguccgcgcugcugggcuggaguccuggggccgccgcuaggcagaucgcagcgcccaccugcgccucgcgggguccccgaggucccgccaccgagcgcccaaggcgggaucccagcgcguccugcagcccgcccagcuucagggccggcccggcgcgcgcaggugcggcacucaccggccaggugaagccgaaggggaagcggaugggguugcugaacgcggagucggcgcccccgccgucgggcagacugaaggagucgacgcccagcacgggggugacggcgcugccguaggugcagggcggcucgggggacacgcuggccugguagugcuugaggcacacgcggaagaagguccggcaggcgcacggcgguggccccgcgcccccgcggcagcaguugcgguuccccagcagccccuucuuguugacgaacuccugcagcuucaguucgaacaccccagagcuccagaccugcacgggggagggcgggggcgugaggacgcgggucccgcccgagcuagggggcgugaggccuggguggggggugugcggagagccuggaagggcucaggggccgagcgcgcucgcugcacggccggcgcuggggucgucgcccccgggauucaucuuccgggccguggcuggcgcggcccgugccgcuguccgccccuccccgcgcgcuccugccccgcgccccggcuacccgugagaccccgcggggccgcggcgcccccaccugcccgccuaccugacacagcaaggccgagagcaccgccagggccagcgcgcaccgacugcccaugcugcuucgcuccacgcgcgagccuggggggcccccacuucucuccuuagaacagcggcggacgcgcgggggaucgaugggccacggggagcgugggcagaaaagcgcccuugccucgccccagaccgcaggacccaggacuucuuucuuuaaaagccggucuccgccucuucccaaggccgcgguucuuuauauccgcccugcgaggucccgcggcagccccagggaugcccgaggaaaggcagcucucgggggacagcgcggcggcggcgacuuucguuuuccuccuuccucccagcccccgaggaggugagggucgccggcuuccugguuuugucuugagcuucuucgcaggagagggagggggagaaagagaaagagagagaguccagagauugagcuuaauucccaagagagcugcagagcuuccucccgagccgauuagaaagccgcggucuggaaaucccacgggcaaggcgauaauccggggccagcggcgcgcgcugaggggacggucggcggcggcgggugugcgcggcggccccugcggaucgcggcccggugucacucggcggcggcggucguuccgggagcacuccgggcuccgaucuccggugucacagcaaagauccgcgucuuuccgaugaauccagccaaugccauccaguacacacgcgcaggaccggaggggccgggccgugggaggaggcucugcgccgcggcugcccggguuccccugcgcucugcccucggccgggucgggucuccgcgggugcgcgcagaggaucuggcucucgccggcgccugccgcccuuauauucagccggccgcccgcauggcuaaugagaugcaaaucagcagccccccaaucuggcgagagcugucacaaaggagccacu

SEQ ID NO: 20196 - RNA, 2651 nt, Homo sapiens
aguggcuccuuugugacagcucucgccagauuggggggcugcugauuugcaucucauuagccaugcgggcggccggcugaauauaagggcggcaggcgccggcgagagccagauccucugcgcgcacccgcggagacccgacccggccgagggcagagcgcaggggaacccgggcagccgcggcgcagagccuccucccacggcccggccccuccgguccugcgcguguguacuggauggcauuggcuggauucaucggaaagacgcggaucuuugcugugacaccggagaucggagcccggagugcucccggaacgaccgccgccgccgagugacaccgggccgcgauccgcaggggccgccgcgcacacccgccgccgccgaccguccccucagcgcgcgccgcuggccccggauuaucgccuugcccgugggauuuccagaccgcggcuuucuaaucggcucgggaggaagcucugcagcucucuugggaauuaagcucaaucucuggacucucucucuuucucuuucucccccucccucuccugcgaagaagcucaagacaaaaccaggaagccggcgacccucaccuccucgggggcugggaggaaggaggaaaacgaaagucgccgccgccgcgcugucccccgagagcugccuuuccucgggcaucccuggggcugccgcgggaccucgcagggcggauauaaagaaccgcggccuugggaagaggcggagaccggcuuuuaaagaaagaaguccuggguccugcggucuggggcgaggcaagggcgcuuuucugcccacgcuccccguggcccaucgaucccccgcgcguccgccgcuguucuaaggagagaagugggggccccccaggcucgcgcguggagcgaagcagcaugggcagucggugcgcgcuggcccuggcggugcucucggccuugcugugucagguaggcgggcaggugggggcgccgcggccccgcggggucucacggguagccggggcgcggggcaggagcgcgcggggaggggcggacagcggcacgggccgcgccagccacggcccggaagaugaaucccgggggcgacgaccccagcgccggccgugcagcgagcgcgcucggccccugagcccuuccaggcucuccgcacaccccccacccaggccucacgcccccuagcucgggcgggacccgcguccucacgcccccgcccucccccgugcaggucuggagcucugggguguucgaacugaagcugcaggaguucgucaacaagaaggggcugcuggggaaccgcaacugcugccgcgggggcgcggggccaccgccgugcgccugccggaccuucuuccgcgugugccucaagcacuaccaggccagcgugucccccgagccgcccugcaccuacggcagcgccgucacccccgugcugggcgucgacuccuucagucugcccgacggcgggggcgccgacuccgcguucagcaaccccauccgcuuccccuucggcuucaccuggccggugagugccgcaccugcgcgcgccgggccggcccugaagcugggcgggcugcaggacgcgcugggaucccgccuugggcgcucgguggcgggaccucggggaccccgcgaggcgcaggugggcgcugcgaucugccuagcggcggccccaggacuccagcccagcagcgcggacaccucgccccggggccccgcggccugcaggaggggaccgcgcuggggcgaggaggagaggccgagcgcgcccgggagauuuccguauccggccucugugccaggucuccagucagaggcgccccuucacgugggaagguucugguuucccgacuccuagacgcguugguggcgcgauuacccgcgcagcgcgaccgcuaccacccggagcgugcccaucccccaagaaaaaugacaagggcccucgggccucuuccaccccauccugccugcauucucucucucucucuaauuaaaaaaacaacguaauauccuguaguacaggcugaaaaaacacgucaggaaaccacucuuuaaaaaguucuuccauuuccuuagggaaggugagagcaggcaggaggugcguggagacccucuccagacacgcugccccagaccugcagccuucaggccucuguugcugaccuggcuguuaggaaugacugcuuuuugccguuuucuuuucguuaccuuucuggguugucuaacgucuucuccccucucucccagggcaccuucucucugauuauugaagcucuccacacagauucuccugaugaccucgcaacagguaaaaacaaaacccaaaccccaaaacugcuuuccccaguuaauagcauuggacuuugcccacccaucccccagccaaacccggacagcuuucauucugcacgugccccagaaaguucaggguggagcagcuugggccuccuucccgugcugaaugucucggcccacccccgcucugucccgagucacaggguucucguucagaaccaaccaggagcaucuucuccccguagaaaacccagaaagacucaucagccgccuggccacccagaggcaccugacggugggcgaggaguggucccaggaccugcacagcagcggccgcacggaccucaaguacuc

SEQ ID NO: 20197 - RNA, 2349 nt, Homo sapiens
gcaccagcaccaggaagcccagcagggccagcccuagggagggagacagucaucuaccagauaguuucagucacauccucaaggggaccacgguucagacacaacacaggacagggcaagacagguccagguaaugcugucauccaguuggcggccuggccuuggccagagacaggcccugggcaaaaggcuuuuggcacugguuacuuaucauggcucaggauggucugggaaguagagaccaugauccccacuuugcaggugaggaaacagacuuggaggggcugagugaccggccccgggugagcccagcagguaagcaauggcagaggacaggccuaggccgucccacucccacacugcucuccccauacaagcaggucacaggagaaggcuaaggcagcgaaaccucaaguugaguugugaagaggacacaugagcagugaugccagcccggggccacuuggcuugcucuucccaacccaaguccuccccucuccauaaguguccagacaaauggaggcacugggccuuuuuaucuucuauaaaggggugaggccaggugggggaagacaaguccagaaugaagggaagggggcuucgaggggcuugucccaucuccccagaccucucccuggggaguuugauuccagccuagcccuuucugggaggucuccaccccucccugccggccucuaguacuggccucccaggggccaaacggggcuccgaaggcugcccacccuugugagaauguggccuggcaaaagcucgggaaaggcacccaggcugggccaggccgcucagggccccuugcccgccuggggcagcucaaggacgggcagggcugugucagcagagcuccgcggggcgcggaggaggggccggacgccuguugggggaagaaggagccgccaccaggcggagccccaagacagagcggcuuggggcgggggcgucaggacggcggcgcugggaggcuccucccgggcccuccucaucgcagucaacaccaucucccggcugggugcuggcgggaggggguucccagggcgcugggauuacagaggccggacaccaugcucccuaccccuggggcucagagggauuaagcaggcucagacccuacucugcuccccucuccugacccggcccccacccgccgggaaaacggaagcuggcagcgcggcccgggacaauggcagcuuugucaccgcggcuacuggcggugccagggccggggcagcccuggacuugggcgcuggggcccuccucggccucagugcccccggcccaacgcagguagggcggccgggggugugggaagcgcguugcgggacgcggcucaccgugcguguagauguugcccaguucguugugcagguagaagaggcugcgcaggcagcccgagccgcugcuggcgggccgguacccggucagcacgaacuuauugaacugcaggugcggcggcgagcuggcccaguccagcaggcgcggcccggccaggaacgccaugguccgcaccgcgcgggcagcccgugcuccugcuguccccgagccuccuccucaguggggccgcagcgcgggaaggcccaucacugccuggcgcccggcgcccggcgcccacccaucgcccugcgcucgaucggcgcacgcgcuggcuagggggucccagcccgcgccccuccggcgcugcgcacgcgcgaguccgucgcccccgcgccggggcggaggcuggggacgcaccggacgccugagcgcacugcggucggcuccgccaaggcagacgcgccgcagggacagcucgcggcggcggcggcggcgguggccgguagucucucugcagccaggaggacgggcgcggccggacgcgggaggggacgccaggcuccgcccaggcuccuaguucccgccggccggccagcguuucgcgcgccgggcuccugacgucggcgcagcgagagccaaugggcguggccggcggggaggcuccgccccgaggccgcccaggccucgccuccuagcauagugugcgcgcucccagccucauuugcaugggguggcugugggcuugcgacccaacguucuggguccugcgggcugcgcuagagugacccuggcaccucgcgucccucagaacugugcauccgggcuuuccgcgugacacccaggucuccguaccuuugggcacccacccucgggggcauaguccugccaccuagcccuacccugcagacggggcucuguccaaggugcugccggacggguccggccuacauccgguacgcccccgcuccaaagugaucuuuccgcaggcuggacucccgagugcagcaaggcgcuccacgg

SEQ ID NO: 20198 - RNA, 2349 nt, Homo sapiens
ccguggagcgccuugcugcacucgggaguccagccugcggaaagaucacuuuggagcgggggcguaccggauguaggccggacccguccggcagcaccuuggacagagccccgucugcaggguagggcuagguggcaggacuaugcccccgagggugggugcccaaagguacggagaccugggugucacgcggaaagcccggaugcacaguucugagggacgcgaggugccagggucacucuagcgcagcccgcaggacccagaacguugggucgcaagcccacagccaccccaugcaaaugaggcugggagcgcgcacacuaugcuaggaggcgaggccugggcggccucggggcggagccuccccgccggccacgcccauuggcucucgcugcgccgacgucaggagcccggcgcgcgaaacgcuggccggccggcgggaacuaggagccugggcggagccuggcguccccucccgcguccggccgcgcccguccuccuggcugcagagagacuaccggccaccgccgccgccgccgccgcgagcugucccugcggcgcgucugccuuggcggagccgaccgcagugcgcucaggcguccggugcguccccagccuccgccccggcgcgggggcgacggacucgcgcgugcgcagcgccggaggggcgcgggcugggacccccuagccagcgcgugcgccgaucgagcgcagggcgaugggugggcgccgggcgccgggcgccaggcagugaugggccuucccgcgcugcggccccacugaggaggaggcucggggacagcaggagcacgggcugcccgcgcggugcggaccauggcguuccuggccgggccgcgccugcuggacugggccagcucgccgccgcaccugcaguucaauaaguucgugcugaccggguaccggcccgccagcagcggcucgggcugccugcgcagccucuucuaccugcacaacgaacugggcaacaucuacacgcacggugagccgcgucccgcaacgcgcuucccacacccccggccgcccuaccugcguugggccgggggcacugaggccgaggagggccccagcgcccaaguccagggcugccccggcccuggcaccgccaguagccgcggugacaaagcugccauugucccgggccgcgcugccagcuuccguuuucccggcgggugggggccgggucaggagaggggagcagaguagggucugagccugcuuaaucccucugagccccagggguagggagcaugguguccggccucuguaaucccagcgcccugggaacccccucccgccagcacccagccgggagaugguguugacugcgaugaggagggcccgggaggagccucccagcgccgccguccugacgcccccgccccaagccgcucugucuuggggcuccgccugguggcggcuccuucuucccccaacaggcguccggccccuccuccgcgccccgcggagcucugcugacacagcccugcccguccuugagcugccccaggcgggcaaggggcccugagcggccuggcccagccugggugccuuucccgagcuuuugccaggccacauucucacaagggugggcagccuucggagccccguuuggccccugggaggccaguacuagaggccggcagggagggguggagaccucccagaaagggcuaggcuggaaucaaacuccccagggagaggucuggggagaugggacaagccccucgaagcccccuucccuucauucuggacuugucuucccccaccuggccucaccccuuuauagaagauaaaaaggcccagugccuccauuugucuggacacuuauggagaggggaggacuuggguugggaagagcaagccaaguggccccgggcuggcaucacugcucauguguccucuucacaacucaacuugagguuucgcugccuuagccuucuccugugaccugcuuguauggggagagcagugugggagugggacggccuaggccuguccucugccauugcuuaccugcugggcucacccggggccggucacucagccccuccaagucuguuuccucaccugcaaaguggggaucauggucucuacuucccagaccauccugagccaugauaaguaaccagugccaaaagccuuuugcccagggccugucucuggccaaggccaggccgccaacuggaugacagcauuaccuggaccugucuugcccuguccuguguugugucugaaccgugguccccuugaggaugugacugaaacuaucugguagaugacugucucccucccuagggcuggcccugcugggcuuccuggugcuggugc

SEQ ID NO: 20199 - RNA, 2532 nt, Homo sapiens
cacucacccuggggcugcacagggcugcuguccucaguggguccagggauaggggucucugcagagagggagggagaauggccugcgauggaggggcagagagaucugcagggcucggggaauagacgggacaacagcagggagcugggguggccuuggcuugguggcugaggcggggcagggucacucacuaacacagggcgccacuggggagcggcuuugcuggaagccaggcgcgcagcgguugcaggugaggccagugacgccauccuugcagggacacuggccuguggucugguugcaggucuugccagcagcaccaaccgggugacagucgcaggcugaggacagaggugggaagggccuggucagaagccugucuggggaucugggaagucagagggugagggccugcagguggccggugguggcucaccccugcaagcccgacggucacucagggcacggccagggucucgauagaagcccucccggcaguaguggcaguggcggccggcgguguugugccggcaguugagacagacacccccgcugcggcggccggacagucgguacagcuccauguugaagcggcagcggcgggcauggccguugcaggagcaagcugcagggagggaugggucaggggcaggcugguuguguccaagguccccaggccacccuccaaggccucaccgaggcaggcgugggauucccgggcaguggcccgcugccauggccugucgcaguagaagggcuugcagcggccgcagucagggcccucggugccaugccgacagucgcagaucagguggcccuguguguccagcaggcaccgugaggcauguccauugcacuugcagcgcccgcccaccuggaggucgguggcugcguaggaguaagggacgacggccuccaugucccuggggucaccugccgugcuaggccuugugagcacuacacggacgucgguggcggucacccagucuuggagcacugggcugcuguccagguccaggccuggggggcugcuguccugcaugcugaaggccagaaggccgcugccaucaggcugggccaggggugcggggaagcacagggccucaggcccugggccagcugggccauuggcaggggcaggcagacggccauaguccaggucacagugggaggagaagaagcccagcggggcccagcugcggccaugguccugagacuugagcagggccacggaggcugggggagcugagcagaagcgcaggcucacgaagaccagcucaaaagccuugcccaggggcaccgugagagucacguugaggggcgcccgaggcagggacuccgagcgccagcacagagggcuggccgugcccccuggggaaguaaggagggcgggggagugugcccgucgcgggucggaggcgucgcaggcccgaguggccggccgcccgcacgugcuggaagccagcaccucgcggcccagggcggcguucaccaguccuggcacgcagccgcggggcgcaccccccucaucguggcaggggucggcgggcgccggcggcccaggacucagggcggcgaagagcgugccugccgucagcagcagcccccagggccagccaggcauggccggagccgcugcgggucagccaguggccgggccccaagacgcugcccuuggggaaaagaagcccucuccgcggcucugcccaccaggcccgcaaugccgaggaacagggcccccgggcggccccagcccggcccagaggugggagcagcggcgggcacgccccgggcccagcacagcagcggggauguuggcgcguccucccgcugggccuagagcgaugacaggcgucgcccccgcucccggugccuccgcccgcggaggccccacccgccgcucgcacucacccaccgagggccgggcggagcaggucucccggccucccgggaagggccgugggcgggcggggccugcggugcacgggccgccgccuccucccggcugcagcgagggcggacgagcugugccaggaggggguggggggcgcagcaggcgcaagcccgggcccagccgggggcggggcugcucgggucgggaaggaggcaggggaggggagggggccucaucgcagagcuggaaucagaagcagauucagacgcgggcugggccagcggggaagggggcugggaggcccgggagccaggggaggggccggggagccaggaaugcgcuggcgggaggggucuggaggggggcagcucagccuucgcagcccgugggggaccacccagcaggguccugggcccacagccaggucuuuacugcuccuggggcugugccacgugcuggacgggggucugggucgccuccucccugaagaccaucaggcaggcaaggccccgggucugacagcagaggcccuggauguuccccagguagggaagccaaguaaccaccaguugaagggucauccccaaagcagcaucuacucgaguagaaggaacccaggauucggucaggucuaauuu

SEQ ID NO: 20200 - RNA, 2532 nt, Homo sapiens
aaauuagaccugaccgaauccuggguuccuucuacucgaguagaugcugcuuuggggaugacccuucaacuggugguuacuuggcuucccuaccuggggaacauccagggccucugcugucagacccggggccuugccugccugauggucuucagggaggaggcgacccagacccccguccagcacguggcacagccccaggagcaguaaagaccuggcugugggcccaggacccugcuggguggucccccacgggcugcgaaggcugagcugccccccuccagaccccucccgccagcgcauuccuggcuccccggccccuccccuggcucccgggccucccagcccccuuccccgcuggcccagcccgcgucugaaucugcuucugauuccagcucugcgaugaggcccccuccccuccccugccuccuucccgacccgagcagccccgcccccggcugggcccgggcuugcgccugcugcgccccccacccccuccuggcacagcucguccgcccucgcugcagccgggaggaggcggcggcccgugcaccgcaggccccgcccgcccacggcccuucccgggaggccgggagaccugcuccgcccggcccucggugggugagugcgagcggcggguggggccuccgcgggcggaggcaccgggagcgggggcgacgccugucaucgcucuaggcccagcgggaggacgcgccaacauccccgcugcugugcugggcccggggcgugcccgccgcugcucccaccucugggccgggcuggggccgcccgggggcccuguuccucggcauugcgggccuggugggcagagccgcggagagggcuucuuuuccccaagggcagcgucuuggggcccggccacuggcugacccgcagcggcuccggccaugccuggcuggcccugggggcugcugcugacggcaggcacgcucuucgccgcccugaguccugggccgccggcgcccgccgaccccugccacgaugaggggggugcgccccgcggcugcgugccaggacuggugaacgccgcccugggccgcgaggugcuggcuuccagcacgugcgggcggccggccacucgggccugcgacgccuccgacccgcgacgggcacacucccccgcccuccuuacuuccccagggggcacggccagcccucugugcuggcgcucggagucccugccucgggcgccccucaacgugacucucacggugccccugggcaaggcuuuugagcuggucuucgugagccugcgcuucugcucagcucccccagccuccguggcccugcucaagucucaggaccauggccgcagcugggccccgcugggcuucuucuccucccacugugaccuggacuauggccgucugccugccccugccaauggcccagcuggcccagggccugaggcccugugcuuccccgcaccccuggcccagccugauggcagcggccuucuggccuucagcaugcaggacagcagccccccaggccuggaccuggacagcagcccagugcuccaagacugggugaccgccaccgacguccguguagugcucacaaggccuagcacggcaggugaccccagggacauggaggccgucgucccuuacuccuacgcagccaccgaccuccaggugggcgggcgcugcaagugcaauggacaugccucacggugccugcuggacacacagggccaccugaucugcgacugucggcauggcaccgagggcccugacugcggccgcugcaagcccuucuacugcgacaggccauggcagcgggccacugcccgggaaucccacgccugccucggugaggccuuggaggguggccuggggaccuuggacacaaccagccugccccugacccaucccucccugcagcuugcuccugcaacggccaugcccgccgcugccgcuucaacauggagcuguaccgacuguccggccgccgcagcgggggugucugucucaacugccggcacaacaccgccggccgccacugccacuacugccgggagggcuucuaucgagacccuggccgugcccugagugaccgucgggcuugcaggggugagccaccaccggccaccugcaggcccucacccucugacuucccagauccccagacaggcuucugaccaggcccuucccaccucuguccucagccugcgacugucacccgguuggugcugcuggcaagaccugcaaccagaccacaggccagugucccugcaaggauggcgucacuggccucaccugcaaccgcugcgcgccuggcuuccagcaaagccgcuccccaguggcgcccuguguuagugagugacccugccccgccucagccaccaagccaaggccaccccagcucccugcuguugucccgucuauuccccgagcccugcagaucucucugccccuccaucgcaggccauucucccucccucucugcagagaccccuaucccuggacccacugaggacagcagcccugugcagccccagggugagug

SEQ ID NO: 20201 - RNA, 3124 nt, Homo sapiens
cuuuuucagggaacccggggaaggcccgguucucucgagggcgccugccccccuccaccaucaugcacccuucucagccagaaaccccacagcugccucccauacagggacccucagauaugcggggggccuggagcccaccuguguggucgccaugguggugcccaucuccaagcccugcuucagccuuguacacggcaccgccgccaggguggggucccagcuccgcgcccgagucggagucgcuguggccggcuuuggcgcucuuccugcgccguggcugguacuuguagucggggugguccuucuugugcugcacgcgaaggcgcucugccuccuccacgaagggccgcuucucgcucucgcucagcaagcugcagcacagggcagaggcagggauggccagggcgcccacugugcccucggcgcaggcacacaccacagggggaaccggcagcagaggccggggccaggaggcucugaccagggaaacccgccugccgugcgcuccggagccucccguggcaccaggcaguacacuccucugggagaaccggccggcgccuguuugggaagguugguaugcuuacgacagccaaagaagaacaagccccacgccucccaucuuccuccuucuauuucccccuauuccgggccugcuguucccucccucuggggcuuucuaagggaggcgggggaggcgggcaggacccagccggcgguggacaaaagcgaggcuucccgggaacggugccggccuucggcgggcagcugggcugcugucccuccauucccagacacccagaagcccuggcagggcccaggcgcccguccucacugagccacaggacacacuccuugggacucuucccgaggcucaccuccaaccgccugugcggcaggacuugggggagcaggggccugccguccacagcgccccguggcugcgcccuagauccagacagaaggcaggaggugcaaauacgcaagcuccaagcucccuucuuccaggugaggagcaggauacgggaaccagagccccaaaccaagagaaccauuugaaacccaaccagaggacacucggugggggcggccuguccugagcaacaaguucuucacucugcaguccuaauuucuggaaaacugaccggccccaccacgccaaggcgugcacacggcgcaccccgucaucuccacuccugcccucccugcuucggaccgaggguguccaggagagggagaaacugcggggaggguacucgcaggcaaaccugcugcccacccauccgccugccgcacucccuccccaugggugguccaggagcuagaggagcugagcccuuucuaaggagggagcaccuccagagagccgcaugcaacuugcugucgugccgggcgugccucccggggcuggggccacucgcaacggcuggagggcacgucggggugccagccauggcccuccgcaggguguuccccgccaggagaacuggcuccagagcgcacccgccacgagggugcacaccccaggcgcugcccuccgcggaucccgacucccauagcuggcgccggaccccggcuggccagaggauguuuuuccacugggacccgcccugacacccgcccggggugcagagcccggagccugcguguggccaccaccuccgcgagcucugcgcccuccaggcccccgcucgcaguccgagaccaggggcggccaaggucccgaaccccgcccccggggcgccggcacucaccgccacagcuugcccagcgucuugcugagcucggcguugugcaggugcggguacuggucggccagcuugcggcgcgccgccugcgcccacaccaugaaugcguucaugggccgcuucacaugcggcuuggcuuugagcgcgccgccgccgccgccgcgcaccggcaugggcaccagacuccagucguagcccuugagcaccugcgacacggcgucgcggaugcaggccgggaagcgcucguccgccgccuccgccgggucgccccgggcgccccccaccgcgacccccgcgcggcccaggcccucggagccggcgggagacggcggcgcguccgaguccgaguccuccacgugcgacauggagcuggcggugccggacgggcugcagggcggcugggagcgggccucgcucauguccagcaucggggccgcgcgcggaggggcgcgcacaggagacgcgcaccggggccggcgcccggggcugcccugcggucgcuccgggacccgaggucgccgcgcgguggccccgacccucgccccugccgccgccgccgccgccgccgaggcucgggucccgcugcgggacccgcaacaaguuucuuuaagcggcggccccgcggccccgccccgcgcccggcuacccauuggcggagcgcgccccgaucccccggaggcggagcccggccgcccccgcccccccacccauaaagaaagcuccgcggcucucgccgcgcccccgccugccccgcccggcgccgcaccacgugggccaggcgccccacgccuggagcuccccucucuggagccccgggaaaggaagcggggcagggaggccgggugggagcaggggggucuccggcgcuuccucuccucugcgggcgccgcgcggcuccugagaguccgccccccguccugacgcucagcuaggaagcggguccucgggccccucccccgacacacacacacacacacacacacacacacacacacacacacacucucucucucucucucucucucucucucucucucucucucucucacacacacacacacacacacagcccgucucgcgccugaggucucgcccgcaggccgguggcgcggggucagcugcugccugcgguccaggacagggucgguuccgccgcgcagcgcccaggcccagcucguccagagucugcggacagcgcacguccagguaacgcgcuucaaggggccgcggcucggagcugggggaccccgggccgcccugcccauacgagugcgagcguggagagcgcgggcgggggcgcggucccgggggccggccagcuggagggggcgggagcgcugggcggggccugcgcugaccccggcgcugagucc

SEQ ID NO: 20202 - RNA, 3124 nt, Homo sapiens
ggacucagcgccggggucagcgcaggccccgcccagcgcucccgcccccuccagcuggccggcccccgggaccgcgcccccgcccgcgcucuccacgcucgcacucguaugggcagggcggcccggggucccccagcuccgagccgcggccccuugaagcgcguuaccuggacgugcgcuguccgcagacucuggacgagcugggccugggcgcugcgcggcggaaccgacccuguccuggaccgcaggcagcagcugaccccgcgccaccggccugcgggcgagaccucaggcgcgagacgggcugugugugugugugugugugugagagagagagagagagagagagagagagagagagagagagagagugugugugugugugugugugugugugugugugugugugugugucgggggaggggcccgaggacccgcuuccuagcugagcgucaggacggggggcggacucucaggagccgcgcggcgcccgcagaggagaggaagcgccggagaccccccugcucccacccggccucccugccccgcuuccuuucccggggcuccagagaggggagcuccaggcguggggcgccuggcccacguggugcggcgccgggcggggcaggcgggggcgcggcgagagccgcggagcuuucuuuaugggugggggggcgggggcggccgggcuccgccuccgggggaucggggcgcgcuccgccaauggguagccgggcgcggggcggggccgcggggccgccgcuuaaagaaacuuguugcgggucccgcagcgggacccgagccucggcggcggcggcggcggcggcaggggcgagggucggggccaccgcgcggcgaccucgggucccggagcgaccgcagggcagccccgggcgccggccccggugcgcgucuccugugcgcgccccuccgcgcgcggccccgaugcuggacaugagcgaggcccgcucccagccgcccugcagcccguccggcaccgccagcuccaugucgcacguggaggacucggacucggacgcgccgccgucucccgccggcuccgagggccugggccgcgcgggggucgcgguggggggcgcccggggcgacccggcggaggcggcggacgagcgcuucccggccugcauccgcgacgccgugucgcaggugcucaagggcuacgacuggagucuggugcccaugccggugcgcggcggcggcggcggcgcgcucaaagccaagccgcaugugaagcggcccaugaacgcauucauggugugggcgcaggcggcgcgccgcaagcuggccgaccaguacccgcaccugcacaacgccgagcucagcaagacgcugggcaagcuguggcggugagugccggcgccccgggggcgggguucgggaccuuggccgccccuggucucggacugcgagcgggggccuggagggcgcagagcucgcggaggugguggccacacgcaggcuccgggcucugcaccccgggcgggugucagggcgggucccaguggaaaaacauccucuggccagccgggguccggcgccagcuaugggagucgggauccgcggagggcagcgccuggggugugcacccucguggcgggugcgcucuggagccaguucuccuggcggggaacacccugcggagggccauggcuggcaccccgacgugcccuccagccguugcgaguggccccagccccgggaggcacgcccggcacgacagcaaguugcaugcggcucucuggaggugcucccuccuuagaaagggcucagcuccucuagcuccuggaccacccauggggagggagugcggcaggcggaugggugggcagcagguuugccugcgaguacccuccccgcaguuucucccucuccuggacacccucgguccgaagcagggagggcaggaguggagaugacggggugcgccgugugcacgccuuggcgugguggggccggucaguuuuccagaaauuaggacugcagagugaagaacuuguugcucaggacaggccgcccccaccgaguguccucugguuggguuucaaaugguucucuugguuuggggcucugguucccguauccugcuccucaccuggaagaagggagcuuggagcuugcguauuugcaccuccugccuucugucuggaucuagggcgcagccacggggcgcuguggacggcaggccccugcucccccaaguccugccgcacaggcgguuggaggugagccucgggaagagucccaaggaguguguccuguggcucagugaggacgggcgccugggcccugccagggcuucugggugucugggaauggagggacagcagcccagcugcccgccgaaggccggcaccguucccgggaagccucgcuuuuguccaccgccggcuggguccugcccgccucccccgccucccuuagaaagccccagagggagggaacagcaggcccggaauagggggaaauagaaggaggaagaugggaggcguggggcuuguucuucuuuggcugucguaagcauaccaaccuucccaaacaggcgccggccgguucucccagaggaguguacugccuggugccacgggaggcuccggagcgcacggcaggcggguuucccuggucagagccuccuggccccggccucugcugccgguucccccuguggugugugccugcgccgagggcacagugggcgcccuggccaucccugccucugcccugugcugcagcuugcugagcgagagcgagaagcggcccuucguggaggaggcagagcgccuucgcgugcagcacaagaaggaccaccccgacuacaaguaccagccacggcgcaggaagagcgccaaagccggccacagcgacuccgacucgggcgcggagcugggaccccacccuggcggcggugccguguacaaggcugaagcagggcuuggagaugggcaccaccauggcgaccacacaggugggcuccaggccccccgcauaucugagggucccuguaugggaggcagcugugggguuucuggcugagaagggugcaugaugguggaggggggcaggcgcccucgagagaaccgggccuuccccggguucccugaaaaag

SEQ ID NO: 20203 - RNA, 2647 nt, Homo sapiens
uccuccgccgucgcgcccggggccgcuccgcguuguccgccucugucuucuccagcuccaccgccuucugcagcgcgcacagcucugagggggaacagagaggcagagagacgcuugguaagagcggcuugaccuacggagcgcggccgcacaguaaugguaagggauccucguggaggccacuguguccugccuggagcgcccagcuggcugcggcucacucugccaagugcacugggagccaccgacacgucucacucagcauuuguagaaagucaggcuggcucaaggcgcuggagaacaaaacgggaggucucugcccucggggcaguucacacccuggugagggagacagacggugacuuaaaauuucaggcugcaaaaaaaaaaaaaauaaauaaaaaaauaaaaaaauaaaaauaaaaccaggugaugcucuggggugaacugaauuagggcuaguuugguuugagaaguuaaaugaacagaggccgaggccucacugcuagggacggucuuaucucaaaauuaaggaaucaagaaacagaaggccagggaguguugguuuggugaucggaggcuccagccuggccgcagcaggguuugcgcaguguccaagaagcugcgggugggcaggcggccucggaaccugccuugcuggcuuccucgaauugguagcgaucaguucuagccgccgugcccgcccgaauuuguucccaggccucugcuccucaacaaaccuaugaauucucucccggcuggcagcggcccuucgcccagcgcuucgcccagcgccugcggccucccgggaaucgcccgggcuccugccuugggcuggggggucucccagaaggccccuuucugcagcggggccggccucccuccccgauccugggauggccugcgggaugaucccgcacucaucucguccacucccuugugcccgcgguagcgcagcauuuccuaacuuuuccacgagggaaccucuccgcccuggccgcgccggcaaguugugcugaaaaaauaaagugaagucagauuccugaggguccgcaguaucccauuuuaaaaucaaggcccucgaucccagacuccacuuuccuggcgcaaagaaagaaaggcaccagaaacccgggucgugggugggcugcagaaagaagguccaggacccuccuccgauuguacgcaaaagcugucuggugagcaacauuucaauuucuguuuagcgguucucaucagaucuuuaaaaagauucguaaauccaaaggagauuuaaaaacagagauuaucugcuugucucucuguucugucuaccauaaaccgauuucucaacuuccuaccagacccaggagcagagccgaagccgcccggggcuuuguuaggccggggggaaacguuuuuuggucucuugcuucugauccuuucaauccggcauuuccucugaaccuccgauuggacgcggggcgcgggagccuggcgacaacaccaggcaucuuacauucugaaccccccgccgcagcccagcccucggcccaagggcgcgugucuccuccuccuggcccugaguuucuuggggacgaaagcgacccaggaggggagaagggggccuguguuuccuccucaccuuucuuuucggcucuaggguccuuggcugggucggggucgcuguaggcacguggauagaaggcgggggcggcgggaaaggcagacgcacacuuggccggugaaggcgcgcggcccagcucugcgcgcagcucugggaggcccggcgcagccgccucgggcccagcguaggccucuggcuugaaggcggccagcaugcaggaggagggcgccagggucgccuccaggcgggcagagagcucuccggcggcagccaggcugcgcugcugcuguuccagguuuaggaugucuuugacugagaagggcgugggcgugagagcagggcuggggaacaugguggcagcgccagucucacagcgccaggugggcggcagaaagcggcgcugcccacggccccuggcagcuucccugcauggugccgccgcccgcccgcgcacccgucggccagcucuggauguguccgggcagcagguagcgcugagcacaaggggcaggagaggcgggaccaggccagaggagggggacucagccugccauugggccaggggccucgaugacaggagcgaugagcaguuucgugucaccuaauauagucauacggcaaaaaaaaaaaaaaaaaaaaaaaaaaaaaaaaaaaaaaaaagcccugcccagcuuuuuuaaaggggccacgacgcauuuggaagggucuccuuuugcuccugcagccugcguuugcucccuaaugugagccugaaaagccuaccagaggcaugcagagucaggccucugggcagggcuggauggguguggguuugaagaaauauuccucagcacccaaaccagcaugggagagagaaggauggggugggaagcgguggggaggagagugauuugaggaaggcuuuauuacugaagguggugggaugagggagagucugaauaggaagagaagccuggaggacagggcuggcuuuggggauagcagcagggcgagauucuggacaauucggggguuugguuuggcuuggccuacagggucagu

SEQ ID NO: 20204 - RNA, 2647 nt, Homo sapiens
acugacccuguaggccaagccaaaccaaacccccgaauuguccagaaucucgcccugcugcuauccccaaagccagcccuguccuccaggcuucucuuccuauucagacucucccucaucccaccaccuucaguaauaaagccuuccucaaaucacucuccuccccaccgcuucccaccccauccuucucucucccaugcugguuugggugcugaggaauauuucuucaaacccacacccauccagcccugcccagaggccugacucugcaugccucugguaggcuuuucaggcucacauuagggagcaaacgcaggcugcaggagcaaaaggagacccuuccaaaugcgucguggccccuuuaaaaaagcugggcagggcuuuuuuuuuuuuuuuuuuuuuuuuuuuuuuuuuuuuuuuuugccguaugacuauauuaggugacacgaaacugcucaucgcuccugucaucgaggccccuggcccaauggcaggcugagucccccuccucuggccuggucccgccucuccugccccuugugcucagcgcuaccugcugcccggacacauccagagcuggccgacgggugcgcgggcgggcggcggcaccaugcagggaagcugccaggggccgugggcagcgccgcuuucugccgcccaccuggcgcugugagacuggcgcugccaccauguuccccagcccugcucucacgcccacgcccuucucagucaaagacauccuaaaccuggaacagcagcagcgcagccuggcugccgccggagagcucucugcccgccuggaggcgacccuggcgcccuccuccugcaugcuggccgccuucaagccagaggccuacgcugggcccgaggcggcugcgccgggccucccagagcugcgcgcagagcugggccgcgcgccuucaccggccaagugugcgucugccuuucccgccgcccccgccuucuauccacgugccuacagcgaccccgacccagccaaggacccuagagccgaaaagaaaggugaggaggaaacacaggcccccuucuccccuccugggucgcuuucguccccaagaaacucagggccaggaggaggagacacgcgcccuugggccgagggcugggcugcggcgggggguucagaauguaagaugccugguguugucgccaggcucccgcgccccgcguccaaucggagguucagaggaaaugccggauugaaaggaucagaagcaagagaccaaaaaacguuuccccccggccuaacaaagccccgggcggcuucggcucugcuccugggucugguaggaaguugagaaaucgguuuaugguagacagaacagagagacaagcagauaaucucuguuuuuaaaucuccuuuggauuuacgaaucuuuuuaaagaucugaugagaaccgcuaaacagaaauugaaauguugcucaccagacagcuuuugcguacaaucggaggaggguccuggaccuucuuucugcagcccacccacgacccggguuucuggugccuuucuuucuuugcgccaggaaaguggagucugggaucgagggccuugauuuuaaaaugggauacugcggacccucaggaaucugacuucacuuuauuuuuucagcacaacuugccggcgcggccagggcggagagguucccucguggaaaaguuaggaaaugcugcgcuaccgcgggcacaagggaguggacgagaugagugcgggaucaucccgcaggccaucccaggaucggggagggaggccggccccgcugcagaaaggggccuucugggagaccccccagcccaaggcaggagcccgggcgauucccgggaggccgcaggcgcugggcgaagcgcugggcgaagggccgcugccagccgggagagaauucauagguuuguugaggagcagaggccugggaacaaauucgggcgggcacggcggcuagaacugaucgcuaccaauucgaggaagccagcaaggcagguuccgaggccgccugcccacccgcagcuucuuggacacugcgcaaacccugcugcggccaggcuggagccuccgaucaccaaaccaacacucccuggccuucuguuucuugauuccuuaauuuugagauaagaccgucccuagcagugaggccucggccucuguucauuuaacuucucaaaccaaacuagcccuaauucaguucaccccagagcaucaccugguuuuauuuuuauuuuuuuauuuuuuuauuuauuuuuuuuuuuuuugcagccugaaauuuuaagucaccgucugucucccucaccagggugugaacugccccgagggcagagaccucccguuuuguucuccagcgccuugagccagccugacuuucuacaaaugcugagugagacgugucgguggcucccagugcacuuggcagagugagccgcagccagcugggcgcuccaggcaggacacaguggccuccacgaggaucccuuaccauuacugugcggccgcgcuccguaggucaagccgcucuuaccaagcgucucucugccucucuguucccccucagagcugugcgcgcugcagaaggcgguggagcuggagaagacagaggcggacaacgcggagcggccccgggcgcgacggcggagga

SEQ ID NO: 20205 - RNA, 2632 nt, Homo sapiens
uuuauguauuaaugucauccuccugaucuuuucagcugcauuggguaaauccuugccugccagagugggucagcggugagccagaaagggggcucauucuaacagugcuguguccuccuggagagugccaacucauucuccaaguaaaaaaagccagauuuguggcucacuucguggggaaauguguccagcgcaccaacgcaggcgagggacugggggaggagggaagugcccuccugcagcacgcgagguuccgggaccggcuggccugcuggaacucggccaggcucagcuggcucggcgcugggcagccaggagccugggccccggggagggcggucccgggcggcgcggugggccgagcgcgggucccgccuccuugaggcgggcccgggcggggcgguuguauaucagggccgcgcugagcugcgccagcugaggugugagcagcugccgaagucaguuccuuguggagccggagcugggcgcggauucgccgaggcaccgaggcacucagaggaggugagagagcggcggcagacaacaggggaccccgggccggcggcccagagccgagccaagcgugcccgcgugugucccugcguguccgcgaggaugcguguucgcgggugugugcugcguucacagguguuucugcggcaggugaaugacgggcgugggucggugcgcgcucggcuugcgcacacggugucucuaagugcgcgggugacgagagucgggaugugccggagaccccggggcggagagcgggauuacaaguacaggaaucccuggucacgcuccccgccccuggaaacccagcuggggcgagggagggcguggacgggaccguucugggagcucgccuuuggcugcgguuggcuccaggccccaggcgcaguuugcucgcggcguggggaugaaguccgugucccuggaggggcccaggaagggcgaggaaagcggaguggaguaaguucgucuaggaucggucccggguggcucugggauccaaucugcgccgcccuggcccaggucccagguucagguccuuuacgccacuguguccaccaccuggcugagcgcugaggucagcgcgggcuguuuccuggcccuugggaaugugccaggacccguccccuaaggacuagcgaggaggugacucacugugacaaggagaccccagggaacggacuguaugaggucagaaccccgcccgggaugggguacagcgggacuccagaagcccucuccccugccccuucgcggucuccguccucccaucggcacagugaccuauuuggcuggaacaguuuguucccaaggaagccgggcacuggagguccgggacaccgcgucggguccccgcuccgcggcgcgcuguaggggucggggagucacggcccugcucugggcgggcucuaaccagccugucagucggggaagggcaagggucuccucuaccucuuucccaccgcggccgggagaaucgcggcccagccuguccucgggucggggcgcuggacuccggggcgggagcggagcccacgccuggaugggaggcggggaggguucaugucuuugagggguggggggucuggggggcacgacgcugcucagggccucuaucagcugccucgggggcucagggcuucccgaccuagcccagauucccucuccgaaagcuacagggcugagcggagcaggggggcgagucgcccccuggggcgccgccgccuggcgcggaccacagcgcguccucuccgucccaaaccccugggggacacuugcgcccucuucgugaggaaaagcaucuuggagcuggguuaggaacuuggggcgcccaggcagcuuccccucuccuugccucccuccacgucgcguuucugggaggacuugcgagcgguuuuguuuucguugcucccgucuauuuuuauuuuccagggaucugacucaucccgugcuuugggcguggagauaagguggaggggccggcucccggcgcgcgcgcgcgugcgugucugcgcgggcgugugugugugugugugugugugugugugugugugugucugugucagagacggcacaagagcgcgcgguuucccaacagcggcgggaguuucggaagccuggccggcucagcgugacguguucgcggccccccgguccccucccauucucccccuccccaccccagggugacgcgcagccggaguggaagcaguuuuggcgggcgagcagcgccuugcaggaaacugacucaucacuacucccuccagcgguccgaggcucugcccacgcaccucccacuccgcgcgugauuuccuggaggccggcgcccccucccggcccuggcgggaauagcacacaggcuuucccgcggaguggggcuggccggcgcgaaccgccgcggcuacuccugggcucauccgagaucaaccccuaugccauuaccaccccuucaaaggagcacuccuuagguucaacaguauucacugagcucuuacuggaaauuaaaauauggcugaagucuaaggcaggaaggccaauaaaggaggcuauuuuuaauuguuucuaaaacaaggguuugcguuucugaguuuucuuugggcugaaaguuauuaugagcaug

SEQ ID NO: 20206 - RNA, 2632 nt, Homo sapiens
caugcucauaauaacuuucagcccaaagaaaacucagaaacgcaaacccuuguuuuagaaacaauuaaaaauagccuccuuuauuggccuuccugccuuagacuucagccauauuuuaauuuccaguaagagcucagugaauacuguugaaccuaaggagugcuccuuugaaggggugguaauggcauagggguugaucucggaugagcccaggaguagccgcggcgguucgcgccggccagccccacuccgcgggaaagccugugugcuauucccgccagggccgggagggggcgccggccuccaggaaaucacgcgcggagugggaggugcgugggcagagccucggaccgcuggagggaguagugaugagucaguuuccugcaaggcgcugcucgcccgccaaaacugcuuccacuccggcugcgcgucacccugggguggggagggggagaaugggaggggaccggggggccgcgaacacgucacgcugagccggccaggcuuccgaaacucccgccgcuguugggaaaccgcgcgcucuugugccgucucugacacagacacacacacacacacacacacacacacacacacacacgcccgcgcagacacgcacgcgcgcgcgcgccgggagccggccccuccaccuuaucuccacgcccaaagcacgggaugagucagaucccuggaaaauaaaaauagacgggagcaacgaaaacaaaaccgcucgcaaguccucccagaaacgcgacguggagggaggcaaggagaggggaagcugccugggcgccccaaguuccuaacccagcuccaagaugcuuuuccucacgaagagggcgcaagugucccccagggguuugggacggagaggacgcgcugugguccgcgccaggcggcggcgccccagggggcgacucgccccccugcuccgcucagcccuguagcuuucggagagggaaucugggcuaggucgggaagcccugagcccccgaggcagcugauagaggcccugagcagcgucgugccccccagaccccccaccccucaaagacaugaacccuccccgccucccauccaggcgugggcuccgcucccgccccggaguccagcgccccgacccgaggacaggcugggccgcgauucucccggccgcggugggaaagagguagaggagacccuugcccuuccccgacugacaggcugguuagagcccgcccagagcagggccgugacuccccgaccccuacagcgcgccgcggagcggggacccgacgcggugucccggaccuccagugcccggcuuccuugggaacaaacuguuccagccaaauaggucacugugccgaugggaggacggagaccgcgaaggggcaggggagagggcuucuggagucccgcuguaccccaucccgggcgggguucugaccucauacaguccguucccuggggucuccuugucacagugagucaccuccucgcuaguccuuaggggacggguccuggcacauucccaagggccaggaaacagcccgcgcugaccucagcgcucagccaggugguggacacaguggcguaaaggaccugaaccugggaccugggccagggcggcgcagauuggaucccagagccacccgggaccgauccuagacgaacuuacuccacuccgcuuuccucgcccuuccugggccccuccagggacacggacuucauccccacgccgcgagcaaacugcgccuggggccuggagccaaccgcagccaaaggcgagcucccagaacggucccguccacgcccucccucgccccagcuggguuuccaggggcggggagcgugaccagggauuccuguacuuguaaucccgcucuccgccccggggucuccggcacaucccgacucucgucacccgcgcacuuagagacaccgugugcgcaagccgagcgcgcaccgacccacgcccgucauucaccugccgcagaaacaccugugaacgcagcacacacccgcgaacacgcauccucgcggacacgcagggacacacgcgggcacgcuuggcucggcucugggccgccggcccgggguccccuguugucugccgccgcucucucaccuccucugagugccucggugccucggcgaauccgcgcccagcuccggcuccacaaggaacugacuucggcagcugcucacaccucagcuggcgcagcucagcgcggcccugauauacaaccgccccgcccgggcccgccucaaggaggcgggacccgcgcucggcccaccgcgccgcccgggaccgcccuccccggggcccaggcuccuggcugcccagcgccgagccagcugagccuggccgaguuccagcaggccagccggucccggaaccucgcgugcugcaggagggcacuucccuccucccccagucccucgccugcguuggugcgcuggacacauuuccccacgaagugagccacaaaucuggcuuuuuuuacuuggagaaugaguuggcacucuccaggaggacacagcacuguuagaaugagcccccuuucuggcucaccgcugacccacucuggcaggcaaggauuuacccaaugcagcugaaaagaucaggaggaugacauuaauacauaaa

SEQ ID NO: 20207 - RNA, 1631 nt, Homo sapiens
acacaccuugguacaccgacaugggggcaccacugaccacaaccauccgcucgaccagggauggguaguagauggagaaaugccaggcaaggagggcaccccagucaugggccacaaggaugcacuucgaguaaccugugggaauucaaggagcucgcauaagugaggugcccaguaggacugaagcagggaugggggaaguagguuccagcaaggagaaagcggggguaugcgugugugcaggaugagggaggccacgccuaggauggggguaugucugcacccaggccuaggaugacaucuuugauguccaccagcagcaggucgauuguguagcaguccacaucccgaggugcauccgaggggccauagccucgcaaguccacagccacaacauggaagcggcucuggaacucccggagcugguaacgccaggagaaccugccaggcgggcgagggagggaggcugagucagggcccucagguugcaccugcacccuacgcacaucagcaaccauuggcaaacccuccuuccugcucuaaacuuccccuaaaaggaggauggggaaucccaggcagaggcagaggcugaggcugaagccagcuacacccugaauccagggaacuucaaucaaccucaauaccccuuuguccugucccuucagggccuagggauccuggguaugcuggcucaguaccccuauccccaucuauguucagcuugucccgaucuauacagcccuccucccugccucuugggagcccaagcuccaccugcccccgagucccgugggccucaggccccuggccccagacguaccaguucucagggaagccgugcagaaacagcaugagggguccguuaccucguccagccgagacauagugcagacgcaggcccgagcucuagggggagggcacagccugaagccuggggaacccucucucccgaggcuugaaccgucucgaccccacgcgaccccgcagccccgauagcgcccccgugcgaucaccuugagguucaggaaaccgugcucacccagcgaggggucgcucaggcaggcgggggacgcgcuccgacggcgcccgcagcagccgcgccggggccggcacagcacgugcgugagcgcuaugcagccguagaccgccgcggccaccagcgccaccgagaacaccaggcuccacaugaaggcgcgcagcagcuucagcgacaggcgcgacggcgccagcagcgcggucaccaccagcuccggcaugucgccgcgcuccgggaccacggcggcgcugccggccaggggcaccugcagcagcggcgaagcggugucagggcucaggggcccaucgcccuuggccuggggccccuccgugccgucgggauuugugggacgcgcugaaggaagaggcgggcggcuccgacagaaaacagccagagcgcaccacucaccugagugccagguaaacaccugggcgcgacagggacaggaaacaaggguagggugcggaggcuggggaggaagagguuggaaaggggggaaauaaaugggcggggccuagcagguccugugcggggcuuagggccggggcggggcccaggaagacucagcagcgggugggugagggucuaaaggcgg

SEQ ID NO: 20208 - RNA, 1631 nt, Homo sapiens
ccgccuuuagacccucacccacccgcugcugagucuuccugggccccgccccggcccuaagccccgcacaggaccugcuaggccccgcccauuuauuuccccccuuuccaaccucuuccuccccagccuccgcacccuacccuuguuuccugucccugucgcgcccagguguuuaccuggcacucaggugaguggugcgcucuggcuguuuucugucggagccgcccgccucuuccuucagcgcgucccacaaaucccgacggcacggaggggccccaggccaagggcgaugggccccugagcccugacaccgcuucgccgcugcugcaggugccccuggccggcagcgccgccguggucccggagcgcggcgacaugccggagcugguggugaccgcgcugcuggcgccgucgcgccugucgcugaagcugcugcgcgccuucauguggagccugguguucucgguggcgcugguggccgcggcggucuacggcugcauagcgcucacgcacgugcugugccggccccggcgcggcugcugcgggcgccgucggagcgcgucccccgccugccugagcgaccccucgcugggugagcacgguuuccugaaccucaaggugaucgcacgggggcgcuaucggggcugcggggucgcguggggucgagacgguucaagccucgggagagaggguuccccaggcuucaggcugugcccucccccuagagcucgggccugcgucugcacuaugucucggcuggacgagguaacggaccccucaugcuguuucugcacggcuucccugagaacugguacgucuggggccaggggccugaggcccacgggacucgggggcagguggagcuugggcucccaagaggcagggaggagggcuguauagaucgggacaagcugaacauagauggggauagggguacugagccagcauacccaggaucccuaggcccugaagggacaggacaaagggguauugagguugauugaaguucccuggauucaggguguagcuggcuucagccucagccucugccucugccugggauuccccauccuccuuuuaggggaaguuuagagcaggaaggaggguuugccaaugguugcugaugugcguagggugcaggugcaaccugagggcccugacucagccucccucccucgcccgccuggcagguucuccuggcguuaccagcuccgggaguuccagagccgcuuccauguuguggcuguggacuugcgaggcuauggccccucggaugcaccucgggauguggacugcuacacaaucgaccugcugcugguggacaucaaagaugucauccuaggccugggugcagacauacccccauccuaggcguggccucccucauccugcacacacgcauacccccgcuuucuccuugcuggaaccuacuucccccaucccugcuucaguccuacugggcaccucacuuaugcgagcuccuugaauucccacagguuacucgaagugcauccuuguggcccaugacuggggugcccuccuugccuggcauuucuccaucuacuacccaucccuggucgagcggaugguuguggucaguggugcccccaugucgguguaccaaggugugu

SEQ ID NO: 20209 - RNA, 2959 nt, Homo sapiens
ucaguaauauugaccuaaccccauauacucauuuugcaugugaggaaauugguuaggagugggagaagagacaaaauaguucaauauaugguaaaugagaaaccagguaucugcuugacagaaucaucuuuuugaucccuaagcacagauggaaagaagacccucaaaaaucuaucuccugucccccucucagacccuauuccuuuacucaucccuguacacuacugggacaggucacauacacauucagaccccagauccuccuccacaaauucagagacccaagcacccaccaaauagcuuaucauaguggcuuuuggggaaggucaacuccauuccuccaaggcuccaguuugccagucuuuucaugaauggguaaggaaaguguguauuugaggccauuagcuucuuuccaaaugcauacaucuucacuuuuacucacccugcagacacucgggaaucagaacccaucacaacgcccccgucaaacuccacugccaugaugguggucugcagagacacagaauauggaaugucagggcaagaacagccuugaugcccucauguuagagaagaagaaacauucccagagaggcgaagugacuggcucaaagauuacacaguaacaggccagagcugacugucaguacaggcuuuuuuucccuucaucuuuccacuuucucuauugcuucauccggcugcaggggaaugccacagcccagcugugauacaacacagaaagaacugugucccuaaguuccaacuugccuaguggaauccucuccacuguagagagguggagaugaggcuccuacagguagaagugaagcagcuccgcaagugaaaauuaucuccaacggaagggcucauaguaugugcagaugugguguagacccaacacagaguaauugacuaugaucuugggaaacaaggucagucuauuuuuuuuuuuuugguccacaauccuccacucucaccccccauuucaucagaagugagcucuuccaauuuacugaacauuggaaaaaaucgaggagggcagugguuagcauggccaggggcaaggcaggagagaagcagcaaggaacacauacagaugguugaaaauaaaaguuucaguuauggaauuuccgaucaagagguaaauacauaucucagcagccagggagguaaauuuguaccaagagauaauuugacugagaaguuuaagcugacuuuuccaggucaagaaaagaaucaagaagaagugagggaagauaaagcuacauuuauucuacuauugaguuggaaggagccuuaaagauccucgguucaaaugaggaaaccaagucacagaaaaugcaaacgacuuaugcaaagucacacagaguuaauaguagaccugggacuaaaauucaggucuaacucuuaucccuuguuuccacuucuacuuccuacuugccacugcucauuuggcagugaggggagauuucccaaauuauaagugguuucacugugucuuucuuaccaggccguaaguuacucuggccccaaaggacgcuccucugaguaugcuuuccgacggaccgacuuaucaugaauagagggucaaagaacaggguuaacuucaaguuagaggcuauuccucucuaacaaagccgcccccaagccacgagugguggcaguaguccagagcagaagccagccagccagucuuggggcugccaucugccccaggcgcccauccuaagcaaaguccccccagugggcacaugggagugggcagggaagacacagggaagggaguaaggcagcaucugggccaaggagaggccuuccugggucaagcuagggaagggcaucacuaguuaacacagaacgcccauuaucagugcuugggcuaagaguugcccaguggcaaguuuaucaaaagucugugugaugaguugguccuucucaauaagugccuauauuuccuucucccaagugcuguucuacuucacccagggcaccauuuccucaucucuuugcaccauccccaacccccuuucuugauuuaaccagcccccacuguccgggaccagagugaaagcgaaagcgcuuuagaguagcuucccguugacgcuuccagcuaagagucaaagcacccgcuuuuuccaccagccucgcgugccuguucccuucacggacacucuagacgaccccccucagaaaagaaauacucuaugcucauugcggguugcaagcgcuggcugcuacaggcgaccucccugcgcucccguuggucucugcauucacuucuccgcgcgcgcuuccaggguccccuggccgcugcaucuccuccaccccucugccaacccucaagcccagacccauuaccccgguguggacuucucccgcccgggguaaguccccgguuggugcucccgcccgcagcaucccugcaaggcaccgcucuccucgccgccuggggcacugguuuccaaccugggacagcgcacaacgcgcagccgacagccccgccccuucgcggcgccgccaggaggcgccugggugcugcggggcugcuuugcgcgcggcgcuaacguguguagggcagaucugccccgagacaagugacgaggcagccccgcccugaggcuggggugggaaaacuggugcaaguggaaaggcaggaggcagggagaggcgagaagggugugcgugauggagaaaauugggcaccagggcugcucccgagauucucagaucugauuuccacgcuugcuaccaaaauagucugggcaggccacuuuuggaaguaggcguuaucuagugagcaggcggccgcuuucgauuucgcuuuccccuaaauggcugagcuucucgccagcgcaggaucagccuguuccugggacuuuccgagagccccgcccucguucccucccccagccgccaguaggggaggacucggcgguacccggagcuucaggccccaccg

SEQ ID NO: 20210 - RNA, 2959 nt, Homo sapiens
cgguggggccugaagcuccggguaccgccgaguccuccccuacuggcggcugggggagggaacgagggcggggcucucggaaagucccaggaacaggcugauccugcgcuggcgagaagcucagccauuuaggggaaagcgaaaucgaaagcggccgccugcucacuagauaacgccuacuuccaaaaguggccugcccagacuauuuugguagcaagcguggaaaucagaucugagaaucucgggagcagcccuggugcccaauuuucuccaucacgcacacccuucucgccucucccugccuccugccuuuccacuugcaccaguuuucccaccccagccucagggcggggcugccucgucacuugucucggggcagaucugcccuacacacguuagcgccgcgcgcaaagcagccccgcagcacccaggcgccuccuggcggcgccgcgaaggggcggggcugucggcugcgcguugugcgcugucccagguuggaaaccagugccccaggcggcgaggagagcggugccuugcagggaugcugcgggcgggagcaccaaccggggacuuaccccgggcgggagaaguccacaccgggguaaugggucugggcuugaggguuggcagagggguggaggagaugcagcggccaggggacccuggaagcgcgcgcggagaagugaaugcagagaccaacgggagcgcagggaggucgccuguagcagccagcgcuugcaacccgcaaugagcauagaguauuucuuuucugaggggggucgucuagaguguccgugaagggaacaggcacgcgaggcugguggaaaaagcgggugcuuugacucuuagcuggaagcgucaacgggaagcuacucuaaagcgcuuucgcuuucacucuggucccggacagugggggcugguuaaaucaagaaaggggguuggggauggugcaaagagaugaggaaauggugcccugggugaaguagaacagcacuugggagaaggaaauauaggcacuuauugagaaggaccaacucaucacacagacuuuugauaaacuugccacugggcaacucuuagcccaagcacugauaaugggcguucuguguuaacuagugaugcccuucccuagcuugacccaggaaggccucuccuuggcccagaugcugccuuacucccuucccugugucuucccugcccacucccaugugcccacuggggggacuuugcuuaggaugggcgccuggggcagauggcagccccaagacuggcuggcuggcuucugcucuggacuacugccaccacucguggcuugggggcggcuuuguuagagaggaauagccucuaacuugaaguuaacccuguucuuugacccucuauucaugauaagucgguccgucggaaagcauacucagaggagcguccuuuggggccagaguaacuuacggccugguaagaaagacacagugaaaccacuuauaauuugggaaaucuccccucacugccaaaugagcaguggcaaguaggaaguagaaguggaaacaagggauaagaguuagaccugaauuuuagucccaggucuacuauuaacucugugugacuuugcauaagucguuugcauuuucugugacuugguuuccucauuugaaccgaggaucuuuaaggcuccuuccaacucaauaguagaauaaauguagcuuuaucuucccucacuucuucuugauucuuuucuugaccuggaaaagucagcuuaaacuucucagucaaauuaucucuugguacaaauuuaccucccuggcugcugagauauguauuuaccucuugaucggaaauuccauaacugaaacuuuuauuuucaaccaucuguauguguuccuugcugcuucucuccugccuugccccuggccaugcuaaccacugcccuccucgauuuuuuccaauguucaguaaauuggaagagcucacuucugaugaaauggggggugagaguggaggauuguggaccaaaaaaaaaaaaauagacugaccuuguuucccaagaucauagucaauuacucuguguugggucuacaccacaucugcacauacuaugagcccuuccguuggagauaauuuucacuugcggagcugcuucacuucuaccuguaggagccucaucuccaccucucuacaguggagaggauuccacuaggcaaguuggaacuuagggacacaguucuuucuguguuguaucacagcugggcuguggcauuccccugcagccggaugaagcaauagagaaaguggaaagaugaagggaaaaaaagccuguacugacagucagcucuggccuguuacuguguaaucuuugagccagucacuucgccucucugggaauguuucuucuucucuaacaugagggcaucaaggcuguucuugcccugacauuccauauucugugucucugcagaccaccaucauggcaguggaguuugacgggggcguugugauggguucugauucccgagugucugcagggugaguaaaagugaagauguaugcauuuggaaagaagcuaauggccucaaauacacacuuuccuuacccauucaugaaaagacuggcaaacuggagccuuggaggaauggaguugaccuuccccaaaagccacuaugauaagcuauuuggugggugcuugggucucugaauuuguggaggaggaucuggggucugaauguguaugugaccugucccaguaguguacagggaugaguaaaggaauagggucugagagggggacaggagauagauuuuugagggucuucuuuccaucugugcuuagggaucaaaaagaugauucugucaagcagauaccugguuucucauuuaccauauauugaacuauuuugucucuucucccacuccuaaccaauuuccucacaugcaaaaugaguauaugggguuaggucaauauuacuga

SEQ ID NO: 20211 - RNA, 2441 nt, Homo sapiens
guugcaguuggcccaggaccuguuuccaagacucugcccccucgcacuuccgucccuccugguuuuguaaagugaugcucauaggaacccccaccccgcgugacacuacucccagcuccuggcugacuucuagucuucugguugaagcugcgccuuuagaugacacgacccuacccaccccuguuuccagcggaugcccgggccuggagguaccucuuacuguaacccaucgccaagugggcuuuugaaggcgccuguuccuuucucgcuuucuucggaagacccuugacccaucauucccccgacccccauaacgggagagcagagaagccgguccccagugugaugguccugguccaggcacuaacuguccuuuucucggaaaaggcagggggauguggaaaagagucuuguucccuccccuucgaucuguggcuuucgcuuucacuuccuccuccgagagcggacagaucucugggugcugggcggucauggcgcuacuagauguaugcggagccccccgagggcagcggccggaaucggcucucccgguugcgggaagcgggcgucgcucggacccaggacacuacaguuucucuaugcgaucuccagagcucgcuuuaccccggggaaugcaggucggggcaguagggaagccccuagggaugcagggaggcgggcgcugaggaguggagggucgccugagaggaggaggcgagagcgggagcgcgggguacagggucggggguagccuucagucccggagagcgccagacccaaagaagaggccacauggggauggggccugagaggaggaagugcaaguuaggacaaagaguuacaggugaggugggggcucccaaaggaagacaagagaacuuuccugcccuuguccacacacaaaugguggagccuuuuucaugggguuaucacaugauauaggagguguguggugucuugggaaaccuaugaaauuugccugcuggccuccucucagcaacucacuguugcgcgacuuagaacaagucacuuagucuaggucccaagccccucuucuguaaagugaggauacuguuacuaaacguguuuugugaggguugaaugcuuuaugcauggaagaaacccuuuaagucacucucaaaauuuuuuaguaaugguaacaugugcuugcuuucauuucuguugugcuggaaaauggaaaagguugauacuggcaugccucuucuuuuccuucucccaagccauuuccuucuagagauugguuauuaacuguuucauuuauugaugguuagaucauuucugcauaucuccucacccucauacucccuaaaaccuuuuccuggagccucuuacuacagaauuuuucauugccuuucucaaccucuuuucucuuaucagcccacagaauucuuccagucccuggguggggacggagaaaggaacguucagauugagauggcccauggcaccaccacgcucgccuucaaguuccagcauggagugauugcagcaguggauucucgggccucagcuggguccuacauuagugaguguauacgcuccagcaggcagaaucuggggagcugggcucuccuuuccacaggaggccaacucugcaacaaaguggaaguggauauugauuuaggacacacugggggaucuauggggucaucccuucucucccaaagcuccaucuucuuccaggugccuuacgggugaacaaggugauugagauuaacccuuaccugcuuggcaccaugucuggcugugcagcagacugucaguacugggagcgccugcuggccaaggaaugcagguaagcgaggccucucaucuuccuuucuuagccuagugguuaaucccuggaucucucagaucauugcuccuuacucuuguccuaugugguccaucuuagugcuaauaguauauuucacaaaacagcuuuuuggugauaagacccuucucccaaaucucagccugugcuccacucauaagccagauaguacgucagguauuuagcacugacacauccacccuggcgggacaguaucauuuacuaggcugccuuuguauguuucagauacuuuaaauuccaaaucuuucucugaucuuuagauccuacaaaauaauuccuuuccaaugcuuaucucuuuaaucauuuccugccccaucaaguuggaaagagcuaaccucucuuuccucacuccaccuuguccucacccaggcuguacuaucugcgaaauggagaacguauuucagugucggcagccuccaagcugcuguccaacaugaugugccaguaccggggcaugggccucucuaugggcaguaugaucuguggcugggauaagaaggugggugcucuccauucuucauguucccccaccauguucccuauggaugacagaucuguuucccaucauauacuccuacucccuccc

SEQ ID NO: 20212 - RNA, 2441 nt, Homo sapiens
gggagggaguaggaguauaugaugggaaacagaucugucauccauagggaacauggugggggaacaugaagaauggagagcacccaccuucuuaucccagccacagaucauacugcccauagagaggcccaugccccgguacuggcacaucauguuggacagcagcuuggaggcugccgacacugaaauacguucuccauuucgcagauaguacagccugggugaggacaagguggagugaggaaagagagguuagcucuuuccaacuugauggggcaggaaaugauuaaagagauaagcauuggaaaggaauuauuuuguaggaucuaaagaucagagaaagauuuggaauuuaaaguaucugaaacauacaaaggcagccuaguaaaugauacugucccgccaggguggaugugucagugcuaaauaccugacguacuaucuggcuuaugaguggagcacaggcugagauuugggagaagggucuuaucaccaaaaagcuguuuugugaaauauacuauuagcacuaagauggaccacauaggacaagaguaaggagcaaugaucugagagauccagggauuaaccacuaggcuaagaaaggaagaugagaggccucgcuuaccugcauuccuuggccagcaggcgcucccaguacugacagucugcugcacagccagacauggugccaagcagguaaggguuaaucucaaucaccuuguucacccguaaggcaccuggaagaagauggagcuuugggagagaagggaugaccccauagaucccccaguguguccuaaaucaauauccacuuccacuuuguugcagaguuggccuccuguggaaaggagagcccagcuccccagauucugccugcuggagcguauacacucacuaauguaggacccagcugaggcccgagaauccacugcugcaaucacuccaugcuggaacuugaaggcgagcgugguggugccaugggccaucucaaucugaacguuccuuucuccguccccacccagggacuggaagaauucugugggcugauaagagaaaagagguugagaaaggcaaugaaaaauucuguaguaagaggcuccaggaaaagguuuuagggaguaugagggugaggagauaugcagaaaugaucuaaccaucaauaaaugaaacaguuaauaaccaaucucuagaaggaaauggcuugggagaaggaaaagaagaggcaugccaguaucaaccuuuuccauuuuccagcacaacagaaaugaaagcaagcacauguuaccauuacuaaaaaauuuugagagugacuuaaaggguuucuuccaugcauaaagcauucaacccucacaaaacacguuuaguaacaguauccucacuuuacagaagaggggcuugggaccuagacuaagugacuuguucuaagucgcgcaacagugaguugcugagaggaggccagcaggcaaauuucauagguuucccaagacaccacacaccuccuauaucaugugauaaccccaugaaaaaggcuccaccauuuguguguggacaagggcaggaaaguucucuugucuuccuuugggagcccccaccucaccuguaacucuuuguccuaacuugcacuuccuccucucaggccccauccccauguggccucuucuuugggucuggcgcucuccgggacugaaggcuacccccgacccuguaccccgcgcucccgcucucgccuccuccucucaggcgacccuccacuccucagcgcccgccucccugcaucccuaggggcuucccuacugccccgaccugcauuccccgggguaaagcgagcucuggagaucgcauagagaaacuguaguguccuggguccgagcgacgcccgcuucccgcaaccgggagagccgauuccggccgcugcccucggggggcuccgcauacaucuaguagcgccaugaccgcccagcacccagagaucuguccgcucucggaggaggaagugaaagcgaaagccacagaucgaaggggagggaacaagacucuuuuccacaucccccugccuuuuccgagaaaaggacaguuagugccuggaccaggaccaucacacuggggaccggcuucucugcucucccguuaugggggucgggggaaugaugggucaagggucuuccgaagaaagcgagaaaggaacaggcgccuucaaaagcccacuuggcgauggguuacaguaagagguaccuccaggcccgggcauccgcuggaaacagggguggguagggucgugucaucuaaaggcgcagcuucaaccagaagacuagaagucagccaggagcugggaguagugucacgcgggguggggguuccuaugagcaucacuuuacaaaaccaggagggacggaagugcgagggggcagagucuuggaaacagguccugggccaacugcaac

SEQ ID NO: 20213 - RNA, 5113 nt, Homo sapiens
cugagucuucaagggauaaaaggcagacaugguuaggaaggggcucagagauagcuuccaggaugaucaucuauauacuuauuauugauuaacagggauagggagcaacugguccaagacucauuccauuuacuaauaugccuagaaguaguuaggucucaggaugaacuuaccaaugaugagggcugugcuacugucuuagcuagauacucuaauaauaaugcuacauuaugcucucagaaugauguugaacuuuucaaaaauauuuccacaacuacaauaccaucauaacccuacuaugccuucuuagaguuagguggggaagacuguaauaauuucuuagaggcaaaaggaaguugugauuggagucaacacaacuuagugggagaguguguaauuuugguuuuagccguggaaaucaccaacuacagggcauacguugaugagagcugagggaugguggauagguugcuuuguccccacacucucuccuuggucaagguaccagaaauccucacacugugauuccuccauaacuuuauagcaugaaaagagaggcgugagggauccagauguagccacaccaucagccuacucuccucaaggucagccuguagucaggacuagaaucccgacacuaacauauguuuuugaccccaagcuucccaucugaaggugguguguucaggcaaacagacuaggauggaaagaacaaugaauuaagggucaagaaauccagguuccucaugaacuucagcuuugcuauguggccuugggagcauugcuuuucugguccuaaguuuucugcucuguaaaaugugauauacaagauggaucuuggauugcaagacaucagaaccacuucuagugcucauggucugagaucccaaaugccuuugugcagccacaggaaggugaacgagaacaguuugucaguucuuuucagccaggaaacagauaccagccaacggguuuccccagagucucuuaagaaaaccuucaaaggaaaagguagccagugacguggccuguaccagcagcacuugaagcuucuggucuucuugacacuuuacauccucaaucucaucucucuccgugcucagagcuuccagucgacuccugagacgauccuguggggagaagaauggguggauagaggugacugaauuaauaauucaacucacaauuauuaacuaucacauccugggcacacuguugagugcugagggguucaaagguggaaaaggcccaguccuugcccuaaagagaccaccaucucaggaagaagucaaugucaagugauuaaaauacagauagauaaaugcaauaguccagggguacacacagugagaugggaacacagaggucagcucugccuguaggccuaagggaagguuuggaaagcagaaaacauuuacaaugugccuugaaagauaaauuuccaguugaauagagagggagagaaaaggacuuagugcccacagaugugaaggaccucuucaaggagaacuacaaaccacugcucaaggaaaucagagagaacacagacaaauggaaaaacauuccaugcucauggauaggaagaaucaauauugugaaaauggccauacugcccaaaguaauuuauagauucaguguuaucccuaucaagcuaccauugacuuucuucacagaauuagaaaaaacuacuuuauauuucauauggaaccaauaaagagcccacauagccaauacaaucuuaagcaaaaagaaugaagcuggaggcaucaugcuaccugacuucaaacuauacuacaaggcuguaguauaugauaucaaauaugucugguaucaaaacagacauauagacaaauggaacagaagaagggccucagaaauaacaccacacaucuacaaccaucugaucuuugacaaaccugacaaaaacaagcaauggggaaaggauucccuauuuaauaaaugguguugggaaaacuggcuagccauaugcagaaaacugaaacuggaccccuuccuuacaccugaaauaaaaauuaacucaagauggauuaaagacuuaaacguaagaccuaaaaccauaaaaacccuagaagaaaaccuaggcaauaccauucaggacauaggcaugggcaaagacuucaugacuagaacaccaaaagcaauggcaacaaaagccuaaauugacaaaugguaucuaauuaaaugaaagagcuucugcacagcaaaagaaacuaucaucagagugaacaggcaaccuacagaaugggagaaacauuuugcaaucuauccaucugacaaagggcuaauauccaaaaucuacaaagaacuuaaacaaauuuacaagaaaaaaacaaacagccccaucaaaaaguaggugaaggauaugaacagacacuucucaaaagaagacauuuauguggccaacaaaccuaugaaaagaagcucaucaucacuggucauuagagaaaugcaaaucaaaaccacaaugagauaccaucucacaccaguuagaauggugaucauuaaaaagucaggaaauaacagaugcuggagaugauguggagaaauaagaaugcuuuuacaauguuggugggaguguaaauuaguucaaccguuguggaagacaguguggcaacuccucaagaaucuagaaugagaaauaccauuugaccuggcaaucccauuacuggguauauacccagaggauuauaaauuauccuacuguaaagacacaugcacacauauguuuauugcagcacuguucacaauagcaaagacuuggaaccaacccaaauguccaucaaugauagacuggauaaagaaaauauggcacauauaugccauggaauacuaugcaggcauaaaaaagauguguucauguccuuugcagggauauggaugaagcuggaaaccaucauucucagcaaacuaacacaggaacagaaaaccaaacaccacauguucuuacucauaagugggaggugaacaaugagaacacauggacacagggaggggaacaucacacaucggggccugucagggcuugggggacuaggggagggauagcauuaggagaaauaccuaauguagaugauggauugaugggugcagcaaaccaccauggcacguauauaccuauguaacaaaccugcacguucugcauauguaucccagaacauguauaauaaaaaaaaaaagaaaaggacuuagugccccugaauuguauacuuaaaaacagagagagaggugggaggaagggagaagaguauucuaggaggaagagacuaugugcaaaaaguauuggaagcaggaaugaauaagacaacucaggaaaaaacagcaagugcagcucagucuggccagacacguggugccuugaggagggaggcugagcgaugaggccggacagggaggaaggaucccgacugcaaagggccuugaaugucuugcuaaagaccuuggacuuucuuugggcacuagguauacaugggaggauuuugugcagaugagugacuuuguguuuuaggaggaucugucucccagcagauuggaaggugacuggaaagggugagaauggagacaggaaaugccauggagacugcaaagucugcgcaagagauagggagaaccuggcugugaggauaaggcagaauuaaagauuugggagauguuucuaagguaaccacuuccagaccuggugacuggaugacaagagagagaucugagaggcugacaggaaagugccccaaggccagauggggaauucucacaauucuggacuacugccacccucccuuucucaagaagaagagcagugcuagcagguuccccuucccagcuccucccuccccucugcgcccuggcagucagggcccuauaaaccccauuuccagucuggauccugggagaacaaguuuacccugcccauaaucugcagaagaucccacucggcauuggagcuuucuuuccauagugagugaagccaaggcuacaguucuuugcacuccaccucugugggguccucugagagcuggagcugaaguuccccccagaccaggaacuaccacacauccaaguggagcccuaucugccuucagucugggaaugccucgaaagucccuguaaccuuaggguucccugauguggaagccuuucauccagauccccgcccgauuuccuccccucauaacaggacaucauccugccccaaacaggcccuagguaaagcuacacuucuuacccgguagggcugaauggccucguccaggaaccccacggugugcgccuggugcgugggacccucccugcagaacacacagaggaacucggcaucguucucgcagaagaaguagaucuucucgccgugcuccucgcaguaaguuucucccagcgggcccaggggcacaggggccaugggagucucugccugcuccuccucuuggcagagcgggcagagcaggaucuugcccgaggauugggcccccaucugggagagcgcggggaggcagagccggcagaagguguguccacagggaauggucaccgcauccuccagcggccccgcacagaggguacaggcaggcagcucauggaccaccuucagggacgggguugcgggcaucacggugccuuccccagcccguccacuccggucuccucagcccacgcgaguucccuuucccugaaaucgagucacacuuacaugaaucgcagagggaaacggcugcaaggcuaagagacagagagagagaaagagagagagaggcaagaaugccagcacagggaagccaccuggcuccgccucuuguguucccuagaacccuggccaccaccuaucagcggaguggguccaaauuccagggcgucucgaauuacccagaauuucccaguggcggccaaguaagccaguucuuuacuccuggcuccuucuggucccuaggguggagaacagagcacaccaugaggucacagggggauggguuuccuggaaucuguagaccacaguggcuggggagaacuggggagcagaagcuuccugucagauugagcaggugggagccauaaacuucuggcucugaggcgugcccacagcaucaaaguccaggcuggagug

SEQ ID NO: 20214 - RNA, 5113 nt, Homo sapiens
cacuccagccuggacuuugaugcugugggcacgccucagagccagaaguuuauggcucccaccugcucaaucugacaggaagcuucugcuccccaguucuccccagccacuguggucuacagauuccaggaaacccaucccccugugaccucauggugugcucuguucuccacccuagggaccagaaggagccaggaguaaagaacuggcuuacuuggccgccacugggaaauucuggguaauucgagacgcccuggaauuuggacccacuccgcugauaggugguggccaggguucuagggaacacaagaggcggagccagguggcuucccugugcuggcauucuugccucucucucucuuucucucucucugucucuuagccuugcagccguuucccucugcgauucauguaagugugacucgauuucagggaaagggaacucgcgugggcugaggagaccggaguggacgggcuggggaaggcaccgugaugcccgcaaccccgucccugaaggugguccaugagcugccugccuguacccucugugcggggccgcuggaggaugcggugaccauucccuguggacacaccuucugccggcucugccuccccgcgcucucccagaugggggcccaauccucgggcaagauccugcucugcccgcucugccaagaggaggagcaggcagagacucccauggccccugugccccugggcccgcugggagaaacuuacugcgaggagcacggcgagaagaucuacuucuucugcgagaacgaugccgaguuccucuguguguucugcagggagggucccacgcaccaggcgcacaccgugggguuccuggacgaggccauucagcccuaccggguaagaaguguagcuuuaccuagggccuguuuggggcaggaugauguccuguuaugaggggaggaaaucgggcggggaucuggaugaaaggcuuccacaucagggaacccuaagguuacagggacuuucgaggcauucccagacugaaggcagauagggcuccacuuggaugugugguaguuccuggucuggggggaacuucagcuccagcucucagaggaccccacagagguggagugcaaagaacuguagccuuggcuucacucacuauggaaagaaagcuccaaugccgagugggaucuucugcagauuaugggcaggguaaacuuguucucccaggauccagacuggaaaugggguuuauagggcccugacugccagggcgcagaggggagggaggagcugggaaggggaaccugcuagcacugcucuucuucuugagaaagggaggguggcaguaguccagaauugugagaauuccccaucuggccuuggggcacuuuccugucagccucucagaucucucucuugucauccagucaccaggucuggaagugguuaccuuagaaacaucucccaaaucuuuaauucugccuuauccucacagccagguucucccuaucucuugcgcagacuuugcagucuccauggcauuuccugucuccauucucacccuuuccagucaccuuccaaucugcugggagacagauccuccuaaaacacaaagucacucaucugcacaaaauccucccauguauaccuagugcccaaagaaaguccaaggucuuuagcaagacauucaaggcccuuugcagucgggauccuuccucccuguccggccucaucgcucagccucccuccucaaggcaccacgugucuggccagacugagcugcacuugcuguuuuuuccugaguugucuuauucauuccugcuuccaauacuuuuugcacauagucucuuccuccuagaauacucuucucccuuccucccaccucucucucuguuuuuaaguauacaauucaggggcacuaaguccuuuucuuuuuuuuuuuauuauacauguucugggauacauaugcagaacgugcagguuuguuacauagguauauacgugccauggugguuugcugcacccaucaauccaucaucuacauuagguauuucuccuaaugcuaucccuccccuagucccccaagcccugacaggccccgaugugugauguuccccucccuguguccauguguucucauuguucaccucccacuuaugaguaagaacaugugguguuugguuuucuguuccuguguuaguuugcugagaaugaugguuuccagcuucauccauaucccugcaaaggacaugaacacaucuuuuuuaugccugcauaguauuccauggcauauaugugccauauuuucuuuauccagucuaucauugauggacauuuggguugguuccaagucuuugcuauugugaacagugcugcaauaaacauaugugugcaugugucuuuacaguaggauaauuuauaauccucuggguauauacccaguaaugggauugccaggucaaaugguauuucucauucuagauucuugaggaguugccacacugucuuccacaacgguugaacuaauuuacacucccaccaacauuguaaaagcauucuuauuucuccacaucaucuccagcaucuguuauuuccugacuuuuuaaugaucaccauucuaacuggugugagaugguaucucauugugguuuugauuugcauuucucuaaugaccagugaugaugagcuucuuuucauagguuuguuggccacauaaaugucuucuuuugagaagugucuguucauauccuucaccuacuuuuugauggggcuguuuguuuuuuucuuguaaauuuguuuaaguucuuuguagauuuuggauauuagcccuuugucagauggauagauugcaaaauguuucucccauucuguagguugccuguucacucugaugauaguuucuuuugcugugcagaagcucuuucauuuaauuagauaccauuugucaauuuaggcuuuuguugccauugcuuuugguguucuagucaugaagucuuugcccaugccuauguccugaaugguauugccuagguuuucuucuaggguuuuuaugguuuuaggucuuacguuuaagucuuuaauccaucuugaguuaauuuuuauuucagguguaaggaagggguccaguuucaguuuucugcauauggcuagccaguuuucccaacaccauuuauuaaauagggaauccuuuccccauugcuuguuuuugucagguuugucaaagaucagaugguuguagaugugugguguuauuucugaggcccuucuucuguuccauuugucuauaugucuguuuugauaccagacauauuugauaucauauacuacagccuuguaguauaguuugaagucagguagcaugaugccuccagcuucauucuuuuugcuuaagauuguauuggcuaugugggcucuuuauugguuccauaugaaauauaaaguaguuuuuucuaauucugugaagaaagucaaugguagcuugauagggauaacacugaaucuauaaauuacuuugggcaguauggccauuuucacaauauugauucuuccuauccaugagcauggaauguuuuuccauuugucuguguucucucugauuuccuugagcagugguuuguaguucuccuugaagagguccuucacaucugugggcacuaaguccuuuucucucccucucuauucaacuggaaauuuaucuuucaaggcacauuguaaauguuuucugcuuuccaaaccuucccuuaggccuacaggcagagcugaccucuguguucccaucucacuguguguaccccuggacuauugcauuuaucuaucuguauuuuaaucacuugacauugacuucuuccugagaugguggucucuuuagggcaaggacugggccuuuuccaccuuugaaccccucagcacucaacagugugcccaggaugugauaguuaauaauugugaguugaauuauuaauucagucaccucuauccacccauucuucuccccacaggaucgucucaggagucgacuggaagcucugagcacggagagagaugagauugaggauguaaagugucaagaagaccagaagcuucaagugcugcugguacaggccacgucacuggcuaccuuuuccuuugaagguuuucuuaagagacucuggggaaacccguuggcugguaucuguuuccuggcugaaaagaacugacaaacuguucucguucaccuuccuguggcugcacaaaggcauuugggaucucagaccaugagcacuagaagugguucugaugucuugcaauccaagauccaucuuguauaucacauuuuacagagcagaaaacuuaggaccagaaaagcaaugcucccaaggccacauagcaaagcugaaguucaugaggaaccuggauuucuugacccuuaauucauuguucuuuccauccuagucuguuugccugaacacaccaccuucagaugggaagcuuggggucaaaaacauauguuagugucgggauucuaguccugacuacaggcugaccuugaggagaguaggcugaugguguggcuacaucuggaucccucacgccucucuuuucaugcuauaaaguuauggaggaaucacagugugaggauuucugguaccuugaccaaggagagaguguggggacaaagcaaccuauccaccaucccucagcucucaucaacguaugcccuguaguuggugauuuccacggcuaaaaccaaaauuacacacucucccacuaaguuguguugacuccaaucacaacuuccuuuugccucuaagaaauuauuacagucuuccccaccuaacucuaagaaggcauaguaggguuaugaugguauuguaguuguggaaauauuuuugaaaaguucaacaucauucugagagcauaauguagcauuauuauuagaguaucuagcuaagacaguagcacagcccucaucauugguaaguucauccugagaccuaacuacuucuaggcauauuaguaaauggaaugagucuuggaccaguugcucccuaucccuguuaaucaauaauaaguauauagaugaucauccuggaagcuaucucugagccccuuccuaaccaugucugccuuuuaucccuugaagacucag

SEQ ID NO: 20215 - RNA, 2576 nt, Homo sapiens
cggccggcucggugcgccgggcucggggaggaggagaucgggaagagguggaggcgugugagggagggaggaagggcccggccgcccgagagggggagggggaggcggagggggccggccgggccggggagggggggcagccaaugagcggcgcgcggcgcguggggguggggggaaggucugggggaggagguaggaugggggagggcgcagcccgagcggcugaggcuccagccauaaacaagcgcccggaggagcggcgcaggagugaggcgagcggggcgcgcggagcggacgccgcggaucuugugcugcgccaccgcgcccacucggcagcucgggaggcggggaccggcccggaggcugcgccgcugcggggccggccgacucggaggaggagagggaggaggcgccgccggcccgggcuggagccgagcgcagcagccaccgccgccgccgcgccagaaguuuggguugaaccggagcugccgggaggaaacuuuuuucuuuuuucccccucccucccgggaggaggaggaggaggaggaggggaagcugccgccggcgccaaggcucgugggcucggggucggcgcggcccgcagaaggggcgggggccucgccccgcgaggggaggcgcgccccgggggccccgagaggggcggugaggaccgcgggcugcuggugcggcggcggcggcgcgugugccccgcgcaggggagggcgcccgccccgcucccggcccggcugcgaggaggaggcggcggcggcgcaggaggauguacuugguggcgggggacaggggguuggccggcugcgggcaccuccuggucucgcugcuggggcugcugcugcugcuggcgcgcuccggcacccgggcgcuggucugccugcccugugacgaguccaagugcgaggagcccaggaacugcccggggagcaucgugcagggcgucugcggcugcugcuacacgugcgccagccagaggaacgagagcugcggcggcaccuucgggauuuacggaaccugcgaccgggggcugcguugugucauccgccccccgcucaauggcgacucccucaccgaguacgaagcgggcguuugcgaagguacggccgcccgcugcgggcccccucccaccuggccugcgccgcccccucggcgcugguugugccgaacaaaguuugggcgagacuuucuggaggaaagagggcucugcgggaagaggggcggccgccgcccccaggagagugcccccgcggcccugcguucccucuccuuguuccccccgacgcuuaggcagucgcgggcgagguuggguauggugggugggggcgagcgaguggaggaucgccccuguccccgcgcagacgcgcacacguguggccguuccugcugggacuggguggcccggccuugcuccccgaggugggggcgccgcgggcggggggcacugcagauucugccgcgcgcgagccccucggggagcccggcccuaccgcccuccccgcacuggcgcaguguggcaccgugagccgcacgccggccgcgaaaguccuuuuucuguuggcggaggagacgugucuccagcucgcacuccccgagugacucuuauuauuuuuuccuugagcucuuccuucaccccuuccuccuccuccgcagauaaaucaguuucagccgcggaauaugucagcccaggggaaguuacacacggugguuacucauuuauuugcccauuguaaacggucaaaggcuuucucuccugaaaggaaagggggguggggguugcaccugggaguaaaaaguuguugcuauuaguggcugcuuuuuaauaucagauacccgcguguuuccugucguguugccgguuccuccuuuuuguuuguuugacagcggggauuguucugcuggcuucuccagcacgcauugugcuccgcggugucgagauugacggugggagaaacagauuagauuaguggagucuuucucguuggggagccaauguuagugcguguuggcuuuaaucccugcccgcuugcgucggccuucagggugccuggucugguuuggggucuagagcgaggcagugaguuauuuugauguggcuaacgggggcacgguucgguaagcaucaguuaaaagugggaucccugcucuggcugacguugggcugaugaugcuguuccgggggcauccuggcgagugagcagagcgcacgcagcagccucguuucuggggaggcggcgaggagggacaggcgcccucugcccggcgugccuuccucacuacucacagccagcaccguccagggaacgguuuauuccgaagcaucuuuguguguguuuguuuaguaugcugggauacugaaaaaggaggugacagccuuaaggauaacaauggaccuauuaaaaggcuucagugcugugauucucucuaaauacgcacagacacacacauagguacuuauuuauaccugaauaguuugggguuuggacaguucaggaaaauaggggaggguuuucugguuuggaagcuagugggcagugaugagugaagggaacucuucucagagggga

SEQ ID NO: 20216 - RNA, 2576 nt, Homo sapiens
uccccucugagaagaguucccuucacucaucacugcccacuagcuuccaaaccagaaaacccuccccuauuuuccugaacuguccaaaccccaaacuauucagguauaaauaaguaccuaugugugugucugugcguauuuagagagaaucacagcacugaagccuuuuaauagguccauuguuauccuuaaggcugucaccuccuuuuucaguaucccagcauacuaaacaaacacacacaaagaugcuucggaauaaaccguucccuggacggugcuggcugugaguagugaggaaggcacgccgggcagagggcgccugucccuccucgccgccuccccagaaacgaggcugcugcgugcgcucugcucacucgccaggaugcccccggaacagcaucaucagcccaacgucagccagagcagggaucccacuuuuaacugaugcuuaccgaaccgugcccccguuagccacaucaaaauaacucacugccucgcucuagaccccaaaccagaccaggcacccugaaggccgacgcaagcgggcagggauuaaagccaacacgcacuaacauuggcuccccaacgagaaagacuccacuaaucuaaucuguuucucccaccgucaaucucgacaccgcggagcacaaugcgugcuggagaagccagcagaacaauccccgcugucaaacaaacaaaaaggaggaaccggcaacacgacaggaaacacgcggguaucugauauuaaaaagcagccacuaauagcaacaacuuuuuacucccaggugcaacccccaccccccuuuccuuucaggagagaaagccuuugaccguuuacaaugggcaaauaaaugaguaaccaccguguguaacuuccccugggcugacauauuccgcggcugaaacugauuuaucugcggaggaggaggaaggggugaaggaagagcucaaggaaaaaauaauaagagucacucggggagugcgagcuggagacacgucuccuccgccaacagaaaaaggacuuucgcggccggcgugcggcucacggugccacacugcgccagugcggggagggcgguagggccgggcuccccgaggggcucgcgcgcggcagaaucugcagugccccccgcccgcggcgcccccaccucggggagcaaggccgggccacccagucccagcaggaacggccacacgugugcgcgucugcgcggggacaggggcgauccuccacucgcucgcccccacccaccauacccaaccucgcccgcgacugccuaagcgucggggggaacaaggagagggaacgcagggccgcgggggcacucuccugggggcggcggccgccccucuucccgcagagcccucuuuccuccagaaagucucgcccaaacuuuguucggcacaaccagcgccgagggggcggcgcaggccaggugggagggggcccgcagcgggcggccguaccuucgcaaacgcccgcuucguacucggugagggagucgccauugagcggggggcggaugacacaacgcagcccccggucgcagguuccguaaaucccgaaggugccgccgcagcucucguuccucuggcuggcgcacguguagcagcagccgcagacgcccugcacgaugcuccccgggcaguuccugggcuccucgcacuuggacucgucacagggcaggcagaccagcgcccgggugccggagcgcgccagcagcagcagcagccccagcagcgagaccaggaggugcccgcagccggccaacccccugucccccgccaccaaguacauccuccugcgccgccgccgccuccuccucgcagccgggccgggagcggggcgggcgcccuccccugcgcggggcacacgcgccgccgccgccgcaccagcagcccgcgguccucaccgccccucucggggcccccggggcgcgccuccccucgcggggcgaggcccccgccccuucugcgggccgcgccgaccccgagcccacgagccuuggcgccggcggcagcuuccccuccuccuccuccuccuccucccgggagggagggggaaaaaagaaaaaaguuuccucccggcagcuccgguucaacccaaacuucuggcgcggcggcggcgguggcugcugcgcucggcuccagcccgggccggcggcgccuccucccucuccuccuccgagucggccggccccgcagcggcgcagccuccgggccgguccccgccucccgagcugccgagugggcgcgguggcgcagcacaagauccgcggcguccgcuccgcgcgccccgcucgccucacuccugcgccgcuccuccgggcgcuuguuuauggcuggagccucagccgcucgggcugcgcccucccccauccuaccuccucccccagaccuuccccccacccccacgcgccgcgcgccgcucauuggcugcccccccuccccggcccggccggcccccuccgccucccccucccccucucgggcggccgggcccuuccucccucccucacacgccuccaccucuucccgaucuccuccuccccgagcccggcgcaccgagccggccg

SEQ ID NO: 20217 - RNA, 2420 nt, Homo sapiens
caagauaggagaccggaggggucggggcaccgcuggguggggcgcgugcgcgugucgcagcccucacugugagucccuuuaccgacgcgaucuugguuuugagggguggggaccuggagcgaaaccccaaacccggggcccugcuugcaaacucagcauauucugucucuacuccgccuuuuucagaggagaaaagaccuggcccacgccucccagaggcuuuaccuggugaagaggaggagcagccacugcagcgcgguggacaggguguccuggcuggcgccgaagaugucagugauaguggccgguacguucuccaaauccagccgcgcgccaccaccgugcgaguccccggccgccuucuuuuccgcagagaggauaaaggcguccaucaugucgcggggggcggccccgggccgaaggcuuucgcagugccucaagaacuuguccaggaugaaguugcugaaguugcgguugagcugcucgaauucgcggaaaacggugcgcaccggguuggggaaguacugcagccagggcaucacguccaccaggcugcccgcgcccaccgugcgcccgaacucuucguuguggcugagcagcucacggaacucggggucgucguggcuguagcggcagccgaaacacacggcacucaugacguuggccacggccacgacggucagcggccucgggucgaggaaggcgccguccgcgcugccgcgcaccagcagcgccaccagcucgcgcgccucgcucagcacguggcccucgaggacuuggcggcugcgcggcuggcgcgugaagaaguugcgcaucaugcugugggcugcgcgccgcugcaccuuccagugcuccgaguaguggccgaaagccaugcugcggccgccggacaccacacggaaggaggcgaaggccggccggucggcgaaggccgagcccugcugcaccagggccugguggauggcgcgcucgccauucagcaccacuauggggcagcugcccaggcggaucuggaaaacgucgccguagcgccgcgccaggcgagcgaacgagaggugagccgccuggcccaccgccgccgcguuuccgaucaguggccacgcaaacgggcccgggggcgcggaccggagcugccgccuccguugccucagcagccgcuggcccacaugcacaguggccagcaccgacaggaguagcaggagcguggucugcuggauggacagcggguuuagcggccaagggucguucgggcugaggcuggugcccaugcuggggacagagaggagaaggcgugacacucaggggugcagagacaggagcgggcgccccacgccccuaccccagccucuggggacugagugccguuggguggagaggucggagcugacucucuggagaaauggccgaagacgccccuucccauccccaacccacucucccuuggagaagagaaggggcguguuuccaccucgcuguaacccagcgccaaacccuuccccuccccgcaaggcgcguaacgguuccugcaaucuggggacaacgcugcgggcaucgaggcgguggcgcuugauuuccuuuaaaguaccuaccacgccacccgcuaccuguaauaauccaucugaagaggucgccgggcagcgccucggcagacagacugaccugcggggaggugcgguuuccaguggcgcgggacagccggcuccgagaaggaacugggaccuuugccuagggcaagacgucaacaggaacccgcagcccggccuggacaccugcugcccucacuggaagcuuuaacucccacucgagucucuuggcgucgucagugccaggagcgcuuggauugggauggggacggagaagggugccucgcucgccgagccccgcugcccuuggggaccuggcaaagucgagguuuccucacagcguugagauugagacugggggucggugaguggcgucaauucccaugcccuugcggcucucacaacuggagucgcagaagcgcucgcucccacucccacuccagagucaaagcgcgccaucccgcuccuccggguuuuaaggacuggguagaaggagggcagcgcgaccuggcagggcggggccugcggggggcggggcgcgccgcacaccaggccgcuuugacccggacucccguccaggcgcaccggccggccucggagcucuaccagcaggcuuucaugggagcggaggugcccacguuuccauugugcgguaaccgcgcuucaucacagccaccuccaaucgaggccgcacgguguccccagaaccacgcucgguacaaccugccccggccgcugcgcucgacuugggagcgcgccccgccccgagcgcacgaccucccuucccucuccgcgacuugagcuugcuucccggaaagccaguguaguggcagcggu

SEQ ID NO: 20218 - RNA, 2420 nt, Homo sapiens
accgcugccacuacacuggcuuuccgggaagcaagcucaagucgcggagagggaagggaggucgugcgcucggggcggggcgcgcucccaagucgagcgcagcggccggggcagguuguaccgagcgugguucuggggacaccgugcggccucgauuggagguggcugugaugaagcgcgguuaccgcacaauggaaacgugggcaccuccgcucccaugaaagccugcugguagagcuccgaggccggccggugcgccuggacgggaguccgggucaaagcggccuggugugcggcgcgccccgccccccgcaggccccgcccugccaggucgcgcugcccuccuucuacccaguccuuaaaacccggaggagcgggauggcgcgcuuugacucuggagugggagugggagcgagcgcuucugcgacuccaguugugagagccgcaagggcaugggaauugacgccacucaccgacccccagucucaaucucaacgcugugaggaaaccucgacuuugccagguccccaagggcagcggggcucggcgagcgaggcacccuucuccguccccaucccaauccaagcgcuccuggcacugacgacgccaagagacucgagugggaguuaaagcuuccagugagggcagcagguguccaggccgggcugcggguuccuguugacgucuugcccuaggcaaaggucccaguuccuucucggagccggcugucccgcgccacuggaaaccgcaccuccccgcaggucagucugucugccgaggcgcugcccggcgaccucuucagauggauuauuacagguagcggguggcgugguagguacuuuaaaggaaaucaagcgccaccgccucgaugcccgcagcguuguccccagauugcaggaaccguuacgcgccuugcggggaggggaaggguuuggcgcuggguuacagcgagguggaaacacgccccuucucuucuccaagggagaguggguuggggaugggaaggggcgucuucggccauuucuccagagagucagcuccgaccucuccacccaacggcacucaguccccagaggcugggguaggggcguggggcgcccgcuccugucucugcaccccugagugucacgccuucuccucucuguccccagcaugggcaccagccucagcccgaacgacccuuggccgcuaaacccgcuguccauccagcagaccacgcuccugcuacuccugucggugcuggccacugugcaugugggccagcggcugcugaggcaacggaggcggcagcuccgguccgcgcccccgggcccguuugcguggccacugaucggaaacgcggcggcggugggccaggcggcucaccucucguucgcucgccuggcgcggcgcuacggcgacguuuuccagauccgccugggcagcugccccauaguggugcugaauggcgagcgcgccauccaccaggcccuggugcagcagggcucggccuucgccgaccggccggccuucgccuccuuccgugugguguccggcggccgcagcauggcuuucggccacuacucggagcacuggaaggugcagcggcgcgcagcccacagcaugaugcgcaacuucuucacgcgccagccgcgcagccgccaaguccucgagggccacgugcugagcgaggcgcgcgagcugguggcgcugcuggugcgcggcagcgcggacggcgccuuccucgacccgaggccgcugaccgucguggccguggccaacgucaugagugccguguguuucggcugccgcuacagccacgacgaccccgaguuccgugagcugcucagccacaacgaagaguucgggcgcacggugggcgcgggcagccugguggacgugaugcccuggcugcaguacuuccccaacccggugcgcaccguuuuccgcgaauucgagcagcucaaccgcaacuucagcaacuucauccuggacaaguucuugaggcacugcgaaagccuucggcccggggccgccccccgcgacaugauggacgccuuuauccucucugcggaaaagaaggcggccggggacucgcacggugguggcgcgcggcuggauuuggagaacguaccggccacuaucacugacaucuucggcgccagccaggacacccuguccaccgcgcugcaguggcugcuccuccucuucaccagguaaagccucugggaggcgugggccaggucuuuucuccucugaaaaaggcggaguagagacagaauaugcugaguuugcaagcagggccccggguuugggguuucgcuccagguccccaccccucaaaaccaagaucgcgucgguaaagggacucacagugagggcugcgacacgcgcacgcgccccacccagcggugccccgaccccuccggucuccuaucuug

SEQ ID NO: 20219 - RNA, 2677 nt, Homo sapiens
uccgaacauguacaugccuaucaguaaaacaugacagggcacaaccuuaaauuuaaaaaaugaauggaaggaggaucuuaagacagugucaaacagauaaacuauaauaugcaguuuggguuuugugccccaaaaggcugucuucuuugaaaguccauccuuagucugcuuauuccucccacugaauaugcucacuuguacuaaaaacaggaaagugcuaucaccacuucaagguaagacagucuaagaaaagacugcaauauuuucccauucauccuaguaaaguagaaaaaaaaauuuacccaaauacuguuuucuggauuuaggacaguuuagauuuuucuuuguucucaagguaaugguuuuuucccuucccauaucauagacccucugaaagucgcagugugaaucuuugcuaccaaacgguggacaagagguuugcuaacuccauacuuuguaggaaaagggggaagaaaagggcacagacauccauuauuuagagucuaucgauaaauuaaccugcuuuauaauauaacgauuccauuacagcacauaguaugccgggggcagaguguauagaauguguggagagugcacauuucaccauaacaagaauccaucuuuccaaacacuaccaaaaauuggcaaauaauucaaacugcgcuuaguucaaggcuuaauuguugaacccuaacaauaaaaguucagaaaaauguaauuagcagguugcucucugcgcaaaaguaaacuacaaagaggggacauuugucuaucucuacacgccccuccccaugccugaggauuucgcccucaagaggugcgucuaguguaagggccagaccccgcuggugccccggacaacgggguaggaguggggaccgaccggucccguaguuggccgcgccugggccucgcugggcgcgcaccccgcuggcucggucgcccggaggcggacaggacggagacgggacguauggacgggacggacagacgcgacaggacggacgggacggguagagaagcagugcguccuacccggagggcucccucccagggccggcggaguaccugcuccggucauccaggcugcgguugucggcggcugcguugcgccagucgggcaacgugcuggcgcacagcaccaccauggacacgaucacgaacaccaccgacacgcuagccaggaucugcgcggccagcgacgacgugggcuccucgaagguccgccgcaugcgcuccagccagcgccuggagggagccgccucggccccgccggggcgcgccucgucgcggcccagcacgcccggcucgucggccgaguagaagguguaggugucggacaugcggucgucgaggcggcgcuggcagcaguacucgaggugcgcgcccuccaggccccaguagaucaucucguuguagaaggagagcucgcacauccgcggcgcgaagcgcagcuugccguggccgcgcacguagagcaggaugaagccgaaggccuccgagugccggucgaagaaguacucguugcgcucgcggucguagucgucgcacaccucgagcacgucgcgcucggagcggcagccgugcagccggcucacgcggcgcagcgggaaguccuucagcagcucccgggacagcgaauaccgggcgccgcccacguucagcaccaccgaggccgccccgcugcgcccgaaggucauggcuggccgcccgggggacuuucggcccgagggccccgcugcagccccccaccccaagccgccacgcggggccugccugcccguggcugacgggggagcgcgccgucggggcccgcgcucccucggggcuccgcuccugcccuccgcuggcccgggggucccugggcucgaguaucuccggcgcugcuaguagcgcgcccuccgcccggcgguaccugcggguggccggggaguccucgccggcgccagcgcugagccccaccggcugggaacgcggcuguguccgcgccgccgacccucgcgcccgagggcugcgcacaccgaggccgcggugcccucucccaagccgcggggccgacccccugagggcugcgggcgccgaauggagccgccggggcggaauagcuccccgucuccggcgcucccugcggccgcgaauccggcggccgccccgccgccguccagaggcgagaggcaaagugagcggguucggaggcggcgaagagccggcucgcggcggcgggggcggggccucugugcaguccuccuccucgcccgccggcuccgcgcgcgccgcucaccucccuccgcgccgcccuccgcuucccgcccgcgcccgcaccuccccggcuugcucgggcugggauucccgggcgccccgcccuggaccucgggcuccccgccucgugacgccguccucccccuccgcuccggcccguaguggcggggagggguccgcagggcgggggagcggggagcccagcgccgggaugccugcucccgcguccugcccugggccaucgggaugaauugggcaguccccagggccccuuuuaacagcccugguucaaagcccaguguggacucgggugcggggacagacggcguuuggagagcuuuuuccagaaacuguccggagcccagcucggguucugacaucgccccuaaggauuucucagggaaggcaucccagccac

SEQ ID NO: 20220 - RNA, 2677 nt, Homo sapiens
guggcugggaugccuucccugagaaauccuuaggggcgaugucagaacccgagcugggcuccggacaguuucuggaaaaagcucuccaaacgccgucuguccccgcacccgaguccacacugggcuuugaaccagggcuguuaaaaggggcccuggggacugcccaauucaucccgauggcccagggcaggacgcgggagcaggcaucccggcgcugggcuccccgcucccccgcccugcggaccccuccccgccacuacgggccggagcggagggggaggacggcgucacgaggcggggagcccgagguccagggcggggcgcccgggaaucccagcccgagcaagccggggaggugcgggcgcgggcgggaagcggagggcggcgcggagggaggugagcggcgcgcgcggagccggcgggcgaggaggaggacugcacagaggccccgcccccgccgccgcgagccggcucuucgccgccuccgaacccgcucacuuugccucucgccucuggacggcggcggggcggccgccggauucgcggccgcagggagcgccggagacggggagcuauuccgccccggcggcuccauucggcgcccgcagcccucagggggucggccccgcggcuugggagagggcaccgcggccucggugugcgcagcccucgggcgcgagggucggcggcgcggacacagccgcguucccagccgguggggcucagcgcuggcgccggcgaggacuccccggccacccgcagguaccgccgggcggagggcgcgcuacuagcagcgccggagauacucgagcccagggacccccgggccagcggagggcaggagcggagccccgagggagcgcgggccccgacggcgcgcucccccgucagccacgggcaggcaggccccgcguggcggcuugggguggggggcugcagcggggcccucgggccgaaagucccccgggcggccagccaugaccuucgggcgcagcggggcggccucgguggugcugaacgugggcggcgcccgguauucgcugucccgggagcugcugaaggacuucccgcugcgccgcgugagccggcugcacggcugccgcuccgagcgcgacgugcucgaggugugcgacgacuacgaccgcgagcgcaacgaguacuucuucgaccggcacucggaggccuucggcuucauccugcucuacgugcgcggccacggcaagcugcgcuucgcgccgcggaugugcgagcucuccuucuacaacgagaugaucuacuggggccuggagggcgcgcaccucgaguacugcugccagcgccgccucgacgaccgcauguccgacaccuacaccuucuacucggccgacgagccgggcgugcugggccgcgacgaggcgcgccccggcggggccgaggcggcucccuccaggcgcuggcuggagcgcaugcggcggaccuucgaggagcccacgucgucgcuggccgcgcagauccuggcuagcgugucggugguguucgugaucguguccaugguggugcugugcgccagcacguugcccgacuggcgcaacgcagccgccgacaaccgcagccuggaugaccggagcagguacuccgccggcccugggagggagcccuccggguaggacgcacugcuucucuacccgucccguccguccugucgcgucuguccgucccguccauacgucccgucuccguccuguccgccuccgggcgaccgagccagcggggugcgcgcccagcgaggcccaggcgcggccaacuacgggaccggucgguccccacuccuaccccguuguccggggcaccagcggggucuggcccuuacacuagacgcaccucuugagggcgaaauccucaggcauggggaggggcguguagagauagacaaauguccccucuuuguaguuuacuuuugcgcagagagcaaccugcuaauuacauuuuucugaacuuuuauuguuaggguucaacaauuaagccuugaacuaagcgcaguuugaauuauuugccaauuuuugguaguguuuggaaagauggauucuuguuauggugaaaugugcacucuccacacauucuauacacucugcccccggcauacuaugugcuguaauggaaucguuauauuauaaagcagguuaauuuaucgauagacucuaaauaauggaugucugugcccuuuucuucccccuuuuccuacaaaguauggaguuagcaaaccucuuguccaccguuugguagcaaagauucacacugcgacuuucagagggucuaugauaugggaagggaaaaaaccauuaccuugagaacaaagaaaaaucuaaacuguccuaaauccagaaaacaguauuuggguaaauuuuuuuuucuacuuuacuaggaugaaugggaaaauauugcagucuuuucuuagacugucuuaccuugaaguggugauagcacuuuccuguuuuuaguacaagugagcauauucagugggaggaauaagcagacuaaggauggacuuucaaagaagacagccuuuuggggcacaaaacccaaacugcauauuauaguuuaucuguuugacacugucuuaagauccuccuuccauucauuuuuuaaauuuaagguugugcccugucauguuuuacugauaggcauguacauguucgga

SEQ ID NO: 20221 - RNA, 2493 nt, Homo sapiens
caugugcaaaccgcgcccgcugggcuggucagccgucuuuccuugccugccgaccuggacuauguggagccugggggacccucuugccucccaacaaaauccccucucuaauugcacaucccauucaacaacucugcccagggcuuuucgaauuucuggaucaacuucuuuaggaaaaagggaagaagaagucucagagacagcgguagagaaaagaggagagagagggagaagagagaagagaggagggggagguagcgagauuaagaguugcaaagauaaaaaaaauucucuuuauccccccacuucucccuccuucccugcucucccccuccccccgcccucuggcuaagugguaaaaccguccuuacguucucgguauugauuggcagggcugacagugauuggcagugguugccguggcaacgccacaacgacacgccacagaccaauagaaaagcgaaacaaaauguuucaaugcugcacucacuguggauuuaggggagauauuaugaggcuguugucauuagggcgauugcgguggaaucgcugaaucuugacucggcggugguuggcucucccucuccucucucccucucccucucccucucugucucggguucucucucugcgcgcgcgcaccgggccgcucuccuaccucccucucuauguggcugcgcggguguguguguguguggauguguguggggugugggugucccuuacgcccuuccuccucucccuccuccuccugcuccccccuccuuuccuucuccuccuccccccucuccucucccuccuccugguccucaucgccccucuccuccucuuccuccccucucucuuccucucccugaauuuucuccucuccucucaggucaguccaugguauuccgcuccccccuagaccucuauuccucccacuucuuguugccaaacuucgccgauucucaccaccgcuccauacuucuggcgaguagcggcggcgggaacggugcgggaggcggcggcggcgcgggaggcggcagcggcggcgggaacggugcgggaggcggcggugcuggcggagcaggcggcggcggcggcggcggcuccagggcccccccggaagaguuguccauguuccagcugcccacccucaacuucucgccggagcagguggccagcgucugugagacgcuggaggagacgggcgacaucgagcggcugggccgcuuccucuggucgcugcccguggcccccggggcgugcgaggccaucaacaaacacgagucgauccugcgcgcgcgcgccguggucgccuuccacacgggcaacuuccgcgaccucuaccacauccuugagaaccacaaguucaccaaggagucucacggcaagcugcaggccauguggcucgaggcgcacuaccaggaggccgagaagcugcgcggccgcccacucggcccgguggacaaguaccgcgugcgcaagaaguucccgcugccacgcaccaucugggacggcgagcagaagacgcauugcuucaaggagcggacucggagccuguugcgggagugguaccuacaggaccccuaccccaaccccagcaagaaacgcgaacuggcgcaggccaccggccucacucccacacaaguaggcaacugguuuaagaaccggcggcagcgcgaccgcgccgcggcggccaagaacagguuaguggcggggcccgcggccuggcuacagccucagaggccugggaaggggagagggguugagauggggcuagcggagcggccgcugagagccagggaagccgugacuccuggccagucggagaaaguuuccgcuuguccgggacgcgcggaagagggggccgggcuggcuguggguguauugauugcuuugaccaagaggggcuuucgucagggcagagagugugugcuugcgacccgaguacccgcagccccugggagacuuagcccugcgcugcacccgugccugccuccucagcccugccgccagcucggcgauccucuggagccuagagacagggagggaaggaaagcacucuuugccaucugguucuuauuucugugcguugcaaaaccccgagagaaauccacuagcgucagagagaggaaagugaaccugggucccuaucacaaggggaaaaggccagaggccacugcgcagcgggccuguuuccccgcaacgcugcacguugccugaccgggagcaggagagccgggcugggaguggagaggccuagcgugugcgugugcgugugugugugcacgcccgugugcauguacucgcccuccuguuucagccgaggagaaucccuuugguccucuaagcugggaagcgggcacgagcagccucguugccggcaaguuggccacaaagucacaaaauuguauagggcuugaccaacaucacaggagcugggccugggggaaggagaaaaagaaccagagggaaagaaguggauaggcgaaaggaguggggagagaa

SEQ ID NO: 20222 - RNA, 2493 nt, Homo sapiens
uucucuccccacuccuuucgccuauccacuucuuucccucugguucuuuuucuccuucccccaggcccagcuccugugauguuggucaagcccuauacaauuuugugacuuuguggccaacuugccggcaacgaggcugcucgugcccgcuucccagcuuagaggaccaaagggauucuccucggcugaaacaggagggcgaguacaugcacacgggcgugcacacacacacgcacacgcacacgcuaggccucuccacucccagcccggcucuccugcucccggucaggcaacgugcagcguugcggggaaacaggcccgcugcgcaguggccucuggccuuuuccccuugugauagggacccagguucacuuuccucucucugacgcuaguggauuucucucgggguuuugcaacgcacagaaauaagaaccagauggcaaagagugcuuuccuucccucccugucucuaggcuccagaggaucgccgagcuggcggcagggcugaggaggcaggcacgggugcagcgcagggcuaagucucccaggggcugcggguacucgggucgcaagcacacacucucugcccugacgaaagccccucuuggucaaagcaaucaauacacccacagccagcccggcccccucuuccgcgcgucccggacaagcggaaacuuucuccgacuggccaggagucacggcuucccuggcucucagcggccgcuccgcuagccccaucucaaccccucuccccuucccaggccucugaggcuguagccaggccgcgggccccgccacuaaccuguucuuggccgccgcggcgcggucgcgcugccgccgguucuuaaaccaguugccuacuugugugggagugaggccgguggccugcgccaguucgcguuucuugcugggguugggguagggguccuguagguaccacucccgcaacaggcuccgaguccgcuccuugaagcaaugcgucuucugcucgccgucccagauggugcguggcagcgggaacuucuugcgcacgcgguacuuguccaccgggccgagugggcggccgcgcagcuucucggccuccugguagugcgccucgagccacauggccugcagcuugccgugagacuccuuggugaacuugugguucucaaggaugugguagaggucgcggaaguugcccguguggaaggcgaccacggcgcgcgcgcgcaggaucgacucguguuuguugauggccucgcacgccccgggggccacgggcagcgaccagaggaagcggcccagccgcucgaugucgcccgucuccuccagcgucucacagacgcuggccaccugcuccggcgagaaguugagggugggcagcuggaacauggacaacucuuccgggggggcccuggagccgccgccgccgccgccgccugcuccgccagcaccgccgccucccgcaccguucccgccgccgcugccgccucccgcgccgccgccgccucccgcaccguucccgccgccgcuacucgccagaaguauggagcgguggugagaaucggcgaaguuuggcaacaagaagugggaggaauagaggucuaggggggagcggaauaccauggacugaccugagaggagaggagaaaauucagggagaggaagagagaggggaggaagaggaggagaggggcgaugaggaccaggaggagggagaggagaggggggaggaggagaaggaaaggaggggggagcaggaggaggagggagaggaggaagggcguaagggacacccacaccccacacacauccacacacacacacacccgcgcagccacauagagagggagguaggagagcggcccggugcgcgcgcgcagagagagaacccgagacagagagggagagggagagggagagaggagagggagagccaaccaccgccgagucaagauucagcgauuccaccgcaaucgcccuaaugacaacagccucauaauaucuccccuaaauccacagugagugcagcauugaaacauuuuguuucgcuuuucuauuggucuguggcgugucguuguggcguugccacggcaaccacugccaaucacugucagcccugccaaucaauaccgagaacguaaggacgguuuuaccacuuagccagagggcggggggagggggagagcagggaaggagggagaaguggggggauaaagagaauuuuuuuuaucuuugcaacucuuaaucucgcuaccucccccuccucucuucucucuucucccucucucuccucuuuucucuaccgcugucucugagacuucuucuucccuuuuuccuaaagaaguugauccagaaauucgaaaagcccugggcagaguuguugaaugggaugugcaauuagagaggggauuuuguugggaggcaagagggucccccaggcuccacauaguccaggucggcaggcaaggaaagacggcugaccagcccagcgggcgcgguuugcacaug

SEQ ID NO: 20223 - RNA, 2536 nt, Homo sapiens
uaugccuuugacugacagcuccuccccagauuuggauauuuaaaauccuggguaggaucucuugucaccagcuucgggaggguuuuucuuucugcuuuccugggagggagcuucccacagggcuggcagcugagaccucaccacuguggaaacuccaaccucagggucucagauaccuggaaguaucugagccugcagcacucccccuaagauguuucugguucagcacccucaccucugacccugaucauucaaacucaggguggaacacaccccauaucaccaaccccagguguccuguuuugcucuuaccccgggcuggauucuguucccauaauaaguuucucuccagguuugagguccugagggguuauagggcaggcaguggcaagggccuaaugaucaaccuuuaggcugguucaggaaguccugguuuaccugaggacauccaacucccagccccucugugccucucagcucaccgcagacauuccgaccuacccaucagagguagggccuaaggagagaggcaucaagggccuggagugccagggaagggcggcuaucucuagcaaggcagaaaacagggcaugcgucucuucucucccagaacugacacuuccucccuuucaccucuggauccuuucuaaggagauaaaggacccgcucucaacuccaugugacaacgaaaauucauggccuggcuuuuccccauccaggucauucuagggaaguuccagccccagucccgaccccaucacacuuuggccuggagcuaaggcuggggggaaaugccgggaagcaccaccagcaagaaaucugcaaauccccuuucaucugggcucaaaccccucuguccugaggaugaccagaccuacugugccugccucacaggggauacaggcccacaguucugcgcugccccgaagcucucugcuucuccacccuuuuccucuagcgaccgaguaguuaguugacaacuuccugaauugcucugcccgcuuuagacaaaucccugcucgccgggucuccggcauagaaaggccuaagcaucguccaagucaggccgggcugccgcugggcuguggccgggccugggggcccaguuuaggccucuccgggggaccggcagaagcccugcgaaccccucccuugggccccggggagcuggcgccgaagaaggucuacuuacucguaccuuuccuuggccucggccgcccggucgcgcugccgccgguucuugaaccaguugcugaccugugugguggugaggcccguggccuccgccagcucacgcuucucgcggggugaaggguagggguugugcgcguaccacucgcgcagcacgcugcgacucuuuuccuugaagcaguagcuggucuccucgccgucccagauggagcgcggcagcgggaauuugcggcgcacgcgguauuugcccacggcgcccaggggucggccgcgcagcuucuccgccucgauguagugugccuugagccacagcugcugcagcuuggcgugguugugcggcgagaacugguggcucuccaggaucuuguagagcucgcggaaguugccgcgguggaaggccaccacggccuuggccuugagcacgcuuucauucuugugaaggugcucgcaggcgggcagcgaccacaggaagcggcccagccgcucgauguugccgcccugcugcagcaccucgcacacgcacgccacuugcuccugcgugaagccgaaggugggcagcauggacauggugccggcugcguccccgcccgcccgcgcgcgcccucaccgggccgcgcggucccgcaugggagcuuccucgccgggccguccgggccgagacgcgggcggggcuggcccccuggcccggcacuggcccccggugagccccgagucacugccguacguccccgcgccggccgcgggucccacgaagcuccgaaccccaacggcccgcgcgccuggcccaagcccucgcccaagcccgggggccgcccggggcgccgcuccgcaugcuccgcgcccgcccgccguucccucgcucgcuucucacucguucucccucccgucuagcuggcucucagcuuucuuaauaauauuauucuaagcgggcaugaggcgcggcggcccgcgcccugauugguccgguuaucugacccggggccugccagcgccagacaauagucggagucaaauuauucgccauggagacgcugucagucacugguaacccgagccucggcgggccgggcggcuccccccggccggcuccgcugacagaucgccccgcuccgcgcagaacugagggcggcucuacuggagccuggggcgcucugagagccugggaggcggagaggggccggguuggggccggcggcggcggagauugacggggcggaugcccaaagagggagggaggaggaggacaggagagcggggggagcgggcgaagacgaaaagggguggaucgagguggggagagaagaggagagaagggaaggcggagaccguuuaaggggguguccag

SEQ ID NO: 20224 - RNA, 2536 nt, Homo sapiens
cuggacacccccuuaaacggucuccgccuucccuucucuccucuucucuccccaccucgauccaccccuuuucgucuucgcccgcuccccccgcucuccuguccuccuccucccucccucuuugggcauccgccccgucaaucuccgccgccgccggccccaacccggccccucuccgccucccaggcucucagagcgccccaggcuccaguagagccgcccucaguucugcgcggagcggggcgaucugucagcggagccggccggggggagccgcccggcccgccgaggcucggguuaccagugacugacagcgucuccauggcgaauaauuugacuccgacuauugucuggcgcuggcaggccccgggucagauaaccggaccaaucagggcgcgggccgccgcgccucaugcccgcuuagaauaauauuauuaagaaagcugagagccagcuagacgggagggagaacgagugagaagcgagcgagggaacggcgggcgggcgcggagcaugcggagcggcgccccgggcggcccccgggcuugggcgagggcuugggccaggcgcgcgggccguugggguucggagcuucgugggacccgcggccggcgcggggacguacggcagugacucggggcucaccgggggccagugccgggccagggggccagccccgcccgcgucucggcccggacggcccggcgaggaagcucccaugcgggaccgcgcggcccggugagggcgcgcgcgggcgggcggggacgcagccggcaccauguccaugcugcccaccuucggcuucacgcaggagcaaguggcgugcgugugcgaggugcugcagcagggcggcaacaucgagcggcugggccgcuuccuguggucgcugcccgccugcgagcaccuucacaagaaugaaagcgugcucaaggccaaggccgugguggccuuccaccgcggcaacuuccgcgagcucuacaagauccuggagagccaccaguucucgccgcacaaccacgccaagcugcagcagcuguggcucaaggcacacuacaucgaggcggagaagcugcgcggccgaccccugggcgccgugggcaaauaccgcgugcgccgcaaauucccgcugccgcgcuccaucugggacggcgaggagaccagcuacugcuucaaggaaaagagucgcagcgugcugcgcgagugguacgcgcacaaccccuacccuucaccccgcgagaagcgugagcuggcggaggccacgggccucaccaccacacaggucagcaacugguucaagaaccggcggcagcgcgaccgggcggccgaggccaaggaaagguacgaguaaguagaccuucuucggcgccagcuccccggggcccaagggagggguucgcagggcuucugccggucccccggagaggccuaaacugggcccccaggcccggccacagcccagcggcagcccggccugacuuggacgaugcuuaggccuuucuaugccggagacccggcgagcagggauuugucuaaagcgggcagagcaauucaggaaguugucaacuaacuacucggucgcuagaggaaaaggguggagaagcagagagcuucggggcagcgcagaacugugggccuguauccccugugaggcaggcacaguaggucuggucauccucaggacagagggguuugagcccagaugaaaggggauuugcagauuucuugcugguggugcuucccggcauuuccccccagccuuagcuccaggccaaagugugauggggucgggacuggggcuggaacuucccuagaaugaccuggauggggaaaagccaggccaugaauuuucguugucacauggaguugagagcggguccuuuaucuccuuagaaaggauccagaggugaaagggaggaagugucaguucugggagagaagagacgcaugcccuguuuucugccuugcuagagauagccgcccuucccuggcacuccaggcccuugaugccucucuccuuaggcccuaccucugauggguaggucggaaugucugcggugagcugagaggcacagaggggcugggaguuggauguccucagguaaaccaggacuuccugaaccagccuaaagguugaucauuaggcccuugccacugccugcccuauaaccccucaggaccucaaaccuggagagaaacuuauuaugggaacagaauccagcccgggguaagagcaaaacaggacaccugggguuggugauaugggguguguuccacccugaguuugaaugaucagggucagaggugagggugcugaaccagaaacaucuuagggggagugcugcaggcucagauacuuccagguaucugagacccugagguuggaguuuccacaguggugaggucucagcugccagcccugugggaagcucccucccaggaaagcagaaagaaaaacccucccgaagcuggugacaagagauccuacccaggauuuuaaauauccaaaucuggggaggagcugucagucaaaggcaua

SEQ ID NO: 20225 - RNA, 2751 nt, Homo sapiens
acccugcggcucuccccaguuggcuacacgcccccgccccugcagguuccccggacagguaccugcccucuuccuugccugggcgaucgauccccccaaucccuucacuccccagaacuacaaccgggaaucauucacccgcagaggcaaaggaaacgaauucccaaacgagccucuggguuucaguuugaaucugggagaggcauacuccggacugcggagcgcgaccggcgugaggccgcgcgugguucuucaaucacagcagaagacuaaagccucuaggaaccccaacucggggcgucaggagggguuggauggaagggaagauuugggguaaugugccaaccguauccacaagaccccccagcucaugagucccaggccauaccgggauuugggggauuuucguguuuucuagaucguggaugguuugguugaaacccccgcaucuucuguccgccaaggucccccggggugagguuggguucaaggacaggaaaaaguuaaguggcgucaggacgaaagcaccacuucucccccuucucucccagaaucuuccuaucaucccccaacgcgccccgggaagugcaugguccuaagguccaaggcgccaggacccagguccccagagcccucaaucagugccauucucuuccgcagcgcgggugucagccgcgagcucguagccccucgacacccgccucucucuggggucuccggggacccuuucagaggcuguaaaggugucagaagcccaaggcaggaggcagcuuggucggcgcaccucccgggccacugcugccacugucggggagagccagcagcucaccucuggggucgcggaggcccugagccucugccugccgcgcaccggcgucaggagcaaguccgcgcggccgcggagccgcagaguuacagccccaaggcgcgcggcggacuucgcccgccccaucuccucgccucgcgccucgggacagcucccguuuccuccgagcggccucagcuucgcugccagcgcccccuuugcccguccagccgcggcaugggcugcuacuccacuaacacacgcgcgcgcgcauacacacacacacacacacacacacacacacacacccuuugccucgccaagcgcccacacucgccaacgcccccgccccgcccuucggccaccgcagcagaggccacgcgugacauuuaggaccacgcgugaccaccgcgaucaaacgacggcuacggucuguguucguagggaagugaagucagaccucugcuggaugucguguguccccuaggacugcguccucccgcgcagacagguacgugccuggggugugcacauagccucggugauaagugucaaagagaauuuucgugcuugcagccccuguucuacagucaagacucgcguugguguuuucuuuuaaaaucaugcccuuagggauguguguucaugcugcuuuauuuguacaagacacccuuccccggcccggccuucuccgagccaccccagcgcguccuccuagaugcgacgacguguuuuuccuagcgaagucaucacgagguuagccaccucggacacuuccccggcagccccaagcccacgcagagaucgcagacacagacacccggcgcgcuguaggucugcaggcagcaggcucagaggcaagcgauggcaaagguccgagcgcuguccugucgcaagggguccgggggcgugugaaccacacuugcugacccucccaggacucccgcgcgcggccacccgcgccucuucucaaaucacuuaccccgauucacuccagacuguggccggggaggucacucccugcagaagugucccccucccccaacgccggcgaauaauuuuaaagcaaaggaggcgcggccaggugggcucccaagcuccgcgcagacccuugggccagccuuggccgcuacccgagcgccucuccaccagaccuuggagggaaguugggggaagggcgggagagcaccggcgcccagggcgcaggggccagagcgagccuggcguuccgccgcagccggcugagacucggcgacgcgggggcuguaccuguggcugcggggccgacggccggcugcagggcggcuggcucucccgccucgagacuaggcgcacucccauccccgccgcauguucuccacgcgggcuccagcgcgcucaccaccgccaccgccgucgucucggcuuuauuuacccagcccggcgcgcgccgcccgggaacaggaauagcgaggccuucucauguuuccugacugccggucccagccggcgaacauccugcgggcgcgguauccacguucccgggcggguggagaggaagcguccgcgcccgcccggccgcgggggcugcuguuaaccccuagcagaggagccgcugccggggagccccgggcccgccgaguccuccggagccgggcgcggcucccagauccgccggccuugcagucguggagcagacggggcuuuucccuucgcacuuuaggagagaaauuggagaagcugccgggagcgcucggcuccggcuccagaagcugagaggcugcggugcaaaucccgugucuuagcuggcccgauugccggaaauuucacugcgcguggcuaggcgggagaggccacugugacgcgcccuguauuuuccucucgauuagcuggagggaaguuagagcuccguuuugcaccuacagcccuggagcguauugcgggaagugcuagugcccaggagccuc

SEQ ID NO: 20226 - RNA, 2751 nt, Homo sapiens
gaggcuccugggcacuagcacuucccgcaauacgcuccagggcuguaggugcaaaacggagcucuaacuucccuccagcuaaucgagaggaaaauacagggcgcgucacaguggccucucccgccuagccacgcgcagugaaauuuccggcaaucgggccagcuaagacacgggauuugcaccgcagccucucagcuucuggagccggagccgagcgcucccggcagcuucuccaauuucucuccuaaagugcgaagggaaaagccccgucugcuccacgacugcaaggccggcggaucugggagccgcgcccggcuccggaggacucggcgggcccggggcuccccggcagcggcuccucugcuagggguuaacagcagcccccgcggccgggcgggcgcggacgcuuccucuccacccgcccgggaacguggauaccgcgcccgcaggauguucgccggcugggaccggcagucaggaaacaugagaaggccucgcuauuccuguucccgggcggcgcgcgccgggcuggguaaauaaagccgagacgacggcgguggcgguggugagcgcgcuggagcccgcguggagaacaugcggcggggaugggagugcgccuagucucgaggcgggagagccagccgcccugcagccggccgucggccccgcagccacagguacagcccccgcgucgccgagucucagccggcugcggcggaacgccaggcucgcucuggccccugcgcccugggcgccggugcucucccgcccuucccccaacuucccuccaaggucugguggagaggcgcucggguagcggccaaggcuggcccaagggucugcgcggagcuugggagcccaccuggccgcgccuccuuugcuuuaaaauuauucgccggcguugggggagggggacacuucugcagggagugaccuccccggccacagucuggagugaaucgggguaagugauuugagaagaggcgcggguggccgcgcgcgggaguccugggagggucagcaagugugguucacacgcccccggaccccuugcgacaggacagcgcucggaccuuugccaucgcuugccucugagccugcugccugcagaccuacagcgcgccgggugucugugucugcgaucucugcgugggcuuggggcugccggggaaguguccgagguggcuaaccucgugaugacuucgcuaggaaaaacacgucgucgcaucuaggaggacgcgcugggguggcucggagaaggccgggccggggaagggugucuuguacaaauaaagcagcaugaacacacaucccuaagggcaugauuuuaaaagaaaacaccaacgcgagucuugacuguagaacaggggcugcaagcacgaaaauucucuuugacacuuaucaccgaggcuaugugcacaccccaggcacguaccugucugcgcgggaggacgcaguccuaggggacacacgacauccagcagaggucugacuucacuucccuacgaacacagaccguagccgucguuugaucgcgguggucacgcgugguccuaaaugucacgcguggccucugcugcgguggccgaagggcggggcgggggcguuggcgagugugggcgcuuggcgaggcaaaggguguguguguguguguguguguguguguguguguaugcgcgcgcgcguguguuaguggaguagcagcccaugccgcggcuggacgggcaaagggggcgcuggcagcgaagcugaggccgcucggaggaaacgggagcugucccgaggcgcgaggcgaggagauggggcgggcgaaguccgccgcgcgccuuggggcuguaacucugcggcuccgcggccgcgcggacuugcuccugacgccggugcgcggcaggcagaggcucagggccuccgcgaccccagaggugagcugcuggcucuccccgacaguggcagcaguggcccgggaggugcgccgaccaagcugccuccugccuugggcuucugacaccuuuacagccucugaaaggguccccggagaccccagagagaggcgggugucgaggggcuacgagcucgcggcugacacccgcgcugcggaagagaauggcacugauugagggcucuggggaccuggguccuggcgccuuggaccuuaggaccaugcacuucccggggcgcguugggggaugauaggaagauucugggagagaagggggagaaguggugcuuucguccugacgccacuuaacuuuuuccuguccuugaacccaaccucaccccgggggaccuuggcggacagaagaugcggggguuucaaccaaaccauccacgaucuagaaaacacgaaaaucccccaaaucccgguauggccugggacucaugagcuggggggucuuguggauacgguuggcacauuaccccaaaucuucccuuccauccaaccccuccugacgccccgaguugggguuccuagaggcuuuagucuucugcugugauugaagaaccacgcgcggccucacgccggucgcgcuccgcaguccggaguaugccucucccagauucaaacugaaacccagaggcucguuugggaauucguuuccuuugccucugcgggugaaugauucccgguuguaguucuggggagugaagggauuggggggaucgaucgcccaggcaaggaagagggcagguaccuguccggggaaccugcaggggcgggggcguguagccaacuggggagagccgcagggu

SEQ ID NO: 20227 - RNA, 2548 nt, Homo sapiens
ucgggcucucccugggugacagagagaguguucccugcugcuuggucuccuucaggcgucaaccagcgcacgcacuuggaaacucugaacccggaggacguucuguaccucuccaugccccagagccguuuggggaagggcccaccuuaccccccgccacccccggggcacagcagcuccccauccucucgcccaacacuugcuagguaguuugggguguagaagcgaccccagcagcagcggcaccuuaggugcucgccgaaggugaacgcuggaccgccccgggaagggcuuugcucccgacuucaucccgacgcuggugcaacgggaaaaagagagagcccgcgcgaguggggccagggcgcgcaggagagggcgggcgagaaagugcccggcgagggcaggcgcgggccgagggcggggcgggcgcgggagggcgcgagaggggcgugggcgcggccgcucgcucggccgggucgggccagggggaggggcgcugggagagcgagagcggcgcgcgcggcagccccgaggcagcagagcgcggagccgggagcgcggggagcgcgggccggcggcggcgagggaggacgggggcgcagacggccggcgcgcggcgcggcuaccaugggcgugcggugagcagccgcucgggacgacuuccucggcugcgcggcgcucgcgcggagcuccccggccggcggugcguccccacggucaccaugaaagguagggcggcggcagcuccgcggggcucugggcggggggaacgggcuucggggcgcgcgggaggccacggaggugccucccgcgcgaaccuucccuugggcugcgggcccggggagucggggcugccagggcgccggguucgugcgcggacacugggggcgcacccggcucccgggucaggcgcggcuggagaccucgagguugggguuuugaagcgcgcaaguauuccccuccccaucgcgucuuugcaaguaguuugaagcccuaagucguuguuuacggauucccguuuccaacuuuuuaauugaaaaaaccugccgaggagaguggaggcaucgccaucccucccggucgcuuuuccacgccgcagcgcuccccacgcucgcccaguccucucuccucccgccucuagccguuucccggcccgagcgguccccgcgcuggcggccggguguuuucuccgggacuggggauguucuccgugcgcccucgccacaucuggcaaugauuaggugcccgaggaguucagcuggcucgggaagugcauuuggcaucuuucuccaucagauucaccgacuggaaaauaguugcccucgguuccgcgucccuuccacgugcccgccuuggggugugcccacugguguuuuggggugacacaccucagcugguuagucgcccccugcgcgguguccucugcaggccgguuuauggaagugucagauguuaucguacuuuagaaagaagcacgagaaggacugcagggcagccuucuguuuaguggaaacacggagauuugucagcggaauccugauuuauguaugagauaaguaaccgcagcggaggcaucaaagagucguucaggaaugggcccgcgugguguuuacacaaggcuucgugugagaguugcugguucugugcuaggauaacacagcccugcgugggugcgaaaugccaucugaccgcggucaccccgcuuccagccgccacagaccuggcgaugcaaucgcuuugacuucuaggguugccguccgagggaggcgcccgggaagccccaaggcgcuuggaaaguaacuuuuggcucuggaaaguuuuuuuucugaagggcagcucccgcggaacuaaccggagcgaugauauccuaccaauucacucccuuuccaagggcguuagguguccacgucgggagaccucgggaagggaggugacugauggccaggugaaaaguggucugccccagggaaaaagaaacaaaagacacgauacaacugccuaccuagagaauuucaaaaugcaguggcuugcuuuccuucugucuccaucucaguuucucuucccucauuuacauucuaggaaauacacacauuccuuagcuggcucugauugaggagacucccuagaaaggaaagaauuucacauggcuaaaaguuaucuggggcucaguuaucauuuuagccagaagugaaucuucucugcuggucauuaagaccagugguuuuuaaaacuugggaagauuaaccaccuacccacuccaucagcucccacguggguucuuaaacccugaaacuuuuguuaugcuuuuuacuggguaaaggaccgcuauugcacuugagacacuuuuccacuuuacauuugcacuggaaaacauacccagaaguccuaaacacauuuuuggagagauuuaugcugcauucuggaccagaugguggccuacccgcuguggucuagcgcugcccagaagccccauacacuuuccgccccagucggggagguugauggagggacggacuggugaauccccggguagacuaaucauuuugaa

SEQ ID NO: 20228 - RNA, 2548 nt, Homo sapiens
uucaaaaugauuagucuacccggggauucaccaguccgucccuccaucaaccuccccgacuggggcggaaaguguauggggcuucugggcagcgcuagaccacagcggguaggccaccaucugguccagaaugcagcauaaaucucuccaaaaauguguuuaggacuucuggguauguuuuccagugcaaauguaaaguggaaaagugucucaagugcaauagcgguccuuuacccaguaaaaagcauaacaaaaguuucaggguuuaagaacccacgugggagcugauggaguggguaggugguuaaucuucccaaguuuuaaaaaccacuggucuuaaugaccagcagagaagauucacuucuggcuaaaaugauaacugagccccagauaacuuuuagccaugugaaauucuuuccuuucuagggagucuccucaaucagagccagcuaaggaauguguguauuuccuagaauguaaaugagggaagagaaacugagauggagacagaaggaaagcaagccacugcauuuugaaauucucuagguaggcaguuguaucgugucuuuuguuucuuuuucccuggggcagaccacuuuucaccuggccaucagucaccucccuucccgaggucucccgacguggacaccuaacgcccuuggaaagggagugaauugguaggauaucaucgcuccgguuaguuccgcgggagcugcccuucagaaaaaaaacuuuccagagccaaaaguuacuuuccaagcgccuuggggcuucccgggcgccucccucggacggcaacccuagaagucaaagcgauugcaucgccaggucuguggcggcuggaagcggggugaccgcggucagauggcauuucgcacccacgcagggcuguguuauccuagcacagaaccagcaacucucacacgaagccuuguguaaacaccacgcgggcccauuccugaacgacucuuugaugccuccgcugcgguuacuuaucucauacauaaaucaggauuccgcugacaaaucuccguguuuccacuaaacagaaggcugcccugcaguccuucucgugcuucuuucuaaaguacgauaacaucugacacuuccauaaaccggccugcagaggacaccgcgcagggggcgacuaaccagcugaggugugucaccccaaaacaccagugggcacaccccaaggcgggcacguggaagggacgcggaaccgagggcaacuauuuuccagucggugaaucugauggagaaagaugccaaaugcacuucccgagccagcugaacuccucgggcaccuaaucauugccagauguggcgagggcgcacggagaacauccccagucccggagaaaacacccggccgccagcgcggggaccgcucgggccgggaaacggcuagaggcgggaggagagaggacugggcgagcguggggagcgcugcggcguggaaaagcgaccgggagggauggcgaugccuccacucuccucggcagguuuuuucaauuaaaaaguuggaaacgggaauccguaaacaacgacuuagggcuucaaacuacuugcaaagacgcgauggggaggggaauacuugcgcgcuucaaaaccccaaccucgaggucuccagccgcgccugacccgggagccgggugcgcccccaguguccgcgcacgaacccggcgcccuggcagccccgacuccccgggcccgcagcccaagggaagguucgcgcgggaggcaccuccguggccucccgcgcgccccgaagcccguuccccccgcccagagccccgcggagcugccgccgcccuaccuuucauggugaccguggggacgcaccgccggccggggagcuccgcgcgagcgccgcgcagccgaggaagucgucccgagcggcugcucaccgcacgcccaugguagccgcgccgcgcgccggccgucugcgcccccguccucccucgccgccgccggcccgcgcuccccgcgcucccggcuccgcgcucugcugccucggggcugccgcgcgcgccgcucucgcucucccagcgccccucccccuggcccgacccggccgagcgagcggccgcgcccacgccccucucgcgcccucccgcgcccgccccgcccucggcccgcgccugcccucgccgggcacuuucucgcccgcccucuccugcgcgcccuggccccacucgcgcgggcucucucuuuuucccguugcaccagcgucgggaugaagucgggagcaaagcccuucccggggcgguccagcguucaccuucggcgagcaccuaaggugccgcugcugcuggggucgcuucuacaccccaaacuaccuagcaaguguugggcgagaggauggggagcugcugugccccggggguggcgggggguaaggugggcccuuccccaaacggcucuggggcauggagagguacagaacguccuccggguucagaguuuccaagugcgugcgcugguugacgccugaaggagaccaagcagcagggaacacucucucugucacccagggagagcccga

SEQ ID NO: 20229 - RNA, 2570 nt, Homo sapiens
ccugguccuagggggcggccccagggucgggaugaagucuggggucgcgggcgcgggcugcgugggguuucaguuacucguggaguuucaguuacucguggacaaagcgccgcgcgcuagcauagcggcccgggcggaguuccccuucccuuucccuuuccuuccacauccgcacgcucguucucccuccgcgccuugcccuccucccgacuccuggguccggccccuucgggggaggguggggcgcucgggucuccgggucucgcgugcguguguccgagcaguccugggcggugggcgaaggcgcggcuuggggacccgggaggggccggggcgcgggggcugcaggaaguggaggcggccgccgcucggggaccggcuuggcggggugagagacacccggaaacggauuccgcuucggggcccgcgcgaguugggugcuucggagggcgcgagaggagcgggcgggugcugcugaguaauccccgcggcggcggccggacgcccaccucccacgccgcgccgcagccgggccgcggcuccucccuccgcgguccuucccuccucuucccucccgucuucuccccuccccuccccuccccucccggcuccgcuuggcuccgggcagguagagccgggcuccgggcgcgcgcggggccgcagcagcugcucccgaucucgccucggcccagcgcagggccucgcacgcccauggccggcucggagcagcagcggccgcggcggcgggacgacggagacucggacgcggcagcggcggcggcggcgccccugcaggacgcggagcuggcccuggccggcaucaacaugcugcucaacaacggcuucagggagucggaccagcuuuucaaacaauacaggugacccacgcguccccgauuccccaacccugcagcgcgcaccucguguccggcucacgcgccucgaccugcggcccccgggagcccccucccccuccugucggucaccgauuccgguccucaggucuccucccuggcaagaucagccagagggaaugcgccucugccacaucuccucguccacccccuacccccggcuccguuguccuuucccucccgggacccgccgcgcgcccgccccgcgcgcccgcagucccccucucacuuucucccagccucgcccucccacagacgugcccggugccgguaggcuccucucugcagggcagcuggcuuugggaccggaugagauuugaggcagcagcgagccugggacccgggcuugucgugacucuggcucgcgugcugccccggcagccuuugugacacggagcccuccggcugccugcuccucgcgccucgcauggcucugcaacauugugcaauuccagacgcuuuuauuguuugaaaacagauacgcacaauugcuuugccgugcaggaauuuaaaaauuucagcucaacucugcccacucaucucucugccuugucuucugcaaacucaguccucaaaaugaguuccugaugucuuucaagcaggcguuauuuauuaagaauuuuuccaacguaaauaaaggaaggaagaaaauggagggauuuuuaaaaaguaugagaaugguaggaaaacacguguguucaguuaauuuuuuauuugucuuuuaaaaaauaaagcgaaagaacugaaaccugguaguuuuccugugggaguggaaggaaccuucauuucuuuggggaccuggaguguuuguucucggguugaggaagcaaguuugugauuugccgucugauuguugacgagccuuaaggacguugauuagcagcuuuccccaacacguuuaaggaccacaugcuucacgcuauggagacccuguaguuugguuggaaugagaggaccaauguacaacugugaccgggagacagagucuguaagaaugagaaugccuaaagucucagaccucagagaauggugguuucuacccagcagagcuuccaccuucuuaauggcgaagcaaguaucucacaacugugaacuuuucacuaaagcccuuuuacuuuuaaaucggugauuuuuuccccccuuuggucugaaaguaaaaacaacuucgcuuuacuuagaacauuucauuuuuaaagcauacaggucugguuucaagauggaguuucaucaaaggcuguugaugggggauuuaaaagguuuacuugucacacaauuucucuuuuguaguuuuuaagaagcccucaggaaaaaaggugugaauauuuccuguaccgugcuaugauuccuuuuuuagacuaccaguuugugucguaugagagaaggauggagauaguuguagagucaaauuuacccuuuuuaguugaugauuuagguacuugcauguuuaaguacuucuugcuuugaagucuccugugauauuuauuuuaauggucuuuuuuaacccuucuuuaguaggcgaaaauacuaccuuuacauugaaagcaugaaauuuuugcacuaucuaagaaauuuuaugcacuguuaauagaaggcaguauaugagugguuggaaaacucucucccagcaacagcagagagaugccccuucaaagauac

SEQ ID NO: 20230 - RNA, 2570 nt, Homo sapiens
guaucuuugaaggggcaucucucugcuguugcugggagagaguuuuccaaccacucauauacugccuucuauuaacagugcauaaaauuucuuagauagugcaaaaauuucaugcuuucaauguaaagguaguauuuucgccuacuaaagaaggguuaaaaaagaccauuaaaauaaauaucacaggagacuucaaagcaagaaguacuuaaacaugcaaguaccuaaaucaucaacuaaaaaggguaaauuugacucuacaacuaucuccauccuucucucauacgacacaaacugguagucuaaaaaaggaaucauagcacgguacaggaaauauucacaccuuuuuuccugagggcuucuuaaaaacuacaaaagagaaauugugugacaaguaaaccuuuuaaaucccccaucaacagccuuugaugaaacuccaucuugaaaccagaccuguaugcuuuaaaaaugaaauguucuaaguaaagcgaaguuguuuuuacuuucagaccaaaggggggaaaaaaucaccgauuuaaaaguaaaagggcuuuagugaaaaguucacaguugugagauacuugcuucgccauuaagaagguggaagcucugcuggguagaaaccaccauucucugaggucugagacuuuaggcauucucauucuuacagacucugucucccggucacaguuguacauugguccucucauuccaaccaaacuacagggucuccauagcgugaagcaugugguccuuaaacguguuggggaaagcugcuaaucaacguccuuaaggcucgucaacaaucagacggcaaaucacaaacuugcuuccucaacccgagaacaaacacuccagguccccaaagaaaugaagguuccuuccacucccacaggaaaacuaccagguuucaguucuuucgcuuuauuuuuuaaaagacaaauaaaaaauuaacugaacacacguguuuuccuaccauucucauacuuuuuaaaaaucccuccauuuucuuccuuccuuuauuuacguuggaaaaauucuuaauaaauaacgccugcuugaaagacaucaggaacucauuuugaggacugaguuugcagaagacaaggcagagagaugagugggcagaguugagcugaaauuuuuaaauuccugcacggcaaagcaauugugcguaucuguuuucaaacaauaaaagcgucuggaauugcacaauguugcagagccaugcgaggcgcgaggagcaggcagccggagggcuccgugucacaaaggcugccggggcagcacgcgagccagagucacgacaagcccgggucccaggcucgcugcugccucaaaucucauccggucccaaagccagcugcccugcagagaggagccuaccggcaccgggcacgucugugggagggcgaggcugggagaaagugagagggggacugcgggcgcgcggggcgggcgcgcggcgggucccgggagggaaaggacaacggagccggggguaggggguggacgaggagauguggcagaggcgcauucccucuggcugaucuugccagggaggagaccugaggaccggaaucggugaccgacaggagggggagggggcucccgggggccgcaggucgaggcgcgugagccggacacgaggugcgcgcugcaggguuggggaaucggggacgcgugggucaccuguauuguuugaaaagcugguccgacucccugaagccguuguugagcagcauguugaugccggccagggccagcuccgcguccugcaggggcgccgccgccgccgcugccgcguccgagucuccgucgucccgccgccgcggccgcugcugcuccgagccggccaugggcgugcgaggcccugcgcugggccgaggcgagaucgggagcagcugcugcggccccgcgcgcgcccggagcccggcucuaccugcccggagccaagcggagccgggaggggaggggaggggaggggagaagacgggagggaagaggagggaaggaccgcggagggaggagccgcggcccggcugcggcgcggcgugggaggugggcguccggccgccgccgcggggauuacucagcagcacccgcccgcuccucucgcgcccuccgaagcacccaacucgcgcgggccccgaagcggaauccguuuccgggugucucucaccccgccaagccgguccccgagcggcggccgccuccacuuccugcagcccccgcgccccggccccucccggguccccaagccgcgccuucgcccaccgcccaggacugcucggacacacgcacgcgagacccggagacccgagcgccccacccucccccgaaggggccggacccaggagucgggaggagggcaaggcgcggagggagaacgagcgugcggauguggaaggaaagggaaagggaaggggaacuccgcccgggccgcuaugcuagcgcgcggcgcuuuguccacgaguaacugaaacuccacgaguaacugaaaccccacgcagcccgcgcccgcgaccccagacuucaucccgacccuggggccgcccccuaggaccagg

SEQ ID NO: 20231 - RNA, 2495 nt, Homo sapiens
uuucucuuuucuaaaaagagaaagaaacccuuugcuagggcucauuaaaaaugguuuuaaaauuggagccaauaaaacacgauugucaauuccuacagccuuuuuaucucagcagcauuuuuaaaaggcaucauuucucucuccccugaaauccuacuugcaacacacacagccacauuucuaacuagcaacaacagaggcagcagcaacucuccaacuucuuugucacuggugagcaggcacacagaccaacuggagcuagaagccucuccacuccuccaucccaauuuucaagugcacucuucucagaaaugggaguugcuaggcaagauucaccccaucacccugaaaucucuugcuuuacucuccuuuaaaagugaaaaggaaaggcuuuccacaacauagaaaaguuugccugggcacaugauaccagcauuuccaauagugacccuaauagacaaagcauuuuggaguucugacaucgacagggagcagaucccagucaugaagaaacaacuugagugugugacggcaagaccaugaaagccuuccuuugcaagcaucgccugggcucuucugcucacccaaggcagaacugaggagggguggggugggcauuccucaccacaggauccuuuuucuugagcaagcccaucuuaagauuuguagggagagcuggcuuagagagacuuccaaagcuacacuucuaacuguccuggccuuuggccccaucugccugucaauuucagucugaguccacaauucccauguuuacggcucuggggauaucuagaaccucggcuuuggagcgcucagggaugcugcuaggccaguucccuauugaccuuucagggacucugaaaucaacuuuccucacacacucugaauuguuugcguuuguuuucauccugccagagccacccgcccaggccacccaucucuucccuccucccugcccccuccccucccuccggccucucuggcucuaccccccccucccccgcccuccucuuuguugucuccuaccugcuggccaggcucugccugcagugcugccugaagggcaucaggugguaguucauggcguccagcagcagcuucuggcagaccgggucgguucgcaugaaauccacugacuggacccgcuccaccagcuccggggccgggaugagggcgaagcggaggcgcuucaugaggucaggcgcauacugcaugcgggucucgcggucgugcuccagccacagcacggacaucuggaagagcgccagcuccgacuccacggggggcggcagcgaguccagcagggcgcgcaucuccucgaaguugagcagcagcacauccuccaccagguacuuguuggccagcuucuuggucuccuccaggccgugcagcgcggcgaucuugcacaccugcuuguaguucugcaccgagaucuggucguugaggaacugcacgcagagcuuggugaccugggggaugugcaggaucuugcugaccgacagcaccuccuccaccguguccagggacagggucacguuggccguguagagguacucgagcaccaggcgcagcccgauggacgagcagcccugcagcaccagguuguugauggcccgggggcuggucagcagcuugucgucgggggaggaagaaggagucccgggcuccuccugcggcggcggcugcugcugcugugacggcugcugcugcggcggcugcugcugguccuugggggcccccaggccguccuggccgccgaccccucccccgagagggggguggcuggagaagagcgaucggaaguacugcgagcaggaggccagcacggccuuguggcaauggaacugcuggcccugggccgucagggucacgucgcaaaacagcugcuuccuccacagcagguugaggccgugcagcagguugucgcuguggcuggggucgaagguggagguccuguccccggaucuggacauggcgagcugacucggugcaccuggcuuuaaacccuccuccaaccuggcagacaggggugggggaugggagggaggggagcagggugguggagcgggugggguguggucgggguggggaaggguguggaggggaggggagggcgaagaacaagaaucaaggcucagcuugacucccuccuggcgcgcuccggaccccgacccuaggaggaaaguccgaagacgcuggauccgugagcgccaccagaagggcccugucuggggucccggcgccgguucugcgcccugcggcuccucucgccaccucccacacacuucgucccucacuuuccuaaaaccaaccaccucagcucggcuguuggcagcaacagcaguggcagcagcgacggcaaaguggcggcugaggccgaggcaccucgugggcucguguccaugccgggccagaugaagggaaaggccgggaaguggggagccgggggugcccugaaagcucagaggcgaccgacggcgaagguuccaggucaa

SEQ ID NO: 20232 - RNA, 2495 nt, Homo sapiens
uugaccuggaaccuucgccgucggucgccucugagcuuucagggcacccccggcuccccacuucccggccuuucccuucaucuggcccggcauggacacgagcccacgaggugccucggccucagccgccacuuugccgucgcugcugccacugcuguugcugccaacagccgagcugaggugguugguuuuaggaaagugagggacgaagugugugggagguggcgagaggagccgcagggcgcagaaccggcgccgggaccccagacagggcccuucugguggcgcucacggauccagcgucuucggacuuuccuccuagggucgggguccggagcgcgccaggagggagucaagcugagccuugauucuuguucuucgcccuccccuccccuccacacccuuccccaccccgaccacaccccacccgcuccaccacccugcuccccucccucccaucccccaccccugucugccagguuggaggaggguuuaaagccaggugcaccgagucagcucgccauguccagauccggggacaggaccuccaccuucgaccccagccacagcgacaaccugcugcacggccucaaccugcuguggaggaagcagcuguuuugcgacgugacccugacggcccagggccagcaguuccauugccacaaggccgugcuggccuccugcucgcaguacuuccgaucgcucuucuccagccaccccccucucgggggaggggucggcggccaggacggccugggggcccccaaggaccagcagcagccgccgcagcagcagccgucacagcagcagcagccgccgccgcaggaggagcccgggacuccuucuuccucccccgacgacaagcugcugaccagcccccgggccaucaacaaccuggugcugcagggcugcucguccaucgggcugcgccuggugcucgaguaccucuacacggccaacgugacccugucccuggacacgguggaggaggugcugucggucagcaagauccugcacaucccccaggucaccaagcucugcgugcaguuccucaacgaccagaucucggugcagaacuacaagcaggugugcaagaucgccgcgcugcacggccuggaggagaccaagaagcuggccaacaaguaccugguggaggaugugcugcugcucaacuucgaggagaugcgcgcccugcuggacucgcugccgccccccguggagucggagcuggcgcucuuccagauguccgugcuguggcuggagcacgaccgcgagacccgcaugcaguaugcgccugaccucaugaagcgccuccgcuucgcccucaucccggccccggagcugguggagcggguccagucaguggauuucaugcgaaccgacccggucugccagaagcugcugcuggacgccaugaacuaccaccugaugcccuucaggcagcacugcaggcagagccuggccagcagguaggagacaacaaagaggagggcgggggagggggggguagagccagagaggccggagggaggggagggggcagggaggagggaagagauggguggccugggcggguggcucuggcaggaugaaaacaaacgcaaacaauucagagugugugaggaaaguugauuucagagucccugaaaggucaauagggaacuggccuagcagcaucccugagcgcuccaaagccgagguucuagauauccccagagccguaaacaugggaauuguggacucagacugaaauugacaggcagauggggccaaaggccaggacaguuagaaguguagcuuuggaagucucucuaagccagcucucccuacaaaucuuaagaugggcuugcucaagaaaaaggauccuguggugaggaaugcccaccccaccccuccucaguucugccuugggugagcagaagagcccaggcgaugcuugcaaaggaaggcuuucauggucuugccgucacacacucaaguuguuucuucaugacugggaucugcucccugucgaugucagaacuccaaaaugcuuugucuauuagggucacuauuggaaaugcugguaucaugugcccaggcaaacuuuucuauguuguggaaagccuuuccuuuucacuuuuaaaggagaguaaagcaagagauuucagggugauggggugaaucuugccuagcaacucccauuucugagaagagugcacuugaaaauugggauggaggaguggagaggcuucuagcuccaguuggucugugugccugcucaccagugacaaagaaguuggagaguugcugcugccucuguuguugcuaguuagaaauguggcuguguguguugcaaguaggauuucaggggagagagaaaugaugccuuuuaaaaaugcugcugagauaaaaaggcuguaggaauugacaaucguguuuuauuggcuccaauuuuaaaaccauuuuuaaugagcccuagcaaaggguuucuuucucuuuuuagaaaagagaaa

SEQ ID NO: 20233 - RNA, 2296 nt, Homo sapiens
uccagaugccaauaaucugcucagaaagcccugacugcacacucauuguuucucccaugcagcccuagccaggaguccuuuccuggcuccuucuauccccgcaguucuuuucuugaggaggacagauaggguuucuuagggaguuaggaugaagaaagccuaaguaugaugaauuccccauccagcacugugcccagcacauagcagacauccaauaaaggucuguuaaaugaaugacacggacccguuguuuaagauuuuaauaaagguggggcaaaggguugaauuggucgaaaaguccucaacguccugacgggacuccccugaagccaaggcaguuugaguccauucauuauucugucuuggaucuuaggcaaagccccgggccccuuggagcagcaccaggguucccgacacccccaccgacagggucgaacgugcacaggcugggaccacgccggaguucauugagcccucgugggggagggcaguuccagggaccaggaagggauucccguccagugucagguuauccaccucgggcagcucgucaggcugcggcgcccuguucagucuguugcagcugagaucgagcacucugagcuuggcuggcaguccuuuaggcaccuguuccagcccagcgaacgacagauugagggaguucagggcgcuggaccacaugcaucucggagcgcuaggguuuacgguggcgcgcagcgaguuguggcugaggucuaggcuguggggcugcacaccugccgccgccagugcggcgcacacgccugugggcgucuccauuccuguguugcgcagcgcuagauucuggauggccgggaacuuguggggacagagagccgccaucaguccgcguucgcccaguccaggauugucagacaggucuaggcugguaagggccgggaaggcgcgaaccuguucgcaggaaaaggcaggcgagugugcuugggcaaugcucaguaccuugaggccuggcuugagccacugcugcagcucggcgagccaagaacgcccugucgcccacgacacguugcguaggcgcaagcuggaaagugcaaguccuguggcuuccagaggcagcggaggcauggugccgguuaucuuuagguccucgagcgucaguuccuugaggcgggaguacgcuagcacacgcagggcgccuaccaguagcugagcaggaaccugugcggcucccacugugagccgccgcacgcggagagccuugaccgugucagcauacugccgcgggucggcguccgcaucgacgcgcuuuagaaacggcucuagguugagaccgccggcauggaucuccaccucuacugcagacacacacuggaaggcuucggaccagucgggcugagguucggagaaguugcagacgcagcggaaaucuucaucguccagcucacaagguucuggcguggucgcagagacgugcaccagcggcagcagcagcagcaacaagcaggacgcgcgcuccuggggagagagcagaggucuaggaggccccauccaaccccuguggcucccgaguggcacgcguucgaccccaagacccuacacucaccauggucgauaagucuuccgaaccucugagcuccggacaggcucuggaagugcuuuagcuucuuuccuacacagcggcacccgccggcuuccaggcuucacacuugugaacucuucggcugccucugacaguuuauguaauccugggaugucauucaguucccuccucugugaacccugaucaccuccccaccucucuuccuccgagccagcccccuuccuuuccuggaaauauugcaaugaaggauguuucagggagggggaccguaacaggaaggauucugcagggcaucuaggguucugugucuccuggcaguguccugaugacucaggcgccccaggcggugaaugcccuguugacucgggagccuaagccuucucuggugggugugggaaaaggaugauccucagugccuuaggccaguaccauacucugcacuauccaaccccccaaucccccuaccuuauaucccagagaaucuacuugauucauuucuuugacuucuuccuugucuugguuuauguugaucuccugccaccaaauccaagucccugaauauccucagauauuuaacugcauguuuuguggaagagauugugaaccucaucuguuggcaccaagggggguagaauuagguucaagaaaaggaaguuggucuaaagaaaaauucccccuuccuuuuuuuuuccuugcuccuuugauuaaguaauaacu

SEQ ID NO: 20234 - RNA, 2296 nt, Homo sapiens
aguuauuacuuaaucaaaggagcaaggaaaaaaaaaggaagggggaauuuuucuuuagaccaacuuccuuuucuugaaccuaauucuaccccccuuggugccaacagaugagguucacaaucucuuccacaaaacaugcaguuaaauaucugaggauauucagggacuuggauuugguggcaggagaucaacauaaaccaagacaaggaagaagucaaagaaaugaaucaaguagauucucugggauauaagguagggggauugggggguuggauagugcagaguaugguacuggccuaaggcacugaggaucauccuuuucccacacccaccagagaaggcuuaggcucccgagucaacagggcauucaccgccuggggcgccugagucaucaggacacugccaggagacacagaacccuagaugcccugcagaauccuuccuguuacggucccccucccugaaacauccuucauugcaauauuuccaggaaaggaagggggcuggcucggaggaagagagguggggaggugaucaggguucacagaggagggaacugaaugacaucccaggauuacauaaacugucagaggcagccgaagaguucacaagugugaagccuggaagccggcgggugccgcuguguaggaaagaagcuaaagcacuuccagagccuguccggagcucagagguucggaagacuuaucgaccauggugaguguagggucuuggggucgaacgcgugccacucgggagccacagggguuggauggggccuccuagaccucugcucucuccccaggagcgcgcguccugcuuguugcugcugcugcugccgcuggugcacgucucugcgaccacgccagaaccuugugagcuggacgaugaagauuuccgcugcgucugcaacuucuccgaaccucagcccgacugguccgaagccuuccagugugugucugcaguagagguggagauccaugccggcggucucaaccuagagccguuucuaaagcgcgucgaugcggacgccgacccgcggcaguaugcugacacggucaaggcucuccgcgugcggcggcucacagugggagccgcacagguuccugcucagcuacugguaggcgcccugcgugugcuagcguacucccgccucaaggaacugacgcucgaggaccuaaagauaaccggcaccaugccuccgcugccucuggaagccacaggacuugcacuuuccagcuugcgccuacgcaacgugucgugggcgacagggcguucuuggcucgccgagcugcagcaguggcucaagccaggccucaagguacugagcauugcccaagcacacucgccugccuuuuccugcgaacagguucgcgccuucccggcccuuaccagccuagaccugucugacaauccuggacugggcgaacgcggacugauggcggcucucuguccccacaaguucccggccauccagaaucuagcgcugcgcaacacaggaauggagacgcccacaggcgugugcgccgcacuggcggcggcaggugugcagccccacagccuagaccucagccacaacucgcugcgcgccaccguaaacccuagcgcuccgagaugcaugugguccagcgcccugaacucccucaaucugucguucgcugggcuggaacaggugccuaaaggacugccagccaagcucagagugcucgaucucagcugcaacagacugaacagggcgccgcagccugacgagcugcccgagguggauaaccugacacuggacgggaaucccuuccuggucccuggaacugcccucccccacgagggcucaaugaacuccggcguggucccagccugugcacguucgacccugucggugggggugucgggaacccuggugcugcuccaaggggcccggggcuuugccuaagauccaagacagaauaaugaauggacucaaacugccuuggcuucaggggagucccgucaggacguugaggacuuuucgaccaauucaacccuuugccccaccuuuauuaaaaucuuaaacaacggguccgugucauucauuuaacagaccuuuauuggaugucugcuaugugcugggcacagugcuggauggggaauucaucauacuuaggcuuucuucauccuaacucccuaagaaacccuaucuguccuccucaagaaaagaacugcggggauagaaggagccaggaaaggacuccuggcuagggcugcaugggagaaacaaugagugugcagucagggcuuucugagcagauuauuggcaucugga

SEQ ID NO: 20235 - RNA, 4450 nt, Homo sapiens
agaacuguuuuguuguuuguuuuuuagaaaaaaaagucccaaaaaagaaaagagagaagauaaucaauucgaugcccaggaagccaaauagacuuuacauagaauucuuuuuaaugcaaccaaacaaauggucaggauucuucccaauaucucagucaacaauaauauacacucuuuaaacuaugaaaugauuucaauuugauacaaugagcuuauguuagauuuuauuaaacauaucuuggcggucuaguaaagaucuuuaauauuuaauuuuaugauguucgauaacuuagaaaaugugaaugcuagagacaaugaagccauuuacuccauaggguauguaugcuuuguguucggaguagucuauaauuuaauuuaacuagcucuuauuuccuuuucuccaaagaagguaccaagacacuauaaauuaauugagacuuuuuuaaaacaguagaauaagaaacaaaugugagaugaaacuaugaauuuugaggcaucagguaaaaauggaucaagacauugagagcuauaaccuccaaacaugaaaguuuguuugaaaauaucuacaagugcuuacauuguuuaauaaucauacacuuugcuugccucaacaagaaguucaaaaguacuauuaaacaaauagaauuuaacuccaguuuacagaauucaucuauaauaccucuauuaguuccuuuaaacaaaauuuaucuacuuugugaaugcaaagauaacuauggauuauuuugauagaucaaaacagaauguccuucaaaguguucccuguauucuggagcaaugccaccagaaagcagaaauagguuacuuaggagccucccacaaaacgaaguuaagcuuucuuaguguuaguucuggauucuccuccugguuccaccaacuacucuccaggaccuagaagaauuuacaaaccaagacuguuucuugccaggucuuuauuccagagcaggucauucucuuuuauucugcaacuaugugaaaggagcuuucuuuucuuucugcuagcagaggguagccucggauccaucaauaauuuaguuuuacucuaucaacaucaguggagagacgaguaccucuaaggauccugucaggacaguccugcauuuugcucaaaugcugucuagagaucccuguuuucucaauuacacuagaauagaguaggaugaagauuugaauugcauacuaggaugaagacuugaauugaauugcauaaugaaaagaaucagccaauccauuauccaguuucuuaugaauucacagcccaguaggaucucugcagauuucugccuucuguagaaaauggguugcuucuauagcugauugcugcagccaagacaaacaacgauuucuuucuuuuuuucucacaagacugggagugagaauauuuggauuccgacauuguucuacuacuauauaaucaauaaucaggaacaaggcaaggcaauucccucuuucuuucuuucuuucuuucuucuucuuuuuuuuuuuuuuuuuuuuuuggcagaguuuugcucuuguuguccaggcuggagugcaauggugugaucucggcucaccacaaccuccaccucccggguucaagcgauuuuccugccucagccuccugaguagcugggauuacaggcgcgcgccaccacgcccggauaauuuuguauuuuuaguagagacgggguuucuccauguuggucaggcuggucucaagcucccgaccucaggugauccgcccgccucggccucacaaagugugggauuacaggcgugagcaacagcaccuggcccccccucucauuuuuuaaacgguuaaaaugaagguguuagaccgucucuaagguucuauacaaucaaaaauuuauuaaaauaggucuauauauuuuacaacaauuuugacuuucugaaucuugcaucauggugucuagaacauauguguucaauuaauacugaauuaauuaaaauuuauauacacugauguaaauauuuucuaaguaaaaucuuucauauguauuuaaauaaaauuuaccuuuuugccuucaauaacugauuuucccaugugcaauaacgugugagucagugcccaaaagagucacuugaaaguugcaaggcaaagcaguuuuuuaaaaauuaucuaagauuaucaaacaccgguccaugaacacuguugcauuaauucagugucuuaaaauggauuuuuaauuaucagggauaucuagagcaaagaaaucuaacagggaaauuuugaaagaugaaacaauuuucuaugaaaucaguguauugugugcaucaauguggugcaguaacuuaguaaggacucacagcgccgcuguucaccaaccagggaaaaauggugcgagagaucccacagaaaccaccgaguuuuacagcacagagaaacgacagauugcgauaagcccucuuccaggcugcacuaaacucaagccucuauccugcuggauucugagcuccccuuccuaagacagagggguccacccggauacacccgcauucugaagcacuucccgagaucggcgccuaagcaagagaagcaggacgacuauggcggcucagccgaggggcggggacuacagaggauucuuccugcucuccauccuccuggggacccccugggaagccugggcaggacguauucucuacuccgugucggaggagacggacaaaggguccuuugugggagacaucgccaaggaccuggggcuggagccccgggagcuggcggagcgcggaguccgcaucaucuccagagguaggacgcagcuuuucgcccugaaccagcgcagcggcagcuuggucacugcgggcaggauagaccgggaagagaucugcgcucagagugcgcggugucugguaaacuuuaacauccugauggaagauaaaaugaaucuuuacccuauagacguggaaauaauagauauuaaugacaacguuccaagauucuugacggaagaaauaaauguaaaaauaauggagaauacagcuccugggguucgguuuccguuaagcgaggcuggggauccagaugugggcacgaacucccuccagaguuaccagcucagccccaaucgccacuucucccuggcugugcaaaguggagacgaugaaacuaaguacccggaacuggugcuggagcgggugcuggaccgggaggaagagcggguucaccaccugguccucacagccucugauggcggcgacccgccccgauccagcaccgcccacauccaggugacagugguggaugugaaugaccacacgccugucuucucucugccucaguaccaaguaacuguccccgagaaugugccaguggguacaagacugcucacgguacaugcuaucgaccuggacgagggagucaauggggaagugacauauucuuuucggaaaauaacuccuaaacuuccaaagauguuucaucugaacucgcuuacaggagaaauaucaacuuuagaaggauuagauuaugaagaaacugccuucuaugaaauggagguucaggcucaagaugguccugguagucugacaaaggcaaaaguacugaucacaguuuuagauguaaaugauaaugcuccagaagugacuaugacgucuuuaaguagcucaaucccugaagacacaccucuugggacagucauugcucuuuucuaccuacaagacagagauucuggaaagaauggugaggugaccugcaccauuccagaaaaccuaccuuuuaaauuagaaaaaucaauagauaauuauuauagauuggucacaaccaaaaacuuggaccgggaaacacucucuuuguauaacaucacacugaaagccacagaugguggaacuccucccuuguccagggaaacucacauauucaugcagguggcagacaccaacgauaacccacccaccuucccccacucauccuacucagucuacaucgcugagaacaaccccagaggggccuccauuuucuuagugacugcacaggaccacgacagugaggauaaugcccagaucacuuauuccuuggccgaagacaccauccagggggcuccaguguccuccuaugucuccauaaacucugacacuggaguccuguacgcgcugcaauccuuugauuaugagcaguugagagaacuacaacuaagagugacugcacaugacagcggggacccgccucucagcagcaacaugucacugagccuguucgugcuggaccagaaugacaacccgcccgagauccuguacccggcccuccccacagaugguucuacuggcauggagcuggcaccccgcuccgcagagcccggcuaccuggugaccaaggugguggcgguggacaaagauucaggccagaacgccuggcugucauaccuccugcuuaaggccagcgagccaggacucuuugcgguugggcuguacacgggcgaggugcgcacgg

SEQ ID NO: 20236 - RNA, 4450 nt, Homo sapiens
ccgugcgcaccucgcccguguacagcccaaccgcaaagaguccuggcucgcuggccuuaagcaggagguaugacagccaggcguucuggccugaaucuuuguccaccgccaccaccuuggucaccagguagccgggcucugcggagcggggugccagcuccaugccaguagaaccaucuguggggagggccggguacaggaucucgggcggguugucauucugguccagcacgaacaggcucagugacauguugcugcugagaggcggguccccgcugucaugugcagucacucuuaguuguaguucucucaacugcucauaaucaaaggauugcagcgcguacaggacuccagugucagaguuuauggagacauaggaggacacuggagcccccuggauggugucuucggccaaggaauaagugaucugggcauuauccucacugucgugguccugugcagucacuaagaaaauggaggccccucugggguuguucucagcgauguagacugaguaggaugagugggggaagguggguggguuaucguuggugucugccaccugcaugaauaugugaguuucccuggacaagggaggaguuccaccaucuguggcuuucagugugauguuauacaaagagaguguuucccgguccaaguuuuugguugugaccaaucuauaauaauuaucuauugauuuuucuaauuuaaaagguagguuuucuggaauggugcaggucaccucaccauucuuuccagaaucucugucuuguagguagaaaagagcaaugacugucccaagaggugugucuucagggauugagcuacuuaaagacgucauagucacuucuggagcauuaucauuuacaucuaaaacugugaucaguacuuuugccuuugucagacuaccaggaccaucuugagccugaaccuccauuucauagaaggcaguuucuucauaaucuaauccuucuaaaguugauauuucuccuguaagcgaguucagaugaaacaucuuuggaaguuuaggaguuauuuuccgaaaagaauaugucacuuccccauugacucccucguccaggucgauagcauguaccgugagcagucuuguacccacuggcacauucucggggacaguuacuugguacugaggcagagagaagacaggcguguggucauucacauccaccacugucaccuggaugugggcggugcuggaucggggcgggucgccgccaucagaggcugugaggaccagguggugaacccgcucuuccucccgguccagcacccgcuccagcaccaguuccggguacuuaguuucaucgucuccacuuugcacagccagggagaaguggcgauuggggcugagcugguaacucuggagggaguucgugcccacaucuggauccccagccucgcuuaacggaaaccgaaccccaggagcuguauucuccauuauuuuuacauuuauuucuuccgucaagaaucuuggaacguugucauuaauaucuauuauuuccacgucuauaggguaaagauucauuuuaucuuccaucaggauguuaaaguuuaccagacaccgcgcacucugagcgcagaucucuucccggucuauccugcccgcagugaccaagcugccgcugcgcugguucagggcgaaaagcugcguccuaccucuggagaugaugcggacuccgcgcuccgccagcucccggggcuccagccccagguccuuggcgaugucucccacaaaggacccuuuguccgucuccuccgacacggaguagagaauacguccugcccaggcuucccaggggguccccaggaggauggagagcaggaagaauccucuguaguccccgccccucggcugagccgccauagucguccugcuucucuugcuuaggcgccgaucucgggaagugcuucagaaugcggguguauccggguggaccccucugucuuaggaaggggagcucagaauccagcaggauagaggcuugaguuuagugcagccuggaagagggcuuaucgcaaucugucguuucucugugcuguaaaacucggugguuucugugggaucucucgcaccauuuuucccugguuggugaacagcggcgcugugaguccuuacuaaguuacugcaccacauugaugcacacaauacacugauuucauagaaaauuguuucaucuuucaaaauuucccuguuagauuucuuugcucuagauaucccugauaauuaaaaauccauuuuaagacacugaauuaaugcaacaguguucauggaccgguguuugauaaucuuagauaauuuuuaaaaaacugcuuugccuugcaacuuucaagugacucuuuugggcacugacucacacguuauugcacaugggaaaaucaguuauugaaggcaaaaagguaaauuuuauuuaaauacauaugaaagauuuuacuuagaaaauauuuacaucaguguauauaaauuuuaauuaauucaguauuaauugaacacauauguucuagacaccaugaugcaagauucagaaagucaaaauuguuguaaaauauauagaccuauuuuaauaaauuuuugauuguauagaaccuuagagacggucuaacaccuucauuuuaaccguuuaaaaaaugagagggggggccaggugcuguugcucacgccuguaaucccacacuuugugaggccgaggcgggcggaucaccugaggucgggagcuugagaccagccugaccaacauggagaaaccccgucucuacuaaaaauacaaaauuauccgggcgugguggcgcgcgccuguaaucccagcuacucaggaggcugaggcaggaaaaucgcuugaacccgggagguggagguuguggugagccgagaucacaccauugcacuccagccuggacaacaagagcaaaacucugccaaaaaaaaaaaaaaaaaaaaaagaagaagaaagaaagaaagaaagaaagagggaauugccuugccuuguuccugauuauugauuauauaguaguagaacaaugucggaauccaaauauucucacucccagucuugugagaaaaaaagaaagaaaucguuguuugucuuggcugcagcaaucagcuauagaagcaacccauuuucuacagaaggcagaaaucugcagagauccuacugggcugugaauucauaagaaacuggauaauggauuggcugauucuuuucauuaugcaauucaauucaagucuucauccuaguaugcaauucaaaucuucauccuacucuauucuaguguaauugagaaaacagggaucucuagacagcauuugagcaaaaugcaggacuguccugacaggauccuuagagguacucgucucuccacugauguugauagaguaaaacuaaauuauugauggauccgaggcuacccucugcuagcagaaagaaaagaaagcuccuuucacauaguugcagaauaaaagagaaugaccugcucuggaauaaagaccuggcaagaaacagucuugguuuguaaauucuucuagguccuggagaguaguugguggaaccaggaggagaauccagaacuaacacuaagaaagcuuaacuucguuuugugggaggcuccuaaguaaccuauuucugcuuucugguggcauugcuccagaauacagggaacacuuugaaggacauucuguuuugaucuaucaaaauaauccauaguuaucuuugcauucacaaaguagauaaauuuuguuuaaaggaacuaauagagguauuauagaugaauucuguaaacuggaguuaaauucuauuuguuuaauaguacuuuugaacuucuuguugaggcaagcaaaguguaugauuauuaaacaauguaagcacuuguagauauuuucaaacaaacuuucauguuuggagguuauagcucucaaugucuugauccauuuuuaccugaugccucaaaauucauaguuucaucucacauuuguuucuuauucuacuguuuuaaaaaagucucaauuaauuuauagugucuugguaccuucuuuggagaaaaggaaauaagagcuaguuaaauuaaauuauagacuacuccgaacacaaagcauacauacccuauggaguaaauggcuucauugucucuagcauucacauuuucuaaguuaucgaacaucauaaaauuaaauauuaaagaucuuuacuagaccgccaagauauguuuaauaaaaucuaacauaagcucauuguaucaaauugaaaucauuucauaguuuaaagaguguauauuauuguugacugagauauugggaagaauccugaccauuuguuugguugcauuaaaaagaauucuauguaaagucuauuuggcuuccugggcaucgaauugauuaucuucucucuuuucuuuuuugggacuuuuuuuucuaaaaaacaaacaacaaaacaguucu

SEQ ID NO: 20237 - RNA, 2563 nt, Homo sapiens
uggaaaauuacuguacucugagacgguuuaggccaagucuguguuauggcuaucuuuauauagauagugcauguuugaagauuggggaaagcuuaugucaauaaauguuuauguacuuaaucuacaugauuugccuaaaaauccucaaaguugggaugaaggcauuccuaagaguacauuuuuagacgucauuaaauauacagacguauccacguaguuuuuguucuuucaguuaggcacacaauuauaauuauugcacugguuaacuugaagcagcagaggcuguaguuuccuagugcugacucugggcgccgcuguuggccaaaguggagagcuuggcgcuccagaucuccucgcgcagccgcagcgcgcuuuccagggcagccccagcucagacuccccagcgccagccuuuacaccgcuuccuccucggaaaaagaagaauuuuuucuugaacuggaacugcaacuaaaguccguucggagauccaaaaaucugcaauacagagguuauuuguaacccggcgucuccaggcuggugagcaagcugaggagagcaagagggauggggagcggcgccggggagcugggccgggcugagaggcugccagugcucuuucucuuccugcugucuuuguucugcccggcgcucugugagcagauccgcuacaggauucccgaggaaaugcccaagggcuccguaguggggaaccucgccacggaccugggguucagcguccaggaguuaccgacucgaaaacugcgcgucaguucggagaagccuuacuucaccgugagcgcagagagcggggaguugcuugugagcagcaggcuagacagggaggagauaugcgggaagaagccagcuugugcucuggaauuugaggcuguugcugaaaauccacugaacuuuuaucacgugaauguggagaucgaggacauuaaugaccacacgccaaaauucacgcaaaauuccuuugagcugcaaauaagugagucugcacagccuggcacacgauuuauauuaggaucugcccaugaugcggauauugguagcaacacacugcagaauuaccaacucagucccagugaucauuucucacugauaaauaaagagaaaucagauggcaguaaauacccugagaugguauugaagacaccuuuggacagagaaaagcagaaauccuaccacuugacuuugacugccuuggacuuuggagcuccaccccuaagcagcacugcacagauacacguucuagugacugaugccaaugauaaugcuccaguguucagucaagacguauacagggugagccuuucagaaaacguguacccggggaccacggugcuacaggugacugccacggaccaggaugagggugucaaugccgagauuacuuucucuuucagugaagcuagccagaucacccaauuugaccugaacucuaacaccggggaaauuacuguuuuaaauacauuagauuuugaagaagucaaagaauauuccauaguuuuggaagcaagggacgguggaggaaugauugcgcaaugcacaguggagguagaagucauagaugaaaaugacaacgccccagaagugauauuccagucucuacccaaccuaauuauggaggacgccgagcugggaacacauauugcuuugcucaaaguccgugacaaggauuccagacacaauggagaagugacuuguaaauuggaaggugauguuccauuuaaaauauuaacuucuucaagaaacacguauaaauuagugacagaugcuguucuagaccgcgagcagaauccagaguacaauauaaccguuacggcaacagaucggggcaagccuccccucuccuccaguuccagcaucacccugcacauuggugauguaaaugacaacgcuccgguuuucucacagucuuccuauauaguccacguggccgagaacaacccgccuggagccucuauuucacaagucagggcuucugauccggacuuggggcccaacggccaagucucuuacugcaucauggccagugaccuggagcagcgggagcugucauccuacguguccauaagcgcggagagcggggugguguucgcgcagcgcgccuucgaccacgagcagcugcgcgccuucgaacucacacugcaggcccgcgaccagggcucgccagcgcucagcgcgaacgugagccugcgcguguuaguggacgaccgcaacgacaaugcgccacgggugcuguaccccgcgcugggucccgacggcucugcgcucuucgauauggugccgcacgcugcagagccuggcuacuuggugaccaagguaguggcgguggacgcagacucaggacacaacgccuggcuguccuaccacgugcugcaggcuagcgagcccgggcucuucagccuggggcugcgcacgggcgaagugcgcacagcgcgugccuuaggcgacagggacgccguccgccagcgccuucuggucgccgugcgugacgguggacagccaccacucucggccacugccacguugcaccuggucuucgccgacagcuugc

SEQ ID NO: 20238 - RNA, 2563 nt, Homo sapiens
gcaagcugucggcgaagaccaggugcaacguggcaguggccgagagugguggcuguccaccgucacgcacggcgaccagaaggcgcuggcggacggcgucccugucgccuaaggcacgcgcugugcgcacuucgcccgugcgcagccccaggcugaagagcccgggcucgcuagccugcagcacgugguaggacagccaggcguuguguccugagucugcguccaccgccacuaccuuggucaccaaguagccaggcucugcagcgugcggcaccauaucgaagagcgcagagccgucgggacccagcgcgggguacagcacccguggcgcauugucguugcggucguccacuaacacgcgcaggcucacguucgcgcugagcgcuggcgagcccuggucgcgggccugcagugugaguucgaaggcgcgcagcugcucguggucgaaggcgcgcugcgcgaacaccaccccgcucuccgcgcuuauggacacguaggaugacagcucccgcugcuccaggucacuggccaugaugcaguaagagacuuggccguugggccccaaguccggaucagaagcccugacuugugaaauagaggcuccaggcggguuguucucggccacguggacuauauaggaagacugugagaaaaccggagcguugucauuuacaucaccaaugugcagggugaugcuggaacuggaggagaggggaggcuugccccgaucuguugccguaacgguuauauuguacucuggauucugcucgcggucuagaacagcaucugucacuaauuuauacguguuucuugaagaaguuaauauuuuaaauggaacaucaccuuccaauuuacaagucacuucuccauugugucuggaauccuugucacggacuuugagcaaagcaauauguguucccagcucggcguccuccauaauuagguuggguagagacuggaauaucacuucuggggcguugucauuuucaucuaugacuucuaccuccacugugcauugcgcaaucauuccuccaccgucccuugcuuccaaaacuauggaauauucuuugacuucuucaaaaucuaauguauuuaaaacaguaauuuccccgguguuagaguucaggucaaauugggugaucuggcuagcuucacugaaagagaaaguaaucucggcauugacacccucauccugguccguggcagucaccuguagcaccgugguccccggguacacguuuucugaaaggcucacccuguauacgucuugacugaacacuggagcauuaucauuggcaucagucacuagaacguguaucugugcagugcugcuuagggguggagcuccaaaguccaaggcagucaaagucaagugguaggauuucugcuuuucucuguccaaaggugucuucaauaccaucucaggguauuuacugccaucugauuucucuuuauuuaucagugagaaaugaucacugggacugaguugguaauucugcaguguguugcuaccaauauccgcaucaugggcagauccuaauauaaaucgugugccaggcugugcagacucacuuauuugcagcucaaaggaauuuugcgugaauuuuggcguguggucauuaauguccucgaucuccacauucacgugauaaaaguucaguggauuuucagcaacagccucaaauuccagagcacaagcuggcuucuucccgcauaucuccucccugucuagccugcugcucacaagcaacuccccgcucucugcgcucacggugaaguaaggcuucuccgaacugacgcgcaguuuucgagucgguaacuccuggacgcugaaccccagguccguggcgagguuccccacuacggagcccuugggcauuuccucgggaauccuguagcggaucugcucacagagcgccgggcagaacaaagacagcaggaagagaaagagcacuggcagccucucagcccggcccagcuccccggcgccgcuccccaucccucuugcucuccucagcuugcucaccagccuggagacgccggguuacaaauaaccucuguauugcagauuuuuggaucuccgaacggacuuuaguugcaguuccaguucaagaaaaaauucuucuuuuuccgaggaggaagcgguguaaaggcuggcgcuggggagucugagcuggggcugcccuggaaagcgcgcugcggcugcgcgaggagaucuggagcgccaagcucuccacuuuggccaacagcggcgcccagagucagcacuaggaaacuacagccucugcugcuucaaguuaaccagugcaauaauuauaauugugugccuaacugaaagaacaaaaacuacguggauacgucuguauauuuaaugacgucuaaaaauguacucuuaggaaugccuucaucccaacuuugaggauuuuuaggcaaaucauguagauuaaguacauaaacauuuauugacauaagcuuuccccaaucuucaaacaugcacuaucuauauaaagauagccauaacacagacuuggccuaaaccgucucagaguacaguaauuuucca

SEQ ID NO: 20239 - RNA, 2538 nt, Homo sapiens
gaauuaaguaguuacaauuauaaagcuucagagugaauuaucucaugaguuuauuuaauauaaucuuuguaugaauguauacuaaauaaaauuggccuauucaaaucacaauuuuaaauuauaagacuuuucugaauuuaccuagacacuaauaugaccuaaaauaaguauuauuuaccuuuuauuaaaguguguacauuucuguugggaaaacguguugcaaauauauauuuaaccaaacauuaucuugaaauauuuacaauauuuucacuccacuuuaucacaccuccccuaagaaaccuacauauaguaaauuauuuaaagauaggaguggagaaaccaaagaaucuauguaaaauauaauaauccaacagaauaguuuacuuuccauugcauguaucacuugggugcaguaacuucuuaggacucugagcgccgcuguucaccuacuaggagagaaaacgcagccagagcucaauccggauucucagggcuucaacuacacaagccccacaaaccggcugcugggcugcagggaagcucacuccagaauuuaaagugcccaggcuacagagacacccugaagccacagaaagacaaaggaaccgguugaaacacacaacguguccagugaggacuuugcagaauucuguaaccagacuacaauggccgcucaaaggaaucgcucaaaggaaucaaaggauugcagcgggcugguccugcucugccuuuucuucgggauuccaugggaggcuggagcccggcagaucuccuacucaauuccugaggaauuagagaaaggcucuuucgugggcaacaucuccaaggacuugggucuggcgccccgggagcuggcggagcgcggaguccgcauagucuccagagguaggacgcagcuuuucucucugaacccgcgcagcggcagcuugaucaccgcgggcaggauagaccgggaggagcucugcgcucagagcgcgcggugcguggugaguuuuaauauccuuguggaagacagggugaaacuuuuugggauagaaauagaaguaacugauaucaaugacaaugcuccaaaauuccaagcagaaaaucuagacguaaaaauuaaugaaaaugucgcugcgggaaugcguuuuccucucccggaagcuauugauccggaugugggcgugaacucccugcagagcuaucagcucagccccaauaagcacuucucccuaagaguucagagccgugccaauggcgucaaguacccggagcugguacuggagcacucccuagaucgcgaggaagaggccauucaccaccugguccucaccgccuccgacgggggugacccucuccgaucuggcacuguccuugucagugugacugucuucgaugcaaaugacaacgcgccggucuucaccuugccagaauaccgagugaguguuccugagaauuugccugugggcacucagcugcugacagucacagccaccgacagggacgaaggugccaauggagaagugacauauucauuccgaaaauuaccugacacgcaauuguugaaguuccaacuaaacaaauauacuggagaaauaaaaauaucagaaaaucuagauuaugaagaaaccgguuucuaugaaauagaaauacaagcagaagauggaggagcauaucuugcaacugcaaaaguguugauuacaguagaagauguaaaugacaacaguccagagcugaccaucacgucucuauuuaguccagugacugaagauucaccucugggaacagucguagcccuuuuaaaugugcaugauuuagacucugagcagaauggacagguaaccuguuccauuuuggcguaucuaccauuuaaauuagaaaaguccauugacaguuauuacagauuggugauacacagagcccuugacagggaacagguauccucuuacaauaucacagugacagccacagaugggggaaguccuccucuaucaacggaagcucacuuuaugcuacaaguggcagauaucaaugacaacccaccuaccuucucucaagucuccuacuuuaccuauaucccagagaacaacgccaggggugccuccaucuucucagugacagcgcuggacccggacagcaaagagaaugcccagauuauuuacucccuggcugaagacaccauccaggggguaccucuguccucauacauauccaucaacucagacacuggcguccuguaugcacucagauccuucgacuaugagcaguuucaugagcuacagaugcaggugacagccagcgacagcggggauccuccacucagcagcaacgugucguugagccuguuugugcuggaccagaacgacaaugcgcccgagauccuguaccccgcccuccccacagacgguuccacaggcguggagcuggcgccccgcuccgcagagcccggcuaccuggugaccaaggugguggcgguggacagagacuccggccagaacgccuggcuguccuaccgucugcucaaggccagcgagccgggacucuucgcgguggggg

SEQ ID NO: 20240 - RNA, 2538 nt, Homo sapiens
cccccaccgcgaagagucccggcucgcuggccuugagcagacgguaggacagccaggcguucuggccggagucucuguccaccgccaccaccuuggucaccagguagccgggcucugcggagcggggcgccagcuccacgccuguggaaccgucuguggggagggcgggguacaggaucucgggcgcauugucguucugguccagcacaaacaggcucaacgacacguugcugcugaguggaggauccccgcugucgcuggcugucaccugcaucuguagcucaugaaacugcucauagucgaaggaucugagugcauacaggacgccagugucugaguugauggauauguaugaggacagagguacccccuggauggugucuucagccagggaguaaauaaucugggcauucucuuugcuguccggguccagcgcugucacugagaagauggaggcaccccuggcguuguucucugggauauagguaaaguaggagacuugagagaagguagguggguugucauugauaucugccacuuguagcauaaagugagcuuccguugauagaggaggacuucccccaucuguggcugucacugugauauuguaagaggauaccuguucccugucaagggcucuguguaucaccaaucuguaauaacugucaauggacuuuucuaauuuaaaugguagauacgccaaaauggaacagguuaccuguccauucugcucagagucuaaaucaugcacauuuaaaagggcuacgacuguucccagaggugaaucuucagucacuggacuaaauagagacgugauggucagcucuggacuguugucauuuacaucuucuacuguaaucaacacuuuugcaguugcaagauaugcuccuccaucuucugcuuguauuucuauuucauagaaaccgguuucuucauaaucuagauuuucugauauuuuuauuucuccaguauauuuguuuaguuggaacuucaacaauugcgugucagguaauuuucggaaugaauaugucacuucuccauuggcaccuucgucccugucgguggcugugacugucagcagcugagugcccacaggcaaauucucaggaacacucacucgguauucuggcaaggugaagaccggcgcguugucauuugcaucgaagacagucacacugacaaggacagugccagaucggagagggucacccccgucggaggcggugaggaccagguggugaauggccucuuccucgcgaucuagggagugcuccaguaccagcuccggguacuugacgccauuggcacggcucugaacucuuagggagaagugcuuauuggggcugagcugauagcucugcagggaguucacgcccacauccggaucaauagcuuccgggagaggaaaacgcauucccgcagcgacauuuucauuaauuuuuacgucuagauuuucugcuuggaauuuuggagcauugucauugauaucaguuacuucuauuucuaucccaaaaaguuucacccugucuuccacaaggauauuaaaacucaccacgcaccgcgcgcucugagcgcagagcuccucccggucuauccugcccgcggugaucaagcugccgcugcgcggguucagagagaaaagcugcguccuaccucuggagacuaugcggacuccgcgcuccgccagcucccggggcgccagacccaaguccuuggagauguugcccacgaaagagccuuucucuaauuccucaggaauugaguaggagaucugccgggcuccagccucccauggaaucccgaagaaaaggcagagcaggaccagcccgcugcaauccuuugauuccuuugagcgauuccuuugagcggccauuguagucugguuacagaauucugcaaaguccucacuggacacguuguguguuucaaccgguuccuuugucuuucuguggcuucagggugucucuguagccugggcacuuuaaauucuggagugagcuucccugcagcccagcagccgguuuguggggcuuguguaguugaagcccugagaauccggauugagcucuggcugcguuuucucuccuaguaggugaacagcggcgcucagaguccuaagaaguuacugcacccaagugauacaugcaauggaaaguaaacuauucuguuggauuauuauauuuuacauagauucuuugguuucuccacuccuaucuuuaaauaauuuacuauauguagguuucuuaggggaggugugauaaaguggagugaaaauauuguaaauauuucaagauaauguuugguuaaauauauauuugcaacacguuuucccaacagaaauguacacacuuuaauaaaagguaaauaauacuuauuuuaggucauauuagugucuagguaaauucagaaaagucuuauaauuuaaaauugugauuugaauaggccaauuuuauuuaguauacauucauacaaagauuauauuaaauaaacucaugagauaauucacucugaagcuuuauaauuguaacuacuuaauuc

SEQ ID NO: 20241 - RNA, 2552 nt, Homo sapiens
auagcaaugggccgugggauaggagaccuauaaaccuucaugcuauauuauuuugugccuuuuuaaauuuugaagaaaaaauauucauuuauucaagauauauguaaauucaguaaauaaaaagauaugauaguuaugaccaaguggaaauauauuuccugauguaaaaggaaucacugaggaaaaagauuaaaauauuuuggcugucaacucguaguuuaaaaaaaauuccuugaaagagguagagaaaagucaaguugcagucccacacagagccucugggcgccgccgucggccagugcagagcaagcgcugacgccggggaucccucagccucuagccugggauucccugcgcagccaacaacagaaaagaaaaccagcucccacacagaggcucccggcugcgcagaccuugcccagcacaccagauugccagcuccgagacccgggacuccuccuguccugggccgaaugcucuuuuagcgcgguagagugcacuuucuccaacuggaaaagcggggacccagcgagaacccgagcgaacgaugggagggagcugcgcgcagaggcgccgggccggcccgcggcagguacuauuuccuuugcugcugccuuuguucuaccccacgcugugugagccgauccgcuacucgauuccggaggagcuggccaagggcucggugguggggaaccucgcuaaggaucuagggcuuaguguccuggaugugucggcucgcgagcugcgagugagcgcggagaagcugcacuucagcguagacgcgcagagcggggacuuacuugugaaggaccgaauagaccgugagcaaauaugcaaagagagaagaagaugugaguugcaauuggaagcugugguggaaaauccuuuaaauauuuuucaugucauuguggugauugaggauguuaaugaccacgccccucaauuccggaaagaugaaauaaacuuagaaaucagugaauccgucagccuggggaugggaacaauucuugagucugcagaagauccugauauuaguaugaauucgcugagcaaauaccaacuaaguccuaacgaguauuucucauugguggagaaagacaauccugaugguggcaaauauccagaauuaguauugcagaagacucuggaccgagaaacgcagagcgcucaccacuugguacugaccgccuuagaugguggggacccuccccgaagcgguacugcucagauaagaauccugguaauagaugccaaugacaaccccccaguguucagccaggacguguacaggguuagccuucgggaagacgugccuccaggcaccuccauccugagagugaaggccacugaccaggacgagggcaucaacucagagaucacuuauuccuucuuugguguggcugacaaagcucagcacguguucucucuggauuacacuacaggaaacauucuaacucagcagccuuuggauuuugaagaaguagaaagauauacgauaaacauagaagcaaaagaccgaggaucucucucaacacgguguaaaguaauuguagaaguuguagacgaaaacgacaacagcccagaaauaaucaucacgucacucucugaucagauuauggaggauuccccuccaggagugguuguugcccucuucaaaacacgggaccaagacucaggggaaaauggggaagucagguguagcuuaaguagagguguuccauuuaagauucauucuucuucuaauaauuacuacaagcuaguaacagaugaggcccuggaucgggagcagaccccagaguacaacgucaccaucgcagccacagacaggggcaagccuccguuauccuccagcaaaaccauaacccugcacauuacugacgucaaugacaacgcgccgguuuucggacagucagccuaccugguccacgugccagaaaacaaccagccgggugccuccauagcgcaagucagugccucugacccagacuucgggcucaacggccgugucuccuacucucucauugccagcgaccuggagucacgaacgcugucguccuacguguccgugagcgcgcagagcggggugguguucgcgcagcgcgccuucgaccacgagcagcugcgcaccuucgagcucacgcugcaggcccgcgaccagggcucgcccgcgcucagcgccaaugugagccugcgcguguuggugggcgaccguaacgacaacgcaccgcgggugcuguacccugcgcugggucccgacggcuccgcgcucuucgacacagugccgcgggccgcgcagccaggcuaccuggugaccaaggugguggccguggacgcggacucggggcacaaugccuggcuguccuaccacguggugcaggccagugagcccgggcucuucagccuggggcugcgaacaggcgaggugcgcauggugcgugcuuugggugacaaggacucgguccgccagcgccugcuagucgcuguaagagauggaggacagccaccccuuucagccacugccacgcugcaccugguguucgcagauagcuugc

SEQ ID NO: 20242 - RNA, 2552 nt, Homo sapiens
gcaagcuaucugcgaacaccaggugcagcguggcaguggcugaaagggguggcuguccuccaucucuuacagcgacuagcaggcgcuggcggaccgaguccuugucacccaaagcacgcaccaugcgcaccucgccuguucgcagccccaggcugaagagcccgggcucacuggccugcaccacgugguaggacagccaggcauugugccccgaguccgcguccacggccaccaccuuggucaccagguagccuggcugcgcggcccgcggcacugugucgaagagcgcggagccgucgggacccagcgcaggguacagcacccgcggugcguugucguuacggucgcccaccaacacgcgcaggcucacauuggcgcugagcgcgggcgagcccuggucgcgggccugcagcgugagcucgaaggugcgcagcugcucguggucgaaggcgcgcugcgcgaacaccaccccgcucugcgcgcucacggacacguaggacgacagcguucgugacuccaggucgcuggcaaugagagaguaggagacacggccguugagcccgaagucugggucagaggcacugacuugcgcuauggaggcacccggcugguuguuuucuggcacguggaccagguaggcugacuguccgaaaaccggcgcguugucauugacgucaguaaugugcaggguuaugguuuugcuggaggauaacggaggcuugccccugucuguggcugcgauggugacguuguacucuggggucugcucccgauccagggccucaucuguuacuagcuuguaguaauuauuagaagaagaaugaaucuuaaauggaacaccucuacuuaagcuacaccugacuuccccauuuuccccugagucuuggucccguguuuugaagagggcaacaaccacuccuggaggggaauccuccauaaucugaucagagagugacgugaugauuauuucugggcuguugucguuuucgucuacaacuucuacaauuacuuuacaccguguugagagagauccucggucuuuugcuucuauguuuaucguauaucuuucuacuucuucaaaauccaaaggcugcugaguuagaauguuuccuguaguguaauccagagagaacacgugcugagcuuugucagccacaccaaagaaggaauaagugaucucugaguugaugcccucguccuggucaguggccuucacucucaggauggaggugccuggaggcacgucuucccgaaggcuaacccuguacacguccuggcugaacacugggggguugucauuggcaucuauuaccaggauucuuaucugagcaguaccgcuucggggaggguccccaccaucuaaggcggucaguaccaaguggugagcgcucugcguuucucgguccagagucuucugcaauacuaauucuggauauuugccaccaucaggauugucuuucuccaccaaugagaaauacucguuaggacuuaguugguauuugcucagcgaauucauacuaauaucaggaucuucugcagacucaagaauuguucccauccccaggcugacggauucacugauuucuaaguuuauuucaucuuuccggaauugaggggcguggucauuaacauccucaaucaccacaaugacaugaaaaauauuuaaaggauuuuccaccacagcuuccaauugcaacucacaucuucuucucucuuugcauauuugcucacggucuauucgguccuucacaaguaaguccccgcucugcgcgucuacgcugaagugcagcuucuccgcgcucacucgcagcucgcgagccgacacauccaggacacuaagcccuagauccuuagcgagguuccccaccaccgagcccuuggccagcuccuccggaaucgaguagcggaucggcucacacagcgugggguagaacaaaggcagcagcaaaggaaauaguaccugccgcgggccggcccggcgccucugcgcgcagcucccucccaucguucgcucggguucucgcuggguccccgcuuuuccaguuggagaaagugcacucuaccgcgcuaaaagagcauucggcccaggacaggaggagucccgggucucggagcuggcaaucuggugugcugggcaaggucugcgcagccgggagccucugugugggagcugguuuucuuuucuguuguuggcugcgcagggaaucccaggcuagaggcugagggauccccggcgucagcgcuugcucugcacuggccgacggcggcgcccagaggcucugugugggacugcaacuugacuuuucucuaccucuuucaaggaauuuuuuuuaaacuacgaguugacagccaaaauauuuuaaucuuuuuccucagugauuccuuuuacaucaggaaauauauuuccacuuggucauaacuaucauaucuuuuuauuuacugaauuuacauauaucuugaauaaaugaauauuuuuucuucaaaauuuaaaaaggcacaaaauaauauagcaugaagguuuauaggucuccuaucccacggcccauugcuau

SEQ ID NO: 20243 - RNA, 2421 nt, Homo sapiens
guaagaauuauaguuaggcauccuaccugaugauuuuaucgggaccguauuauuuccacuuccagaaaugucguuccuuucagucgguuaaaaucaauuggaaccaacuacaaccuacaaguuuucagcuccaguaauauuuugaaaacuuuuuaaaaauuaagcaagcccuuuuaauaauuacuccuuucgcagguguucuugguaaaguuuuaacgucacauaauguaaguauuguguaucaucguuuuuaagcucuacaaauacgugugauucacaaaggugagcguaaucauuucuucuggaauuucuuagucguugcaauaauaagaaugggcucuaggcgccgcugcucaccaaucagggaaugggaagcugcgcgccauugagucccucccucccccgccucuaccacacaaagcggaaugagauggauacucacagauccugacacuggagacuuagaaguauuuuccuucgcuuucugauauauuuuggauguagucggccuaggacuucauagauacauaagccgauucacaaccaaccagcucgagaaaccgcggaauaucggcuuagagccugccauggcgaaucggcuacagcgcggggaccgcagucggcugcugcugcugcugugcauuuuccuggggacgcugcggggguuccgggccaggcagauccgauauucggugccagaagagaccgaaaagggcuccuucgugggcaauaucuccaaggaccuggggcuggagccccgggagcuggcgaagcgcggaguccgcaucgucuccagagggaagacacagcuuuucgcugugaauccgcgaagcggcagcuugaucacggcaggcaggauagaccgggaggagcucugugagacgguguccuccuguuuuuuaaauauggaacuucucguggaagacaccuugaagauuuacggaguggagguggaaauaauagauauuaaugauaacgcccccagcuuccaggaggacgaaguggagauaaaagucagugagcacgcaauuccuggggcgcgauuugcucuuccuaaugcuagggauccagaugugggcgugaacucccuccagagcuaccagcucagcccuaauaauuacuuuuccuugcaacugcggggcagaacggauggggccaagaauccagagcuaguacuggagggaagccuggaccgagagaaagaggcugcucaccugcuccuccucacagcuuuagauggaggcgaucccauccgaaagggcgcaguucccauucguguggugguccucgauguaaaugaucacaucccaauguuuacacaguccguauaucgcgugaguguuccagaaaacaucagcuccggaacucgggugcugaugguuaaugcaacggauccagacgagggaaucaacggggaaguaauguauucauuucggaacauggaaagcaaggcuucugaaauauuccaauuggauucacaaacuggagaaguucaaguacgggggucucuggauuuugaaaaauauagauucuaugagauggaaauucaaggccaagaugguggaggucucuuuaccaccacgacgauguugaucacuguuguggaugugaaugauaacgcuccagaaauaacuaucaccucuucuauuaauucaauucuggaaaacucuccuccagguacagugauugcucuucuaaaugugcaagaucaagauucuggagaaaauggucaagucuccuguuuuauuccuaaccaccugccuuuuaaauuagaaaagacuuauggaaauuauuacaaauugauaacaagcagagugcuggacagggaguugguccagagcuacaauauaacguugacagccacagaccagggaagcccgccuuugucugcagaaacucaugucuggcugaauguggcagaugacaacgauaacccucccguuuuuccucacuccucuuacucugccuacauucccgaaaacaaccccaggggugccuccaucuucucagugaccgcccucgacccggacagcaaacagaaugcccuggucacuuacucucugacggaugacacuguccagggggugccucuguccuccuaugucucuauuaacuccaacacugguguucucuaugcccuacaauccuucgacuaugagcaguuucgagacuuagaacugagagugauagcacgugacagcggggacccgccccucagcagcaacgugucgcugagccuguucgugcuggaccagaacgacaaugcgcccgagauccuguacccugcccuccccacagacggcuccacuggcguggagcuggcgccccgcucugcggaaccuggcuaccuggugaccaaggugguugcgguggacaaagauucaggccagaacgccuggcuguccuaucgccugcuuaagg

SEQ ID NO: 20244 - RNA, 2421 nt, Homo sapiens
ccuuaagcaggcgauaggacagccaggcguucuggccugaaucuuuguccaccgcaaccaccuuggucaccagguagccagguuccgcagagcggggcgccagcuccacgccaguggagccgucuguggggagggcaggguacaggaucucgggcgcauugucguucugguccagcacgaacaggcucagcgacacguugcugcugaggggcggguccccgcugucacgugcuaucacucucaguucuaagucucgaaacugcucauagucgaaggauuguagggcauagagaacaccaguguuggaguuaauagagacauaggaggacagaggcacccccuggacagugucauccgucagagaguaagugaccagggcauucuguuugcuguccgggucgagggcggucacugagaagauggaggcaccccugggguuguuuucgggaauguaggcagaguaagaggagugaggaaaaacgggaggguuaucguugucaucugccacauucagccagacaugaguuucugcagacaaaggcgggcuucccuggucuguggcugucaacguuauauuguagcucuggaccaacucccuguccagcacucugcuuguuaucaauuuguaauaauuuccauaagucuuuucuaauuuaaaaggcaggugguuaggaauaaaacaggagacuugaccauuuucuccagaaucuugaucuugcacauuuagaagagcaaucacuguaccuggaggagaguuuuccagaauugaauuaauagaagaggugauaguuauuucuggagcguuaucauucacauccacaacagugaucaacaucgucguggugguaaagagaccuccaccaucuuggccuugaauuuccaucucauagaaucuauauuuuucaaaauccagagacccccguacuugaacuucuccaguuugugaauccaauuggaauauuucagaagccuugcuuuccauguuccgaaaugaauacauuacuuccccguugauucccucgucuggauccguugcauuaaccaucagcacccgaguuccggagcugauguuuucuggaacacucacgcgauauacggacuguguaaacauugggaugugaucauuuacaucgaggaccaccacacgaaugggaacugcgcccuuucggaugggaucgccuccaucuaaagcugugaggaggagcaggugagcagccucuuucucucgguccaggcuucccuccaguacuagcucuggauucuuggccccauccguucugccccgcaguugcaaggaaaaguaauuauuagggcugagcugguagcucuggagggaguucacgcccacaucuggaucccuagcauuaggaagagcaaaucgcgccccaggaauugcgugcucacugacuuuuaucuccacuucguccuccuggaagcugggggcguuaucauuaauaucuauuauuuccaccuccacuccguaaaucuucaaggugucuuccacgagaaguuccauauuuaaaaaacaggaggacaccgucucacagagcuccucccggucuauccugccugccgugaucaagcugccgcuucgcggauucacagcgaaaagcugugucuucccucuggagacgaugcggacuccgcgcuucgccagcucccggggcuccagccccagguccuuggagauauugcccacgaaggagcccuuuucggucucuucuggcaccgaauaucggaucugccuggcccggaacccccgcagcguccccaggaaaaugcacagcagcagcagcagccgacugcgguccccgcgcuguagccgauucgccauggcaggcucuaagccgauauuccgcgguuucucgagcugguugguugugaaucggcuuauguaucuaugaaguccuaggccgacuacauccaaaauauaucagaaagcgaaggaaaauacuucuaagucuccagugucaggaucugugaguauccaucucauuccgcuuugugugguagaggcgggggagggagggacucaauggcgcgcagcuucccauucccugauuggugagcagcggcgccuagagcccauucuuauuauugcaacgacuaagaaauuccagaagaaaugauuacgcucaccuuugugaaucacacguauuuguagagcuuaaaaacgaugauacacaauacuuacauuaugugacguuaaaacuuuaccaagaacaccugcgaaaggaguaauuauuaaaagggcuugcuuaauuuuuaaaaaguuuucaaaauauuacuggagcugaaaacuuguagguuguaguugguuccaauugauuuuaaccgacugaaaggaacgacauuucuggaaguggaaauaauacggucccgauaaaaucaucagguaggaugccuaacuauaauucuuac

SEQ ID NO: 20245 - RNA, 2504 nt, Homo sapiens
uugauggggauguuuucccacaagguuuuuguucuacaacaggagagaagacuuugccuaguucuuccaauaugugcauugcuucugcuuagaaaaaaacaaacuuuuaaauucucuuugcuggguuaaugacuguucuauagauucccaucucuaaggaaucuucuuugguaguaaacacuggaaaacagucacuacgaaaacucauaaaaugucuaguuuccuauacauuaguccaacacaucagucuaauucugaaucccauugaauuagcaaaggcuuccggcugcaguuuucuaaauagacucagagcccugcuguuggccaaugugcugcaagaacuggagccugggaucuaccaggacgauauucuguucagucacagaagcaagucggagaguggccaagacuugggcuuucugcuccugcaaaucugauuccauacggauuggggugcccucaaacugggagcauugaguuuucuauguauggaaguaaauauuuuaaaagcacuuugugaaacauuuucucuuaacgucggagacugcagcaacgcaugggaaggaugggaaacagggugaagcagagaagcaggacccggcaguggcaagcacucuucccuuuccugcugccuuuguucugcggggcacccucggagcagauccgcuacucuauuccagaagaaacgguccagggcuccgugguggggaaccuugcggaggacaugcggcugcauguucaggauuuauugaccugaaaccuuagaguuagugcagagaaacaauacuuuaccgugaacacggagaaugggaacauacuugugagugacagaauagaucgagagucacugucuucaaaauccucugugucauacccuuagagauuguagcagagaauccucuaaauguuuuucacauaaaugugaugauagaagauauaaaugauaacccaccucauuuuccccaaaauagcauuguuuuacaaaucaaugaacuagcaauuccaggcauucgguuuggccuggaaucugcuauagaugcagauguagggccucacucucuccagaguuaccagcucaguucuaaugaacauuucucucugaugauggacaagacuaaaggcaagaacgcuccagaauuagugcuggagaagccccugggccaggagcaacagagcucucaucuccugguccuggaagcaauggacaugggugacccagucccaacuggcacugcugcaauucaaauugaggucacugaugccaacgauaaugccccaguuuuuagccaggauguauacaaagucagccuuagagagaaugugcccccaggcaccucuguacuaaaggugacagccacugaccaggaugagggugucaaugcggagaucaccuacucuuucaaaucccuacgagaugauauuggaaauauguuugugcuagaccaucaaaauggggaaauuaaauccaaagacuuaauagacuucgaauuucguagcaguuauaccaugagaguagaagcuaaggaugguggaggcaugaccagcgaauguaaaauuauacuagaaauccuagaugagaaugacaaugccccagacgugguuuuuacuucaguguccaguucuguaacugaggacgcagaacccuggacggugaucacucuguucaaaacacaugauaaagauucgagagaaaauggggagguuacaugccucauaaacgaaagaguuccuuuuagaaucgaaucuuccgccaauaaugacuauaagcuuguaacagaugggacccuggauugggagcggaucccggaguacaacgucaccaucacugccacugacaagggcaagccuccgcucucauccagcacaagccucacccuacgcauuggugaagucaacgacaaugcuccgguuuuccaccaagucuccuacgugguccacguggccgaaaacaaccuucccggagccuccaucccacaagucagcgccucugaccuggaccuagggcugaauggccaagucuccuacuccaucguuaccacugacuuggagcugcgggcacugucguccuacguguccgugagcgcacagagcggggugguggucgcgcagcgugccuucgaccacgagcagcugugcgccuucgagcucacgaugcaggcccacgaccagggcucgcccgcgcucagcgccaacaugagccggcgcauguuggugggcgaccucaaugacaaugugccgcgggugcuguaccccgcgcuggggcccgauggcuccgcacucuucgauauagugccacgcgccgcagaguccggcuaccuggugaccaaggugguggcgguggacgcagauucgggacacaacgcuuggcuguccuaccacgugcugcaggccaucgagcccgggcuuuucagccuggggcugcacacgggaaccugcugguugcugugcgugacggaggacagccgccgcucucugcgccgcuacgcuucaccuagucuucgcag

SEQ ID NO: 20246 - RNA, 2504 nt, Homo sapiens
cugcgaagacuaggugaagcguagcggcgcagagagcggcggcuguccuccgucacgcacagcaaccagcagguucccgugugcagccccaggcugaaaagcccgggcucgauggccugcagcacgugguaggacagccaagcguugugucccgaaucugcguccaccgccaccaccuuggucaccagguagccggacucugcggcgcguggcacuauaucgaagagugcggagccaucgggccccagcgcgggguacagcacccgcggcacauugucauugaggucgcccaccaacaugcgccggcucauguuggcgcugagcgcgggcgagcccuggucgugggccugcaucgugagcucgaaggcgcacagcugcucguggucgaaggcacgcugcgcgaccaccaccccgcucugugcgcucacggacacguaggacgacagugcccgcagcuccaagucagugguaacgauggaguaggagacuuggccauucagcccuagguccaggucagaggcgcugacuugugggauggaggcuccgggaagguuguuuucggccacguggaccacguaggagacuugguggaaaaccggagcauugucguugacuucaccaaugcguagggugaggcuugugcuggaugagagcggaggcuugcccuugucaguggcagugauggugacguuguacuccgggauccgcucccaauccagggucccaucuguuacaagcuuauagucauuauuggcggaagauucgauucuaaaaggaacucuuucguuuaugaggcauguaaccuccccauuuucucucgaaucuuuaucauguguuuugaacagagugaucaccguccaggguucugcguccucaguuacagaacuggacacugaaguaaaaaccacgucuggggcauugucauucucaucuaggauuucuaguauaauuuuacauucgcuggucaugccuccaccauccuuagcuucuacucucaugguauaacugcuacgaaauucgaagucuauuaagucuuuggauuuaauuuccccauuuugauggucuagcacaaacauauuuccaauaucaucucguagggauuugaaagaguaggugaucuccgcauugacacccucauccuggucaguggcugucaccuuuaguacagaggugccugggggcacauucucucuaaggcugacuuuguauacauccuggcuaaaaacuggggcauuaucguuggcaucagugaccucaauuugaauugcagcagugccaguugggacugggucacccauguccauugcuuccaggaccaggagaugagagcucuguugcuccuggcccaggggcuucuccagcacuaauucuggagcguucuugccuuuagucuuguccaucaucagagagaaauguucauuagaacugagcugguaacucuggagagagugaggcccuacaucugcaucuauagcagauuccaggccaaaccgaaugccuggaauugcuaguucauugauuuguaaaacaaugcuauuuuggggaaaaugagguggguuaucauuuauaucuucuaucaucacauuuaugugaaaaacauuuagaggauucucugcuacaaucucuaaggguaugacacagaggauuuugaagacagugacucucgaucuauucugucacucacaaguauguucccauucuccguguucacgguaaaguauuguuucucugcacuaacucuaagguuucaggucaauaaauccugaacaugcagccgcauguccuccgcaagguuccccaccacggagcccuggaccguuucuucuggaauagaguagcggaucugcuccgagggugccccgcagaacaaaggcagcaggaaagggaagagugcuugccacugccggguccugcuucucugcuucacccuguuucccauccuucccaugcguugcugcagucuccgacguuaagagaaaauguuucacaaagugcuuuuaaaauauuuacuuccauacauagaaaacucaaugcucccaguuugagggcaccccaauccguauggaaucagauuugcaggagcagaaagcccaagucuuggccacucuccgacuugcuucugugacugaacagaauaucguccugguagaucccaggcuccaguucuugcagcacauuggccaacagcagggcucugagucuauuuagaaaacugcagccggaagccuuugcuaauucaaugggauucagaauuagacugauguguuggacuaauguauaggaaacuagacauuuuaugaguuuucguagugacuguuuuccaguguuuacuaccaaagaagauuccuuagagaugggaaucuauagaacagucauuaacccagcaaagagaauuuaaaaguuuguuuuuuucuaagcagaagcaaugcacauauuggaagaacuaggcaaagucuucucuccuguuguagaacaaaaaccuugugggaaaacauccccaucaa

SEQ ID NO: 20247 - RNA, 2610 nt, Homo sapiens
ugucugauauuuucucacagcuaccuauauauuucuucccaauuuaaaauauauuauuuuauuuuaugccuagcaaauaucuuuacaguauaaauauuuacgcucaugaaaguacguagccaguuauuucuuagggagaauuuuuucccuauauuuugaugggcuuccaaaaguauuaccaguaauucucaguaauuacaauuaggucaguuacccaggaaaagguaagucuguaacauucuuuggacuaccaauuuucuuuuacuaaguuuccugaacaauaaauauuuuugaaauauaauguauuaauagaauucuggaguacuuccauuauuuccagucaaugcaaguuggaaugcuucuacuuuaugcuaaaaauauuaauguuucuuuuucacuuggguucuuguuaagugugauucugauaauguauacaaucacauaucauuuuuagguuuccauaauaucaugaaaauuugauuuuuaagcguuacaugucaacaaccugguaaaguaauccuuccauucaggaucauucaaggaaucuauuuaaaaauauuuuccccaaauuauagcugaaucagaaaguuuaaauuauuauauuauaugauuugucaaaaagagaaacuccuagggagacaucuccauaauagguguguugggggaacaguaaucucaaagcagaugcacuaacauuauaagauuaaaaucauuguuuauagaaacuuccaauucauuuaaaagcucauuggggaaaaaaaagcucauugggaaaaaaaaaaaaagcucacuaaaguuucuauuaaagcgaauacgguagauuuccauccccuuuugaagaacaguagguggagcuauuuaagauauaaaaacgaaauauccuuucugggaguucaagauugugcaguaauugguuaggacucugagcgccgcuguucaccaaucggggagagaaaagcggagauccugcucgccuugcacgcgccugaagcacaaagcagauagcuaggaaugaaccaucccugggaguauguggaaacaacggaggagcucugacuucccaacugucccauucuaugggcgaaggaacugcuccugacuucagugguuaagggcagaauugaaaauaauucuggaggaagauaagaaugauuccugcgcgacugcaccgggacuacaaagggcuuguccugcugggaauccuccuggggacucugugggagaccggaugcacccagauacgcuauucaguuccggaagagcuggagaaaggcucuagggugggcgacaucuccagggaccuggggcuggagccccgggagcucgcggagcgcggaguccgcaucauccccagagguaggacgcagcuuuucgcccugaauccgcgcagcggcagcuuggucacggcgggcaggauagaccgggaggagcucuguaugggggccaucaagugucaauuaaaucuagacauucugauggaggauaaagugaaaauauauggaguagaaguagaaguaagggacauuaacgacaaugcgccuuacuuucgugaaagugaauuagaaauaaaaauuagugaaaaugcagccacugagaugcgguucccucuaccccacgccugggauccggauaucgggaagaacucucugcagagcuacgagcucagcccgaacacucacuucucccucaucgugcaaaauggagccgacgguaguaaguaccccgaauuggugcugaaacgcgcccuggaccgcgaagaaaaggcugcucaccaccugguccuuacggccuccgacgggggcgacccggugcgcacaggcaccgcgcgcauccgcgugaugguucuggaugcgaacgacaacgcaccagcguuugcucagcccgaguaccgcgcgagcguuccggagaaucuggccuugggcacgcagcugcuuguagucaacgcuaccgacccugacgaaggagucaaugcggaagugagguauuccuuccgguauguggacgacaaggcggcccaaguuuucaaacuagauuguaauucagggacaauaucaacaauaggggaguuggaccacgaggagucaggauucuaccagauggaagugcaagcaauggauaaugcaggauauucugcgcgagccaaaguccugaucacuguucuggacgugaacgacaaugccccagaagugguccucaccucucucgccagcucgguucccgaaaacucucccagagggacauuaauugcccuuuuaaauguaaaugaccaagauucugaggaaaacggacaggugaucuguuucauccaaggaaaucugcccuuuaaauuagaaaaaucuuacggaaauuacuauaguuuagucacagacauagucuuggauagggaacagguuccuagcuacaacaucacagugaccgccacugaccggggaaccccgccccuauccacggaaacucauaucucgcugaacguggcagacaccaacgacaacccgccggucuucccucaggccuccuauuccgcuuauaucccagagaacaaucccagaggaguuucccucgucucugugaccgcccacgaccccgacugugaagagaacgcccagauca

SEQ ID NO: 20248 - RNA, 2610 nt, Homo sapiens
ugaucugggcguucucuucacagucggggucgugggcggucacagagacgagggaaacuccucugggauuguucucugggauauaagcggaauaggaggccugagggaagaccggcggguugucguuggugucugccacguucagcgagauaugaguuuccguggauaggggcgggguuccccggucaguggcggucacugugauguuguagcuaggaaccuguucccuauccaagacuaugucugugacuaaacuauaguaauuuccguaagauuuuucuaauuuaaagggcagauuuccuuggaugaaacagaucaccuguccguuuuccucagaaucuuggucauuuacauuuaaaagggcaauuaaugucccucugggagaguuuucgggaaccgagcuggcgagagaggugaggaccacuucuggggcauugucguucacguccagaacagugaucaggacuuuggcucgcgcagaauauccugcauuauccauugcuugcacuuccaucugguagaauccugacuccucgugguccaacuccccuauuguugauauugucccugaauuacaaucuaguuugaaaacuugggccgccuugucguccacauaccggaaggaauaccucacuuccgcauugacuccuucgucagggucgguagcguugacuacaagcagcugcgugcccaaggccagauucuccggaacgcucgcgcgguacucgggcugagcaaacgcuggugcguugucguucgcauccagaaccaucacgcggaugcgcgcggugccugugcgcaccgggucgcccccgucggaggccguaaggaccagguggugagcagccuuuucuucgcgguccagggcgcguuucagcaccaauucgggguacuuacuaccgucggcuccauuuugcacgaugagggagaagugaguguucgggcugagcucguagcucugcagagaguucuucccgauauccggaucccaggcgugggguagagggaaccgcaucucaguggcugcauuuucacuaauuuuuauuucuaauucacuuucacgaaaguaaggcgcauugucguuaaugucccuuacuucuacuucuacuccauauauuuucacuuuauccuccaucagaaugucuagauuuaauugacacuugauggcccccauacagagcuccucccggucuauccugcccgccgugaccaagcugccgcugcgcggauucagggcgaaaagcugcguccuaccucuggggaugaugcggacuccgcgcuccgcgagcucccggggcuccagccccaggucccuggagaugucgcccacccuagagccuuucuccagcucuuccggaacugaauagcguaucugggugcauccggucucccacagaguccccaggaggauucccagcaggacaagcccuuuguagucccggugcagucgcgcaggaaucauucuuaucuuccuccagaauuauuuucaauucugcccuuaaccacugaagucaggagcaguuccuucgcccauagaaugggacaguugggaagucagagcuccuccguuguuuccacauacucccagggaugguucauuccuagcuaucugcuuugugcuucaggcgcgugcaaggcgagcaggaucuccgcuuuucucuccccgauuggugaacagcggcgcucagaguccuaaccaauuacugcacaaucuugaacucccagaaaggauauuucguuuuuauaucuuaaauagcuccaccuacuguucuucaaaaggggauggaaaucuaccguauucgcuuuaauagaaacuuuagugagcuuuuuuuuuuuuucccaaugagcuuuuuuuuccccaaugagcuuuuaaaugaauuggaaguuucuauaaacaaugauuuuaaucuuauaauguuagugcaucugcuuugagauuacuguucccccaacacaccuauuauggagaugucucccuaggaguuucucuuuuugacaaaucauauaauauaauaauuuaaacuuucugauucagcuauaauuuggggaaaauauuuuuaaauagauuccuugaaugauccugaauggaaggauuacuuuaccagguuguugacauguaacgcuuaaaaaucaaauuuucaugauauuauggaaaccuaaaaaugauaugugauuguauacauuaucagaaucacacuuaacaagaacccaagugaaaaagaaacauuaauauuuuuagcauaaaguagaagcauuccaacuugcauugacuggaaauaauggaaguacuccagaauucuauuaauacauuauauuucaaaaauauuuauuguucaggaaacuuaguaaaagaaaauugguaguccaaagaauguuacagacuuaccuuuuccuggguaacugaccuaauuguaauuacugagaauuacugguaauacuuuuggaagcccaucaaaauauagggaaaaaauucucccuaagaaauaacuggcuacguacuuucaugagcguaaauauuuauacuguaaagauauuugcuaggcauaaaauaaaauaauauauuuuaaauugggaagaaauauauagguagcugugagaaaauaucagaca

SEQ ID NO: 20249 - RNA, 2560 nt, Homo sapiens
aaacaucuuuugcucccucugcuguuucccagcaguaaacccagagaaccccaaucccagaguuacuauuuuauuuuagaauaguggaaaaacaaagcucuugcucacggucuuauucuggcugaaguaauaccaaaacaaccaaguucaucguggucucaaacaaaagaggaaaacuuagucuuuaccaaugaggcuacgauggcaaauuugccccgaaucuuuuaaggggguauuaacacacccuuccauuacaauaaauuuuuugaauuacuguauaguuguuuuaugaaaagugauuggaacaauugacucccaaguuuaaguaucuuggaaaaagagcaugagacuuucagucuccaggauaaggguuuccuccaccucugugauuccugcugcacuuugagacagaacccacagaaaucuucaaaaauauuaacucuccguccaggucagcaugcccaggaggucacgucccacuucccagcucuugucccacuuccuaacacuugucugcgcgaagcaguagcagucagaaccaggcaccagagcgcccccugaagguagaccggggagcggggccucagacauaucagcccguaccuggccagacaguuuuccuccgccgcgcaucucagguuguacauggacaucuucugcacguacguggacgccuggauguaguaggggucggccaccaggucugggagaccuaaacgucagcaggcgacgggcgcagcagugaaacaacccggcgccccccgcuccaacucccuaccccucuaggucccuuacuccucacccuucgcccaccgggacugcagaguggagcggaggacagcaagagaacuggggacgcccgggacugcaaagcaaugugaaaaggaagcaggaggggccagacgcgcgguuugcacuggauuccagggcugccacugcaggcgcgugggggagggaucggaucugcgaggaccggggcccgccgcgcccaggcagccacgucgagaagccacauagcuggggaccaggugcacgggugcuuccagcggacuuggggguacuuaccguacuggaaguagccagugccguauccgggccgguaccugcccccaggucugggccuuucauaaguaucguaguaguuguaauaaggguugucgucagaguacuuguagggguuguaagggucgucgcccaccaugccguccacgcggcugggcggccgcagguuacugagcgcaggaacuucucccggcgcugucugguucuccgcgcgcgaggcgccagcuucgcgggcucuagaugucgaguagccagcuuggaaccagugacgggcggugggccuggggcggccagcggugacuccagaugagccggccguccgcguucgcgccgcggcggugcgguugucgcggaucagcaggaucggagugcggggcugcugggcggaggcguuggcugcaccagggacggcggcgcccgggucccggcggcgcugaggcugguacugugagcccaggcucagcaagcugaacaccugcccguuguucucccauuggaucugcuggcgccaggcgcccggagccgccggcggcucgcgcgggggcugcuguuggccggcggcgggaggggcgcagugcacuagcgcgcagagcugcaaaggcccgagcaggagcacgguccaggcgaagcgcaucacuccuuuugccagauugaccccgcucgaggaggacguggcucacagaaaauaaaaacggggcucaaaucacgugagggaaggagaaaucuucaaccaaggaggcgagcggagcacggguaucucagucuccaccaagcaaugccaagggugggauucagacccuuccccagucaaggcggcugcucggacguggcacccuucccuuuccccuuucucaguccuggaaggcaacggggagcggcgcggcagucccggagagcgggcagugucuggagugaaggaaggaggagagauuuuaaacuuucuggcacguuugcaaaguuacacaagccguucuggcccggccgccccucagcuauuuguucacguaaugcgauuggaaacgugcaaggcggacagcuccucgccucugccccucccucucucccgucccugcccuccuccccccagacacguugcacagggagcguuaaggggaaagaacaaaacggaacacacauccugagacacacuggcuuaaucuggggcgaacaugcaggaauuucaaaaaacucagacaggcgaaggcagccaggccauggggcgacgccaaaauaugcacgaagaaaaaugcuauuaggucaccagcccuugagaggcgggaagucgggagguugggagggugcugggggugagaggggggcgggggaggauugugacuaaaguuuauccauaaaagaguuaaccagacacauuucccaacgcacacucucucgcuuuuaugggaagcgcccucagcaaauaaaccccaggauaucaaauuuuguuuuucuguguguagguaauaugagaaauggguuacaaauuuauuuccuacaguga

SEQ ID NO: 20250 - RNA, 2560 nt, Homo sapiens
ucacuguaggaaauaaauuuguaacccauuucucauauuaccuacacacagaaaaacaaaauuugauauccugggguuuauuugcugagggcgcuucccauaaaagcgagagagugugcguugggaaaugugucugguuaacucuuuuauggauaaacuuuagucacaauccucccccgccccccucucacccccagcacccucccaaccucccgacuucccgccucucaagggcuggugaccuaauagcauuuuucuucgugcauauuuuggcgucgccccauggccuggcugccuucgccugucugaguuuuuugaaauuccugcauguucgccccagauuaagccagugugucucaggauguguguuccguuuuguucuuuccccuuaacgcucccugugcaacgugucuggggggaggagggcagggacgggagagagggaggggcagaggcgaggagcuguccgccuugcacguuuccaaucgcauuacgugaacaaauagcugaggggcggccgggccagaacggcuuguguaacuuugcaaacgugccagaaaguuuaaaaucucuccuccuuccuucacuccagacacugcccgcucuccgggacugccgcgccgcuccccguugccuuccaggacugagaaaggggaaagggaagggugccacguccgagcagccgccuugacuggggaagggucugaaucccacccuuggcauugcuugguggagacugagauacccgugcuccgcucgccuccuugguugaagauuucuccuucccucacgugauuugagccccguuuuuauuuucugugagccacguccuccucgagcggggucaaucuggcaaaaggagugaugcgcuucgccuggaccgugcuccugcucgggccuuugcagcucugcgcgcuagugcacugcgccccucccgccgccggccaacagcagcccccgcgcgagccgccggcggcuccgggcgccuggcgccagcagauccaaugggagaacaacgggcagguguucagcuugcugagccugggcucacaguaccagccucagcgccgccgggacccgggcgccgccgucccuggugcagccaacgccuccgcccagcagccccgcacuccgauccugcugauccgcgacaaccgcaccgccgcggcgcgaacgcggacggccggcucaucuggagucaccgcuggccgccccaggcccaccgcccgucacugguuccaagcuggcuacucgacaucuagagcccgcgaagcuggcgccucgcgcgcggagaaccagacagcgccgggagaaguuccugcgcucaguaaccugcggccgcccagccgcguggacggcauggugggcgacgacccuuacaaccccuacaaguacucugacgacaacccuuauuacaacuacuacgauacuuaugaaaggcccagaccugggggcagguaccggcccggauacggcacuggcuacuuccaguacgguaaguacccccaaguccgcuggaagcacccgugcaccugguccccagcuauguggcuucucgacguggcugccugggcgcggcgggccccgguccucgcagauccgaucccucccccacgcgccugcaguggcagcccuggaauccagugcaaaccgcgcgucuggccccuccugcuuccuuuucacauugcuuugcagucccgggcguccccaguucucuugcuguccuccgcuccacucugcagucccggugggcgaagggugaggaguaagggaccuagagggguagggaguuggagcggggggcgccggguuguuucacugcugcgcccgucgccugcugacguuuaggucucccagaccugguggccgaccccuacuacauccaggcguccacguacgugcagaagauguccauguacaaccugagaugcgcggcggaggaaaacugucuggccagguacgggcugauaugucugaggccccgcuccccggucuaccuucagggggcgcucuggugccugguucugacugcuacugcuucgcgcagacaaguguuaggaagugggacaagagcugggaagugggacgugaccuccugggcaugcugaccuggacggagaguuaauauuuuugaagauuucuguggguucugucucaaagugcagcaggaaucacagagguggaggaaacccuuauccuggagacugaaagucucaugcucuuuuuccaagauacuuaaacuugggagucaauuguuccaaucacuuuucauaaaacaacuauacaguaauucaaaaaauuuauuguaauggaaggguguguuaauacccccuuaaaagauucggggcaaauuugccaucguagccucauugguaaagacuaaguuuuccucuuuuguuugagaccacgaugaacuugguuguuuugguauuacuucagccagaauaagaccgugagcaagagcuuuguuuuuccacuauucuaaaauaaaauaguaacucugggauugggguucucuggguuuacugcugggaaacagcagagggagcaaaagauguuu

SEQ ID NO: 20251 - RNA, 2478 nt, Homo sapiens
caacugaagcugcuccucaaaucccugccuaaaauaccccgugugagcaaauaagaggagugggggaagaguccauguucacagcugaaagguccgagauacucaaaauccucaaguccaaggguguaggaaggaaaaucuccuucagauacaaauuaccagcagcaauauauuaccccuaauacuugaauagugagguagauacauggaaaagucaugaaaauauagcagacucagguccucuaggacuaaagcucuuuagacauaaacuuacaaauuccaugcaaagaggaacugaacuguacaaauaacaaauaaucacucaaauaaguuuucucucuuuuuacagcuuaaaaaaauaaaaaaggcagaaggaugcccuuccuucugcauaucucuauacaauuuuacaauuuuauucuaaguuuauuacccucaaguuaaauagucuguuuaguguucuguugggggggggggucuuuaaaaguagaaaaacugcuuuacagcagugagucauuuguacuacaauuccucccuugugaaucaauguuaucgcuaggcacaguaccuugauggcccacaaagucuuccgugccugggaggucuucacacagcaguuuauuuucuuucuccuguuccacgugauauccacucugcuccccuguguugccguugcuggaguagccauucccauaggccuucaaagaagaccugcgcaggcacagaagcuccuggaaggcaauccugaaaucugggcuccggcaguagauaaggggauugaaaccagaauugacauagccuauccaauuuaggaggauguaaacuuccuuacggaugagguuauccuggaucacaugcacaauguuaacgaugaagaagggcagccagcagagggugaaagugcccaugaugaugccuaacgucuugagggcuuugugcuccuucaagcagaacuuggaagaucugcggaguccaugccccguccgcccauccugcuccaccuggcuaagguucuggacauggaagcggcccucagauuugucaaucuucuggagcugccuuuuggccuccugaaagacccuggaguagacgaagaccaugaucaccaggggaacguagaaggacacgauggaagaggcaauggcauaggcuugguucgugaagaagucacagcaggucucauuggcauagcaguugauggcuuccugguggguggcccgguaccagugcaucugaaugggcaagaaggagguaaggccugacacaauccacaccaucagaaugaucacccgggccuuauucuuggucagcaggcucugguacuugaaaggugaaguaauggcaaaguagcgauccacugcgaucacgcacagggucucaaugcuggccgugacgcacagcacaucaauggaaguccaaaacucgcaccagaaguugccaaaaguccacauuuucauaagaauaugggcggccccaaagggcaccacugccaggcccaugaccagaucagcacaggccagugaagugaugaaguaguuggugaccgucugcagacgcucgaacuuggcaauggcugugaugaccagcacauugccaaacacgauggccaggacgaugagagacaugacgaugcccaugcccaccacccacaccucgucccuuuccugcgugacgucgugguccggcgcauggcuuccauugggugccagcaagaaggcgcugccguucccggguugccccauggcgcgcagucuggcaggugagcgcacuggcugggggcgccucagcgggcggacccacggcggggcucugcgggccgcgagcggacgccuggaagccucauucagcggcuguggugugggugugguggggacucguccugcacacucagcuugucgggugcuaggggcucgcggugccugccaguuccagcccgugcucugaagaagccgcuucgcagugcguucugcccguuaugugcacaggacuuuaggggaacugcccucgccgugacguacgggaacuuucggccaauggcacgccggcagccgcgaaggggcgaggcacuccuccccuuucccuccccuccccucgcccuccuucuccuggggcuggcccgggcggggcccaacugcucccuggagggcgggccaccacugcuucccggcuacccuggcuggccccagagggcuaaagcuggaggugguguccuuaccagccaacccgggagcuuuuggcucuucuguggccgcuaccugccugcccugggcgccugcgcggcuugaggucucaaggcagagggcagcacaccggcacugccccacauucggaaggaaacgagagugcccaccgaggcacgcacauacaggcacaaauacacccuggcagacaugcucagacuuauaccgaaccacagccauagacacugagacacacccucccagcucaccgacaugcacacucgcgcgcgcucucaca

SEQ ID NO: 20252 - RNA, 2478 nt, Homo sapiens
ugugagagcgcgcgcgagugugcaugucggugagcugggagggugugucucagugucuauggcugugguucgguauaagucugagcaugucugccaggguguauuugugccuguaugugcgugccucggugggcacucucguuuccuuccgaauguggggcagugccggugugcugcccucugccuugagaccucaagccgcgcaggcgcccagggcaggcagguagcggccacagaagagccaaaagcucccggguuggcugguaaggacaccaccuccagcuuuagcccucuggggccagccaggguagccgggaagcagugguggcccgcccuccagggagcaguugggccccgcccgggccagccccaggagaaggagggcgaggggaggggagggaaaggggaggagugccucgccccuucgcggcugccggcgugccauuggccgaaaguucccguacgucacggcgagggcaguuccccuaaaguccugugcacauaacgggcagaacgcacugcgaagcggcuucuucagagcacgggcuggaacuggcaggcaccgcgagccccuagcacccgacaagcugagugugcaggacgaguccccaccacacccacaccacagccgcugaaugaggcuuccaggcguccgcucgcggcccgcagagccccgccguggguccgcccgcugaggcgcccccagccagugcgcucaccugccagacugcgcgccauggggcaacccgggaacggcagcgccuucuugcuggcacccaauggaagccaugcgccggaccacgacgucacgcaggaaagggacgagguguggguggugggcaugggcaucgucaugucucucaucguccuggccaucguguuuggcaaugugcuggucaucacagccauugccaaguucgagcgucugcagacggucaccaacuacuucaucacuucacuggccugugcugaucuggucaugggccuggcaguggugcccuuuggggccgcccauauucuuaugaaaauguggacuuuuggcaacuucuggugcgaguuuuggacuuccauugaugugcugugcgucacggccagcauugagacccugugcgugaucgcaguggaucgcuacuuugccauuacuucaccuuucaaguaccagagccugcugaccaagaauaaggcccgggugaucauucugaugguguggauugugucaggccuuaccuccuucuugcccauucagaugcacugguaccgggccacccaccaggaagccaucaacugcuaugccaaugagaccugcugugacuucuucacgaaccaagccuaugccauugccucuuccaucguguccuucuacguuccccuggugaucauggucuucgucuacuccagggucuuucaggaggccaaaaggcagcuccagaagauugacaaaucugagggccgcuuccauguccagaaccuuagccagguggagcaggaugggcggacggggcauggacuccgcagaucuuccaaguucugcuugaaggagcacaaagcccucaagacguuaggcaucaucaugggcacuuucacccucugcuggcugcccuucuucaucguuaacauugugcaugugauccaggauaaccucauccguaaggaaguuuacauccuccuaaauuggauaggcuaugucaauucugguuucaauccccuuaucuacugccggagcccagauuucaggauugccuuccaggagcuucugugccugcgcaggucuucuuugaaggccuaugggaauggcuacuccagcaacggcaacacaggggagcagaguggauaucacguggaacaggagaaagaaaauaaacugcugugugaagaccucccaggcacggaagacuuugugggccaucaagguacugugccuagcgauaacauugauucacaagggaggaauuguaguacaaaugacucacugcuguaaagcaguuuuucuacuuuuaaagacccccccccccaacagaacacuaaacagacuauuuaacuugaggguaauaaacuuagaauaaaauuguaaaauuguauagagauaugcagaaggaagggcauccuucugccuuuuuuauuuuuuuaagcuguaaaaagagagaaaacuuauuugagugauuauuuguuauuuguacaguucaguuccucuuugcauggaauuuguaaguuuaugucuaaagagcuuuaguccuagaggaccugagucugcuauauuuucaugacuuuuccauguaucuaccucacuauucaaguauuagggguaauauauugcugcugguaauuuguaucugaaggagauuuuccuuccuacacccuuggacuugaggauuuugaguaucucggaccuuucagcugugaacauggacucuucccccacuccucuuauuugcucacacgggguauuuuaggcagggauuugaggagcagcuucaguug

SEQ ID NO: 20253 - RNA, 2832 nt, Homo sapiens
ucgucccagaaccuacugacuguccucgacccccgacucucugcaugcuccggaucucacucccgggagggcccggagaaaacccaaguuggggugagacucagaggggggcgguucuaguggagagguaaacggggggggacaacgcugcagcccccuggggcgagggugcgcucuacagagcgcugggggcaagggcaccuggccucucagagaaguuggugggggagggcaaugugacaauuaaagauauguagucuugaggaaucaguccccaaagagagaggcgauugaaucuacccggauuucguuuaaguggggagcuggucuucuugggggaaaaaagugcaaaaagaaaaguagagaggguggagcaggggaugcggcgaguggacccccagugggugcucggggcgcgcgggguguugcugcugcuggacgcccuccccgcaccuccgccccaggcgcggggccugccccaacccucgcgcggccccucccccguucccccuccccgccgagcgggccugagccgcggagcagcuacgcgagugcggaacucggggcgcgggcggcgguggggcccgggcgcgggcagggcuggccauggcgcgggcggcgggcgcgcggggcccugccggguggugcaggaggcgcgggcgcugcgggcggggcacgcuccucgccuucgccgcguggaccgcgggcugggugcuggcggccgcgcugcugcuccgcgcgcacccggguguccucuccgagcgcugcaccgacgagaagagccggcgcauccuggccgcgcugguaggucccgccgccgcucugccccgcgccgcgcguccggggaggggggaucacacccgcucccgguccccagccuucccggggacuuggguggcgguggcacccgccggggacauggguucccgacaccugcguggagugccagaggcgcacgccccggucccccgaauggggacgcagccggcagugcucugugggcgcgcugggggugucucuccccuuuucgccagaauucgcccuuuguccccagacagccucuccguccuacccucgccaccccugagcccgagcuccggaagaaaguuugcgggucugauccgaguguccagggaggugccgcguccggugucaggccgccgggcucggggcgcaagccagugcgggguucgggauccggggugccacgccucugucucucggguccgcagcgcuccagcccagcccgcguucugugauuccacccugagcugccaggucacccccuaucucaccgagcccaugcggagggcuggucugaccccggccccccugcgcuccagagcccaggcucuccgcggucgcggucugugggaaccgacgcagugugcgcucgggcgagcagagagcgcugcggaggcggcugggaccgggaggaucccgggucccgguccucgacaggcgccuccuaaccugggagggcccgaaagcucgcacccagcagcuccucagcugagccagagaauuagggagagaaagaaacauuucgcauuuugcagacugcugcguacgcugggcucacaucauaugaaugaaacgcccaccuuuaguugauuggaaacuuggcuagccguucuuucaggcgcaaaggagacuucaguaaaggugggaguccccuaaaucccagaaaggggaagauaguagcagcuacucuuacaugacuucuuaagcgauuauucauuuccuaaaauagugaccaucuaagcauuugguuugaaaagagaucuauuuucuaaaaaaucuucaagaaacacaugggaaguuuucaguccaguugcuuacauaugggugggccuuuugagauuguagauuuucaaaaugugggaccacaaaguuuuuaaaguaaaugauuuuuuaagugagauugaaauuguuuuuuaaaaaaaugagccagguauacuagcuaagacaaguuaugcuccuaauugauucugacgcgugucaucgugucaucgugaauugaacauaggugagucacucauagauucuauugaccccuucuaguguuacacugaaguuuuagcaaguuuuguuguuguugguuugguuuuuuuuuucuuuuucuuuuucuuuuuuuuuuauggaguuuugcucuugucucccaggcuaaagugcaauggcgugaucucggcucaccgcaaccuccaccaccaugccuggcuaauuuuguauuuuuaauagagauggugguuuguccauguuggucaggcucgucucgaacucccaaccucaggcgauccgcccacuucggccuuccaaagugcuaggauuacaggcgugaaccaccacaccgggccaguuuuaugaaguuuuaaguugcaagagcucuuugauuuuucuuaguaacccauaaaaguccuuuucauuuauaaauuuuuccccccugguuuucuuuuuuugugaagggagugcugauagacuaauuauaguaaacaaacauugaugguuuaacuagaggggaauaccuauuuacaaauuuaauguaguaauccuuuagauuaagauagaaaacgaaugccauuuuucauuuaccuuugguuaagugaggaaaggcuuaauaauggaaauuaaaucgucuaguauaauuuaaguaauugcuaaucaugacuuucccagcauuccaggucaugaauuaaaaccaauucuguuuagaggcuuuaccaauauaucuucaauggcagccauauggaaucauuucuagucagacauaaagcuggagagguugguucugccccugaagaucgaagguuuggcagucuuuccuauugccaa

SEQ ID NO: 20254 - RNA, 2832 nt, Homo sapiens
uuggcaauaggaaagacugccaaaccuucgaucuucaggggcagaaccaaccucuccagcuuuaugucugacuagaaaugauuccauauggcugccauugaagauauauugguaaagccucuaaacagaauugguuuuaauucaugaccuggaaugcugggaaagucaugauuagcaauuacuuaaauuauacuagacgauuuaauuuccauuauuaagccuuuccucacuuaaccaaagguaaaugaaaaauggcauucguuuucuaucuuaaucuaaaggauuacuacauuaaauuuguaaauagguauuccccucuaguuaaaccaucaauguuuguuuacuauaauuagucuaucagcacucccuucacaaaaaaagaaaaccaggggggaaaaauuuauaaaugaaaaggacuuuuauggguuacuaagaaaaaucaaagagcucuugcaacuuaaaacuucauaaaacuggcccgguguggugguucacgccuguaauccuagcacuuuggaaggccgaagugggcggaucgccugagguugggaguucgagacgagccugaccaacauggacaaaccaccaucucuauuaaaaauacaaaauuagccaggcauggugguggagguugcggugagccgagaucacgccauugcacuuuagccugggagacaagagcaaaacuccauaaaaaaaaaagaaaaagaaaaagaaaaaaaaaaccaaaccaacaacaacaaaacuugcuaaaacuucaguguaacacuagaaggggucaauagaaucuaugagugacucaccuauguucaauucacgaugacacgaugacacgcgucagaaucaauuaggagcauaacuugucuuagcuaguauaccuggcucauuuuuuuaaaaaacaauuucaaucucacuuaaaaaaucauuuacuuuaaaaacuuuguggucccacauuuugaaaaucuacaaucucaaaaggcccacccauauguaagcaacuggacugaaaacuucccauguguuucuugaagauuuuuuagaaaauagaucucuuuucaaaccaaaugcuuagauggucacuauuuuaggaaaugaauaaucgcuuaagaagucauguaagaguagcugcuacuaucuuccccuuucugggauuuaggggacucccaccuuuacugaagucuccuuugcgccugaaagaacggcuagccaaguuuccaaucaacuaaaggugggcguuucauucauaugaugugagcccagcguacgcagcagucugcaaaaugcgaaauguuucuuucucucccuaauucucuggcucagcugaggagcugcugggugcgagcuuucgggcccucccagguuaggaggcgccugucgaggaccgggacccgggauccucccggucccagccgccuccgcagcgcucucugcucgcccgagcgcacacugcgucgguucccacagaccgcgaccgcggagagccugggcucuggagcgcaggggggccggggucagaccagcccuccgcaugggcucggugagauagggggugaccuggcagcucaggguggaaucacagaacgcgggcugggcuggagcgcugcggacccgagagacagaggcguggcaccccggaucccgaaccccgcacuggcuugcgccccgagcccggcggccugacaccggacgcggcaccucccuggacacucggaucagacccgcaaacuuucuuccggagcucgggcucagggguggcgaggguaggacggagaggcugucuggggacaaagggcgaauucuggcgaaaaggggagagacacccccagcgcgcccacagagcacugccggcugcguccccauucgggggaccggggcgugcgccucuggcacuccacgcaggugucgggaacccauguccccggcgggugccaccgccacccaaguccccgggaaggcuggggaccgggagcgggugugauccccccuccccggacgcgcggcgcggggcagagcggcggcgggaccuaccagcgcggccaggaugcgccggcucuucucgucggugcagcgcucggagaggacacccgggugcgcgcggagcagcagcgcggccgccagcacccagcccgcgguccacgcggcgaaggcgaggagcgugccccgcccgcagcgcccgcgccuccugcaccacccggcagggccccgcgcgcccgccgcccgcgccauggccagcccugcccgcgcccgggccccaccgccgcccgcgccccgaguuccgcacucgcguagcugcuccgcggcucaggcccgcucggcggggagggggaacgggggaggggccgcgcgaggguuggggcaggccccgcgccuggggcggaggugcggggagggcguccagcagcagcaacaccccgcgcgccccgagcacccacuggggguccacucgccgcauccccugcuccacccucucuacuuuucuuuuugcacuuuuuucccccaagaagaccagcuccccacuuaaacgaaauccggguagauucaaucgccucucucuuuggggacugauuccucaagacuacauaucuuuaauugucacauugcccucccccaccaacuucucugagaggccaggugcccuugcccccagcgcucuguagagcgcacccucgccccagggggcugcagcguuguccccccccguuuaccucuccacuagaaccgccccccucugagucucaccccaacuuggguuuucuccgggcccucccgggagugagauccggagcaugcagagagucgggggucgaggacagucaguagguucugggacga

SEQ ID NO: 20255 - RNA, 2593 nt, Homo sapiens
cacuuuccuugggcccuauguuauaauuggguuacauacucaguuuuuguugugugaaauccuggagggcuuggaugggguggaggggaauccuauagacuccagggccaagugcgcaggaaggggaugcucaggcuacauucuucagucucauuuucauaugcaggugacucugugaacgcagacauacaucuugucugggacuuaacucauccauuaguuuauauagucugaggcaucagauacaauugcgauuucaagaagaucaaaggccgagaaaaaugaucaagcauccagucguaaagcaaagggcuucaaaggucaagcuaagaagacgacucccuuccaccuccagcucugcaccucccuuggcugacagcuguguggugacagacuugagcauuccgucccggcugcgaggaacaaccagacuccuggagaaccgcagcuuuucccguggguucguccuuauaugccuggaaaagaaugaggcgcuuucuucuacccaagaaaagcccuugaaaccuggccgaggaucugacucuggcgccugcucucucucgccuugguggggcucacggcagcgcacguuggcuccaggcuggaggaaggggggcguugcugucacccagcuccgcacucgcucuugcagccucccagccuacuacagagcugcugaaguuccagaaugggccccuguuguccuugggguacagucugcaccuuuaaugcgaaacccagcagaggcagcaccaagagucaagucugccuuucccguccuccuguccccaacaccuggcgccgccaacucccgacaaagcgacuccuggugcuuggugaucugcccucuuucggggauucuaccuuaucuuucuuccacucucuaacacuacccuucuuuugcuuucuuuuuuacacaaaaauuagcaaaguccuccccucuuuuuccccuucuccaaguuggaggauucauccagucaucagggaacacaggaaagguucuagcucaaggacccuuugccccgggaggcaggagcuugguagaacuggaaguuggagaacagugagguagacacaaccagagucuggaacaggggcccuuucuuucccagacgaguuuccccucgcuuuucuggaccagccagccggggucagccucccaggccacccuacaucgcgcgcuccccagggaccuccugcccaucccuccauccucucucucgcgucccaagucuaggcugcucccgcccaggugacagccccuccugucccgcugccucccgugagucccuccuaccgccucgucuggucacuagaauaguuuugaacccuuggguucuacacgguuucccucccaagccaggcagcgcaucucucaagaauagggaaaggucuccaucaacuuugccgucacggagcagugaccgcgggcgggcgcggggcacacaccugccugcacgcgggcgcggguccccggguaggggagcacuugcggggcgcgggagccgcccucggccacggcgaaggcgcccuaaacuacagccggcagggacgcgcggcgcugggagggcaucagacgggaauuucgaauugagcuugggaagcggagaccagaaaauggugauucuaaacacacgcgagcgucgccacacacagcaguuccacccgaaaggcgcacacuuuugagaacagaccaucguggauagcaccgcaaagaaaccuccuccaaggcacguuccucguuggaacugacaaccccuuucgucuacugacuuccccgcacggucgaagacagcccggugcacucgaggauggggacucaggcgcuccuggaguccccagguccgucugcggagccccccggcaggugugggcccccaccuggccaagcaacaagcgggccauccgccuaagggccgggucccucucugcccuguacccgcacgggucaccucucccugccccccccccaggcagccagccgggccgaacgagcgccggggaaggagcaagccgagcgagccacucaccccaagcuuccugcugcggauuuucacguagcccugcuugacuaugucguuaaaguuggaggccauggccagcgcgaucgggcuccugcgccccgcgauccgcucuccggagucgagagccgccguccgccgccgggucugcgcgggucucgcauccagccggccgccgccagcagcagcgccgccgcccgcucuuccccgagcucccgccgguggggacgcggggucgccugcagggccgccgcggacggggaacggggcccggcgccgcgagccgcgccagcccuccgcguucuggcgcucaccuucgcuccccgccgcgagcccagcgccgcggcccgcgccuccgccagcugcgggagcccccaccgcgccgccgcccccggcagcacccacgggcuggcgccucgcucggcggcgcacagcuggccggagcgcaccaccgcggcuccccggcgcggggggagggggcgggccggggggggcgggcugaugcgccggccccgcucccucccccuggcccgugggguggcugggcucggagacgcucgcaagacgcgcuc

SEQ ID NO: 20256 - RNA, 2593 nt, Homo sapiens
gagcgcgucuugcgagcgucuccgagcccagccaccccacgggccagggggagggagcggggccggcgcaucagcccgccccccccggcccgcccccuccccccgcgccggggagccgcgguggugcgcuccggccagcugugcgccgccgagcgaggcgccagcccgugggugcugccgggggcggcggcgcggugggggcucccgcagcuggcggaggcgcgggccgcggcgcugggcucgcggcggggagcgaaggugagcgccagaacgcggagggcuggcgcggcucgcggcgccgggccccguuccccguccgcggcggcccugcaggcgaccccgcguccccaccggcgggagcucggggaagagcgggcggcggcgcugcugcuggcggcggccggcuggaugcgagacccgcgcagacccggcggcggacggcggcucucgacuccggagagcggaucgcggggcgcaggagcccgaucgcgcuggccauggccuccaacuuuaacgacauagucaagcagggcuacgugaaaauccgcagcaggaagcuuggggugaguggcucgcucggcuugcuccuuccccggcgcucguucggcccggcuggcugccuggggggggggcagggagaggugacccgugcggguacagggcagagagggacccggcccuuaggcggauggcccgcuuguugcuuggccaggugggggcccacaccugccggggggcuccgcagacggaccuggggacuccaggagcgccugaguccccauccucgagugcaccgggcugucuucgaccgugcggggaagucaguagacgaaagggguugucaguuccaacgaggaacgugccuuggaggagguuucuuugcggugcuauccacgauggucuguucucaaaagugugcgccuuucggguggaacugcuguguguggcgacgcucgcguguguuuagaaucaccauuuucuggucuccgcuucccaagcucaauucgaaauucccgucugaugcccucccagcgccgcgcgucccugccggcuguaguuuagggcgccuucgccguggccgagggcggcucccgcgccccgcaagugcuccccuacccggggacccgcgcccgcgugcaggcaggugugugccccgcgcccgcccgcggucacugcuccgugacggcaaaguugauggagaccuuucccuauucuugagagaugcgcugccuggcuugggagggaaaccguguagaacccaaggguucaaaacuauucuagugaccagacgaggcgguaggagggacucacgggaggcagcgggacaggaggggcugucaccugggcgggagcagccuagacuugggacgcgagagagaggauggagggaugggcaggaggucccuggggagcgcgcgauguaggguggccugggaggcugaccccggcuggcugguccagaaaagcgaggggaaacucgucugggaaagaaagggccccuguuccagacucugguugugucuaccucacuguucuccaacuuccaguucuaccaagcuccugccucccggggcaaaggguccuugagcuagaaccuuuccuguguucccugaugacuggaugaauccuccaacuuggagaaggggaaaaagaggggaggacuuugcuaauuuuuguguaaaaaagaaagcaaaagaaggguaguguuagagaguggaagaaagauaagguagaauccccgaaagagggcagaucaccaagcaccaggagucgcuuugucgggaguuggcggcgccagguguuggggacaggaggacgggaaaggcagacuugacucuuggugcugccucugcuggguuucgcauuaaaggugcagacuguaccccaaggacaacaggggcccauucuggaacuucagcagcucuguaguaggcugggaggcugcaagagcgagugcggagcugggugacagcaacgccccccuuccuccagccuggagccaacgugcgcugccgugagccccaccaaggcgagagagagcaggcgccagagucagauccucggccagguuucaagggcuuuucuuggguagaagaaagcgccucauucuuuuccaggcauauaaggacgaacccacgggaaaagcugcgguucuccaggagucugguuguuccucgcagccgggacggaaugcucaagucugucaccacacagcugucagccaagggaggugcagagcuggagguggaagggagucgucuucuuagcuugaccuuugaagcccuuugcuuuacgacuggaugcuugaucauuuuucucggccuuugaucuucuugaaaucgcaauuguaucugaugccucagacuauauaaacuaauggaugaguuaagucccagacaagauguaugucugcguucacagagucaccugcauaugaaaaugagacugaagaauguagccugagcauccccuuccugcgcacuuggcccuggagucuauaggauuccccuccaccccauccaagcccuccaggauuucacacaacaaaaacugaguauguaacccaauuauaacauagggcccaaggaaagug

SEQ ID NO: 20257 - RNA, 2346 nt, Homo sapiens
gcagcugggcugagacugcucccgggugugauggggcugcuguguccagauuugggucucugagucucugggaagcgaccucaccccacagccccgagccccaacuugagggucacagagcucggcaggcaggcuuuucccacccccugacucucagccccauggggccuggggcagccgucaacugcgccuucuccccuccuccgcccccaaccuuagagccccccaccccacugcuuccugcucuagcggcccccggggaagagggagcagggagcuggcagccgccccagcccacuccuuacaaggccugagcccggccccaggcccgcccccggcccgcccgcaggaggccccaggcccucccccugucaagagcugccgccagcccggggccggaccaguccgggggcaucgcgaugcugcugcgccuguugcuggccugggcggccgcagggcccacacugggccaggaccccugggcugcugagccccgugccgccugcggccccagcagcugcuacgcucucuucccacggcgccgcaccuuccuggaggccuggcgggccugccgcgagcuggggggcgaccuggccacuccucggacccccgaggaggcccagcguguggacagccuggugggugcgggcccagccagccggcugcuguggaucgggcugcagcggcaggcccggcaaugccagcugcagcgcccacugcgcggcuucacguggaccacaggggaccaggacacggcuuucaccaacugggcccagccagccucuggaggccccugcccggcccagcgcuguguggcccuggaggcaaguggcgagcaccgcuggcuggagggcucgugcacgcuggcugucgacggcuaccugugccaguuuggcuucgagggcgccugcccggcgcugcaagaugaggcgggccaggccggcccagccguguauaccacgcccuuccaccuggucuccacagaguuugaguggcugcccuucggcucuguggccgcugugcagugccaggcuggcaggggagccucucugcucugcgugaagcagccugagggaggugugggcuggucacgggcugggccccugugccuggggacuggcugcagcccugacaacgggggcugcgaacacgaauguguggaggagguggauggucacguguccugccgcugcacugagggcuuccggcuggcagcagacgggcgcaguugcgaggaccccugugcccaggcuccgugcgagcagcagugugagcccggugggccacaaggcuacagcugccacugucgccuggguuuccggccagcggaggaugauccgcaccgcuguguggacacagaugagugccagauugccggugugugccagcagaugugugucaacuacguugguggcuucgaguguuauuguagcgagggacaugagcuggaggcugauggcaucagcugcagcccugcaggggccaugggugcccaggcuucccaggaccucggagaugaguugcuggaugacggggaggaugaggaagaugaagacgaggccuggaaggccuucaacgguggcuggacggagaugccugggauccuguggauggagccuacgcagccgccugacuuugcccuggccuauagaccgagcuucccagaggacagagagccacagauacccuacccggagcccaccuggccacccccgcucagugcccccaggguccccuaccacuccucagugcucuccgucacccggccugugguggucucugccacgcaucccacacugccuucugcccaccagccuccugugaucccugccacacacccagcuuugucccgugaccaccagauccccgugaucgcagccaacuauccagaucugccuucugccuaccaacccgguauucucucugucucucauucagcacagccuccugcccaccagcccccuaugaucucaaccaaauauccggagcucuucccugcccaccagucccccauguuuccagacacccgggucgcuggcacccagaccaccacucauuugccuggaaucccaccuaaccaugccccucuggucaccacccucggugcccagcuacccccucaagccccagaugcccuuguccucagaacccaggccacccagcuucccauuaucccaacugcccagcccucucugaccaccaccuccagguccccugugucuccugcccaucaaaucucugugccugcugccacccagcccgcagcccuccccacccuccugcccucucagagccccacuaaccagaccucacccaucagcccuacacauccccauuccaaagccc

SEQ ID NO: 20258 - RNA, 2346 nt, Homo sapiens
gggcuuuggaauggggauguguagggcugaugggugaggucugguuaguggggcucugagagggcaggaggguggggagggcugcgggcuggguggcagcaggcacagagauuugaugggcaggagacacaggggaccuggaggugguggucagagagggcugggcaguugggauaaugggaagcuggguggccuggguucugaggacaagggcaucuggggcuugaggggguagcugggcaccgaggguggugaccagaggggcaugguuaggugggauuccaggcaaaugagugguggucugggugccagcgacccgggugucuggaaacaugggggacuggugggcagggaagagcuccggauauuugguugagaucauagggggcuggugggcaggaggcugugcugaaugagagacagagagaauaccggguugguaggcagaaggcagaucuggauaguuggcugcgaucacggggaucugguggucacgggacaaagcuggguguguggcagggaucacaggaggcuggugggcagaaggcagugugggaugcguggcagagaccaccacaggccgggugacggagagcacugaggagugguaggggacccugggggcacugagcggggguggccaggugggcuccggguaggguaucuguggcucucuguccucugggaagcucggucuauaggccagggcaaagucaggcggcugcguaggcuccauccacaggaucccaggcaucuccguccagccaccguugaaggccuuccaggccucgucuucaucuuccucauccuccccgucauccagcaacucaucuccgagguccugggaagccugggcacccauggccccugcagggcugcagcugaugccaucagccuccagcucaugucccucgcuacaauaacacucgaagccaccaacguaguugacacacaucugcuggcacacaccggcaaucuggcacucaucuguguccacacagcggugcggaucauccuccgcuggccggaaacccaggcgacaguggcagcuguagccuuguggcccaccgggcucacacugcugcucgcacggagccugggcacagggguccucgcaacugcgcccgucugcugccagccggaagcccucagugcagcggcaggacacgugaccauccaccuccuccacacauucguguucgcagcccccguugucagggcugcagccaguccccaggcacaggggcccagcccgugaccagcccacaccucccucaggcugcuucacgcagagcagagaggcuccccugccagccuggcacugcacagcggccacagagccgaagggcagccacucaaacucuguggagaccagguggaagggcgugguauacacggcugggccggccuggcccgccucaucuugcagcgccgggcaggcgcccucgaagccaaacuggcacagguagccgucgacagccagcgugcacgagcccuccagccagcggugcucgccacuugccuccagggccacacagcgcugggccgggcaggggccuccagaggcuggcugggcccaguuggugaaagccguguccugguccccugugguccacgugaagccgcgcagugggcgcugcagcuggcauugccgggccugccgcugcagcccgauccacagcagccggcuggcugggcccgcacccaccaggcuguccacacgcugggccuccucggggguccgaggaguggccaggucgccccccagcucgcggcaggcccgccaggccuccaggaaggugcggcgccgugggaagagagcguagcagcugcuggggccgcaggcggcacggggcucagcagcccagggguccuggcccagugugggcccugcggccgcccaggccagcaacaggcgcagcagcaucgcgaugcccccggacugguccggccccgggcuggcggcagcucuugacagggggagggccuggggccuccugcgggcgggccgggggcgggccuggggccgggcucaggccuuguaaggagugggcuggggcggcugccagcucccugcucccucuuccccgggggccgcuagagcaggaagcagugggguggggggcucuaagguugggggcggaggaggggagaaggcgcaguugacggcugccccaggccccauggggcugagagucagggggugggaaaagccugccugccgagcucugugacccucaaguuggggcucggggcuguggggugaggucgcuucccagagacucagagacccaaaucuggacacagcagccccaucacacccgggagcagucucagcccagcugc

SEQ ID NO: 20259 - RNA, 2362 nt, Homo sapiens
aacaaggccaguggaaagaccucacuccacgaagcuuuggguggcgguuggcguggcuccuagagaugugauucuuucgugcuauuuugugggagcagaaacggagguuagcccaggccucgagagggcuggggcggggcgcgggcucuggcaggugcgucaguccgcaggggaacccggggcuccaccugggcgcggcgaggaaguuacaccauguaugggcagcuacgucaggggggcgggcccgcagccuccggggaacgccgagccgggcccaucccggugaaaaggcugcagccggacuuggggaggcgucgccaaguucgggaccgacgggccaaggcggcgcgucucggggguggagccuggaggugaccgcgccgcugcaacgcccccaccccccgcggucgcagugguucagcccgagaacuuuucauucauaaaaagaaaagacuccgcacggcgcgggugagucagaacccagcagccguguaccccgcagagccgccagccccgggcauguuccgagacuucggggaacccggcccgagcuccgggaacggcggcggguacggcggccccgcgcagcccccggccgcagcgcaggcagcccagcaggugaguggggcccgacgccgguggucccacgggaggaccgcgcgugggaggccggggucaacucccgcacgcuccgggacuggagcggggaaccggagucggggccgggcugggggcuggggcgaggauccugccccucgccguccggggccaguugcccccaccgcgcagcgggcagcagagacccgcgaacuccccuucucccagccgcccccuucucccucgccguccgcguccgucccuccgucuccgugcccgcuuucucuccuccugcccaccucugacuucugcguccacccugcuucagaaggggcgugggcgccuaggguggucgccucgaaggcuaggagggucucuccgcuucgggcugaauuccugggaucuggagucugggcuggggugaggguccccacacgggagggaggcgggauccgucgggagagcagcugggccagggugggagucccggcccggucugcgacccuccgcguguccguccgucugucuguccuucgccccuccgucgccaagucccuaucguuucucggccuggggaguccagggggguccgggcaguggaaccugccagguccccggagaccggcccucgaucccuuugccgaaugcggcgaauagagaccucgagguuccgggacgugcgcggggucaggcugcgggcgacucucgcgaccccacucucagccccuaacggcgcccgcugcccgccggggggcacccgggaggcugcaggugcccauuuccugucgaggggcugcgagcacgugucgacaggggagggaaggaggggcguccguuccgccgagucacggcggccgagucacggcggcugagucacccggggcgucccucccuuccuggccuggagcggcccgggcccgggagugggagaugccgccggcggugccucggacccggaacuggggucacugggacgccgggcccgcagcgcuugggcucgggcuaccgcugucgggacuugccugggcuugugggcgcuucccggacgauugggcgcccacacccagggcccagcggcagagcuagaacccacuucucccagaacacugagccccaucccaacccacuccucagauagcuggcugauagaaugggaacagggacguugugcugggcgcuugcuacaucauuuaccauauuucacggaaucgaagaccucaucgauugaaaaaaaaacccacuauaacuuuaugccacuaauuuucuuuccuucucuuucuuuucuuuuuuuuuuuuuuucugagacagggucucccucuguugcccagacuauagagcaguggugcaaucacagcucacugcagccucagccuccugggcucaagcaauccuacugagauccuagcugggaagcgaccuggccacaggcacgcaccaccacacccaacuaauuuuuuaauuuuuuuguagaaaugaagucucacuguguugcccggugugaccucaaacuccugagcucaagugauccuucuaccucagccucccaaagugcuggguaugagccaccaugccuaguccacuaaaauuuuuuaaauugccaauuaaacuaugauuucagagcuauuaaaggguacuucuuaacaucagugaaauccuguaauccucaccuguaacaauauuaaaaaugaggaaacugaggcacauggagguuaaauaacuugcccauggucacacagccaguaaguagcugagagcugagauuaga

SEQ ID NO: 20260 - RNA, 2362 nt, Homo sapiens
ucuaaucucagcucucagcuacuuacuggcugugugaccaugggcaaguuauuuaaccuccaugugccucaguuuccucauuuuuaauauuguuacaggugaggauuacaggauuucacugauguuaagaaguacccuuuaauagcucugaaaucauaguuuaauuggcaauuuaaaaaauuuuaguggacuaggcaugguggcucauacccagcacuuugggaggcugagguagaaggaucacuugagcucaggaguuugaggucacaccgggcaacacagugagacuucauuucuacaaaaaaauuaaaaaauuaguugggugugguggugcgugccuguggccaggucgcuucccagcuaggaucucaguaggauugcuugagcccaggaggcugaggcugcagugagcugugauugcaccacugcucuauagucugggcaacagagggagacccugucucagaaaaaaaaaaaaaaagaaaagaaagagaaggaaagaaaauuaguggcauaaaguuauaguggguuuuuuuuucaaucgaugaggucuucgauuccgugaaauaugguaaaugauguagcaagcgcccagcacaacgucccuguucccauucuaucagccagcuaucugaggaguggguugggauggggcucaguguucugggagaaguggguucuagcucugccgcugggcccugggugugggcgcccaaucguccgggaagcgcccacaagcccaggcaagucccgacagcgguagcccgagcccaagcgcugcgggcccggcgucccagugaccccaguuccggguccgaggcaccgccggcggcaucucccacucccgggcccgggccgcuccaggccaggaagggagggacgccccgggugacucagccgccgugacucggccgccgugacucggcggaacggacgccccuccuucccuccccugucgacacgugcucgcagccccucgacaggaaaugggcaccugcagccucccgggugccccccggcgggcagcgggcgccguuaggggcugagaguggggucgcgagagucgcccgcagccugaccccgcgcacgucccggaaccucgaggucucuauucgccgcauucggcaaagggaucgagggccggucuccggggaccuggcagguuccacugcccggaccccccuggacuccccaggccgagaaacgauagggacuuggcgacggaggggcgaaggacagacagacggacggacacgcggagggucgcagaccgggccgggacucccacccuggcccagcugcucucccgacggaucccgccucccucccguguggggacccucaccccagcccagacuccagaucccaggaauucagcccgaagcggagagacccuccuagccuucgaggcgaccacccuaggcgcccacgccccuucugaagcaggguggacgcagaagucagaggugggcaggaggagagaaagcgggcacggagacggagggacggacgcggacggcgagggagaagggggcggcugggagaaggggaguucgcgggucucugcugcccgcugcgcggugggggcaacuggccccggacggcgaggggcaggauccucgccccagcccccagcccggccccgacuccgguuccccgcuccagucccggagcgugcgggaguugaccccggccucccacgcgcgguccucccgugggaccaccggcgucgggccccacucaccugcugggcugccugcgcugcggccgggggcugcgcggggccgccguacccgccgccguucccggagcucgggccggguuccccgaagucucggaacaugcccggggcuggcggcucugcgggguacacggcugcuggguucugacucacccgcgccgugcggagucuuuucuuuuuaugaaugaaaaguucucgggcugaaccacugcgaccgcggggggugggggcguugcagcggcgcggucaccuccaggcuccacccccgagacgcgccgccuuggcccgucggucccgaacuuggcgacgccuccccaaguccggcugcagccuuuucaccgggaugggcccggcucggcguuccccggaggcugcgggcccgccccccugacguagcugcccauacaugguguaacuuccucgccgcgcccagguggagccccggguuccccugcggacugacgcaccugccagagcccgcgccccgccccagcccucucgaggccugggcuaaccuccguuucugcucccacaaaauagcacgaaagaaucacaucucuaggagccacgccaaccgccacccaaagcuucguggagugaggucuuuccacuggccuuguu

SEQ ID NO: 20261 - RNA, 2155 nt, Homo sapiens
uuuacaaugacggucuggggcagagaauaaaauuuugcagggagcagauugagggucuggaggacuggguuaggugggcucuagguacccaggacgaucucgggaggcgcacaaugagaaucugggggcuccaggauuacggugugggugcacaggaugaaauucugggggcgcagauuagguaggaccuaggugagcaggaugacauuuuuggugagcgucugggggcccccgggugagucugggggccuggcaucaaggucggggccccaggaucgagcacugggggacccugguccggcgccgggaggcggcuccuggcggcgccgcgggggaccggguaggggccuguggcuggccgggggcggagaagcggggggucggggucccucccccuggcgcuggcucaggaauccgccgaagggcgggcggaggcgccggggugggccgcgccgcggcaggcgggcgggcggggggcgcuuccuggggccgcgcguccagggagcugugccguccgcccguccgucugcccgcaggcauugcccgagccagccgagccgccagagccgcgggccgcgggggugucgcgggcccaagugaguggcugugaccguccgugggggagggcgugggccggagucucggccgaguccgcggcagcguagcgcccacagaggcccgcgcuccucggccuucgccgcaggggcgcggggcgggggcgggguggccggggcgggugggccugggacccgggccugggaccugggccugugaggagucggcccccagcccugggaggccccgaggcccaagcacgguccugagcgggcaguggcgggggcugggcucgggcucccgguacagggaguugaggugccgcgggcagaggccccugacccguguccaccaucucgcagccccaggaugcuccccugcgccuccugccuacccgggucucuacugcucugggcgcugcuacuguugcucuugggaucagcuucuccucaggauucugaagagcccgacagcuacacgguggggacagugagggccgcuggccugggacaggaaggguagggaggaagagaccgggacccagggugacugcugccggggaagucuuccuccccuggcugguggagagcugggggccauuguuuggagcaggccggaggguggccaggcucaggcccuagucuuggccuggccaguuggaggagaucuuagggugaccacuggccacuucugguucccuuccaggaaugcacagauggcuaugagugggacccagacagccagcacugccggggugugugugccugggggaccaaacacccccaggaacccggaaagggauugauagcugcuuuccaagggacagccccaccuccaagaacugccgugggagcccagcagcccguucuaugcccagcucugcuacacagaggccagcucuggcucucuggaggccaguugagcuagggguggccucauccucucccagaaacccaggaaaccuugucccuaccccucagaggagcuggauccuguacgccuucucugaaccacucuccugucccagcucuuugucucaucacaaccugggaggguagcguccccagggguggguaaggaggccccccaucuugggcugagcuagggcuagggccguggggagggauagagacccacuugcaggccgagaaugagggcaacagugggaacagcugccccaucuccagccuuggccaacccuggggagggguccugagcaggcagacuuagcuuguugagcagagugggaaggcuuugcuggggccacacaucucagagaaggccgagcuggguuccugccuccgcucccuccagggccagcccaggagacuggcugugcccagcaggccccucucugcagaugucaacgagugucugaccaucccugaggccugcaagggggaaaugaagugcaucaaccacuacgggggcuacuugugccugccccgcuccgcugccgucaucaacgaccuacacggcgagggacccccgccaccagugccucccgcucaacaccccaaccccugcccaccaggcuaugagcccgacgaucaggacagcugugugggugaguggggacugcucuggugccuggcuucca

SEQ ID NO: 20262 - RNA, 2155 nt, Homo sapiens
uggaagccaggcaccagagcaguccccacucacccacacagcuguccugaucgucgggcucauagccuggugggcagggguugggguguugagcgggaggcacugguggcgggggucccucgccguguaggucguugaugacggcagcggagcggggcaggcacaaguagcccccguagugguugaugcacuucauuucccccuugcaggccucagggauggucagacacucguugacaucugcagagaggggccugcugggcacagccagucuccugggcuggcccuggagggagcggaggcaggaacccagcucggccuucucugagauguguggccccagcaaagccuucccacucugcucaacaagcuaagucugccugcucaggaccccuccccaggguuggccaaggcuggagauggggcagcuguucccacuguugcccucauucucggccugcaagugggucucuaucccuccccacggcccuagcccuagcucagcccaagauggggggccuccuuacccaccccuggggacgcuacccucccagguugugaugagacaaagagcugggacaggagagugguucagagaaggcguacaggauccagcuccucugagggguagggacaagguuuccuggguuucugggagaggaugaggccaccccuagcucaacuggccuccagagagccagagcuggccucuguguagcagagcugggcauagaacgggcugcugggcucccacggcaguucuuggagguggggcugucccuuggaaagcagcuaucaaucccuuuccggguuccuggggguguuuggucccccaggcacacacaccccggcagugcuggcugucugggucccacucauagccaucugugcauuccuggaagggaaccagaaguggccaguggucacccuaagaucuccuccaacuggccaggccaagacuagggccugagccuggccacccuccggccugcuccaaacaauggcccccagcucuccaccagccaggggaggaagacuuccccggcagcagucacccugggucccggucucuuccucccuacccuuccugucccaggccagcggcccucacuguccccaccguguagcugucgggcucuucagaauccugaggagaagcugaucccaagagcaacaguagcagcgcccagagcaguagagacccggguaggcaggaggcgcaggggagcauccuggggcugcgagaugguggacacgggucaggggccucugcccgcggcaccucaacucccuguaccgggagcccgagcccagcccccgccacugcccgcucaggaccgugcuugggccucggggccucccagggcugggggccgacuccucacaggcccaggucccaggcccgggucccaggcccacccgccccggccaccccgcccccgccccgcgccccugcggcgaaggccgaggagcgcgggccucugugggcgcuacgcugccgcggacucggccgagacuccggcccacgcccucccccacggacggucacagccacucacuugggcccgcgacacccccgcggcccgcggcucuggcggcucggcuggcucgggcaaugccugcgggcagacggacgggcggacggcacagcucccuggacgcgcggccccaggaagcgccccccgcccgcccgccugccgcggcgcggcccaccccggcgccuccgcccgcccuucggcggauuccugagccagcgccagggggagggaccccgaccccccgcuucuccgcccccggccagccacaggccccuacccggucccccgcggcgccgccaggagccgccucccggcgccggaccagggucccccagugcucgauccuggggccccgaccuugaugccaggcccccagacucacccgggggcccccagacgcucaccaaaaaugucauccugcucaccuagguccuaccuaaucugcgcccccagaauuucauccugugcacccacaccguaauccuggagcccccagauucucauugugcgccucccgagaucguccuggguaccuagagcccaccuaacccaguccuccagacccucaaucugcucccugcaaaauuuuauucucugccccagaccgucauuguaaa

SEQ ID NO: 20263 - RNA, 2841 nt, Homo sapiens
cuccuugccauggggaugaggacaaauucucccuucauccuugagauuggacucccgccacacauccuggaggagccuacagagaagccggcaggucucccucaccuggauggugccagcggguggccuggaccacccagaggcccucuccugcaccugacaggaagccccuggggcauacgucuccccugccacuuccacuguggccacuggaaguguggcagagaaaauagcuaggacaaaaagaagucaaugauuucaaccaacggaauuucuuuguccuuuguaaaaaucaacacaugaucuguuacugauugggaugugaaauaaaacuaaaaauaacagcacacugagccuggcucagggcucagcucaccuuuaccacgguccaaguucaguuuaucagaucccaaggagcagcuaagcagcaagucaaacacaggugaggguggagggcggagggcggagcggggagggggcucuggcccucugcgugcccccaccaacccccagguagagaaccagccagcucaccagggaguguggccaagcaagaagcuauacacagaauucugagcccacacccuaaucugccucagguggggaggccacucacuucccuuuuugccucaguuuccccacugggguuaccagggucuucuggcacauucccuuguuuuaaggaacgguggaagagggguccccuugagaucagguuaagcugugaaacauccugccagcgccacaggccacuggguccuggaaggucaggccacaaagaccucaccaggacacugucuccaacagcuuauucaggagggaaacugagcaagagcccucacggggccccucacugcugcccucauuuccccacuuuccuacaaggccuggggcggugccagggagucugcagaucaagggucaaagucaguugguuaauuacuccuccccuccccccucggaggggcugggcugggcguucagagcguccacgccccgcccccaaggccuggggagggggcguucggaaggaagcaggcuuucuccagaccaaagacuuuguugggggugggggaggacagaagggguaggaguguucuuggggcguucaggggaagaugccgcuggaggaagaagcaacucucacagucgacgcugucuaggcgucugccaaaaauaacuggguacaccagcuuccccgggccuggcccuccgcuguggggugggcucccugcagcugcuuuccaugcaauugugcccuccgcaaggugaaggaagugcguuucuagcagaggugagacccgaucccaccucugcuuuaagggcaagcggggcgcagcgggcgccugucccaccgucucggcucacugcgcgggacuagcagccggagcccaacgaaaauuugggggcccacgccccccaccggcccgacccucacuccgacccggccaccaguguugugggggaggaggaaggaccugugcgagcggcugaagcucugagcuuuuaacacaaaucucggccgaaacuccagcccgcuccccgccccccaaaguggcaucgcuccagugccuucucccgccucaugcgagucccgguuuucuggauuuacgacgucggagccgagggucgccugagcggugacacaccccgcugccuccucugugccgcgguucaggggguggggguaggcgguuccgcgcccccuggcccugggagcggcuccccuuccaccaugcagcccccgccccgaccagcgcucuuccgccggccccgcccccgccccccgagucccgggucgagagccgcgggcccacccagcccaggccgcggccgcauucagccccggcgcccacaccgcgccugccgccuggcuccgcggaccugcgcccgcccgcccgcccgcagccucgacgccgccgcgggugccccaggccggagggcgguuggagccucaccuggcacguagaucucgccgcgcuccucgucggggagcucgcuccaguuccucuugcacguggagacgcacggcuucuucaccaggaacgcgcggggcauuuucgaacccucgucgcuggacacgggccgcuuccguaacugaagccgggagccgucccaccuuugcggggccgggcugaacgccgggaacgggggcacaacagggaaggagucgcuaaggcgcccccacguuccggggaagguccgagcccggacggcgcgcggcgguuccaccuccgcggaaugucgccgucuucccugagaacgaggucccuugcggccaggugcaccgggcggcgcggggaagcggcagguaagcgucucccggcucgacuggcguccccgccgccgcucgggaagucuuaaagugcgagccggacggacggguucacgcuuuauuggcucgcggcgguguguguugguggcuggggcggggggggguggggguggggggcggugaucugaucuaauuagcuugggguggcccggggagcgacggcgcaugcguugggaaauaacggugacaacccaccuauuuguuaccugucgaaccgguuuccauuccgcugcgggugagguggccucgcggcccgggcggggcggccgggcggggcggggucggggggcgagcuucgggcacucagccccuggcugcccagccggcccggcccccgcgggaccuccuagccaggcguacuggcguuugcaaacaggaguuucggagcgagcggagccgggagggagggggcaacguuauuugcaccggcgcuggcacgcuccgcgggugaugacacgaaacucgccccacuggggccggcccaacccggcgcgcccgaggcuccu

SEQ ID NO: 20264 - RNA, 2841 nt, Homo sapiens
aggagccucgggcgcgccggguugggccggccccaguggggcgaguuucgugucaucacccgcggagcgugccagcgccggugcaaauaacguugcccccucccucccggcuccgcucgcuccgaaacuccuguuugcaaacgccaguacgccuggcuaggaggucccgcgggggccgggccggcugggcagccaggggcugagugcccgaagcucgccccccgaccccgccccgcccggccgccccgcccgggccgcgaggccaccucacccgcagcggaauggaaaccgguucgacagguaacaaauagguggguugucaccguuauuucccaacgcaugcgccgucgcuccccgggccaccccaagcuaauuagaucagaucaccgccccccacccccacccccccccgccccagccaccaacacacaccgccgcgagccaauaaagcgugaacccguccguccggcucgcacuuuaagacuucccgagcggcggcggggacgccagucgagccgggagacgcuuaccugccgcuuccccgcgccgcccggugcaccuggccgcaagggaccucguucucagggaagacggcgacauuccgcggagguggaaccgccgcgcgccguccgggcucggaccuuccccggaacgugggggcgccuuagcgacuccuucccuguugugcccccguucccggcguucagcccggccccgcaaaggugggacggcucccggcuucaguuacggaagcggcccguguccagcgacgaggguucgaaaaugccccgcgcguuccuggugaagaagccgugcgucuccacgugcaagaggaacuggagcgagcuccccgacgaggagcgcggcgagaucuacgugccaggugaggcuccaaccgcccuccggccuggggcacccgcggcggcgucgaggcugcgggcgggcgggcgggcgcagguccgcggagccaggcggcaggcgcggugugggcgccggggcugaaugcggccgcggccugggcugggugggcccgcggcucucgacccgggacucggggggcgggggcggggccggcggaagagcgcuggucggggcgggggcugcaugguggaaggggagccgcucccagggccagggggcgcggaaccgccuacccccacccccugaaccgcggcacagaggaggcagcggggugugucaccgcucaggcgacccucggcuccgacgucguaaauccagaaaaccgggacucgcaugaggcgggagaaggcacuggagcgaugccacuuuggggggcggggagcgggcuggaguuucggccgagauuuguguuaaaagcucagagcuucagccgcucgcacagguccuuccuccucccccacaacacugguggccgggucggagugagggucgggccgguggggggcgugggcccccaaauuuucguugggcuccggcugcuagucccgcgcagugagccgagacggugggacaggcgcccgcugcgccccgcuugcccuuaaagcagaggugggaucgggucucaccucugcuagaaacgcacuuccuucaccuugcggagggcacaauugcauggaaagcagcugcagggagcccaccccacagcggagggccaggcccggggaagcugguguacccaguuauuuuuggcagacgccuagacagcgucgacugugagaguugcuucuuccuccagcggcaucuuccccugaacgccccaagaacacuccuaccccuucuguccucccccacccccaacaaagucuuuggucuggagaaagccugcuuccuuccgaacgcccccuccccaggccuugggggcggggcguggacgcucugaacgcccagcccagccccuccgaggggggaggggaggaguaauuaaccaacugacuuugacccuugaucugcagacucccuggcaccgccccaggccuuguaggaaaguggggaaaugagggcagcagugaggggccccgugagggcucuugcucaguuucccuccugaauaagcuguuggagacaguguccuggugaggucuuuguggccugaccuuccaggacccaguggccuguggcgcuggcaggauguuucacagcuuaaccugaucucaaggggaccccucuuccaccguuccuuaaaacaagggaaugugccagaagacccugguaaccccaguggggaaacugaggcaaaaagggaagugaguggccuccccaccugaggcagauuagggugugggcucagaauucuguguauagcuucuugcuuggccacacucccuggugagcuggcugguucucuaccuggggguuggugggggcacgcagagggccagagcccccuccccgcuccgcccuccgcccuccacccucaccuguguuugacuugcugcuuagcugcuccuugggaucugauaaacugaacuuggaccgugguaaaggugagcugagcccugagccaggcucagugugcuguuauuuuuaguuuuauuucacaucccaaucaguaacagaucauguguugauuuuuacaaaggacaaagaaauuccguugguugaaaucauugacuucuuuuuguccuagcuauuuucucugccacacuuccaguggccacaguggaaguggcaggggagacguaugccccaggggcuuccugucaggugcaggagagggccucugggugguccaggccacccgcuggcaccauccaggugagggagaccugccggcuucucuguaggcuccuccaggauguguggcgggaguccaaucucaaggaugaagggagaauuuguccucauccccauggcaaggag

SEQ ID NO: 20265 - RNA, 2546 nt, Homo sapiens
uucagaugaguguuaggaaaaaaugaguauacaaugcucagcccugugccuggcagguggucggcaccuagcauuauucccugccuccguguggaccagggccccaagaagcaggggcuugccccucacaccccauccuggauuccggcagcagggaucccuggggacaugugauugucccucccagcccugcaccgcuuaguaagggggacuuacuaagcgucccccuaaagcuacccacaucaacuuacgcucaaaguaaaaacagaguuccuuggacaggugugccugaaagugagucccugaaccuccucuccccaauuagacugcugccccgggugcuguccgggagagggucuggugccgcccugacuuggcagcgcuuuuccuggaugugcccuagccguccccaccuccugcugaguucugugagucagagacggaacccuggggucuccuggcaggccccacaguaaggccugggcccccgcacguugcagccuuuccuuccagaccagcggacaagccuggucuggaacuaugcuccucuccagccauggccaaccugaagacccccacccccagccgcugccagccccugcccuggggcucugcugugccccucuccagccccugggcccucggacagcgcccccguccucccggcuguuagccugggaagggggccaggcccugagcucagaccuuggcgauuccagagugucugaggcccagagccagccccgccagcacggccagacgaaaggaaaggggggagguggcagggugggcaccaggaagccauuccgagggggcuggcagggaagcuggguucuagcuuuguucuuucugcuccucuucuggaccccacagacuuccuccugggaccuccgugagcccuggccaaaggcuguccccacccuuuagcccuuuccucagaggggauuggaccagcacuaacgagaaguuacuuuggggcccugagacccccacguuugcaagggaggcugggaaagagcuggaaggccugggcuccggcuccacccggccuccaucgucagugugacccggcagggccaccucucucccucagccucgguaucucgcucuacgcaggccuccccgccccgccccgcccggaggaauccgcggccggccagacggucccaggugagggcccucuggaaagggcccagcgcggccgcggguuccggcgggggcgggcaucugggguggggacuguccccgcgccaccccccagccuccgccagccugcacacccucgcuucuccaggcggcagaggcgacgcuuuaaacaacaaaaaaaaaaaaacugugucccuggcccggggccagcgucccagccccccucgccgccgccgcgccgcgcuccagccagggaaaacaacugcucacuucucccugagcccuccccgcgcgcucccugccuccccgcggccgcgggagaggagcccggccagggggaggcgcggagcgggccggccgcccggccuuccucucccucgcuccuccucuccgccucaacuugcuccggccuccucgcuccugccugaguucggggccuggucugggcuucguccuggggcugggaaguuucugcgcuccccgcuguccagucugcaucuccgcgccucccgccgggcccccgcgguccccucccgcccgcuucccccgcugcccucccucgcugcccccuacccucucccggggcucccggcccucuacucccuucgggcgcgggccccucgccccgcccgggcgcgcccccccucccccggguccugcggccccggaugcccgggccccgaggggcugcuggcggccuggccccugagaugcgcggggcgggggcggcggggcugcuggcgcugcugcugcugcugcugcugcugcugcugggccugggcggcagggucgagggggggccggccggcgagcggggcgcaggcgggggcggggcgcuggcccgcgagcgcuucaagguggucuuugcgccggugaucugcaagcggaccugucucaagggccagugucgggacaguugucagcagggcuccaacaugacgcucaucggagagaacggccacagcacagacacgcucacgggcuccggcuuccgcgugggugagggccgggggcacggcugggggcaggggaaggacaggcaccaggcccggugggagagcuaguggggucuuggccuuagagacugggggcugaggguauaaagggcagagauccgagggccugggggaccaggggccucagggaacuugggaggcuggaacucugggggccagaguuggagggcugcauggaggccuggacuuugaagcuuugcguuaggguuggggccuaagggguggggaaaugcagagguccuggaugacacuggcuucccagaaggugcugaguucugagcaggagcacacaggguuuuugaggaaugugagccggggacaggaagccucagagaagggcuaaauauucccgcaagaagcagacuugcuggaagaaacaagaaa

SEQ ID NO: 20266 - RNA, 2546 nt, Homo sapiens
uuucuuguuucuuccagcaagucugcuucuugcgggaauauuuagcccuucucugaggcuuccuguccccggcucacauuccucaaaaacccugugugcuccugcucagaacucagcaccuucugggaagccagugucauccaggaccucugcauuuccccaccccuuaggccccaacccuaacgcaaagcuucaaaguccaggccuccaugcagcccuccaacucuggcccccagaguuccagccucccaaguucccugaggccccuggucccccaggcccucggaucucugcccuuuauacccucagcccccagucucuaaggccaagaccccacuagcucucccaccgggccuggugccuguccuuccccugcccccagccgugcccccggcccucacccacgcggaagccggagcccgugagcgugucugugcuguggccguucucuccgaugagcgucauguuggagcccugcugacaacugucccgacacuggcccuugagacagguccgcuugcagaucaccggcgcaaagaccaccuugaagcgcucgcgggccagcgccccgcccccgccugcgccccgcucgccggccggcccccccucgacccugccgcccaggcccagcagcagcagcagcagcagcagcagcagcgccagcagccccgccgcccccgccccgcgcaucucaggggccaggccgccagcagccccucggggcccgggcauccggggccgcaggacccgggggagggggggcgcgcccgggcggggcgaggggcccgcgcccgaagggaguagagggccgggagccccgggagaggguagggggcagcgagggagggcagcgggggaagcgggcgggaggggaccgcgggggcccggcgggaggcgcggagaugcagacuggacagcggggagcgcagaaacuucccagccccaggacgaagcccagaccaggccccgaacucaggcaggagcgaggaggccggagcaaguugaggcggagaggaggagcgagggagaggaaggccgggcggccggcccgcuccgcgccucccccuggccgggcuccucucccgcggccgcggggaggcagggagcgcgcggggagggcucagggagaagugagcaguuguuuucccuggcuggagcgcggcgcggcggcggcgaggggggcugggacgcuggccccgggccagggacacaguuuuuuuuuuuuuguuguuuaaagcgucgccucugccgccuggagaagcgagggugugcaggcuggcggaggcugggggguggcgcggggacaguccccaccccagaugcccgcccccgccggaacccgcggccgcgcugggcccuuuccagagggcccucaccugggaccgucuggccggccgcggauuccuccgggcggggcggggcggggaggccugcguagagcgagauaccgaggcugagggagagagguggcccugccgggucacacugacgauggaggccggguggagccggagcccaggccuuccagcucuuucccagccucccuugcaaacgugggggucucagggccccaaaguaacuucucguuagugcugguccaauccccucugaggaaagggcuaaaggguggggacagccuuuggccagggcucacggaggucccaggaggaagucugugggguccagaagaggagcagaaagaacaaagcuagaacccagcuucccugccagcccccucggaauggcuuccuggugcccacccugccaccuccccccuuuccuuucgucuggccgugcuggcggggcuggcucugggccucagacacucuggaaucgccaaggucugagcucagggccuggcccccuucccaggcuaacagccgggaggacgggggcgcuguccgagggcccaggggcuggagaggggcacagcagagccccagggcaggggcuggcagcggcugggggugggggucuucagguuggccauggcuggagaggagcauaguuccagaccaggcuuguccgcuggucuggaaggaaaggcugcaacgugcgggggcccaggccuuacuguggggccugccaggagaccccaggguuccgucucugacucacagaacucagcaggagguggggacggcuagggcacauccaggaaaagcgcugccaagucagggcggcaccagacccucucccggacagcacccggggcagcagucuaauuggggagaggagguucagggacucacuuucaggcacaccuguccaaggaacucuguuuuuacuuugagcguaaguugauguggguagcuuuagggggacgcuuaguaagucccccuuacuaagcggugcagggcugggagggacaaucacauguccccagggaucccugcugccggaauccaggauggggugugaggggcaagccccugcuucuuggggcccugguccacacggaggcagggaauaaugcuaggugccgaccaccugccaggcacagggcugagcauuguauacucauuuuuuccuaacacucaucugaa

SEQ ID NO: 20267 - RNA, 2192 nt, Homo sapiens
uauaaaacaaagaaggagggccccguggaucaggccccaaggucccagagagaggaaagucugugugaagagcuccauuucaaggaggccuuaggagccaggccgugagguuuccauuugaggaaguucugugaacgcagccccgaguucccugaaagaggaaagccccuucgaggaggugccaggggaggggaccccaccaggcaacguugaggcuuccugcaagggguccaggggaagcagcuccaauucccacccagcucaccacuggccccccaggaagcccagggggaagccugaggcugcccugcgugcagauuccuuccaaggcacagacccaguuuccauagcaacagccugcggccaggucuucacccaccuugugcagguguuccagggccagcacgaucucacccccauacacgcgcaccucagccuccuugaaguacuggcgcugguagaggugggugaacaucuccccgccgcucacauagucugggaggugcaguggaagucaggaagcagccccgucagguggccucgccugcccccagccaccccaaccccguugggauguggugugcgcucacccaggaugaggugcagcuuggcauccgucuggaaagcguagugcagcgugaccaggaagggcgccuggcgcaccagcuccagcaccgagcgcucggugcgcgugugcucuugcgucuuggcgcgcugcaccagcgccgccuugcgcagcaccuucauggcguacagcuuccccgcgucgugcccgcccgccuuccgcaccaggaacaccuugccguaggcugugggagcagcgaguggguggagggugggcugugagcgggagauuggugcaggcuuggggggugggggcgaugccaacccaggagggugugcaaaugaggcgaaggagcuggggcaacaggcaggugugcaaaaagcuggcagagccuucuaaggaaagggugugcacaccccgggagggugcccagcaaaaccagggaaaggaugugcaaaccaggcuggggagcaugcaucuccagggggccugcugcgaggcaugggggcggggcauaugcaaaccugcgagagaucagauggaugugaaaagaugccagugcaaggaagggaggcagaggugugcaccuggcuggggaagggaugcgcaaaccagcgcuggggcauuugcaaaaugugggagggggaucccauauuggaagaaagggaggagcuaugcaaaucacuugagaggggcgccagucccccuccccaggguguuggcaaauccagggggguaugcacgcacaggaccguggagggaggagugaugucaauguggagugcccuggaagugggcaugcaaacucuggcgaggcagggcggggcaggcaaggcaggcugugccgggaaaggguggggggccugcucaguggccuggcccaggcccaagagugagcaggcaggaggucaggggcaccgcgccugggacgccugcccgguggauggggguccucaccucccgugcccagcaccuugagcagcucgaaguucuccacgcucaccuucuccucgugcccggucagguuggcugugggcacagggggcgaaugagcccagccgguccaugacccgucccggccugccccgggcagccgcagucaggccccacacccaccuucugugauccgcagcuccacggcgcagcucucaucgucguccucgucccccauggcgggcgggucgcuggggcccgcgcggcucgggcuccgggcggcgccgguuacauggcggcuccggccggggcgggcgcuuccuggugccgccuccggggccgaggcgggcgccggcaccgccucccggcuccccgcccugcgcggccugagucaggcggcuggaacgugacagcgccgggcugccggugggcggccggcuggggccgcccugucucccgagcccccaggccaggccucagggccgugcgcuccgggaccuuacucgacucucccgggaacuggaaacaccccgugggagccaucccugagcccguggguaaccuggagccucuggggcauuaguccccaagccaggaaucugcccgggaaugccggcugcagccaguggcuggaggacauuaggagucugugccccaaggugggggacgaggugccuggugcugggcaggcuga

SEQ ID NO: 20268 - RNA, 2192 nt, Homo sapiens
ucagccugcccagcaccaggcaccucgucccccaccuuggggcacagacuccuaauguccuccagccacuggcugcagccggcauucccgggcagauuccuggcuuggggacuaaugccccagaggcuccagguuacccacgggcucagggauggcucccacgggguguuuccaguucccgggagagucgaguaaggucccggagcgcacggcccugaggccuggccugggggcucgggagacagggcggccccagccggccgcccaccggcagcccggcgcugucacguuccagccgccugacucaggccgcgcagggcggggagccgggaggcggugccggcgcccgccucggccccggaggcggcaccaggaagcgcccgccccggccggagccgccauguaaccggcgccgcccggagcccgagccgcgcgggccccagcgacccgcccgccaugggggacgaggacgacgaugagagcugcgccguggagcugcggaucacagaagguggguguggggccugacugcggcugcccggggcaggccgggacgggucauggaccggcugggcucauucgcccccugugcccacagccaaccugaccgggcacgaggagaaggugagcguggagaacuucgagcugcucaaggugcugggcacgggaggugaggacccccauccaccgggcaggcgucccaggcgcggugccccugaccuccugccugcucacucuugggccugggccaggccacugagcaggccccccacccuuucccggcacagccugccuugccugccccgcccugccucgccagaguuugcaugcccacuuccagggcacuccacauugacaucacuccucccuccacgguccugugcgugcauaccccccuggauuugccaacacccuggggagggggacuggcgccccucucaagugauuugcauagcuccucccuuucuuccaauaugggaucccccucccacauuuugcaaaugccccagcgcugguuugcgcaucccuuccccagccaggugcacaccucugccucccuuccuugcacuggcaucuuuucacauccaucugaucucucgcagguuugcauaugccccgcccccaugccucgcagcaggcccccuggagaugcaugcuccccagccugguuugcacauccuuucccugguuuugcugggcacccucccggggugugcacacccuuuccuuagaaggcucugccagcuuuuugcacaccugccuguugccccagcuccuucgccucauuugcacacccuccuggguuggcaucgcccccaccccccaagccugcaccaaucucccgcucacagcccacccuccacccacucgcugcucccacagccuacggcaagguguuccuggugcggaaggcgggcgggcacgacgcggggaagcuguacgccaugaaggugcugcgcaaggcggcgcuggugcagcgcgccaagacgcaagagcacacgcgcaccgagcgcucggugcuggagcuggugcgccaggcgcccuuccuggucacgcugcacuacgcuuuccagacggaugccaagcugcaccucauccugggugagcgcacaccacaucccaacgggguugggguggcugggggcaggcgaggccaccugacggggcugcuuccugacuuccacugcaccucccagacuaugugagcggcggggagauguucacccaccucuaccagcgccaguacuucaaggaggcugaggugcgcguguaugggggugagaucgugcuggcccuggaacaccugcacaaggugggugaagaccuggccgcaggcuguugcuauggaaacugggucugugccuuggaaggaaucugcacgcagggcagccucaggcuucccccugggcuuccuggggggccaguggugagcugggugggaauuggagcugcuuccccuggaccccuugcaggaagccucaacguugccuggugggguccccuccccuggcaccuccucgaaggggcuuuccucuuucagggaacucggggcugcguucacagaacuuccucaaauggaaaccucacggccuggcuccuaaggccuccuugaaauggagcucuucacacagacuuuccucucucugggaccuuggggccugauccacggggcccuccuucuuuguuuuaua

SEQ ID NO: 20269 - RNA, 2365 nt, Homo sapiens
cucccuuuccccuucuucagggcaagaucuucagcuggaagggggugccuugggguccugggggagugccccccugcccuccuccagggccaggggaccagcaucuucaggcaggaaauauucagaccacugugaggcccgggccucgaggccuggaaagagccgcaucccuggccgugaccaccggcgcuacuaccacgaccacuggcggcuggaguaccugauggacuucaacccugcccggcacggcauggugugcauggugugcggcagcucccuggccacccucaagcucagcaccaucaagcgccacauccgccaaaagcaccccuacuccuugcauuggaguccccgggagaaggaagucaucagcaacagcugggaugcacaccuggggcugggggccugcggagaggccgagggccuggggguccagggggcugaggaggaggaggaggaggaagaagaggaggaggaggagggggccggugucccagcuugcccgcccaagggcccagguaaugcaaaugcagauucuguacaggcaggggccuggguggccaguggggcacagugggccagcugcucugccaaggagcugguguucuugagcaaggcacugcuccuccucuggguggggucuguuuauugcccuuauuauacaaaggugggggaaggacaguggggugagagggucuccgauguccaugacagcuuguacauucugugguuuuugaaguaucaaggagagaaguugggugacaggcaguggaaaggcuuggagcagggaggccuggcuggggugggugagggaaggggagggugcuggagagguguggcugacggugaaggccagggacagggcuagauuccagucugggggagguguggguggugcuugaaaugcuagcagaggaggguuuagggaguuaggauuucaggagagaggaagagaagggcaaagguuaggccuggggcccaagugagugagaggcuugugggagaccuggcuguaguggguaugcucccguggggccagcgucucaguuccuucccuccaacccuuucaggcaaagccccagcuggugggggcugccggcgccagcggcgagggggcccaguggcaccccgggcucggcgucugcgccucucagccucccggagggccgggggcagcagggggcugggggcccggcgccuggagaggaggcugaaggagucccugcagaacugguuccgggccgagugucucauggacuaugacccgcgggggaaccggcuggugugcauggccuguggccgggcacugcccagccugcaccuggacgacauccgugcccacgugcuggaggugcacccuggcucccuggggcucagcggcccccagcgcagugcccugcugcaggccugggggggccagcccgaggcgcugucugagcucacccaguccccaccaggugcgaggcccaucccaggcugagacccccucauacuggggcucugaaguggggucuguggccaaaacugggaggcagggacuuagggcugagggcugaaggccaggagcuggugcuccacacacauacuuucccccugcccccagacagagacagacuggggccucuagcuuggggcuggggugaggagccaggauggaccccucugagugggcaagggcaacccagccagcaggcugagccccucucccucaccccuuccccaacaggcgaugaccucgccccccaggaccugaccggaaagagccgggacucggccuccgcugcuggagcccccuccucucaggaucucagccccccagacguaaaggaagaggcuggcugggucccugagaggcccgggcccgcagaggaggaggaggagcuggaggagggcgagggcgagagggcgggggucccgggccggucgccgcggggccgcgcccaccgccgccacccccaggagcgcuggcggcuggaguaccucauggaguuggacggcggccggcgcggccuggugugcggggugugcgggggcgcgcuggccucgcucaagaugagcaccaucgagcgccacauccgccggcgccacccgggcuccacgcgccucggcgggccuguccaggcccucaucgcccgggaguggagcgagaaggccgcccaccugcuggcccuggggccgccccgccccgaguccccccagggccccaucccccccggcacugccgcagccuccgacgaggggggaggggacgaggaggaggagccagaggaggaggaggaggaguggggugagcgguggggccagagcaggcggagagggagagccgggcaguugcuggggcagaagggacuggaggaugggauag

SEQ ID NO: 20270 - RNA, 2365 nt, Homo sapiens
cuaucccauccuccagucccuucugccccagcaacugcccggcucucccucuccgccugcucuggccccaccgcucaccccacuccuccuccuccuccucuggcuccuccuccucguccccuccccccucgucggaggcugcggcagugccgggggggauggggcccuggggggacucggggcggggcggccccagggccagcaggugggcggccuucucgcuccacucccgggcgaugagggccuggacaggcccgccgaggcgcguggagcccggguggcgccggcggauguggcgcucgauggugcucaucuugagcgaggccagcgcgcccccgcacaccccgcacaccaggccgcgccggccgccguccaacuccaugagguacuccagccgccagcgcuccuggggguggcggcggugggcgcggccccgcggcgaccggcccgggacccccgcccucucgcccucgcccuccuccagcuccuccuccuccucugcgggcccgggccucucagggacccagccagccucuuccuuuacgucuggggggcugagauccugagaggagggggcuccagcagcggaggccgagucccggcucuuuccggucagguccuggggggcgaggucaucgccuguuggggaaggggugagggagaggggcucagccugcuggcuggguugcccuugcccacucagagggguccauccuggcuccucaccccagccccaagcuagaggccccagucugucucugucugggggcagggggaaaguauguguguggagcaccagcuccuggccuucagcccucagcccuaagucccugccucccaguuuuggccacagaccccacuucagagccccaguaugagggggucucagccugggaugggccucgcaccugguggggacugggugagcucagacagcgccucgggcuggcccccccaggccugcagcagggcacugcgcugggggccgcugagccccagggagccagggugcaccuccagcacgugggcacggaugucguccaggugcaggcugggcagugcccggccacaggccaugcacaccagccgguucccccgcgggucauaguccaugagacacucggcccggaaccaguucugcagggacuccuucagccuccucuccaggcgccgggcccccagcccccugcugcccccggcccuccgggaggcugagaggcgcagacgccgagcccggggugccacugggcccccucgccgcuggcgccggcagcccccaccagcuggggcuuugccugaaaggguuggagggaaggaacugagacgcuggccccacgggagcauacccacuacagccaggucucccacaagccucucacucacuugggccccaggccuaaccuuugcccuucucuuccucucuccugaaauccuaacucccuaaacccuccucugcuagcauuucaagcaccacccacaccucccccagacuggaaucuagcccugucccuggccuucaccgucagccacaccucuccagcacccuccccuucccucacccaccccagccaggccucccugcuccaagccuuuccacugccugucacccaacuucucuccuugauacuucaaaaaccacagaauguacaagcugucauggacaucggagacccucucaccccacuguccuucccccaccuuuguauaauaagggcaauaaacagaccccacccagaggaggagcagugccuugcucaagaacaccagcuccuuggcagagcagcuggcccacugugccccacuggccacccaggccccugccuguacagaaucugcauuugcauuaccugggcccuugggcgggcaagcugggacaccggcccccuccuccuccuccucuucuuccuccuccuccuccuccucagcccccuggacccccaggcccucggccucuccgcaggcccccagccccaggugugcaucccagcuguugcugaugacuuccuucucccggggacuccaaugcaaggaguaggggugcuuuuggcggauguggcgcuugauggugcugagcuugaggguggccagggagcugccgcacaccaugcacaccaugccgugccgggcaggguugaaguccaucagguacuccagccgccaguggucgugguaguagcgccgguggucacggccagggaugcggcucuuuccaggccucgaggcccgggccucacaguggucugaauauuuccugccugaagaugcugguccccuggcccuggaggagggcaggggggcacucccccaggaccccaaggcacccccuuccagcugaagaucuugcccugaagaaggggaaagggag

SEQ ID NO: 20271 - RNA, 2476 nt, Homo sapiens
gaaagagagaacgcgagaaaugggcgcggcagcacggagcuugggaaccaagcaaggaggcuggggccugggaucugaaguguaguugccuaagcugagagaaaacucaaagguccggagcaagcugacggucgcggcugaaucacccagccaccuucagagcccccaggcccuuccugcaaaauaaguugauucgcaguuccagcugugagggugagcccagggagccugcaggaguuucuugccaaugaagccacacagugcacauguuggagagcagguccagguccgggacaggacagggggcaguggaugcggggagggggggaaagaauguccccgcgucccccagcggccccccuccccagcagcccacucccgggucccuccagggucugccccgcucgccagucccagccccgcuccggccccgcccggccccgcccucuccccacagcuccgggcagacccgcccgcccgagccggaguuacaagagccgccuccgcgcacgggggcccggccacucggagcugcucugccgcggggacugcaccgcccgcccugccagacccgcccggaacggggcucgucgccgccaguagccgcagcaccgcagccuugggccucgcgccggcuauggccgugcccuggggcugagcccucagguaggggcgccaggcgcaccguggcgccaucgggguccggggcaccaagggcgggucgcggggagguggguugcggugcuccggcagggcgcguuguugggggugucacugugaggauucaagcaguuuggagcaagcggggccacccggggcggcgacgcgucgcucucugggagcggaguucugccucuggaguuggggcgcaaguugguuaaaguuggaaaaucgcuccgaagugcuuugcuccacucuuuauuucuccggagggcggacuguuggcuccacugcaaggcagggcgccccguuccgggccugguggccucugucccaccuccucucccugcauggggcgguggcucgggggcugcuccguucguaucccauguuuacuggaggggaaauuuccgagaucgccaccgcggcccccagcgccuccgcgccuccgcgaccccgcaccgugcgcccccucggcuguccuuccgcgcucccugcaccucugccccuaaccgcgucccgagucguccaggccccacccuguucuguaccaccagccccucagccuccuccagcugccccgcccuagccuugccucuccgcguuccccgcuccagaaaaccuuccucucgggccgcggaaccuggaaguuugcaaugcgccucccagcgggauggguggggagggggacaaaauuagggagauuccuaugcugaggugggcgaggaggggggugcgcugcggcggcccaguccucgggaccgccccuuccccuccggaggcggcgcuuuccccccgcccaacucccaaacccguccgggcgggauggcccccgccccagagccuggcccggcgccagcagccugaggaauguggugguuggagccggugacuaauucaaaccagaacucagggaggaguggugaggggcaaaggggaggaggaaggggcugugugugggaguugggggcaggagccgggcuuggcgugggaggagggcuaagcugcgcucgcuggaacccugcgcuccagcggugcgcgccaggagagggggcccgaagcgaggucucgccuagaguuggaaaggcagcgugcuuagggugugugcagagcuguguuauguaaggcuuucccaugcaaggggagggggugugugugugcagugugcgagggccugggccgucccuggcagggcuggucgccccccagcagugcccaggccgggaugugggggcgcagccccuuggcggcgcugaccaugagggacuccaggggcccaaacagggcuggcugugccccuugcugggaggggugcggagggggcagauggguguucucagcuguagccgaggccccacaacaagguggggaacggcucuggccccucugcacaaugaggccacugaggguugugugcgaugugugugcuugccgguuucgcaggguguggcucccgccgcggcgaccguggcagugaggugcucccagggagcgugcggucgcugcagagugcccugcucuguggaggggauuuguggaaaggcagugugggagccucccaagucagucagguccuuagaccuccggagucuccggaggaaaagggaccgagauaucuaccucugugucuccagcacagcgcugggcgcucaguaaauacugguuucgaacccgucuucauuagaauccaaccucggauugcagggcuccugcucucugcuugcccgucccagcacagccuagugcaugguagguguuggguugauuuuguggaauacagugaggggcugcagcagugaagcugagagugggggaa

SEQ ID NO: 20272 - RNA, 2476 nt, Homo sapiens
uucccccacucucagcuucacugcugcagccccucacuguauuccacaaaaucaacccaacaccuaccaugcacuaggcugugcugggacgggcaagcagagagcaggagcccugcaauccgagguuggauucuaaugaagacggguucgaaaccaguauuuacugagcgcccagcgcugugcuggagacacagagguagauaucucggucccuuuuccuccggagacuccggaggucuaaggaccugacugacuugggaggcucccacacugccuuuccacaaauccccuccacagagcagggcacucugcagcgaccgcacgcucccugggagcaccucacugccacggucgccgcggcgggagccacacccugcgaaaccggcaagcacacacaucgcacacaacccucaguggccucauugugcagaggggccagagccguuccccaccuuguuguggggccucggcuacagcugagaacacccaucugcccccuccgcaccccucccagcaaggggcacagccagcccuguuugggccccuggagucccucauggucagcgccgccaaggggcugcgcccccacaucccggccugggcacugcuggggggcgaccagcccugccagggacggcccaggcccucgcacacugcacacacacacccccuccccuugcaugggaaagccuuacauaacacagcucugcacacacccuaagcacgcugccuuuccaacucuaggcgagaccucgcuucgggcccccucuccuggcgcgcaccgcuggagcgcaggguuccagcgagcgcagcuuagcccuccucccacgccaagcccggcuccugcccccaacucccacacacagccccuuccuccuccccuuugccccucaccacuccucccugaguucugguuugaauuagucaccggcuccaaccaccacauuccucaggcugcuggcgccgggccaggcucuggggcgggggccaucccgcccggacggguuugggaguugggcggggggaaagcgccgccuccggaggggaaggggcggucccgaggacugggccgccgcagcgcaccccccuccucgcccaccucagcauaggaaucucccuaauuuugucccccuccccacccaucccgcugggaggcgcauugcaaacuuccagguuccgcggcccgagaggaagguuuucuggagcggggaacgcggagaggcaaggcuagggcggggcagcuggaggaggcugaggggcuggugguacagaacaggguggggccuggacgacucgggacgcgguuaggggcagaggugcagggagcgcggaaggacagccgagggggcgcacggugcggggucgcggaggcgcggaggcgcugggggccgcgguggcgaucucggaaauuuccccuccaguaaacaugggauacgaacggagcagcccccgagccaccgccccaugcagggagaggaggugggacagaggccaccaggcccggaacggggcgcccugccuugcaguggagccaacaguccgcccuccggagaaauaaagaguggagcaaagcacuucggagcgauuuuccaacuuuaaccaacuugcgccccaacuccagaggcagaacuccgcucccagagagcgacgcgucgccgccccggguggccccgcuugcuccaaacugcuugaauccucacagugacacccccaacaacgcgcccugccggagcaccgcaacccaccuccccgcgacccgcccuuggugccccggaccccgauggcgccacggugcgccuggcgccccuaccugagggcucagccccagggcacggccauagccggcgcgaggcccaaggcugcggugcugcggcuacuggcggcgacgagccccguuccgggcgggucuggcagggcgggcggugcaguccccgcggcagagcagcuccgaguggccgggcccccgugcgcggaggcggcucuuguaacuccggcucgggcgggcgggucugcccggagcuguggggagagggcggggccgggcggggccggagcggggcugggacuggcgagcggggcagacccuggagggacccgggagugggcugcuggggaggggggccgcugggggacgcggggacauucuuucccccccuccccgcauccacugcccccuguccugucccggaccuggaccugcucuccaacaugugcacuguguggcuucauuggcaagaaacuccugcaggcucccugggcucacccucacagcuggaacugcgaaucaacuuauuuugcaggaagggccugggggcucugaagguggcugggugauucagccgcgaccgucagcuugcuccggaccuuugaguuuucucucagcuuaggcaacuacacuucagaucccaggccccagccuccuugcuugguucccaagcuccgugcugccgcgcccauuucucgcguucucucuuuc

SEQ ID NO: 20273 - RNA, 3518 nt, Homo sapiens
agggcuccgagagagcugcagcggcggugggggccccgcagagauuggggcccaugguuugaaggcuguucacaggcaccccgagacagcguccccccucugggcgcacuggauuugacguugcaggacgcgcggcuggaagccccccaggccccgcugcucacagaccgggacuccgccuccgguucccgagggcguggcgaggcgcugcgggacgcccaacaggugcguguuguguccccaggccccgcgcuccggguggagucaagaaccuggaagccggcagcccgggaaaagggggcgggacggugccccggggcagggcuggguggcggccgcuguccucccgggaggggcgggccgccucgacgccgcccucccuggcggccaauggagaccgaggccccgcgccuggauuggagcggacgcggggggucagccagccuugggggccggggccuggccgggggcgggggggcaggcgaggcgaggcgggcgccguccgcgcgguuauaaggcggggaguucccugcgccgcgagccgggaggcgcacgcucgcucguacggcggccgcggcggcagggcggggccggagcagcgggcggcggcggaggcggcgcccgggagcgcucuucgcuucccucggggucuugcucggaccucggccaccgccugggauccccaggacucgugcgugcagcaugggcggcgucggggagccgggaccgcgggagggacccgcgcagccgggggcgccgcugcccaccuucugcugggagcagauccgcgcgcacgaccagcccggcgacaaguggcuggucaucgagcgccgcgucuacgacaucagccgcugggcacagcggcacccagggggcagccgccucaucggccaccacggcgcugaggacgccacgguaaggaagccauaaggaagccacccaccggcggguggagccuggagcucggucgugggcgugaugucccgcuccaccuguggggccuuagcauccucccuccccucgcugaccuuugaccuccacgccgggacccagaguugggguggacuagccagggccagaugugggguagggagggcaguucccugcguggaggacccgcagcuguccacggagcaggucugcgggggaggagggggccucagaggugggugugucaugcugcagagccugcccugggugaggggcugcccuguugcucccaggucccuguuucaguucuggguccccaugcugggugcuugcugagugcuagggguagggcagggcaggguccccaggggccgguaaggacaugccauuagaggcugggggcugggccggccugaggucuguggcuuucccaagagcuucuguaaagggcucagggacagugacucaccucuccgggcuagcagcugcacgugggagggcuuugccagccaggcugggugggccucuccuggaagcacagucaccccaggaacaggcuggccccuggggaccccaacuucccaaucccagccccugucuagacaggcagggauguagccuggccccaggguacugucuggcuggaguccagugguggagcagcccgaccagccccuuuuccuuaguuacccaccugcauaauagggguuggggccacgaugcccuguccuugacccuccaaauuucuagguuggccacacuggguaucaggaaggucuucaagacccgaggacaugaauccugaaugcuggcuuuuugggcagcagcggagguucuguccagucccaggacugucggcgucccucuugacagggccaccugcucucugccgauugccaucuccagcauguuggacaaucuucacuggacucuuugaggaagaaagccccucuuuuccccuuccaccccaugaagcugaggagugagaauaagaauccuccugaaauucuaaaaaaagaaaaaaaaaaaaaagagaacgccuuguccguggcuguucaggcgccagacgcuggcccgaggggacagcacagccgugggaugaagcagccugggggcaguauuugagcgugcagguguuugcaugucugggugaguguggugugugugccugccuuucugccagggcguggcgaggugaggggcacggcuucuccccaaaggccuugcugagcccuggccucccuucaaggagucuuguggaugccugcucuggucuuuuucuaaaaaaguaucuauuuuauuuauuauuauuuguuuaaaaauagagacagggucucacuauguugcucgggcuggucucaaaguccuggguucaagcauuccuccugccucagccuccgaaaguucugggauuacaggcaugagccaccacucccggccugcucuagucuuuuguaaccuagaggacaguauggauacagaaaacuuuacuccccaccaaccgccggagacagagucuugcucugccacccagacuggagugcaauggcgccaucuuggcucacugcaaccuccgccucccagguucaagcgauucuccugccucagccucccgaguagcugggauuacgggcacgcgccaccacgcccagcauauuguauuuuuaguagagacgggguuucaccauguuggccaagcuggucucgaacuccugaccucgugauccacccaccucggccucccaaagcgcugggauuacaggcgugagccaccacgcccggcugggauacagaaagcuuuuauuucaucacuguuuccugccuggugccaggcccaugcugggguuccucccaaguggaauuacugacuuaacauuuagcuugggauccugagacuuccaucacacaguuuucucauugauucgcagccaauaauaucuguuuuaaaaacaucucaggccgagcgcuguggcucacaccuguaaucccagcacuuugggaggcugaggugggcagaucaccugaggucgggaguuugagaccagccugaccaacauggagaaacccugucucuucuaaaaaaauacaaaauuagccaggcgugguggcgcaugccuguaaucccagcacuuugggaggcugaggcaggagaaucgcuugaacccaggagacggagguuccggugagccgagaucgcgccauugcacuccagccugggcaacaagagcaaaacuccgucucaaacaaacaaacaaaaaacaucucucugcuccuuggggccgggugccagcucugcuauuggaggcacugagcgaccuugaagcaggcaugucacuccucugugccccaguuuacucaucuguaaagugggagagcuggggcagacagugagcuggcugagggcaggacugugucuccucaagcccauggcccagggcugccagguaguaguuuguauucgguaaaugcugcuggccccuaagugugagcgugcccugcaaacugcagcguauggugggacagcccugcacggcuaccccuuuccugggugaccuuauuugguuacgguccuaucugaaguaggaaag

SEQ ID NO: 20274 - RNA, 3518 nt, Homo sapiens
cuuuccuacuucagauaggaccguaaccaaauaaggucacccaggaaagggguagccgugcagggcugucccaccauacgcugcaguuugcagggcacgcucacacuuaggggccagcagcauuuaccgaauacaaacuacuaccuggcagcccugggccaugggcuugaggagacacaguccugcccucagccagcucacugucugccccagcucucccacuuuacagaugaguaaacuggggcacagaggagugacaugccugcuucaaggucgcucagugccuccaauagcagagcuggcacccggccccaaggagcagagagauguuuuuuguuuguuuguuugagacggaguuuugcucuuguugcccaggcuggagugcaauggcgcgaucucggcucaccggaaccuccgucuccuggguucaagcgauucuccugccucagccucccaaagugcugggauuacaggcaugcgccaccacgccuggcuaauuuuguauuuuuuuagaagagacaggguuucuccauguuggucaggcuggucucaaacucccgaccucaggugaucugcccaccucagccucccaaagugcugggauuacaggugugagccacagcgcucggccugagauguuuuuaaaacagauauuauuggcugcgaaucaaugagaaaacugugugauggaagucucaggaucccaagcuaaauguuaagucaguaauuccacuugggaggaaccccagcaugggccuggcaccaggcaggaaacagugaugaaauaaaagcuuucuguaucccagccgggcgugguggcucacgccuguaaucccagcgcuuugggaggccgagguggguggaucacgaggucaggaguucgagaccagcuuggccaacauggugaaaccccgucucuacuaaaaauacaauaugcugggcgugguggcgcgugcccguaaucccagcuacucgggaggcugaggcaggagaaucgcuugaaccugggaggcggagguugcagugagccaagauggcgccauugcacuccagucuggguggcagagcaagacucugucuccggcgguugguggggaguaaaguuuucuguauccauacuguccucuagguuacaaaagacuagagcaggccgggagugguggcucaugccuguaaucccagaacuuucggaggcugaggcaggaggaaugcuugaacccaggacuuugagaccagcccgagcaacauagugagacccugucucuauuuuuaaacaaauaauaauaaauaaaauagauacuuuuuuagaaaaagaccagagcaggcauccacaagacuccuugaagggaggccagggcucagcaaggccuuuggggagaagccgugccccucaccucgccacgcccuggcagaaaggcaggcacacacaccacacucacccagacaugcaaacaccugcacgcucaaauacugcccccaggcugcuucaucccacggcugugcuguccccucgggccagcgucuggcgccugaacagccacggacaaggcguucucuuuuuuuuuuuuuucuuuuuuuagaauuucaggaggauucuuauucucacuccucagcuucaugggguggaaggggaaaagaggggcuuucuuccucaaagaguccagugaagauuguccaacaugcuggagauggcaaucggcagagagcagguggcccugucaagagggacgccgacaguccugggacuggacagaaccuccgcugcugcccaaaaagccagcauucaggauucauguccucgggucuugaagaccuuccugauacccaguguggccaaccuagaaauuuggagggucaaggacagggcaucguggccccaaccccuauuaugcagguggguaacuaaggaaaaggggcuggucgggcugcuccaccacuggacuccagccagacaguacccuggggccaggcuacaucccugccugucuagacaggggcugggauugggaaguugggguccccaggggccagccuguuccuggggugacugugcuuccaggagaggcccacccagccuggcuggcaaagcccucccacgugcagcugcuagcccggagaggugagucacugucccugagcccuuuacagaagcucuugggaaagccacagaccucaggccggcccagcccccagccucuaauggcauguccuuaccggccccuggggacccugcccugcccuaccccuagcacucagcaagcacccagcauggggacccagaacugaaacagggaccugggagcaacagggcagccccucacccagggcaggcucugcagcaugacacacccaccucugaggcccccuccucccccgcagaccugcuccguggacagcugcggguccuccacgcagggaacugcccucccuaccccacaucuggcccuggcuaguccaccccaacucugggucccggcguggaggucaaaggucagcgaggggagggaggaugcuaaggccccacagguggagcgggacaucacgcccacgaccgagcuccaggcuccacccgccgguggguggcuuccuuauggcuuccuuaccguggcguccucagcgccgugguggccgaugaggcggcugcccccugggugccgcugugcccagcggcugaugucguagacgcggcgcucgaugaccagccacuugucgccgggcuggucgugcgcgcggaucugcucccagcagaaggugggcagcggcgcccccggcugcgcgggucccucccgcggucccggcuccccgacgccgcccaugcugcacgcacgaguccuggggaucccaggcgguggccgagguccgagcaagaccccgagggaagcgaagagcgcucccgggcgccgccuccgccgccgcccgcugcuccggccccgcccugccgccgcggccgccguacgagcgagcgugcgccucccggcucgcggcgcagggaacuccccgccuuauaaccgcgcggacggcgcccgccucgccucgccugcccccccgcccccggccaggccccggcccccaaggcuggcugaccccccgcguccgcuccaauccaggcgcggggccucggucuccauuggccgccagggagggcggcgucgaggcggcccgccccucccgggaggacagcggccgccacccagcccugccccggggcaccgucccgcccccuuuucccgggcugccggcuuccagguucuugacuccacccggagcgcggggccuggggacacaacacgcaccuguugggcgucccgcagcgccucgccacgcccucgggaaccggaggcggagucccggucugugagcagcggggccuggggggcuuccagccgcgcguccugcaacgucaaauccagugcgcccagaggggggacgcugucucggggugccugugaacagccuucaaaccaugggccccaaucucugcggggcccccaccgccgcugcagcucucucggagcccu

SEQ ID NO: 20275 - RNA, 2642 nt, Homo sapiens
uucccccuccaaagcgacuuuauucaugacaccguuuccuugcccauuuagcugacuaggaaaauaacgguaucaaacgcuuccucuuuuccuucuuaaauaaaacgaaauuuccuuaguggacggcaguuuugucuugaauguucacgagaggcgaccgccgaggaugcgaccagcagagagaaacgugguggcugagauccguuucagcgucacucucuguuggauucuucgcgggagguuuagcucugccagcuucugcucccaggaauaagggucagaaucgacuuccaauuuaccagcgaaugaggcuuuccuaaccuccuucguucccuccccccauaacuuauggauuuauauuaauuacaauagaaacucuuaccugaaaauuggcuuucauuaaucugauuguacaacauaguauaaacacagacaccaggaagguuauauuuauucagaccacuggagaauccacuuuucgggguuguucgucuauuuaaauaccuuccguuccagcaaaggcugagacucgccagcucugcccggccugaccagggcgcccucuccccgucgggugguuugggcgguuccgggcccggcgucucucaccccgcuggucuccccacgcccgccggguccccuaggagugcacuagcaccgagugcaaggagccgcccuugcuuucggccgagguaggggcugugggcuccagcagagaggcaacgggcgaggccgcggccgcggagcacacgguggauggcgccggaggcugcugcgaagccgcggggacagugagccccggcugcagcgcggacacgggcggcagcgcaggcgugggcuugaugggcaccggcauggcaggcaggcucuggcuugccgaguggcacagggacuugaccgggaccccgaaggccccauacuccgggccuacagggacuccggcugcggcugcggcggccgcggcggcggccaccgaauccaugacgccaacgugcggccacacggagcugacgacguugccaagcuggccgggcacgggguagcccagguggugcaugacggacgccaagggcagcccuccagccugcagcacgcccuuguagucccggccaauaauguucucaauggcaaaggggugcuugaagccugacguggacgccgcggccgcggcggcagcggcggcggccgagcccagcccguagggugggaacugagacaggcgucccacgcugcccaccgcggcugccgcggccgccgccgccgccgccgccacggccgccgccuccugcaucuugccggggugagacggcugcugaggcugcgacugcuggggcgguugcugcgggggcugugacgggaggugcggaggcggcugcggagcaguaggcgguugcugauggaaauaguguaccaugugcggcggcggcgggggcggcggcggcggcggcuggggugggugguggugauggugguggugugcggcagcguggugaugaugguggugguggggguggugguggugaugggggugaaggugcccucccggaccggcgcccggcgcgcucuuggugcuucccgcgugcaagugaguauggucggcgcgcagcaccuugaagcgcuugcgacgccgcaggaagcugccguucucgaacauguccccgcagucggggugcagcgcccagaagcuacccuugccaggcuggucgggccuccgcggaaucuugaugaagcagucguugaaggagagguuguggcgcaggcuguucugccagcgcugugugugcucgcgguaguaggggaagcgcuccaugaugaacuuguagaugucgcucagcggcagcaucuucucggccgagugcuggauugccauggcggucagcgagauguaagaguagggcgguuuuuggucgcuguacgagcucuuccccggccgcggcaucgcccccggcuccuccaccgcccuccggcccgcacuggaccacagaaucucuccgcacuccguuccuggggccuggcugcccccacuaauucccacucggccccuccagucccgccacuuugcccucucgcccuccaggcccucucugcuucucucuccugccuucuccgaauugccuggugucuccgaccuuggccuuucgggccuacucagcucucggaagcuggcaacuucuggccccgacgguugccgacuggcgcgcacagucgcgggcggagugcaccagguuuaccgccgccuucucugcgucuucccccggguggccaaagacugagugcuggagcuggcugcagaggagaguggcaaggggccguguuuccucccggccucuuugcuuuuucuagguccgagggaaacccagaccaagauggcugggaggaaggucugggcaguagagacucuggcccuuuaaaucugaguuugcgccugcuguccuggaggccagugacagcaggacuuccagugcccuggacgcaggccccuggccaggcacuuagccagaccgcgcuggaguucuccuuuuccuggagugaaaaaucaggguaaggagagagaagauuggcuucuagggcgccucucuuuucuccgaggcucgcagcgucgccgggguuagaagagacgcgcagcccuaggcugucgcuga

SEQ ID NO: 20276 - RNA, 2642 nt, Homo sapiens
ucagcgacagccuagggcugcgcgucucuucuaaccccggcgacgcugcgagccucggagaaaagagaggcgcccuagaagccaaucuucucucuccuuacccugauuuuucacuccaggaaaaggagaacuccagcgcggucuggcuaagugccuggccaggggccugcguccagggcacuggaaguccugcugucacuggccuccaggacagcaggcgcaaacucagauuuaaagggccagagucucuacugcccagaccuuccucccagccaucuuggucuggguuucccucggaccuagaaaaagcaaagaggccgggaggaaacacggccccuugccacucuccucugcagccagcuccagcacucagucuuuggccacccgggggaagacgcagagaaggcggcgguaaaccuggugcacuccgcccgcgacugugcgcgccagucggcaaccgucggggccagaaguugccagcuuccgagagcugaguaggcccgaaaggccaaggucggagacaccaggcaauucggagaaggcaggagagagaagcagagagggccuggagggcgagagggcaaaguggcgggacuggaggggccgagugggaauuagugggggcagccaggccccaggaacggagugcggagagauucugugguccagugcgggccggagggcgguggaggagccgggggcgaugccgcggccggggaagagcucguacagcgaccaaaaaccgcccuacucuuacaucucgcugaccgccauggcaauccagcacucggccgagaagaugcugccgcugagcgacaucuacaaguucaucauggagcgcuuccccuacuaccgcgagcacacacagcgcuggcagaacagccugcgccacaaccucuccuucaacgacugcuucaucaagauuccgcggaggcccgaccagccuggcaaggguagcuucugggcgcugcaccccgacugcggggacauguucgagaacggcagcuuccugcggcgucgcaagcgcuucaaggugcugcgcgccgaccauacucacuugcacgcgggaagcaccaagagcgcgccgggcgccgguccgggagggcaccuucacccccaucaccaccaccacccccaccaccaccaucaucaccacgcugccgcacaccaccaccaucaccaccacccaccccagccgccgccgccgccgcccccgccgccgccgcacaugguacacuauuuccaucagcaaccgccuacugcuccgcagccgccuccgcaccucccgucacagcccccgcagcaaccgccccagcagucgcagccucagcagccgucucaccccggcaagaugcaggaggcggcggccguggcggcggcggcggcggcggccgcggcagccgcggugggcagcgugggacgccugucucaguucccacccuacgggcugggcucggccgccgccgcugccgccgcggccgcggcguccacgucaggcuucaagcaccccuuugccauugagaacauuauuggccgggacuacaagggcgugcugcaggcuggagggcugcccuuggcguccgucaugcaccaccugggcuaccccgugcccggccagcuuggcaacgucgucagcuccguguggccgcacguuggcgucauggauucgguggccgccgccgcggccgccgcagccgcagccggagucccuguaggcccggaguauggggccuucggggucccggucaagucccugugccacucggcaagccagagccugccugccaugccggugcccaucaagcccacgccugcgcugccgcccguguccgcgcugcagccggggcucacuguccccgcggcuucgcagcagccuccggcgccauccaccgugugcuccgcggccgcggccucgcccguugccucucugcuggagcccacagccccuaccucggccgaaagcaagggcggcuccuugcacucggugcuagugcacuccuaggggacccggcgggcguggggagaccagcggggugagagacgccgggcccggaaccgcccaaaccacccgacggggagagggcgcccuggucaggccgggcagagcuggcgagucucagccuuugcuggaacggaagguauuuaaauagacgaacaaccccgaaaaguggauucuccaguggucugaauaaauauaaccuuccuggugucuguguuuauacuauguuguacaaucagauuaaugaaagccaauuuucagguaagaguuucuauuguaauuaauauaaauccauaaguuauggggggagggaacgaaggagguuaggaaagccucauucgcugguaaauuggaagucgauucugacccuuauuccugggagcagaagcuggcagagcuaaaccucccgcgaagaauccaacagagagugacgcugaaacggaucucagccaccacguuucucucugcuggucgcauccucggcggucgccucucgugaacauucaagacaaaacugccguccacuaaggaaauuucguuuuauuuaagaaggaaaagaggaagcguuugauaccguuauuuuccuagucagcuaaaugggcaaggaaacggugucaugaauaaagucgcuuuggagggggaa

SEQ ID NO: 20277 - RNA, 2532 nt, Homo sapiens
caggcacccgggauuggaggcgagggcggcgcgcgagccaaccagcggucgccccgggcccccgugagccccaggcgaacgcgcggagcagccgggccccuagagcgguccggguggcggcggcggcagccacgaccacgaccgcggucacucacgcacgcucacacucgcacgcuccccgcgcgggcacccggcugcccggcgcgugcaagaggagcgcgucgagggaaaggagggccgaagccgccgcgcucccgcccgcccgccgcgccucccguugaccacgcccccuccggcccccuccccgcugcucaccccgcucuccggccgccgccggugcgggugcuccgcuaccggcuccucuccguucugugcucucuucugcucucggcuccccacccccucucccuucccuccucuccccuugccuccccuccucugcagcgccugcauuauuuucugcccgcaggcucggcuugcacugcugcugcagcccggggagguggcuggguggguggggaggagacugugcaaguuguaggggagggggugcccucuucuuccccgcucccuucccccgccaacuccuuccccuccuucucccccuuuccccuccccgcccccaccuucuuccuccuuucggaaggacugguaacuugucgugcggagcgaacggcggcggcggcggcggcggcggcaccauccaggcgggcaccaugggcacguccgcgcucugggcgcucuggcugcugcucgcgcugugcugggcgccccgggagagcggcgccaccggaaccggugagugaggacgcgccccuccgccggcgggcgggacccagccggggcaccgggagaccccgaggcguaggucuccguuugcccacccgccuccuaggaggcgccucucgguucuccucgccuucccucccuccccuccgugguggcgccucugagcugucagcgccgaggcuaaagggagccgggcuuggggaacagcgggguucggggugccccgacgccucgccugaacuagucuucugccccucacuccgccucccccagagccgcugcuucgccucguuucucgcccucuugacgggcgccgaggugcgugggcuucugagcauugaacaaugguucugccuccucugccaggcgcaguguugggaaggaggcagagggccaagacgugugcggcagccucgggcgcacccucgaaccccggggagugcgggagcggacggggggagaaggugagcgccuccggggacgcggagcgccaggggccggccgggcuucagagucuuccggcggccgcgagcuggcgcacguucggugggcggcggccgggaggcuccgcggagccgagggcacccggacugcgacucccccggcgcggggccgccucuccggcgugcgggguaggggagcggcggggcuuuacgcaggacucugcucugggcgcuucuccucucccuuuuccccgccucgggcggcguuuggaaaccgcucgggucucccguguagcugaacgcggagggggaguggaggggagacuuaaucagguuaguuugcugacccuccuucccggugacguuuccucgagaggaauugaguccuaggcuagugacuguaauuagccuucauucuacacaauagcucaaaggagcagcgcgagagcgagcguguggcccugucuuguugggaagggcggcggugacuacugucggguccccagacucugccgcgggggccugggggccccgccuggucgucagccacguucccacuuggggccucguaacuuuccuggacaggcgacaggaagccuuucugagaggacucagucggaauccuagcgcguccccgaagugaucuucagaugugacgccgaggggcuugcuugccagcugcagggaauugggacugaaagccgcccaggcccuuaacacccguuccagagucccuggcucccgucgccggguggcuucaggggcccugccggccugcagucacgugcuccugaagugagagcgaacuuuaaagcauguggucaaggagccugucgggcagcgccugggguuuuuacgucuccgaaugccccugcccuuugguugccacuguccggagcgugugaacugggacuggccuuuccgcccucugcgauugguuagcggugcgaucacguuuagguuggucacaugguuccgcggacucuuaagugggcagcaugggcaguguuauuuucaauggaaaguaggagacuccacaggcucuuacgggcuguucucucaaaugccuuccccugccuggacucuuugaagaggacgaauguguagugaacauggaaucugauguguaacaagccugagagccuagaaaagcucugcuuacaagaguuuccaaacgcuagcauuaaucauuaauagaugaguaauacuaacuuauuaaacgauuucucaguauagugccaugacuugcauuaugccuuuuguaacauuucaaaacgcuaagguauaccagaaggaggga

SEQ ID NO: 20278 - RNA, 2532 nt, Homo sapiens
ucccuccuucugguauaccuuagcguuuugaaauguuacaaaaggcauaaugcaagucauggcacuauacugagaaaucguuuaauaaguuaguauuacucaucuauuaaugauuaaugcuagcguuuggaaacucuuguaagcagagcuuuucuaggcucucaggcuuguuacacaucagauuccauguucacuacacauucguccucuucaaagaguccaggcaggggaaggcauuugagagaacagcccguaagagccuguggagucuccuacuuuccauugaaaauaacacugcccaugcugcccacuuaagaguccgcggaaccaugugaccaaccuaaacgugaucgcaccgcuaaccaaucgcagagggcggaaaggccagucccaguucacacgcuccggacaguggcaaccaaagggcaggggcauucggagacguaaaaaccccaggcgcugcccgacaggcuccuugaccacaugcuuuaaaguucgcucucacuucaggagcacgugacugcaggccggcagggccccugaagccacccggcgacgggagccagggacucuggaacggguguuaagggccugggcggcuuucagucccaauucccugcagcuggcaagcaagccccucggcgucacaucugaagaucacuucggggacgcgcuaggauuccgacugaguccucucagaaaggcuuccugucgccuguccaggaaaguuacgaggccccaagugggaacguggcugacgaccaggcggggcccccaggcccccgcggcagagucuggggacccgacaguagucaccgccgcccuucccaacaagacagggccacacgcucgcucucgcgcugcuccuuugagcuauuguguagaaugaaggcuaauuacagucacuagccuaggacucaauuccucucgaggaaacgucaccgggaaggagggucagcaaacuaaccugauuaagucuccccuccacucccccuccgcguucagcuacacgggagacccgagcgguuuccaaacgccgcccgaggcggggaaaagggagaggagaagcgcccagagcagaguccugcguaaagccccgccgcuccccuaccccgcacgccggagaggcggccccgcgccgggggagucgcaguccgggugcccucggcuccgcggagccucccggccgccgcccaccgaacgugcgccagcucgcggccgccggaagacucugaagcccggccggccccuggcgcuccgcguccccggaggcgcucaccuucuccccccguccgcucccgcacuccccgggguucgagggugcgcccgaggcugccgcacacgucuuggcccucugccuccuucccaacacugcgccuggcagaggaggcagaaccauuguucaaugcucagaagcccacgcaccucggcgcccgucaagagggcgagaaacgaggcgaagcagcggcucugggggaggcggagugaggggcagaagacuaguucaggcgaggcgucggggcaccccgaaccccgcuguuccccaagcccggcucccuuuagccucggcgcugacagcucagaggcgccaccacggaggggagggagggaaggcgaggagaaccgagaggcgccuccuaggaggcgggugggcaaacggagaccuacgccucggggucucccggugccccggcugggucccgcccgccggcggaggggcgcguccucacucaccgguuccgguggcgccgcucucccggggcgcccagcacagcgcgagcagcagccagagcgcccagagcgcggacgugcccauggugcccgccuggauggugccgccgccgccgccgccgccgccguucgcuccgcacgacaaguuaccaguccuuccgaaaggaggaagaaggugggggcggggaggggaaagggggagaaggaggggaaggaguuggcgggggaagggagcggggaagaagagggcacccccuccccuacaacuugcacagucuccuccccacccacccagccaccuccccgggcugcagcagcagugcaagccgagccugcgggcagaaaauaaugcaggcgcugcagaggaggggaggcaaggggagaggagggaagggagaggggguggggagccgagagcagaagagagcacagaacggagaggagccgguagcggagcacccgcaccggcggcggccggagagcggggugagcagcggggagggggccggagggggcguggucaacgggaggcgcggcgggcgggcgggagcgcggcggcuucggcccuccuuucccucgacgcgcuccucuugcacgcgccgggcagccgggugcccgcgcggggagcgugcgagugugagcgugcgugagugaccgcggucguggucguggcugccgccgccgccacccggaccgcucuaggggcccggcugcuccgcgcguucgccuggggcucacgggggcccggggcgaccgcugguuggcucgcgcgccgcccucgccuccaaucccgggugccug

SEQ ID NO: 20279 - RNA, 2675 nt, Homo sapiens
aaaauaauucaaaagacacuucugaugugcuaagaaugagucuuaacauccuuaccuuuggugugauacauuuuugaagacaaggugguucuucuggaauacccauccaaggugcuaugaucauuaccaaagcuuucagugaugguuuccucaauuucuccucggaaaugauuuugaucagaagacacacauauuccuaaggaagcaggaaauagugauuaacuucaggguuguaaugcauuacugcuaacagcugugacaguggcagucuguuaugccagcaucaacuugagauacuucauugcagugacaucauuuuaaacacaagccaaacuuccucuuuacuguuaaugcaaaacucuccagauggacagaagcaccaauguguauacuguauacagucagucauagguaauauccccaguauagccauuuaaaauacuuucccaccaacugugguaggggcaagugagauuucugcccauuuuaauauuaccuuugggguaagaaaaagaaacucagucacuuuaaaaauguucuuaaaaauaacuucucugccccuggugcuauauggguccuaccagacuaaguuaagcaaaugcaauuccagcugccuggaacauugcaaucucaccggccaguuacuuuacuguguaauuucuauauuacagagauuuacuuaguucauccuggaguacugcuggguccuaaggagggucgucgcccuguuagcuuauuucuggagaccucuuuagcugucuaaauccaccuuuugaaaaauuaaaaguuaguggaucugugguuggggggaggaguacuuauauuaaggcagcagaggguagagggagggggaaggauggagaagucaaguugugaggguaccaagaucucucuuaaaaauggccaaugcagauaaaucaguccucuggcugacaacaguuucagcaaaaaucagaaggcgaggccagucuggcaaaacugugagaaucacaauaagaaaaaugaaaaggacagcugaacgccaaagcugguuucuuugauaucuguaugaucccaucguccuccucaucaucccccuucucaauugaccucaagguucuccccagacaaauuuuuauggaagaguccacuacgaggugaaccguuguauugaaucauugagggacacggaggaagauaaggaccucagagaccucccaacuucucucuucuucccgauuaaacacuugcaaugaagauacuucagcggaauccugcaugcugaacacccauuugcagguggcgccgcaguguucucagggcggagauuucuccccccaccccccccaaccccccgcccccgcccaauucauagacgcucaaaggcuggacaguuuuagugugaaagggagcuuucaggacucaccauuuuugcaguaauucccggggcagcacauagcgugacgcaugcagcguuuucggcgcuuccugcaggcgagacagauuugcacgccugcguccccuccgcgggugggacuagcgcaguacucaucagugccgcacuccucguccucugcgcacggguacggcugugggaaggguucggggagagggugaggcacccagacguccagguacccgcccucuuggacccgggcgcugaucacaguccuuaucuguccaccucuccaaaaccuguuacugcccacugcucccaaaugcaggguuaccaaaugcucccugaaccgcacacauucagcacguucuacucccucgucuccagauaggacccuuucaaggucagagcauccucugagugcccgaccccucucaccugguaguugucaauggucugguacuuauucccgcccggguacaggauucccggcgcggcgcugacugcagagccugggugccccgcagcgccgcccagcggugggggcagguucuugauagcguuggaauugagaaccgaguucaagguggcgcucacucccagcagaggguggccgccgagagccgccgcuaccaucgcgacaaagacccggguagcucccgcugcgcccagagccaucaucucagaaggacucaagagggagaaagaaagagaaaaugaccgucacuuugcaagccuggguccccacgaaaccgugccgguucggcugcagagucaggguccgggagcccccugcggucccagaguccugacugcagggagcacagagcucugcgccgccaccgccaccgcggcugccuuuauaccgcgggcccggagcauuccggccccuugggagggagacaacaaagccgggaugggauuucaaagcgcugggaggggcugggaggggguguguuuguguacaugaaggggggccuuugacacucuucaccccgccccucccuugcuuagucgcucggcuggcccggcucaccuucggggugaaggcuaccagcgagcguuauagcagacgacuuuaauaaaugcaggcggcagcaggaacucugggaacuugggugcccuugccuggcaguaaggguugaauuauccggaucugaaauacuuuacagagccgaggggugauaggcucugcaaaagcacuuuuugccccucuccuuuaugccaauacucgcugacugugcacacaagucauauucaguauuaaauacaaaccggucuguaauucaauggcucuagc

SEQ ID NO: 20280 - RNA, 2675 nt, Homo sapiens
gcuagagccauugaauuacagaccgguuuguauuuaauacugaauaugacuugugugcacagucagcgaguauuggcauaaaggagaggggcaaaaagugcuuuugcagagccuaucaccccucggcucuguaaaguauuucagauccggauaauucaacccuuacugccaggcaagggcacccaaguucccagaguuccugcugccgccugcauuuauuaaagucgucugcuauaacgcucgcugguagccuucaccccgaaggugagccgggccagccgagcgacuaagcaagggaggggcggggugaagagugucaaaggccccccuucauguacacaaacacacccccucccagccccucccagcgcuuugaaaucccaucccggcuuuguugucucccucccaaggggccggaaugcuccgggcccgcgguauaaaggcagccgcgguggcgguggcggcgcagagcucugugcucccugcagucaggacucugggaccgcagggggcucccggacccugacucugcagccgaaccggcacgguuucguggggacccaggcuugcaaagugacggucauuuucucuuucuuucucccucuugaguccuucugagaugauggcucugggcgcagcgggagcuacccgggucuuugucgcgaugguagcggcggcucucggcggccacccucugcugggagugagcgccaccuugaacucgguucucaauuccaacgcuaucaagaaccugcccccaccgcugggcggcgcugcggggcacccaggcucugcagucagcgccgcgccgggaauccuguacccgggcgggaauaaguaccagaccauugacaacuaccaggugagaggggucgggcacucagaggaugcucugaccuugaaaggguccuaucuggagacgagggaguagaacgugcugaaugugugcgguucagggagcauuugguaacccugcauuugggagcagugggcaguaacagguuuuggagagguggacagauaaggacugugaucagcgcccggguccaagagggcggguaccuggacgucugggugccucacccucuccccgaacccuucccacagccguacccgugcgcagaggacgaggagugcggcacugaugaguacugcgcuagucccacccgcggaggggacgcaggcgugcaaaucugucucgccugcaggaagcgccgaaaacgcugcaugcgucacgcuaugugcugccccgggaauuacugcaaaaauggugaguccugaaagcucccuuucacacuaaaacuguccagccuuugagcgucuaugaauugggcgggggcgggggguugggggggguggggggagaaaucuccgcccugagaacacugcggcgccaccugcaaauggguguucagcaugcaggauuccgcugaaguaucuucauugcaaguguuuaaucgggaagaagagagaaguugggaggucucugagguccuuaucuuccuccgugucccucaaugauucaauacaacgguucaccucguaguggacucuuccauaaaaauuugucuggggagaaccuugaggucaauugagaagggggaugaugaggaggacgaugggaucauacagauaucaaagaaaccagcuuuggcguucagcuguccuuuucauuuuucuuauugugauucucacaguuuugccagacuggccucgccuucugauuuuugcugaaacuguugucagccagaggacugauuuaucugcauuggccauuuuuaagagagaucuugguacccucacaacuugacuucuccauccuucccccucccucuacccucugcugccuuaauauaaguacuccuccccccaaccacagauccacuaacuuuuaauuuuucaaaagguggauuuagacagcuaaagaggucuccagaaauaagcuaacagggcgacgacccuccuuaggacccagcaguacuccaggaugaacuaaguaaaucucuguaauauagaaauuacacaguaaaguaacuggccggugagauugcaauguuccaggcagcuggaauugcauuugcuuaacuuagucugguaggacccauauagcaccaggggcagagaaguuauuuuuaagaacauuuuuaaagugacugaguuucuuuuucuuaccccaaagguaauauuaaaaugggcagaaaucucacuugccccuaccacaguuggugggaaaguauuuuaaauggcuauacuggggauauuaccuaugacugacuguauacaguauacacauuggugcuucuguccaucuggagaguuuugcauuaacaguaaagaggaaguuuggcuuguguuuaaaaugaugucacugcaaugaaguaucucaaguugaugcuggcauaacagacugccacugucacagcuguuagcaguaaugcauuacaacccugaaguuaaucacuauuuccugcuuccuuaggaauaugugugucuucugaucaaaaucauuuccgaggagaaauugaggaaaccaucacugaaagcuuugguaaugaucauagcaccuuggauggguauuccagaagaaccaccuugucuucaaaaauguaucacaccaaagguaaggauguuaagacucauucuuagcacaucagaagugucuuuugaauuauuuu

SEQ ID NO: 20281 - RNA, 2638 nt, Homo sapiens
acaccuccuccuuuuccacaugaggaaucagggauccagggccaaauuucacuuuaucuuucuuuuagaaagggcuguaccugcugcauguauguuuuaauuaagaaaacugaauauacagaaauuccagauuucagaagcaaugcuuugauguucauuugcaguagcuauggauggauucaugaaaacaggggcuuccucagaauccccuugcacaucuaucagccacucuaguguauacuauugacucaccaguuuugcaaagcaaggcacgccuccaauucuguucuuccccuaauccauucccacaaauaauaaaaugauugacugcucagcguuaaucuuucuaugaaacuuuacagaguaauccuaucauuugccuguuauacagaaaucagcugaaaagcauuaagaauauuagcguguuuuuccuccaugaaauugcuagagcacaacaaacagagccccuucuccugccuccuuuucucuaacaacccccaacagaacacccuacacccagauuccucucuuuccauggugaggcugauggaggcuuagaaggacacuugguaugcccgcucccucuucccuuuuuuaucagucaaaauaccagugaaacggaagucaauacuuauuugauucaugguuuuuuuuccuuuuuaaagcacgaauaacauuucuuucaaaauaaauauacaguucuauaaaaaaauauaagaagguacuauaauucuuggucacuguccagcagaaacauguuugauugcuuuuagagucagaagucaacaccauccacaaaaauacauucuuuuagccagguuuuagaacacuuugaaacauagaaaauuccuuauucuacaaacaaguccuuuuagagauauucuaaauaugccagugaugaaugucuaauucauaugcaggauucaaggcuauugaggugagcuagacuaagaauaccaagaacacaaaauuguauugauacacaaacaguauguaaauuacuuugucagauuacaaaaaugcaucagauuuuaucuaugguuuucauagauaaacauaaagcaauaaguuaguugcuuuaaaaaaauauauagcucagguguuucucuucauucaagugugaaaggcacagcagucccgagucuuaggggcacccaccgcagccacaucaccgcgcugggacagaugcaguccgcagcguucccaguauuuugucccaguguguaaaguacggagcgaaguugcaguuaaagugagagugaugcaggucguggugcaccacacccccguaccacccgaagggcaccagucugugaguggaccaagggaaguuguagccggagugguccuccacggaaagccagauguugaccacguggaaggucaggguggugagcggguggcacccgagcagugugacguucaucaugucgaagaagcccaaagaaaacaguucccagacgcucauauacugcguugccagcgcgaacgaggacgaguucugguggugcaccuuguggaaggugcgguacagccagggcaccuuguggugcagcaggugccacacgaagaacuccaugucgaagaguagcaggcagaacaggauguggugcagcagcaggagcagcucgggagcuucguggggcaggagggccgggcugcgggcccaaugcagcagcgucacggggaacacaaacaucacaugcugguagagggucugccccaggcaagguagcagcugcugcgcggauggcgagaagucaggguggaucuuguagcgccgcagggcgggcacccaggagcacaggauauccaggaccacgaagggcaggcaaaagcccacguauguggugauggagaagaugaccgggaagaagggcgacuguaggagggccucccagcuccucagguggucccagaggggcugcaggaacagcugcccggagcugcaaaggaccugggggucggagcaguuguggcagcucauugcgaggcugugcaaggcagcugaggcugcugcucgagucccaucgacuuuucacaggacucacggccccgccccgagugaugucagcugccuuuccaucccuuucccggcgaugcgaagcuugaauaagcuagcaacccggcagaguggcccuucauugcuguaaaugugcucaucuauagccgcaucuuaccggcuuuuagauaugcguguaugcaguggcacuucguacuuuucauguaaguucugauuuuucaguugacguacaauuaacacgggacacaauguacagaucuaccguguggaguuucuaugaguuuggcaacucaguucacgugugucaucacgggucucaaacuagaccguuuacauugccaccagaaagcgcuccuuugcaaucaaugcagaauuguuuguguuuuuuaaugcauacguauaacugcauccaugugcuuucauaaagacgcaagcauaaucgcauuuuaaaaacuguuuaaagcuacaugcggucuguagcucggguguuuucugagaacccgguugcggucuauccagcggcgaucgagaaacgagcccuuugcacagggaaccgcugguccccgaacgccggcggugaccgucagcucaggaaaucagacgggaaggguggcc

SEQ ID NO: 20282 - RNA, 2638 nt, Homo sapiens
ggccacccuucccgucugauuuccugagcugacggucaccgccggcguucggggaccagcgguucccugugcaaagggcucguuucucgaucgccgcuggauagaccgcaaccggguucucagaaaacacccgagcuacagaccgcauguagcuuuaaacaguuuuuaaaaugcgauuaugcuugcgucuuuaugaaagcacauggaugcaguuauacguaugcauuaaaaaacacaaacaauucugcauugauugcaaaggagcgcuuucugguggcaauguaaacggucuaguuugagacccgugaugacacacgugaacugaguugccaaacucauagaaacuccacacgguagaucuguacauugugucccguguuaauuguacgucaacugaaaaaucagaacuuacaugaaaaguacgaagugccacugcauacacgcauaucuaaaagccgguaagaugcggcuauagaugagcacauuuacagcaaugaagggccacucugccggguugcuagcuuauucaagcuucgcaucgccgggaaagggauggaaaggcagcugacaucacucggggcggggccgugaguccugugaaaagucgaugggacucgagcagcagccucagcugccuugcacagccucgcaaugagcugccacaacugcuccgacccccagguccuuugcagcuccgggcagcuguuccugcagccccucugggaccaccugaggagcugggaggcccuccuacagucgcccuucuucccggucaucuucuccaucaccacauacgugggcuuuugccugcccuucgugguccuggauauccugugcuccugggugcccgcccugcggcgcuacaagauccacccugacuucucgccauccgcgcagcagcugcuaccuugccuggggcagacccucuaccagcaugugauguuuguguuccccgugacgcugcugcauugggcccgcagcccggcccuccugccccacgaagcucccgagcugcuccugcugcugcaccacauccuguucugccugcuacucuucgacauggaguucuucguguggcaccugcugcaccacaaggugcccuggcuguaccgcaccuuccacaaggugcaccaccagaacucguccucguucgcgcuggcaacgcaguauaugagcgucugggaacuguuuucuuugggcuucuucgacaugaugaacgucacacugcucgggugccacccgcucaccacccugaccuuccacguggucaacaucuggcuuuccguggaggaccacuccggcuacaacuucccuugguccacucacagacuggugcccuucgggugguacggggguguggugcaccacgaccugcaucacucucacuuuaacugcaacuucgcuccguacuuuacacacugggacaaaauacugggaacgcugcggacugcaucugucccagcgcggugauguggcugcggugggugccccuaagacucgggacugcugugccuuucacacuugaaugaagagaaacaccugagcuauauauuuuuuuaaagcaacuaacuuauugcuuuauguuuaucuaugaaaaccauagauaaaaucugaugcauuuuuguaaucugacaaaguaauuuacauacuguuuguguaucaauacaauuuuguguucuugguauucuuagucuagcucaccucaauagccuugaauccugcauaugaauuagacauucaucacuggcauauuuagaauaucucuaaaaggacuuguuuguagaauaaggaauuuucuauguuucaaaguguucuaaaaccuggcuaaaagaauguauuuuuguggaugguguugacuucugacucuaaaagcaaucaaacauguuucugcuggacagugaccaagaauuauaguaccuucuuauauuuuuuuauagaacuguauauuuauuuugaaagaaauguuauucgugcuuuaaaaaggaaaaaaaaccaugaaucaaauaaguauugacuuccguuucacugguauuuugacugauaaaaaagggaagagggagcgggcauaccaaguguccuucuaagccuccaucagccucaccauggaaagagaggaaucuggguguaggguguucuguuggggguuguuagagaaaaggaggcaggagaaggggcucuguuuguugugcucuagcaauuucauggaggaaaaacacgcuaauauucuuaaugcuuuucagcugauuucuguauaacaggcaaaugauaggauuacucuguaaaguuucauagaaagauuaacgcugagcagucaaucauuuuauuauuugugggaauggauuaggggaagaacagaauuggaggcgugccuugcuuugcaaaacuggugagucaauaguauacacuagaguggcugauagaugugcaaggggauucugaggaagccccuguuuucaugaauccauccauagcuacugcaaaugaacaucaaagcauugcuucugaaaucuggaauuucuguauauucaguuuucuuaauuaaaacauacaugcagcagguacagcccuuucuaaaagaaagauaaagugaaauuuggcccuggaucccugauuccucauguggaaaaggaggaggugu

SEQ ID NO: 20283 - RNA, 2372 nt, Homo sapiens
gaggaggcagcuggacgauuccugaaaggacuuucccuugcuuccucaucacguggaagagagcccacccggcaccuggaaauggaaagccagugaaggcugcuuugggccggggcagcgggugggaccgggcgggagggauuccaaagagaccgccgggaaggcuagagcuuggaauuccggcuccucggaguccuggcccucccccaccgccgccucggagcucagcacaccuuggaugggggaggcgggcagcuccuagccccgcaccccaggaggcgcgcucggagggaagccgccaccgcgccgccucugccucggcgcggaacaaacgguuaaagauuuugggcagcgccucgcggggggaggagccaggggcccaauccgcaauuaaagaugaacuuugggugaacuaauugucugaccaagguaacgugggcagcaaccugggccgccuauaaagcggcagcgccgugggguuugaagcgcuggcggcggcggcagguggcgcgggaggucgcggcgcgccauggggcucccggcgcugcuggccagugcgcucugcaccuucgugcugccgcugcugcucuuccuggcugcgaucaagcucugggaccuguacugcgugagcggccgcgaccgcaguugugcccucccauugccccccgggacuaugggcuuccccuucuuuggggaaaccuugcagaugguacugcagguaagggaggguggggcgggacaggcugcuuccccggagcccggcgcggcucugggcuucugcugaagucgggguaggcgcccccgggaggcaugcuauugcggcuaggagcagggcuggcgggagcgcggcgcuccccggcgcccccucaugcccacuucucuccuccgccuuccucccacagcggaggaaguuccugcagaugaagcgcaggaaauacggcuucaucuacaagacgcaucuguucgggcggcccaccguacgggugaugggcgcggacaaugugcggcgcaucuugcucggagagcaccggcuggugucgguccacuggccagcgucggugcgcaccauucugggaucuggcugccucucuaaccugcacgacuccucgcacaagcagcgcaagaaggugggggcaggaggcgacggcuggacagggagggggaccccauuuaugagcggaauuccggcugauggaugcuaggcgcgggcuagcagcuugaggugggcuaggacccucugccagcuccagguuagcuuucccagcucggagagugccaugugucuggcaggacugggggugucuggaaggggacggcgguagacgagaggggcggauggaggcuuuuaacgcuguccccuccucgggacucaggugauuaugcgggccuucagccgcgaggcacucgaaugcuacgugccggugaucaccgaggaagugggcagcagccuggagcaguggcugagcugcggcgagcgcggccuccuggucuaccccgaggugaagcgccucauguuccgaaucgccaugcgcauccuacugggcugcgaaccccaacuggcgggcgacggggacuccgagcagcagcuuguggaggccuucgaggaaaugacccgcaaucucuucucgcugcccaucgacgugcccuucagcgggcuguaccggguaagggcggcaaacgggcugcggacuaggggcgcgggaccugggcgucugcucaccgccgcgcgcucucugcgcucagggcaugaaggcgcggaaccucauucacgcgcgcaucgagcagaacauucgcgccaagaucugcgggcugcgggcauccgaggcgggccagggcugcaaagacgcgcugcagcuguugaucgagcacucgugggagaggggagagcggcuggacaugcaggugaguagcagcuucagaccaggcacugcggaguuugguccccuggcuuuccaagcgcuguuccuggggcccccaaagcgcgcgccuggggcccagcuuucuggagugggcggccggcucagacuacagcuauggaaucccgaaggaaggcugagacacccggucaggagagcugcggaaggggcugcggcggaacugggagcauccccuagccuuuccagguuucaaagggaaaguuggaauuugcaaaaauguuaauaaagaaccuugcgauuuuaauaaaacuaagacuuuaacucaggaguuuccgguagagcggggucguacucgccuuacugcuccagcugaacuaaagggacguugcauuuuguuuaaagauauugcuuuccuugacuuucugucagcaaaacauuuagcccuucuagucuucccuccagaacucucaguucgauucugaguaauccuucugu

SEQ ID NO: 20284 - RNA, 2372 nt, Homo sapiens
acagaaggauuacucagaaucgaacugagaguucuggagggaagacuagaagggcuaaauguuuugcugacagaaagucaaggaaagcaauaucuuuaaacaaaaugcaacgucccuuuaguucagcuggagcaguaaggcgaguacgaccccgcucuaccggaaacuccugaguuaaagucuuaguuuuauuaaaaucgcaagguucuuuauuaacauuuuugcaaauuccaacuuucccuuugaaaccuggaaaggcuaggggaugcucccaguuccgccgcagccccuuccgcagcucuccugaccgggugucucagccuuccuucgggauuccauagcuguagucugagccggccgcccacuccagaaagcugggccccaggcgcgcgcuuugggggccccaggaacagcgcuuggaaagccaggggaccaaacuccgcagugccuggucugaagcugcuacucaccugcauguccagccgcucuccccucucccacgagugcucgaucaacagcugcagcgcgucuuugcagcccuggcccgccucggaugcccgcagcccgcagaucuuggcgcgaauguucugcucgaugcgcgcgugaaugagguuccgcgccuucaugcccugagcgcagagagcgcgcggcggugagcagacgcccaggucccgcgccccuaguccgcagcccguuugccgcccuuacccgguacagcccgcugaagggcacgucgaugggcagcgagaagagauugcgggucauuuccucgaaggccuccacaagcugcugcucggaguccccgucgcccgccaguugggguucgcagcccaguaggaugcgcauggcgauucggaacaugaggcgcuucaccucgggguagaccaggaggccgcgcucgccgcagcucagccacugcuccaggcugcugcccacuuccucggugaucaccggcacguagcauucgagugccucgcggcugaaggcccgcauaaucaccugagucccgaggaggggacagcguuaaaagccuccauccgccccucucgucuaccgccguccccuuccagacacccccaguccugccagacacauggcacucuccgagcugggaaagcuaaccuggagcuggcagaggguccuagcccaccucaagcugcuagcccgcgccuagcauccaucagccggaauuccgcucauaaauggggucccccucccuguccagccgucgccuccugcccccaccuucuugcgcugcuugugcgaggagucgugcagguuagagaggcagccagaucccagaauggugcgcaccgacgcuggccaguggaccgacaccagccggugcucuccgagcaagaugcgccgcacauuguccgcgcccaucacccguacggugggccgcccgaacagaugcgucuuguagaugaagccguauuuccugcgcuucaucugcaggaacuuccuccgcugugggaggaaggcggaggagagaagugggcaugagggggcgccggggagcgccgcgcucccgccagcccugcuccuagccgcaauagcaugccucccgggggcgccuaccccgacuucagcagaagcccagagccgcgccgggcuccggggaagcagccugucccgccccacccucccuuaccugcaguaccaucugcaagguuuccccaaagaaggggaagcccauagucccggggggcaaugggagggcacaacugcggucgcggccgcucacgcaguacaggucccagagcuugaucgcagccaggaagagcagcagcggcagcacgaaggugcagagcgcacuggccagcagcgccgggagccccauggcgcgccgcgaccucccgcgccaccugccgccgccgccagcgcuucaaaccccacggcgcugccgcuuuauaggcggcccagguugcugcccacguuaccuuggucagacaauuaguucacccaaaguucaucuuuaauugcggauugggccccuggcuccuccccccgcgaggcgcugcccaaaaucuuuaaccguuuguuccgcgccgaggcagaggcggcgcgguggcggcuucccuccgagcgcgccuccuggggugcggggcuaggagcugcccgccucccccauccaaggugugcugagcuccgaggcggcggugggggagggccaggacuccgaggagccggaauuccaagcucuagccuucccggcggucucuuuggaaucccucccgcccggucccacccgcugccccggcccaaagcagccuucacuggcuuuccauuuccaggugccgggugggcucucuuccacgugaugaggaagcaagggaaaguccuuucaggaaucguccagcugccuccuc

SEQ ID NO: 20285 - RNA, 2500 nt, Homo sapiens
agguuaacucucccucucuaagauuccaugauauguguccccuggccugcauuauucucuagcuaccaaguagauuccugauuugaaacuuaggauaaauggggaaaaaaaugggaaaaagagcauguagacacuguuuucucaugauuaggccaaauuuuaggauguucuucuacaaguccucaacaucacuccccuccacaucugauuuucacagcuuaguggaaagggaagaggccacagccacagcacacugugccuggcucagaaucucagcaucagcaggccaggcacuugggaggcauccaccccuaugcacaguguucccuccguccuuggauagggcucucucggccucugugggagccccagauagucaagcugucucagggauucagcccaaagagacggaggaaaugcagagcuagguggaguggugaugugaaagacaggaggagaaagcauggagaaagcacacaccuuggcacaguggcugguggggaaaaugacaccugacaaaccgaaagguccuuuugagcuuaggccagguuucuugagcugagguuuggggaggggguagguagcugcucccaaucuuguuccccuaaccucagguggugcugcggguuccugacacuuccagaccuuuccgcaggccauucuuccuaaggguagguaccucuggagaagaaacccagcgauuuggcccgguaggcgccccauucccaagacagucccacagagcugacuacucacuuccuuucuggagaaaggaggcuacgccccaguacuucaucuugaacuuggcaggguccucggugucugugaaggugcccaccaugucugcgcacacgucccaguuacugcaaaagccaaggggauccucagccaagccgggcaaagggcuuccucccucccuccacccauucggugcucccuucccuucacaaugcccacguggcgaucagcaggcagggcccuuggggaacccuggagcgcaaagggcgcagcugccccggcggccacugacuucaaaagacggacucggcccuuggcuguggcgcucaucuggccggucucguccacggagaacuccgcgacgauguuguccugcagaaagaggcccucgggguccuucuuggccauggcguaccaggucccagagaacugugagaaggaugacagcagggguuuggcguccgggggcgcacggcgggccgcggggagggcggggaugggguggggaccugggccgccugggcccccugggccgauaccuacgcgagccuugucgaaguucuccuugacucggaagcugcucacucggcagucgcgcuccgcgcggccgcugcccagcgccgccaacagcaagagcgcccacacccacuucaucuugcccaggaauccgcccugcgggagacgcgccuccgucagugcccggcagccgacccccgccgccguaucccaccucaccccaccccaccccaccccggcccaucccgccgccggccccgaggccccggccgcgacucaccaccgggaggggaaccgcgcgcaagccuggccgccgaguccgggcgcgcguggagcgagggaggcgagcgcgccgcggccgccccgcugcuuuauagcgccggggggagggggucgcgcuuucguaaccgcgcggggugaaagaccgaaggggaggcgccgggggcacuugcauaacgcgcccugacucaccggagcccgggcacgggcagggucccugugggccggccucaccuccaggacagccucgggcacaguggagcggccgcgcgggguggccucggccaggccaaaugcgccagcggcccuggcucaguuacccugcacucgugccagcggccgccagcugcggucuaggguggccuccggggccaguggcucuggcaggaggcucgagucaaccuggcgggaagaccguggccucacagagcgagagcggacccgcgaggcucccuggugcgugagugcccaggcccuggccaugccaaauuggcgccuccgucugccuucugagguccacuugugcaggaauuuuggaauaauucauccaaguaguuuuucauuuuauaaaggauguauuuuacucucuuucaggagcguuguggugcccucuggucaauauuuguucuuuaguuucaacaucuuuaaaagcguuaaaacccucccuguuaaauauucuccagaaacgcaacccuggucaggacaggaaauauuuuagcagccucgguggucgccugcuuacuccguggcacuucccugaaaccacuuugaaaaacaccuaccgauuguuuaugaugcaauuuuauuucaaacccauguuggaauuuucauuuauuuucaaaacagcuaaggucgguuguuuuguuggcuggggaguagacaaaggagagaagaguaaacaacauucuauaacuucaguagccaauugaaucaaaacagugugacuaguuuagguauuuuccugugu

SEQ ID NO: 20286 - RNA, 2500 nt, Homo sapiens
acacaggaaaauaccuaaacuagucacacuguuuugauucaauuggcuacugaaguuauagaauguuguuuacucuucucuccuuugucuacuccccagccaacaaaacaaccgaccuuagcuguuuugaaaauaaaugaaaauuccaacauggguuugaaauaaaauugcaucauaaacaaucgguagguguuuuucaaagugguuucagggaagugccacggaguaagcaggcgaccaccgaggcugcuaaaauauuuccuguccugaccaggguugcguuucuggagaauauuuaacagggaggguuuuaacgcuuuuaaagauguugaaacuaaagaacaaauauugaccagagggcaccacaacgcuccugaaagagaguaaaauacauccuuuauaaaaugaaaaacuacuuggaugaauuauuccaaaauuccugcacaaguggaccucagaaggcagacggaggcgccaauuuggcauggccagggccugggcacucacgcaccagggagccucgcggguccgcucucgcucugugaggccacggucuucccgccagguugacucgagccuccugccagagccacuggccccggaggccacccuagaccgcagcuggcggccgcuggcacgagugcaggguaacugagccagggccgcuggcgcauuuggccuggccgaggccaccccgcgcggccgcuccacugugcccgaggcuguccuggaggugaggccggcccacagggacccugcccgugcccgggcuccggugagucagggcgcguuaugcaagugcccccggcgccuccccuucggucuuucaccccgcgcgguuacgaaagcgcgacccccuccccccggcgcuauaaagcagcggggcggccgcggcgcgcucgccucccucgcuccacgcgcgcccggacucggcggccaggcuugcgcgcgguuccccucccgguggugagucgcggccggggccucggggccggcggcgggaugggccgggguggggugggguggggugaggugggauacggcggcgggggucggcugccgggcacugacggaggcgcgucucccgcagggcggauuccugggcaagaugaagugggugugggcgcucuugcuguuggcggcgcugggcagcggccgcgcggagcgcgacugccgagugagcagcuuccgagucaaggagaacuucgacaaggcucgcguagguaucggcccagggggcccaggcggcccagguccccaccccauccccgcccuccccgcggcccgccgugcgcccccggacgccaaaccccugcugucauccuucucacaguucucugggaccugguacgccauggccaagaaggaccccgagggccucuuucugcaggacaacaucgucgcggaguucuccguggacgagaccggccagaugagcgccacagccaagggccgaguccgucuuuugaagucaguggccgccggggcagcugcgcccuuugcgcuccaggguuccccaagggcccugccugcugaucgccacgugggcauugugaagggaagggagcaccgaauggguggagggagggaggaagcccuuugcccggcuuggcugaggauccccuuggcuuuugcaguaacugggacgugugcgcagacauggugggcaccuucacagacaccgaggacccugccaaguucaagaugaaguacuggggcguagccuccuuucuccagaaaggaagugaguagucagcucugugggacugucuugggaauggggcgccuaccgggccaaaucgcuggguuucuucuccagagguaccuacccuuaggaagaauggccugcggaaaggucuggaagugucaggaacccgcagcaccaccugagguuaggggaacaagauugggagcagcuaccuacccccuccccaaaccucagcucaagaaaccuggccuaagcucaaaaggaccuuucgguuugucaggugucauuuuccccaccagccacugugccaaggugugugcuuucuccaugcuuucuccuccugucuuucacaucaccacuccaccuagcucugcauuuccuccgucucuuugggcugaaucccugagacagcuugacuaucuggggcucccacagaggccgagagagcccuauccaaggacggagggaacacugugcauagggguggaugccucccaagugccuggccugcugaugcugagauucugagccaggcacagugugcuguggcuguggccucuucccuuuccacuaagcugugaaaaucagauguggaggggagugauguugaggacuuguagaagaacauccuaaaauuuggccuaaucaugagaaaacagugucuacaugcucuuuuucccauuuuuuuccccauuuauccuaaguuucaaaucaggaaucuacuugguagcuagagaauaaugcaggccaggggacacauaucauggaaucuuagagagggagaguuaaccu

SEQ ID NO: 20287 - RNA, 2478 nt, Homo sapiens
agcuaccuuaaaguuuggggguggcaccuuacaaaagcgccgucaaguuucauacagccagcggcuucuucucugggagagucacauuuuaaaaccgguuucagacacaaaagaagggcuggcacgggaggaggaaauaaauugugagggugaggagccgccgaggccgaggcccaugacuccauggagggccagaagagagcagaaaaacguccagggucucucaugcauuccuauagacaccagaaaggguggaauaagaaagcucagcugggaggacaagaaagagacucaagagaucguuuaugacuguuucugagaaagcuccuggcauggccaugaguggccuuccgggaguccuguaaaaaggaaagcacagaaaacaggaaagaacucucccuacacgucccucucugccuguuuguguccucgggagacuccaagcggugguaaagcaccaacagggcucuucuuggagcaagagaaagaaaagacuccggggugaguaagcucucccaggaaccccacagcaaaccgugaccuugaacacagauggcaaggucaagucauuuacaaguccacauucaaauccaaaucucccaccugcaaaauucuucaccucucuccagucccuuaauuggaguucacaucucccaccuucaccagccaccgaaucggugggaaaaaggggcaaugccaagccacccaccaccaaacuuuuacauucuucuccccucuggaauuucuuugcacagcaauuguagcaccacuuacuaagcuccuccaccagaaaauaagaaaauguaugcgugucguuaguuuucaaguauuguuauaaagccaucgcgauuccuaccccugagcccuccuuaaacaauccaagcucacgacgcccccaagggcuaagugagguacaagucgaugcaaguagcugccauaguucucccaguuuaucccagguccuugggcuuggauggcccgggaaauucucaugccccacggaagcacccuggcgcauacauuucuccacgcuuaaguuuucuccgacggccucgccgcggcugguaacuucucugguugagaucucuccccacgcgccuccccgcagccaaaguggucgcucccaggcuggcgacgucggcuucagcucagaguuaguaggaacuggacgcuguugggucuacgcagcggccuccacuuccuccuccaggaggccugcgucagagcaaggagccugagggcugcagggcaaugcggucagguccgcugcggccucccccgggcccaggggcgcuugcggggcccguggcugcaaccgcggcgacggcucguuggagucuccgcacggcuuccuugaugagguuucccgagagcacgagcugcuggaggagccgaugcgggucgucgucgccggcgcgugccccggcuuggguccaucggcgcugcugcaagcggcgggaggugaccgcgucccugagccauccucgccggcacggccccggcagcgcgcuggggccugcggcgaccuccgccacgcaguagggcgcagcgcguccgcgcacgcggccgcgguccccuagggcgcagcgcagggccccagagggcgccgggcccaccgucucagccgaagcgggcggcagcagcagcggcaccgccgggggccgggccuuguccgccggcaccgccgcagccaggggccccggggcccgcagcggcacccccgggggcgcgcacggcgaggccgggcuguccugcgccgcguccagcugcagcgucucgccgaucugggccaccagccgguccaccucgcccgagcugcccagcgucaccgacugcugcagcaggaggaagcugucguccuccucuuccucccccuccgccuccucgccggcuuccucuuccuccucccuccggcacggcauggccccccguccuggcacccggagcugugcgggcuucgcugggggcuugguugcccgcgggcgcggagcugcgggcgaagccggagcaggggcggacgcggaagccggagcccgccaggcacucgagccacgcgccugcagccgcuggagccggaauccugccggcucggguugauuuguaaacaaugggugacgucgcgccgggcccuaccaccgcaccggggcgggggugacgcgcgagcaggcacgggggcaaagggcggcgcgggcggugaccgaagccgucccgcgccuguguucguugucccuccaggaggggguccggggcguggggacugauuuccgaccucccgggcccaacgagccgugcugaaacguggcgccucggaggaggcugagguugguuucucccacgcacggacacacccacacccacuccgggcccgccuccugggccgcggccucccuccccacgugucggccgcgccuaagcccgcccgacucccgccccgcgcacccgcaguucccggcccuggucgugggggaggggcgggcc

SEQ ID NO: 20288 - RNA, 2478 nt, Homo sapiens
ggcccgccccucccccacgaccagggccgggaacugcgggugcgcggggcgggagucgggcgggcuuaggcgcggccgacacguggggagggaggccgcggcccaggaggcgggcccggaguggguguggguguguccgugcgugggagaaaccaaccucagccuccuccgaggcgccacguuucagcacggcucguugggcccgggaggucggaaaucaguccccacgccccggacccccuccuggagggacaacgaacacaggcgcgggacggcuucggucaccgcccgcgccgcccuuugcccccgugccugcucgcgcgucacccccgccccggugcggugguagggcccggcgcgacgucacccauuguuuacaaaucaacccgagccggcaggauuccggcuccagcggcugcaggcgcguggcucgagugccuggcgggcuccggcuuccgcguccgccccugcuccggcuucgcccgcagcuccgcgcccgcgggcaaccaagcccccagcgaagcccgcacagcuccgggugccaggacggggggccaugccgugccggagggaggaggaagaggaagccggcgaggaggcggagggggaggaagaggaggacgacagcuuccuccugcugcagcagucggugacgcugggcagcucgggcgagguggaccggcugguggcccagaucggcgagacgcugcagcuggacgcggcgcaggacagcccggccucgccgugcgcgcccccgggggugccgcugcgggccccggggccccuggcugcggcggugccggcggacaaggcccggcccccggcggugccgcugcugcugccgcccgcuucggcugagacggugggcccggcgcccucuggggcccugcgcugcgcccuaggggaccgcggccgcgugcgcggacgcgcugcgcccuacugcguggcggaggucgccgcaggccccagcgcgcugccggggccgugccggcgaggauggcucagggacgcggucaccucccgccgcuugcagcagcgccgauggacccaagccggggcacgcgccggcgacgacgacccgcaucggcuccuccagcagcucgugcucucgggaaaccucaucaaggaagccgugcggagacuccaacgagccgucgccgcgguugcagccacgggccccgcaagcgccccugggcccgggggaggccgcagcggaccugaccgcauugcccugcagcccucaggcuccuugcucugacgcaggccuccuggaggaggaaguggaggccgcugcguagacccaacagcguccaguuccuacuaacucugagcugaagccgacgucgccagccugggagcgaccacuuuggcugcggggaggcgcguggggagagaucucaaccagagaaguuaccagccgcggcgaggccgucggagaaaacuuaagcguggagaaauguaugcgccagggugcuuccguggggcaugagaauuucccgggccauccaagcccaaggaccugggauaaacugggagaacuauggcagcuacuugcaucgacuuguaccucacuuagcccuugggggcgucgugagcuuggauuguuuaaggagggcucagggguaggaaucgcgauggcuuuauaacaauacuugaaaacuaacgacacgcauacauuuucuuauuuucugguggaggagcuuaguaaguggugcuacaauugcugugcaaagaaauuccagaggggagaagaauguaaaaguuuggugguggguggcuuggcauugccccuuuuucccaccgauucgguggcuggugaaggugggagaugugaacuccaauuaagggacuggagagaggugaagaauuuugcaggugggagauuuggauuugaauguggacuuguaaaugacuugaccuugccaucuguguucaaggucacgguuugcugugggguuccugggagagcuuacucaccccggagucuuuucuuucucuugcuccaagaagagcccuguuggugcuuuaccaccgcuuggagucucccgaggacacaaacaggcagagagggacguguagggagaguucuuuccuguuuucugugcuuuccuuuuuacaggacucccggaaggccacucauggccaugccaggagcuuucucagaaacagucauaaacgaucucuugagucucuuucuuguccucccagcugagcuuucuuauuccacccuuucuggugucuauaggaaugcaugagagacccuggacguuuuucugcucucuucuggcccuccauggagucaugggccucggccucggcggcuccucacccucacaauuuauuuccuccucccgugccagcccuucuuuugugucugaaaccgguuuuaaaaugugacucucccagagaagaagccgcuggcuguaugaaacuugacggcgcuuuuguaaggugccacccccaaacuuuaagguagcu

SEQ ID NO: 20289 - RNA, 2068 nt, Homo sapiens
agagcgguuacucaagucugacagcagacggggaggaagggggagagggcauggagccagccuggaagagcuauguggaccagcacagaaaaggggaggcugagaccagggagaaauuaggguucaggggacugaggggugggugggaggagggacuuaggaccucauagguuucaugagccugggauggcuuccuauuuuauggauggggaaacugaggcucagugaagucaagcaacuugccuaagggcuucucuucaggggcagagccuaaucugcucuuccuuccgcacugagccuuacccgaaugacucccagccaggggaacuggggaagaggguggagaucuuaggguuccagguacagaaaacggggacgcagaucauaguccagaacauucuuaguccccagucuuucuccacaucccuucccucaccucuccucucuucccaaggucccaacacggaguggggaugaugcuugcuuuggugccucgggauccaggugaaaggcauuguuuaacgaccccaggcauucuugggcugagaggggucauaaggcauuuaucaggacgucccaggauuggggggacggcauugggggauucucagcagcuugguuggauggguacugagaggggugccagggguuuccagggaacgagagccagagggaaggucuggagccgccgggaggcacuaugcugccacucccuggggaggugggaaggcgggaaggcugcgggggauaauuccggggacgcugggcugagcuaggacagcgugugugugugugugugggcggagggggggagcugcaccucuugggggguucgcagagcugugcuaggggagcugcagggccgucggagcgcgcggggacggcggcggcggcgcuaccuggaggcgcgguggcgggcaggugcccgaacugcacggcgaugcagaggucguuguccagggggaacuuguggcagugcagcaucucaggccaggggaagccguaggccuccaugagcggcgcgcagccggcgcgcacggccucgcacagcgagcggcacggguagaugggccggucgagacagacgggcgcaaagagcgagcacaggaagaccugcguauccgaguggcagcgcuuggccagcagcggcagccagcugcucgccugcugcuucacuucggccaggcucucgugcuccagcagguugggcagccgcaugcgcuuguagcccaccguguggcagagcggcaggucggcagggaugucaaggcacugcggcggcuuggaguaggagcggccgugcagcggcucggccugccagccauaguagucguacuccucgcagcgcgccggcgcccagugcagcgcccccagcagcagcgccagcgcggccguccgcacgcccccccccgccgccgccgcccgcauggcugcgcccucuccaggugcgcgccgcgcagccccccgacgcucggugcccggcggcccagguguuccggcgugcgcccccggcccugacucuacccagccgccgccgccgccgccgcggaggucgcccagguggguggcagccugcgcugcgggcgccccgacugauccuggcgccucccaccucggggcuccagcccgggccucgccgugcgccccagccaaucuccggccgccuggccccagcuccaaggcggggaggcagugggggcggcccucagccccucccgcacccugcccgagcgucccgcccagcgccaggucuugcgccccucucccggcucggcuccccugccgcagcccuggccucgcccagcguuucuccccagggcucccugccucccugggcauuuuccucgacccucgccuucuccauccuuccuccuuaucucucuccgccacagccucuccuguuccuuuucucacucacuucacuugcuuaucucucugccuuggcuuuucucccucugcucuguuuucucuuccccgacaccucgguuccucuucucccuggugggaggcucgugccaccccacacccuggaucuucugguccuccuggcaggucuucauugagcuug

SEQ ID NO: 20290 - RNA, 2068 nt, Homo sapiens
caagcucaaugaagaccugccaggaggaccagaagauccagggugugggguggcacgagccucccaccagggagaagaggaaccgaggugucggggaagagaaaacagagcagagggagaaaagccaaggcagagagauaagcaagugaagugagugagaaaaggaacaggagaggcuguggcggagagagauaaggaggaaggauggagaaggcgagggucgaggaaaaugcccagggaggcagggagcccuggggagaaacgcugggcgaggccagggcugcggcaggggagccgagccgggagaggggcgcaagaccuggcgcugggcgggacgcucgggcagggugcgggaggggcugagggccgcccccacugccuccccgccuuggagcuggggccaggcggccggagauuggcuggggcgcacggcgaggcccgggcuggagccccgaggugggaggcgccaggaucagucggggcgcccgcagcgcaggcugccacccaccugggcgaccuccgcggcggcggcggcggcggcuggguagagucagggccgggggcgcacgccggaacaccugggccgccgggcaccgagcgucggggggcugcgcggcgcgcaccuggagagggcgcagccaugcgggcggcggcggcgggggggggcgugcggacggccgcgcuggcgcugcugcugggggcgcugcacugggcgccggcgcgcugcgaggaguacgacuacuauggcuggcaggccgagccgcugcacggccgcuccuacuccaagccgccgcagugccuugacaucccugccgaccugccgcucugccacacggugggcuacaagcgcaugcggcugcccaaccugcuggagcacgagagccuggccgaagugaagcagcaggcgagcagcuggcugccgcugcuggccaagcgcugccacucggauacgcaggucuuccugugcucgcucuuugcgcccgucugucucgaccggcccaucuacccgugccgcucgcugugcgaggccgugcgcgccggcugcgcgccgcucauggaggccuacggcuuccccuggccugagaugcugcacugccacaaguucccccuggacaacgaccucugcaucgccgugcaguucgggcaccugcccgccaccgcgccuccagguagcgccgccgccgccguccccgcgcgcuccgacggcccugcagcuccccuagcacagcucugcgaaccccccaagaggugcagcucccccccuccgcccacacacacacacacacgcuguccuagcucagcccagcguccccggaauuaucccccgcagccuucccgccuucccaccuccccagggaguggcagcauagugccucccggcggcuccagaccuucccucuggcucucguucccuggaaaccccuggcaccccucucaguacccauccaaccaagcugcugagaaucccccaaugccguccccccaauccugggacguccugauaaaugccuuaugaccccucucagcccaagaaugccuggggucguuaaacaaugccuuucaccuggaucccgaggcaccaaagcaagcaucauccccacuccguguugggaccuugggaagagaggagaggugagggaagggauguggagaaagacuggggacuaagaauguucuggacuaugaucugcguccccguuuucuguaccuggaacccuaagaucuccacccucuuccccaguuccccuggcugggagucauucggguaaggcucagugcggaaggaagagcagauuaggcucugccccugaagagaagcccuuaggcaaguugcuugacuucacugagccucaguuuccccauccauaaaauaggaagccaucccaggcucaugaaaccuaugagguccuaagucccuccucccacccaccccucaguccccugaacccuaauuucucccuggucucagccuccccuuuucugugcugguccacauagcucuuccaggcuggcuccaugcccucucccccuuccuccccgucugcugucagacuugaguaaccgcucu

SEQ ID NO: 20291 - RNA, 2597 nt, Homo sapiens
gaaagggcaguuccaacaaccuuucauccagaagccugcacagccaaugcgaaugcgccccgccaggacuucuuccccgaaaaucugccuuccagacucuuuucugaggcaggaaagcauuaggcgaacaggcagauuuuuuaaaaaaagaaagaaagcuggugggggaaagggggucugcgcagcugaaggaguucaaugaaagugggacaagcguugcggaaaacuccguugcacccuacauucggacgagcucauagacgcgcucugcugcacgaaagagcuuucgaagaggaagcugggccgcgcggagcuggcuguuccgcccucgcggcaaccgcaccaacaggaaccgaaacggccucggcaagggcagcuacagccucucaguccuccggcuaccuuuccuccacguggaaggagcgcuccacguggcgccucccgcuaccugccgcguccgcagacccgacccgggccagggggacaaccccaagagcugagaggcgggcgcaccucaagaagcaaaacucgaauuucgcaaggagugaaaaauacgaaggacgcacaacggaccuggccucggggcaaagugggacugagagcgcugagggcucuucgaggggaacccacagcugaggcuccaacuuguagggaauuuuuaaaaacucaacacuuggauucgacauugcagaggauuuauuucuuauuuuacacugcaacucugucccugaugggaagggaucgcaguugccuaacugccaaacugcaacaacccgggaagagugugagcccaauuagauuacaagcccuagagcaaaggggaucacaaaccuccggguuugcuaaucugcuggugcggaguucagaucuccgaagccucccuggaguauuucuaggacucuuaccgcuucccuuauaacgcugugaccccagcgaggauuuuuuuuuuccuuuaaagaaaagcuaaacugugcaguuaccgcaggagauuuaaggaggaggaacuggcggggggaggggggcauuccgucuauaaaaagcgccuuacaaaguccugaagucuggaaaugacagcggaggauauaaaauaaaaaauuuuaacuccgauccaacuugcccaccacucaagccucugcuuaaauucguuuucugagagugggagagaacugacgaaacgaucuuuccguggaaaauuccaguuucgugcaaucccgcuugaacacucacacacacacacucuccugucucacauacacacacacacacacacacacacacauacccauuccuuucagcucuuuguuguuugagaccuuuucuucgcuuuuguaacugcucugaaccucuuguuucuuuuucagaaguagacgggaaggcuaauuguggauauauguaagcacaacauuuuuucagucauaacugauaaguuucugaaaugccuucugcauugcaaacaugugcaucuuaauagaaaacauugcuuuucucaaucacuaguuacagccucacagcacacaauccaggagaaggaaaaccucuuuucuucucuuugagagaucugcuuggcuuauuuucuucuuuccccuuuggaaugggggauaggaagggcuugaggggguguuacuaaaaaauuuuaaaugauccaucgaaaccccugccuuaccuuaggaaaucgagccagccaucaugaaugauggacggauccagcugcagagagaggaaguucucauugacuguccugacuggguucuuggugcucacaucaaguagaaucagggucuuuuccuucaaaccugcagcucugucuacaggcaagggucuccugucuccagccugggaggaaagggagagauggagcaacagagccaaguagagagcccccggggcuaggcacgcgggggggcgggaguugcuggagggcauggcuucagggaaggcacaaagcacccucauucaaucccucugauuuaaaccucucuuccuacugggucucgcuagugacuaauuguccuuaucuaaagugugugucuguccgccuuuuuccccccuuuuuuucccuuccucccaccacccccccaacacacacacacucucucucucucccgcucucucucucucucgcucgcucgcucgcucguuuuguuuuuuucuuuuuuuuuuuuaauuuuuuuuaauuuuuuuuuucaguguuuuggugcugguggagcgaacucacgccccuagccagccuuccccgugacucuugccaagagaacucguacaccggcaccgccccuuuaagagauuucuacugcagacauuuuuuaacuuuuuaaagguaaggggaggggagcaggcgggaaggaggagaaaaggguggcguuguacccuccuaauuuaacccucuagggucaggaagcagagggaggaauccaaaccaugccguuguaccgucuggguacagagcaaagggucucguuuuuacguccuucccugagaggcucuggagggcgguucaagcuccgacuccgacccgaaagccccagcgccaacccgggacgcgcugggauagaguucccaccgacagcacgcuuguuucuccugacagcgucaggcac

SEQ ID NO: 20292 - RNA, 2597 nt, Homo sapiens
gugccugacgcugucaggagaaacaagcgugcugucggugggaacucuaucccagcgcgucccggguuggcgcuggggcuuucgggucggagucggagcuugaaccgcccuccagagccucucagggaaggacguaaaaacgagacccuuugcucuguacccagacgguacaacggcaugguuuggauuccucccucugcuuccugacccuagaggguuaaauuaggaggguacaacgccacccuuuucuccuccuucccgccugcuccccuccccuuaccuuuaaaaaguuaaaaaaugucugcaguagaaaucucuuaaaggggcggugccgguguacgaguucucuuggcaagagucacggggaaggcuggcuaggggcgugaguucgcuccaccagcaccaaaacacugaaaaaaaaaauuaaaaaaaauuaaaaaaaaaaaagaaaaaaacaaaacgagcgagcgagcgagcgagagagagagagagcgggagagagagagaguguguguguguuggggggguggugggaggaagggaaaaaaaggggggaaaaaggcggacagacacacacuuuagauaaggacaauuagucacuagcgagacccaguaggaagagagguuuaaaucagagggauugaaugagggugcuuugugccuucccugaagccaugcccuccagcaacucccgcccccccgcgugccuagccccgggggcucucuacuuggcucuguugcuccaucucucccuuuccucccaggcuggagacaggagacccuugccuguagacagagcugcagguuugaaggaaaagacccugauucuacuugaugugagcaccaagaacccagucaggacagucaaugagaacuuccucucucugcagcuggauccguccaucauucaugauggcuggcucgauuuccuaagguaaggcagggguuucgauggaucauuuaaaauuuuuuaguaacacccccucaagcccuuccuaucccccauuccaaaggggaaagaagaaaauaagccaagcagaucucucaaagagaagaaaagagguuuuccuucuccuggauugugugcugugaggcuguaacuagugauugagaaaagcaauguuuucuauuaagaugcacauguuugcaaugcagaaggcauuucagaaacuuaucaguuaugacugaaaaaauguugugcuuacauauauccacaauuagccuucccgucuacuucugaaaaagaaacaagagguucagagcaguuacaaaagcgaagaaaaggucucaaacaacaaagagcugaaaggaauggguauguguguguguguguguguguguguguaugugagacaggagagugugugugugugaguguucaagcgggauugcacgaaacuggaauuuuccacggaaagaucguuucgucaguucucucccacucucagaaaacgaauuuaagcagaggcuugaguggugggcaaguuggaucggaguuaaaauuuuuuauuuuauauccuccgcugucauuuccagacuucaggacuuuguaaggcgcuuuuuauagacggaaugccccccuccccccgccaguuccuccuccuuaaaucuccugcgguaacugcacaguuuagcuuuucuuuaaaggaaaaaaaaaauccucgcuggggucacagcguuauaagggaagcgguaagaguccuagaaauacuccagggaggcuucggagaucugaacuccgcaccagcagauuagcaaacccggagguuugugauccccuuugcucuagggcuuguaaucuaauugggcucacacucuucccggguuguugcaguuuggcaguuaggcaacugcgaucccuucccaucagggacagaguugcaguguaaaauaagaaauaaauccucugcaaugucgaauccaaguguugaguuuuuaaaaauucccuacaaguuggagccucagcuguggguuccccucgaagagcccucagcgcucucagucccacuuugccccgaggccagguccguugugcguccuucguauuuuucacuccuugcgaaauucgaguuuugcuucuugaggugcgcccgccucucagcucuugggguugucccccuggcccgggucgggucugcggacgcggcagguagcgggaggcgccacguggagcgcuccuuccacguggaggaaagguagccggaggacugagaggcuguagcugcccuugccgaggccguuucgguuccuguuggugcgguugccgcgagggcggaacagccagcuccgcgcggcccagcuuccucuucgaaagcucuuucgugcagcagagcgcgucuaugagcucguccgaauguagggugcaacggaguuuuccgcaacgcuugucccacuuucauugaacuccuucagcugcgcagacccccuuucccccaccagcuuucuuucuuuuuuuaaaaaaucugccuguucgccuaaugcuuuccugccucagaaaagagucuggaaggcagauuuucggggaagaaguccuggcggggcgcauucgcauuggcugugcaggcuucuggaugaaagguuguuggaacugcccuuuc

SEQ ID NO: 20293 - RNA, 2624 nt, Homo sapiens
gacuuccggcuagacgaucuaggagcucuuccuuggagaacaguuuccacucguggaggcuaagugucagaaacauguuccaaguggagagaaagcuugagcaaaggcaacaaguugaaaaaggacaugucgcccacccauagauagauaaaacacugcaucuccucguggauccagcgcccaguauuuacccgccaggaaguuuuccugccccgcgcagcagcugaaaaaaacacacuccuggggcauccuucccuggcguugguucguggacagcaagccucccagaacuggccuaggucgggaaggugcagccacgcgggaaucaaugguucaggaaccggaucugugcagccucgcccgcagcgucucggacuucaggacucuauacuaguccuugucuauuucugguagagccgcaacaucccacucgcagagagcagggggcguggcccacaugagccagaaccuauagggagggagguuggggcgccagccccgcccccccaacgugacgcaaaucucccggacagaggcuuaggagcccgggccccagucccugcaguggcuguaacaaaacccagacccccaggucccggccaauggaggcgauuuagacuggagugggaccgcgucugucaaaagcccgacucggcagcagcggcggaguccaggaggagagcuggagccgccgcgcugccuccccgcccccgccgggauuuauuauuuggacuggacaauuaaguggcccugaugauguuaccaagcccggucaccuccaccccuuucucagucaaagacauuuugaaucuggagcagcagcaccagcacuuccauggugcgcacuugcaggcggacuuggagcaccacuuccacucugcgcccugcaugcuggccgccgcugaggggacgcaauuuucugacggaggggaggaggacgaggaagacgagggcgagaaauuguccuauuugaacucacuagccgcagcagacggccacggggauucagggcuguguccccagggcuauguccacacgguccugcgagacucgugcagcgagcccaaggaacaugaagaggagcccgaggucgugagggaccggagccaaagugaguagagggggaaagaaaacgcacccgcacaccuggagcaauggcagagcgcacacaaacagcccacagaccuugccagcgcagcugcccaucccuuuacccuuuggcuggggccaugccuccgcccuggucaccgacagcuccacaaagcgcagguaccugcaagggagccgggguggagagacaaggacgaggugacccugacaacuacuccccccaaaagggggaaaugagggaagggaaggugguuacugcugcccugaugcugagaggcgacgugggcucagcgccuggguccucauaacuggcaguauuuuugcucuuccccccgccccaaaaggcucuucccccaaaaagggcaggagccuggaccuuuuucguuuucccucuagggugagaugaguucucuuagcccagggcagccaccccuucuucuccgaaaagacagcccaagcagccugugucucucgcacccgcaggggcaggaacuuugguggaggccagcugggcgguuuccucccuucucugcuuggagcucagcguccuugaacccguggcacucgguagagagagaggagaugaucggaaagugcgugggaacaaugucuauuccgcgcgaccauagcucucacaucccuaaggcgccagccuuuuuugaaaauccguaacguuuugcuuugugucccaggcugcgggccuaauagaaaacgcgccgaacuugaguccgagaucuuggcugcucacaucggaugggaagugaauugauagggagaugggauaaucaaauaaaguccccaaggaaguguauuuaagaggacagaaucacagucuuuccccaagaggcgguuugauguggcagaggccaaggccuaugcucucauaguucccagagccgaaaaucggcaugaaacugucuauaacuagucaaucaaacuucauuuucaaagugcacacagaugucgucauaacauucgcuuguagucuuuuauaagccacacacacacacaagucccugagccaugcacaagcguuacacucagaacagauuuucgcgcaacccaugcccaccggcccacucauaccaacacgccucacaccuucaguuauccuugguggaguagaaugcaaacgaguuugcaaauacuguaguuauuauguaguugcaagccuucauccugaaaauagucauuagcacgucgagccgcauauuuaauacagaguaaucucuucucucgcagaugcucaagauccaaauaaacacgcacuaacuaccccucuccacgaaacgcgccuccgccugcuaagggcguucuuuggguacuggggcugucucagggucccacagcgccaggagccacaaacguucccaaaaguccagccauuuacuaccgcacgcucugcgcagccaccaaaaagggucacggugcuccaggacaggagccgcggugcggccgggaacagcuaaggacgcuguuguuugcuucuuccgcagaaagcugccagcugaaga

SEQ ID NO: 20294 - RNA, 2624 nt, Homo sapiens
ucuucagcuggcagcuuucugcggaagaagcaaacaacagcguccuuagcuguucccggccgcaccgcggcuccuguccuggagcaccgugacccuuuuugguggcugcgcagagcgugcgguaguaaauggcuggacuuuugggaacguuuguggcuccuggcgcugugggacccugagacagccccaguacccaaagaacgcccuuagcaggcggaggcgcguuucguggagagggguaguuagugcguguuuauuuggaucuugagcaucugcgagagaagagauuacucuguauuaaauaugcggcucgacgugcuaaugacuauuuucaggaugaaggcuugcaacuacauaauaacuacaguauuugcaaacucguuugcauucuacuccaccaaggauaacugaaggugugaggcguguugguaugagugggccggugggcauggguugcgcgaaaaucuguucugaguguaacgcuugugcauggcucagggacuuguguguguguguggcuuauaaaagacuacaagcgaauguuaugacgacaucugugugcacuuugaaaaugaaguuugauugacuaguuauagacaguuucaugccgauuuucggcucugggaacuaugagagcauaggccuuggccucugccacaucaaaccgccucuuggggaaagacugugauucuguccucuuaaauacacuuccuuggggacuuuauuugauuaucccaucucccuaucaauucacuucccauccgaugugagcagccaagaucucggacucaaguucggcgcguuuucuauuaggcccgcagccugggacacaaagcaaaacguuacggauuuucaaaaaaggcuggcgccuuagggaugugagagcuauggucgcgcggaauagacauuguucccacgcacuuuccgaucaucuccucucucucuaccgagugccacggguucaaggacgcugagcuccaagcagagaagggaggaaaccgcccagcuggccuccaccaaaguuccugccccugcgggugcgagagacacaggcugcuugggcugucuuuucggagaagaagggguggcugcccugggcuaagagaacucaucucacccuagagggaaaacgaaaaagguccaggcuccugcccuuuuugggggaagagccuuuuggggcggggggaagagcaaaaauacugccaguuaugaggacccaggcgcugagcccacgucgccucucagcaucagggcagcaguaaccaccuucccuucccucauuucccccuuuuggggggaguaguugucagggucaccucguccuugucucuccaccccggcucccuugcagguaccugcgcuuuguggagcugucggugaccagggcggaggcauggccccagccaaaggguaaagggaugggcagcugcgcuggcaaggucugugggcuguuugugugcgcucugccauugcuccaggugugcgggugcguuuucuuucccccucuacucacuuuggcuccggucccucacgaccucgggcuccucuucauguuccuugggcucgcugcacgagucucgcaggaccguguggacauagcccuggggacacagcccugaauccccguggccgucugcugcggcuagugaguucaaauaggacaauuucucgcccucgucuuccucguccuccuccccuccgucagaaaauugcguccccucagcggcggccagcaugcagggcgcagaguggaaguggugcuccaaguccgccugcaagugcgcaccauggaagugcuggugcugcugcuccagauucaaaaugucuuugacugagaaagggguggaggugaccgggcuugguaacaucaucagggccacuuaauuguccaguccaaauaauaaaucccggcgggggcggggaggcagcgcggcggcuccagcucuccuccuggacuccgccgcugcugccgagucgggcuuuugacagacgcggucccacuccagucuaaaucgccuccauuggccgggaccugggggucuggguuuuguuacagccacugcagggacuggggcccgggcuccuaagccucuguccgggagauuugcgucacguugggggggcggggcuggcgccccaaccucccucccuauagguucuggcucaugugggccacgcccccugcucucugcgagugggauguugcggcucuaccagaaauagacaaggacuaguauagaguccugaaguccgagacgcugcgggcgaggcugcacagauccgguuccugaaccauugauucccgcguggcugcaccuucccgaccuaggccaguucugggaggcuugcuguccacgaaccaacgccagggaaggaugccccaggaguguguuuuuuucagcugcugcgcggggcaggaaaacuuccuggcggguaaauacugggcgcuggauccacgaggagaugcaguguuuuaucuaucuaugggugggcgacauguccuuuuucaacuuguugccuuugcucaagcuuucucuccacuuggaacauguuucugacacuuagccuccacgaguggaaacuguucuccaaggaagagcuccuagaucgucuagccggaaguc

SEQ ID NO: 20295 - RNA, 2537 nt, Homo sapiens
gagggaggcgaggaaggagcgggccggugcauucgccacaugcagagaaaaaucaaaacagccggagcugccacuccccuagaccgcaggguuaguguuccccgcccugguuucugucucgcccucagcaaacccggcagcccgagagcuuugaaaacaucgaaaucuccgagauuuaaaaaauaauaauaaaagaaaggaaaaaucaggcugcggugggaagaacccgcuauauagguuuaaauauuuauauagaagccauacagaauugcacggcgagggcuuccggggcggcggaggccgcugguggcggccggcccggccggccagccuggguuuauugcuucgagagggaagaggcggcugccaggagccgaguccggggccggggacaggggaggaggcgggaguuggcagaggaggucccagcuccccucggcgguccgguccgggaggcguugggcuuucgagcgcuaggagcccagggcggcggaagacccggggcgccgcucaaucguccacgucgaucucuucgucuuccucguccuccgagcaguccuggcugcuggccggcugguccgugagcggagaggcaggcgagagcugcagggcgccagcgcccggggccuucggggcgccuggggggaggaccggagagccgggccucgacuuggcccugccgcagccgccgccaccgccggcuguggccuccgaguucugcucgaguucggccagcgccacgauguccaucugcccgcuggggcccaguuucuuggcggacucuacgucggccuucaucuccuccaggucccgcuugagcuuagcgcgccgauucuggaaccaggugaugacuugcgcguuggugaggcccagcugcugcgcgauuuggucgcgaucggcgggggacagguacuucugguauagaaagcgcuuuuccaauucauagaucuggugguuggugaaggccgugcgcgacuuucgccgcuucuuaggggucugccgcugcccaaagauggucauaccgucgcggccugggaggaaaggacaguguaggcucgcguugggagagaggaagcccacccuggcucucgcccccguaacuccguaacccacccaggccuguccggccugcagucuaccaauguucccuucucagauuuaauucagccuccaggaccagggcaagucuuggcuauggcaaaccaucuccugucuuuggucucccagaagucccuaggaaaaauuguuuuggucucugcccccuaccuaagaguugguuugaaagacccaaagucucuaaggguaugagaaagccagacagagacacccuaauugcggugugaauguugguucuccaucccuucccaaucacuucaacucuacccuacccauaagguccccggcaaaagacucucgauuccccacgccgaguagccgggcuaagagcgcccaggacacugggaacgcaagggagcccggcaaagcaagcagacugcggaaagagcuuggccacccuucuccugccaccccccagcucuggccuacccagaggucccugggaaauaaggauugggucccgucccacauaucuucacucccauaagcagcugcucaggcuggaaggcccuggcggccggagagggcagaggcgagcagaggcauaggggacgaagcgcgcagggcacagggcgcgaggcgcugggugcaggggaacccagcagcugcgccuaccuucggcugccugcagaacgcugaccuccagccccuuaaacgucuugcuggcgagcuccuccagcgcgcacagcggcgaggucugcgagagcagcgcgcggcccgccaggggcaagccgcccugcgcgugcuuguccgcggcggccagcaggugcgccgccccgcacagcgaguaacuucuccgcacagacggcuuguugaggauguccucgaugcugaacggcgucaguggcuuguuggaguuggcaggcggaggcaggugguccagcgggcugcgccgccgcuccucccccggcgccgccuugccguccuccuuggaagucaucucggccuuguucggggucccggccggggcggcucgggccgcggggacccagcccgcgggcagcucgggcgccggacggcgcgggcaggcagcggcggguggaaaggaggccgcacugggcagggcgcgggccgggcgcggggccgauuagcgcggcggcugaggaggggagaacagcgcggggccccgggaagagggcgcugacgcgggcgccgcugcugcuggggcuuccagcaauccggggccggagccggggcgcgcugcgcggggcuccaguuucgccaaccccggugcuauuuaaaggugucagguggcucggcaguggcuccuggccccggguccuggcggccgcaguuggaagagccgaggcgagggcgccgaucccggacugcgagggaggcggagagacggggcaauugacuauugcuaacaaguuagccuugaucgcgguguaaucaauuaucugcagcggcacuucuuu

SEQ ID NO: 20296 - RNA, 2537 nt, Homo sapiens
aaagaagugccgcugcagauaauugauuacaccgcgaucaaggcuaacuuguuagcaauagucaauugccccgucucuccgccucccucgcaguccgggaucggcgcccucgccucggcucuuccaacugcggccgccaggacccggggccaggagccacugccgagccaccugacaccuuuaaauagcaccgggguuggcgaaacuggagccccgcgcagcgcgccccggcuccggccccggauugcuggaagccccagcagcagcggcgcccgcgucagcgcccucuucccggggccccgcgcuguucuccccuccucagccgccgcgcuaaucggccccgcgcccggcccgcgcccugcccagugcggccuccuuuccacccgccgcugccugcccgcgccguccggcgcccgagcugcccgcgggcuggguccccgcggcccgagccgccccggccgggaccccgaacaaggccgagaugacuuccaaggaggacggcaaggcggcgccgggggaggagcggcggcgcagcccgcuggaccaccugccuccgccugccaacuccaacaagccacugacgccguucagcaucgaggacauccucaacaagccgucugugcggagaaguuacucgcugugcggggcggcgcaccugcuggccgccgcggacaagcacgcgcagggcggcuugccccuggcgggccgcgcgcugcucucgcagaccucgccgcugugcgcgcuggaggagcucgccagcaagacguuuaaggggcuggaggucagcguucugcaggcagccgaagguaggcgcagcugcuggguuccccugcacccagcgccucgcgcccugugcccugcgcgcuucguccccuaugccucugcucgccucugcccucuccggccgccagggccuuccagccugagcagcugcuuaugggagugaagauaugugggacgggacccaauccuuauuucccagggaccucuggguaggccagagcugggggguggcaggagaaggguggccaagcucuuuccgcagucugcuugcuuugccgggcucccuugcguucccaguguccugggcgcucuuagcccggcuacucggcguggggaaucgagagucuuuugccggggaccuuauggguaggguagaguugaagugauugggaagggauggagaaccaacauucacaccgcaauuagggugucucugucuggcuuucucauacccuuagagacuuugggucuuucaaaccaacucuuagguagggggcagagaccaaaacaauuuuuccuagggacuucugggagaccaaagacaggagaugguuugccauagccaagacuugcccugguccuggaggcugaauuaaaucugagaagggaacauugguagacugcaggccggacaggccuggguggguuacggaguuacgggggcgagagccagggugggcuuccucucucccaacgcgagccuacacuguccuuuccucccaggccgcgacgguaugaccaucuuugggcagcggcagaccccuaagaagcggcgaaagucgcgcacggccuucaccaaccaccagaucuaugaauuggaaaagcgcuuucuauaccagaaguaccugucccccgccgaucgcgaccaaaucgcgcagcagcugggccucaccaacgcgcaagucaucaccugguuccagaaucggcgcgcuaagcucaagcgggaccuggaggagaugaaggccgacguagaguccgccaagaaacugggccccagcgggcagauggacaucguggcgcuggccgaacucgagcagaacucggaggccacagccggcgguggcggcggcugcggcagggccaagucgaggcccggcucuccgguccuccccccaggcgccccgaaggccccgggcgcuggcgcccugcagcucucgccugccucuccgcucacggaccagccggccagcagccaggacugcucggaggacgaggaagacgaagagaucgacguggacgauugagcggcgccccgggucuuccgccgcccugggcuccuagcgcucgaaagcccaacgccucccggaccggaccgccgaggggagcugggaccuccucugccaacucccgccuccuccccuguccccggccccggacucggcuccuggcagccgccucuucccucucgaagcaauaaacccaggcuggccggccgggccggccgccaccagcggccuccgccgccccggaagcccucgccgugcaauucuguauggcuucuauauaaauauuuaaaccuauauagcggguucuucccaccgcagccugauuuuuccuuucuuuuauuauuauuuuuuaaaucucggagauuucgauguuuucaaagcucucgggcugccggguuugcugagggcgagacagaaaccagggcggggaacacuaacccugcggucuaggggaguggcagcuccggcuguuuugauuuuucucugcauguggcgaaugcaccggcccgcuccuuccucgccucccuc

SEQ ID NO: 20297 - RNA, 2537 nt, Homo sapiens
cuggaaauuggccccguuucaaggcaggaauauugaauguuuuagaaaucaaucaguccucagccucucugccggcaguagcucuccgcacuugccaccccacagggagccgggagcccugccccagccgccuggguuccccagggaauggagcagggagagcccccuuccaagcccaguuuccacguguaaauugacccauccgauuaaaguauuuaaggguucccagcaaccuccuuuuccaacugggagaguugaggggauuucucucccuucucuuucccacucuccuuuugugggcccuggcgacauauccucuuucaagcgcuugccuuaaaccuaggcccccucccccugaacccccugccuccaccugcagcuggggaggaguguaugaaggggggagguguaaagggagauuccuagauucauucauuugcugggcagggaagggggcaccuguggccaaguacuccccgaggccccuucccuagcccucucuuccccagcugacccucaagacaccuuucugccuuaacuccuucccuucugagcuggggacccugcaggcccccggccagugcaguugggacuggugguccaggcgccgcgcaucccacaagcuaccuucagcgcgccuuaccgaaggggucgccguccucugccauggcguugaugcgcuuguuggccaggaccugcacgugcuucccgcuggugcggcuguagaguugguagguccggaugaggcggcggcugagcugauccgucaccaggcucugcucccucacaugcuguguaaaauuaggugaggacugaacaguuaccuuuaggaaauugaaaaauacacaauacaccauuauaaugcuacuccgcccaggggcccgaguggccccaucacccugcgucccccucacugccccaagccgccagcaggugcuggggguucccccaacaugccagcccaggccaccaucccccacccacgcaagucgggcagacccagcccaggaugaacgagccccagggagaagcuggacccaccuguugggagacacccuggggcucccggccagcccggaacagggaagcgagcucccugcccagcgcagggccccugcccgggccuuccuagaggagcagggcgcuuuuaaguagggaggcagcccuccccgaccccugacauuuauaaagacaaauuuacggagcaaauguugagagugcagggaaccugggcacccgaucauugggccaaaucggccacaagccucccccgaggggcgcugagagggucucugcugcagucacccggcuuccccuggcaucgaacauccauccccuggccgcggcugcccccuuccucggcggcuggguguucccuaugcccccagccggcgaggaugcaugggggacagugcugggcuccgagaccuucguuucuauccuggccacucacucgcugugugaccucaggaggggugcuaccucucugugccucagcucccuccucgggguggcucggggcuggguuucuaaggugcccucagcccucccgcgccggccgcagagucagucccggugcccccgaccggcgcugcccacccgggucucacaccggcgcgcccggcccccgccuccgcgcaccccuccucaccugggcuuggaggcagaggaccagcaagugcaacagccugugggagacaaaagcgggcgggagagagaggcgcgggugaggcgaggggcgcggggggcggguggcggggcagggcggcgcgguacucacaggcagcucagcgcggagcgggggcugcccauggcgcgcggccccggggcaccgagagcccggcgggucacgccgucccgcgggccgccgcgggaggacgcgcugagcagggcgcgagcggagagggugcgggugcgggaggccggcggcgaucacgacgcggcuccgcgggucccguggaacgucgugcucgccgcgccgcaccgaaucgcugugcgccgcugccggagccgguggccgcuggcugcucgggagccggagcgggcgggagggucacgggcuggcgggguggguggggaggugggagggcggggaggggugggggcggggggcgccgcaccgggcgcgaggggggagcgcggggcgggcggcgggagcccgcagcccccggcugggaacuggggccuggaugcagcccggggcgggggcggggcggccggggaggggcggccgacggguucgggauugagggucugggcuaggggaggggucuggggacccgcgggaggggcgggggcggccggucugggcgccucccccuauccccggccuguccccucgcgcgcuccccggucccggacgcgcggggaugggggcgccuagggcugcaaacucugcgggccgggagaccccgagccugggcuuccccgaccgccuggagcgcccgagucuggcgggucugggucuccgccuccgggcccagccgcuuccgccgccggcuacgcaguggucuccgagccaccuacugugugucccg

SEQ ID NO: 20298 - RNA, 2537 nt, Homo sapiens
cgggacacacaguagguggcucggagaccacugcguagccggcggcggaagcggcugggcccggaggcggagacccagacccgccagacucgggcgcuccaggcggucggggaagcccaggcucggggucucccggcccgcagaguuugcagcccuaggcgcccccauccccgcgcguccgggaccggggagcgcgcgaggggacaggccggggauagggggaggcgcccagaccggccgcccccgccccucccgcggguccccagaccccuccccuagcccagacccucaaucccgaacccgucggccgccccuccccggccgccccgcccccgccccgggcugcauccaggccccaguucccagccgggggcugcgggcucccgccgcccgccccgcgcuccccccucgcgcccggugcggcgccccccgcccccaccccuccccgcccucccaccuccccacccaccccgccagcccgugacccucccgcccgcuccggcucccgagcagccagcggccaccggcuccggcagcggcgcacagcgauucggugcggcgcggcgagcacgacguuccacgggacccgcggagccgcgucgugaucgccgccggccucccgcacccgcacccucuccgcucgcgcccugcucagcgcguccucccgcggcggcccgcgggacggcgugacccgccgggcucucggugccccggggccgcgcgccaugggcagcccccgcuccgcgcugagcugccugugaguaccgcgccgcccugccccgccacccgccccccgcgccccucgccucacccgcgccucucucucccgcccgcuuuugucucccacaggcuguugcacuugcugguccucugccuccaagcccaggugaggaggggugcgcggaggcgggggccgggcgcgccggugugagacccgggugggcagcgccggucgggggcaccgggacugacucugcggccggcgcgggagggcugagggcaccuuagaaacccagccccgagccaccccgaggagggagcugaggcacagagagguagcaccccuccugaggucacacagcgagugaguggccaggauagaaacgaaggucucggagcccagcacugucccccaugcauccucgccggcugggggcauagggaacacccagccgccgaggaagggggcagccgcggccaggggauggauguucgaugccaggggaagccgggugacugcagcagagacccucucagcgccccucgggggaggcuuguggccgauuuggcccaaugaucgggugcccagguucccugcacucucaacauuugcuccguaaauuugucuuuauaaaugucaggggucggggagggcugccucccuacuuaaaagcgcccugcuccucuaggaaggcccgggcaggggcccugcgcugggcagggagcucgcuucccuguuccgggcuggccgggagccccagggugucucccaacagguggguccagcuucucccuggggcucguucauccugggcugggucugcccgacuugcgugggugggggaugguggccugggcuggcauguugggggaacccccagcaccugcuggcggcuuggggcagugagggggacgcagggugauggggccacucgggccccugggcggaguagcauuauaaugguguauuguguauuuuucaauuuccuaaagguaacuguucaguccucaccuaauuuuacacagcaugugagggagcagagccuggugacggaucagcucagccgccgccucauccggaccuaccaacucuacagccgcaccagcgggaagcacgugcagguccuggccaacaagcgcaucaacgccauggcagaggacggcgaccccuucgguaaggcgcgcugaagguagcuugugggaugcgcggcgccuggaccaccagucccaacugcacuggccgggggccugcaggguccccagcucagaagggaaggaguuaaggcagaaaggugucuugagggucagcuggggaagagagggcuagggaaggggccucggggaguacuuggccacaggugcccccuucccugcccagcaaaugaaugaaucuaggaaucucccuuuacaccuccccccuucauacacuccuccccagcugcagguggaggcaggggguucagggggagggggccuagguuuaaggcaagcgcuugaaagaggauaugucgccagggcccacaaaaggagagugggaaagagaagggagagaaauccccucaacucucccaguuggaaaaggagguugcugggaacccuuaaauacuuuaaucggaugggucaauuuacacguggaaacugggcuuggaagggggcucucccugcuccauucccuggggaacccaggcggcuggggcagggcucccggcucccugugggguggcaagugcggagagcuacugccggcagagaggcugaggacugauugauuucuaaaacauucaauauuccugccuugaaacggggccaauuuccag

SEQ ID NO: 20299 - RNA, 2979 nt, Homo sapiens
cuacuuccauagaggccugacgagaaaagacuuauacacccagugggccccuggcuccuuuccuucugccugaggcccugagcaucacccugggaggagagaggaagcaacuucaaaguugagugagcccggaguucuuauggcacuuuggagcuacuucuagaauaggggaaguugguaccccacccucuggaaaaggggugucagccagcugucaccaucauacagcccugugaccccuauagucucucuuauggaggccccucacucagggaagggaaacucaggccuccuggaaggagagggaagaggaacagguguuauauagggaugcugaagggcugagaggcacagcauggaaguggggagaaaagccugagcagaggcuccuacccccaauauauacauacugagugggaaagggacauucuucuuuuuuuuuuuuuuuuuugagauggaguuucgccccugcugcccaggcuggaguggaauggcgcuaucucagcucacugcaaccuccgccucccaaguucaagugauucuccugccucagacuccugaauagcuuggauuacaggcgcucagcacuaugccuggcuaauuuuuguauuuuuaguagagauggaguuucaccauguuguccaggcuaguuucaaacuccugaccucaggggauccacccacuuuggccucccaaaguguugggauuacaggcgugagccaccgcacccggccagggacauucuuuucuucauacagguacagacaggcaccuacacacacacaaacacacacacacacacacacacacacacacgcacacacauacauaaggacaaauaugucaguacacaguuaaacacauucauaggcaacacccucuggcacacacacagacacacacacacacacacugcucaaagacacacccucaugcacucucacagucauaacaaguauguguguaaugaaaaggcacaugcuuguuuuacacacacaccaucaucaaacaggaacacacaaagagguacccaaauauauacacaagcugucauucuccagugcacacagagguccagguguaucagacacucacagagaccuacugcucacagucacauacacauacagauguacacauacagauguacacacucaagcagggacacacaccguccccucccccccaccuacuggggucucuugaggggaaucugcacccauauuccucuccucucccucucuccccagggguaagacagaucccgcccaggagagaccauaaccagguaaaggggccucugguggcaaugcaggggaggggcagaggucaggaguagcaacccugccaggcagguuccggaagcucaacggggucccagcgcauacccggugcagccccaacucaaugccaccucaguacucaccgcugcucgcccagagcugagaccgaggagagacagaggagaggcugggcccagcugagcugugaaggcagcgcggcucccguuugcuccaggcccgcccgccucucagucccucccccuacccccuacgcgccgcucaggcaacgcuaaucccccccaccccccgcccucucccagggcccagagccccggaggcugccagccccccuugucgcuagguccccgcugggcucucccgccaaccuaagacccgccccagacaaggaggagggcgcauggaaccccugguucuauuccccagacccucacgugccccaccccacuuguguccacgucucucucgcccaccgccccuugagccacacguaaggcccggcugcacacgcgugucccgcuccagaccccacgcgugucccuaggaggcugccacaugaccuguuacaugccacacgcgcucccgcccccacgagcacgcggccgcgccaagcacacgguauggguguagacuggacccgcccccuaaauccaggagaccaucaacuauggaaaggagaucuagggaacaccgucuugaacccgccagggguuuugagucucggacccaggagauccaacccugaccacccucccaggaugcagcagggggauguuaaaucagacuucaggaagaacuuccuugcugccugaguuaggugucgucacgccugcccagggguaagagguuagacgggaugaacuagggaccggaagacgugggggaccggcaacccuugugcccuuggccaggguagaagggggcccugcuauuuuaagaaagagccgcuggaguuacuauggcaacuacucucuuugggagggccagggcgggcagauggugaccucggaaggaagaaggggucuguucgggcagucagggggcgcgaggacgugcgaggcgggggcgcgcggggcucaccgcggggaggggcggcgcggacuccgcguggugcugaaggggacagcgccagauuugucgcacugcgcaggcgcagaggcgcgaacaaagaggggagggggacgaggcgcgcggccggagguggugcgcgcucacguggcucuaucuuugcaggggucuguccucccagcuacccccucccuaagcaggcugaggaagaagagauagcaagcccucaccuaacuugaccccuuucuugucucuccccgcugcuagcuucucccuucucgcugccuugcgggguggggaaacguggaaggaauucugggaaaaccagaugucuggguucucuauucccgucuggcuugauucuggacaaggggcuuccucuccagggccucgguuuccccaucuuuaaaauggacugauagcauagaccugcccaccuuucagaggugcccgaagccuugacgagauaacagaugagaagugguuuucguugugaugagccagcugaagcgguugcaccggagcgccagaccgucagcggugcaguggcucucgcguccuucacauccccccacacccaucccguggaugaugggggaaggcacuacuc

SEQ ID NO: 20300 - RNA, 2979 nt, Homo sapiens
gaguagugccuucccccaucauccacgggauggguguggggggaugugaaggacgcgagagccacugcaccgcugacggucuggcgcuccggugcaaccgcuucagcuggcucaucacaacgaaaaccacuucucaucuguuaucucgucaaggcuucgggcaccucugaaaggugggcaggucuaugcuaucaguccauuuuaaagauggggaaaccgaggcccuggagaggaagccccuuguccagaaucaagccagacgggaauagagaacccagacaucugguuuucccagaauuccuuccacguuuccccaccccgcaaggcagcgagaagggagaagcuagcagcggggagagacaagaaaggggucaaguuaggugagggcuugcuaucucuucuuccucagccugcuuagggaggggguagcugggaggacagaccccugcaaagauagagccacgugagcgcgcaccaccuccggccgcgcgccucgucccccuccccucuuuguucgcgccucugcgccugcgcagugcgacaaaucuggcgcuguccccuucagcaccacgcggaguccgcgccgccccuccccgcggugagccccgcgcgcccccgccucgcacguccucgcgcccccugacugcccgaacagaccccuucuuccuuccgaggucaccaucugcccgcccuggcccucccaaagagaguaguugccauaguaacuccagcggcucuuucuuaaaauagcagggcccccuucuacccuggccaagggcacaaggguugccggucccccacgucuuccggucccuaguucaucccgucuaaccucuuaccccugggcaggcgugacgacaccuaacucaggcagcaaggaaguucuuccugaagucugauuuaacaucccccugcugcauccugggaggguggucaggguuggaucuccuggguccgagacucaaaaccccuggcggguucaagacgguguucccuagaucuccuuuccauaguugauggucuccuggauuuagggggcggguccagucuacacccauaccgugugcuuggcgcggccgcgugcucgugggggcgggagcgcguguggcauguaacaggucauguggcagccuccuagggacacgcguggggucuggagcgggacacgcgugugcagccgggccuuacguguggcucaaggggcggugggcgagagagacguggacacaagugggguggggcacgugagggucuggggaauagaaccagggguuccaugcgcccuccuccuugucuggggcgggucuuagguuggcgggagagcccagcggggaccuagcgacaaggggggcuggcagccuccggggcucugggcccugggagagggcggggggugggggggauuagcguugccugagcggcgcguaggggguagggggagggacugagaggcgggcgggccuggagcaaacgggagccgcgcugccuucacagcucagcugggcccagccucuccucugucucuccucggucucagcucugggcgagcagcggugaguacugagguggcauugaguuggggcugcaccggguaugcgcugggaccccguugagcuuccggaaccugccuggcaggguugcuacuccugaccucugccccuccccugcauugccaccagaggccccuuuaccugguuauggucucuccugggcgggaucugucuuaccccuggggagagagggagaggagaggaauaugggugcagauuccccucaagagaccccaguaggugggggggaggggacggugugugucccugcuugaguguguacaucuguauguguacaucuguauguguaugugacugugagcaguaggucucugugagugucugauacaccuggaccucugugugcacuggagaaugacagcuuguguauauauuuggguaccucuuuguguguuccuguuugaugaugguguguguguaaaacaagcaugugccuuuucauuacacacauacuuguuaugacugugagagugcaugagggugugucuuugagcagugugugugugugugugucugugugugugccagaggguguugccuaugaauguguuuaacuguguacugacauauuuguccuuauguaugugugugcguguguguguguguguguguguguguguguuuguguguguguaggugccugucuguaccuguaugaagaaaagaaugucccuggccgggugcgguggcucacgccuguaaucccaacacuuugggaggccaaaguggguggauccccugaggucaggaguuugaaacuagccuggacaacauggugaaacuccaucucuacuaaaaauacaaaaauuagccaggcauagugcugagcgccuguaauccaagcuauucaggagucugaggcaggagaaucacuugaacuugggaggcggagguugcagugagcugagauagcgccauuccacuccagccugggcagcaggggcgaaacuccaucucaaaaaaaaaaaaaaaaaagaagaaugucccuuucccacucaguauguauauauuggggguaggagccucugcucaggcuuuucuccccacuuccaugcugugccucucagcccuucagcaucccuauauaacaccuguuccucuucccucuccuuccaggaggccugaguuucccuucccugagugaggggccuccauaagagagacuauaggggucacagggcuguaugauggugacagcuggcugacaccccuuuuccagagggugggguaccaacuuccccuauucuagaaguagcuccaaagugccauaagaacuccgggcucacucaacuuugaaguugcuuccucucuccucccagggugaugcucagggccucaggcagaaggaaaggagccaggggcccacuggguguauaagucuuuucucgucaggccucuauggaaguag

SEQ ID NO: 20301 - RNA, 2421 nt, Homo sapiens
gcuuucugacguagcaucucccaccuuucuccuuggggacccugaggaaggggacaagggcucgcucugcagguccucacuguaacuggaaaaacacgaccucgcccucgggaaggcuuucugugcgccucaccucaggaugaggguggguguaggggacaccucccagaaaccccuaaccucccagucgguuaaagaagaggggauagggucaagggaugcgacagagcugugugguuuccggaugggaaaccucagucguuuaggcaccccuccgcucgagucacuuccgaagcagucgauucuuggggagaagcgcugcggaaaggggcgacuccgaugcagauggcccugucccggcgccccaggucgucgcgcgcgcagcugcgguagucacugcgccuccccgcccccacuccuggaugccccccuucccucucccggccagacucugagcaggagcuccgcccccagcgcgccgccccagccccggcgccuuaaaagccgggcgcaccgccccgccgcgcccugccugccgcaccucuccuuucuucuguagcucgcguugaagccgcacguccggccccgaucccggcaccaugagcuucggcucggagcacuaccugugcuccuccuccuccuaccgcaagguguucggggauggcucucgccuguccgcccgccucucuggggccggcggcgcgggcggcuuccgcucgcagucgcugucccgcagcaauguggccuccucggccgccugcuccucggccucgucgcucggccucggccuggccuaucgccggccgccggcguccgacgggcuggaccugagccaggcggcggcgcgcaccaacgaguacaagaucauccgcaccaacgagaaggagcagcugcagggccucaacgaccgcuucgccguguucaucgagaaggugcaucagcuggagacgcagaaccgcgcguuggaggccgagcuggccgcgcugcgacagcgccacgcugagccgucgcgcgucggcgagcucuuccagcgcgagcugcgcgaccugcgcgcgcagcuggaggaggccagcucggcucgcucgcaggcccugcuggagcgcgacgggcuggcggaggaggugcagcggcugcgggcgcgcugcgaggaggagagccgcggacgcgaaggcgccgagcgcgcccugaaggcgcagcagcgcgacguggacggcgccacgcuggcccgccuggaccuggagaagaagguggagucgcugcuggacgagcuggccuucguacgccaggugcacgacgaggagguagccgagcugcuggccacgcugcaggcgucgucgcaggccgcggccgagguggacgugacuguggcuaaaccagaccugaccucggcucugagggagauccgcgcccaguaugagucccuggccgcuaagaaccugcaguccgcggaagaaugguacaaguccaaguuugccaaccugaacgagcaggcggcgcgcagcaccgaggccauccgggccagccgcgaggagauccacgaguaucggcgccagcugcaggcgcgcaccaucgagaucgagggccugcgcggggccaacgaguccuuggagaggcagauccuggagcuggaggagcggcacagugccgagguagcuggcuaccagguaagggccggggcugggcguggggaggggugcccugcccucuuccgcgcguacccucuuccucugguaaaacugggccccaggacuuaaggggagggcaaaagagaggagagaagagccgcggcuggaggcgcugguuaacaaaaaacccuggagucuuuaauguuaauuuuagggaacgccccucauuuaugucccugccccagcccuucaaacaaagaagcccuuaaauuuauuugagguucgaaaacccaacucugccugucugucagcaagcgggccuacacacaccggcgacccggagaacagugccccacccaaaguaagacugagcccaacggggcagguuacgugggcggugcugucucggcuaucuggcuuguuugguugacuuugaaaagcuuucugugcgcccuagaaguuauuuauggaguauggucugcuucagggcugaaggaagaaugcgauccugaacugggaagaguccuaucccauuuucuugacuuucgcgcuccaaaaaguagagauugggagccaacaagcugagcgaugcuugagcuaguaguaaccacccugcucuacccaccuccccaacacacacacacacacgauucccuuguccaccagcacacacacacacacacacacacacacacacgauucccuuguccaccagcugacauuuccuccuuaagaaagcguucgccgguuggcaaaacgugaaaggucggggcgcuguccacggugcugaucucga

SEQ ID NO: 20302 - RNA, 2421 nt, Homo sapiens
ucgagaucagcaccguggacagcgccccgaccuuucacguuuugccaaccggcgaacgcuuucuuaaggaggaaaugucagcugguggacaagggaaucgugugugugugugugugugugugugugugugcugguggacaagggaaucguguguguguguguguuggggagguggguagagcagggugguuacuacuagcucaagcaucgcucagcuuguuggcucccaaucucuacuuuuuggagcgcgaaagucaagaaaaugggauaggacucuucccaguucaggaucgcauucuuccuucagcccugaagcagaccauacuccauaaauaacuucuagggcgcacagaaagcuuuucaaagucaaccaaacaagccagauagccgagacagcaccgcccacguaaccugccccguugggcucagucuuacuuuggguggggcacuguucuccgggucgccgguguguguaggcccgcuugcugacagacaggcagaguuggguuuucgaaccucaaauaaauuuaagggcuucuuuguuugaagggcuggggcagggacauaaaugaggggcguucccuaaaauuaacauuaaagacuccaggguuuuuuguuaaccagcgccuccagccgcggcucuucucuccucucuuuugcccuccccuuaaguccuggggcccaguuuuaccagaggaagaggguacgcgcggaagagggcagggcaccccuccccacgcccagccccggcccuuaccugguagccagcuaccucggcacugugccgcuccuccagcuccaggaucugccucuccaaggacucguuggccccgcgcaggcccucgaucucgauggugcgcgccugcagcuggcgccgauacucguggaucuccucgcggcuggcccggauggccucggugcugcgcgccgccugcucguucagguuggcaaacuuggacuuguaccauucuuccgcggacugcagguucuuagcggccagggacucauacugggcgcggaucucccucagagccgaggucaggucugguuuagccacagucacguccaccucggccgcggccugcgacgacgccugcagcguggccagcagcucggcuaccuccucgucgugcaccuggcguacgaaggccagcucguccagcagcgacuccaccuucuucuccagguccaggcgggccagcguggcgccguccacgucgcgcugcugcgccuucagggcgcgcucggcgccuucgcguccgcggcucuccuccucgcagcgcgcccgcagccgcugcaccuccuccgccagcccgucgcgcuccagcagggccugcgagcgagccgagcuggccuccuccagcugcgcgcgcaggucgcgcagcucgcgcuggaagagcucgccgacgcgcgacggcucagcguggcgcugucgcagcgcggccagcucggccuccaacgcgcgguucugcgucuccagcugaugcaccuucucgaugaacacggcgaagcggucguugaggcccugcagcugcuccuucucguuggugcggaugaucuuguacucguuggugcgcgccgccgccuggcucagguccagcccgucggacgccggcggccggcgauaggccaggccgaggccgagcgacgaggccgaggagcaggcggccgaggaggccacauugcugcgggacagcgacugcgagcggaagccgcccgcgccgccggccccagagaggcgggcggacaggcgagagccauccccgaacaccuugcgguaggaggaggaggagcacagguagugcuccgagccgaagcucauggugccgggaucggggccggacgugcggcuucaacgcgagcuacagaagaaaggagaggugcggcaggcagggcgcggcggggcggugcgcccggcuuuuaaggcgccggggcuggggcggcgcgcugggggcggagcuccugcucagagucuggccgggagagggaaggggggcauccaggagugggggcggggaggcgcagugacuaccgcagcugcgcgcgcgacgaccuggggcgccgggacagggccaucugcaucggagucgccccuuuccgcagcgcuucuccccaagaaucgacugcuucggaagugacucgagcggaggggugccuaaacgacugagguuucccauccggaaaccacacagcucugucgcaucccuugacccuauccccucuucuuuaaccgacugggagguuagggguuucugggagguguccccuacacccacccucauccugaggugaggcgcacagaaagccuucccgagggcgaggucguguuuuuccaguuacagugaggaccugcagagcgagcccuuguccccuuccucaggguccccaaggagaaaggugggagaugcuacgucagaaagc

SEQ ID NO: 20303 - RNA, 2504 nt, Homo sapiens
ugucuguccuucuguccuaccagcuugggcgaggcaggcucgggauucagggggccgcagcggaggcggcgccggccagggacucugcagggaccggggugccccggagggaguggugcugguggaggaggaggcgguggcugagggggaguagguggggaaagaggaggaggaagaagaggaggaggaggaagaagaggaggaggaggagaagaagaaacuggaggaagaggaggaggcgaaggaggaggagaagccgcagcgggcgccgcaggagcgagugagcugggagcgaggggcgaaggcgcggagaagcccggccgcccggugggcggcagaaggcucagccgaggcggcggcgccgacuccguuccacucucggcccggauccaggccuccggguucccaggcgcucaccucccucugacgcacuuuaaagagucuccccccuuccaccucagggcgaguaauagcgaccaaucaucaagccauuuaccaggcuucggaggaagcuguuuaugugauccccgcacuaauuaggcucaugaacuaacaaaucguuugcacaacuugugaagaagcgaacacuuccauggauuguccuuggacuuagggcgcccugcccgccuuuugcagaggagaaaaaacuuuuuuuuuuuuuugccucccccgagaacuuuccccccuucuccucccugccucuaacuccgauccccccacgccaucucgccaaaaaaaaaaaaaaaaaaaaaaaagaaaaaaaaagaaaaaaaaagaaaaaaaauuaccccaauccacgccugcaaauucuucuggaaggauuuuccccccucucuucagguugggcgcguuuggugcaagauucucgggauccucggcuuugccucucccucucccuccccccuccuuuccuuuuuccuuuccuuuccuuucuuucuuccuuuccuuccccccacccccacccccaccccaaacaaacgaguccccaauucucguccguccucgccgcgggcagcgggcggcggaggcagcgugcggcggucgccaggagcugggagcccagggcgcccgcuccucggcgcagcauguuccagccggcgcccaagcgcugcuucaccaucgagucgcugguggccaaggacaguccccugcccgccucgcgcuccgaggaccccauccgucccgcggcacucagcuacgcuaacuccagccccauaaauccguuccucaacggcuuccacucggccgccgccgccgccgccgguaggggcgucuacuccaacccggacuugguguucgccgaggcggucucgcacccgcccaaccccgccgugccagugcacccggugccgccgccgcacgcccuggccgcccacccccuacccuccucgcacucgccacacccccuauucgccucgcagcagcgggauccguccaccuucuaccccuggcucauccaccgcuaccgauaucugggucaucgcuuccaagguacgugccacgucgcggaacugcagcgcgccgcucccgccgcauccuucacugcccccggccugcuccgggugggcgcuuggcaaggccugggcggagguuccuccggcucgcgggccagcgcgcccuguugggaaacuaggcggcgcggggccgggcguggugucgauccccagucuccgaagcuacgacugguuuggagugauggccugcgggccgcuugacccuuugggaaggggugcgaacggagaaguugucccccagugcgcucgaaucagagcaggcugggcugugcgugcccggcgccgcggagcccagagcccgcgggauccccaggcuccugguacccucggcaaugcccccaaccguccuggcuccgaggggcgcggacaggacucggccgccaggcuugcuuucgacugcguucgacccuguucaccacccacuuugcgccccuucaguccagacccgcggcuucuuagucuuccacccucuucuggaggcgagaggauccucgcgccccgggagaaaaguaugggauuuguuuuuucuuuccugcuuuucggaggccuggggaggggcgggaacccgugcgggaggaaagcuccagggcuuggcgcucucgccgcgaccugcuuaauuggggcgccgagcagccacagcgggaaggcagguucggucugguuuuuguuuuucuuucuuucuuuaaaaaaaaaaaaaaagaaccuggucaggaaacugucuuagagggaaauaucuguucguguguuuucauuucuugcgauauuuuuuauuuguuuguuuuucucuggguacggggugggaggaggagaguuaaaacuucagaaaaaggaguaauuaguuuacggauuggagucaguaaaagaccuaccuccggcggcagccgaucaauacuccgcggcuuguccauucauuaacccauugcguuccugccggagccuagaaucggguagaugucaccccccuccccauauuuuaaaaaaucaaaccaa

SEQ ID NO: 20304 - RNA, 2504 nt, Homo sapiens
uugguuugauuuuuuaaaauauggggaggggggugacaucuacccgauucuaggcuccggcaggaacgcaauggguuaaugaauggacaagccgcggaguauugaucggcugccgccggagguaggucuuuuacugacuccaauccguaaacuaauuacuccuuuuucugaaguuuuaacucuccuccucccaccccguacccagagaaaaacaaacaaauaaaaaauaucgcaagaaaugaaaacacacgaacagauauuucccucuaagacaguuuccugaccagguucuuuuuuuuuuuuuuuaaagaaagaaagaaaaacaaaaaccagaccgaaccugccuucccgcuguggcugcucggcgccccaauuaagcaggucgcggcgagagcgccaagcccuggagcuuuccucccgcacggguucccgccccuccccaggccuccgaaaagcaggaaagaaaaaacaaaucccauacuuuucucccggggcgcgaggauccucucgccuccagaagaggguggaagacuaagaagccgcgggucuggacugaaggggcgcaaaguggguggugaacagggucgaacgcagucgaaagcaagccuggcggccgaguccuguccgcgccccucggagccaggacgguugggggcauugccgaggguaccaggagccuggggaucccgcgggcucugggcuccgcggcgccgggcacgcacagcccagccugcucugauucgagcgcacugggggacaacuucuccguucgcaccccuucccaaagggucaagcggcccgcaggccaucacuccaaaccagucguagcuucggagacuggggaucgacaccacgcccggccccgcgccgccuaguuucccaacagggcgcgcuggcccgcgagccggaggaaccuccgcccaggccuugccaagcgcccacccggagcaggccgggggcagugaaggaugcggcgggagcggcgcgcugcaguuccgcgacguggcacguaccuuggaagcgaugacccagauaucgguagcgguggaugagccagggguagaagguggacggaucccgcugcugcgaggcgaauaggggguguggcgagugcgaggaggguagggggugggcggccagggcgugcggcggcggcaccgggugcacuggcacggcgggguugggcgggugcgagaccgccucggcgaacaccaaguccggguuggaguagacgccccuaccggcggcggcggcggcggccgaguggaagccguugaggaacggauuuauggggcuggaguuagcguagcugagugccgcgggacggaugggguccucggagcgcgaggcgggcaggggacuguccuuggccaccagcgacucgauggugaagcagcgcuugggcgccggcuggaacaugcugcgccgaggagcgggcgcccugggcucccagcuccuggcgaccgccgcacgcugccuccgccgcccgcugcccgcggcgaggacggacgagaauuggggacucguuuguuugggguggggguggggguggggggaaggaaaggaagaaagaaaggaaaggaaaggaaaaaggaaaggaggggggagggagagggagaggcaaagccgaggaucccgagaaucuugcaccaaacgcgcccaaccugaagagaggggggaaaauccuuccagaagaauuugcaggcguggauugggguaauuuuuuuucuuuuuuuuucuuuuuuuuucuuuuuuuuuuuuuuuuuuuuuuuuggcgagauggcguggggggaucggaguuagaggcagggaggagaaggggggaaaguucucgggggaggcaaaaaaaaaaaaaaguuuuuucuccucugcaaaaggcgggcagggcgcccuaaguccaaggacaauccauggaaguguucgcuucuucacaaguugugcaaacgauuuguuaguucaugagccuaauuagugcggggaucacauaaacagcuuccuccgaagccugguaaauggcuugaugauuggucgcuauuacucgcccugagguggaaggggggagacucuuuaaagugcgucagagggaggugagcgccugggaacccggaggccuggauccgggccgagaguggaacggagucggcgccgccgccucggcugagccuucugccgcccaccgggcggccgggcuucuccgcgccuucgccccucgcucccagcucacucgcuccugcggcgcccgcugcggcuucuccuccuccuucgccuccuccucuuccuccaguuucuucuucuccuccuccuccucuucuuccuccuccuccucuucuuccuccuccucuuuccccaccuacucccccucagccaccgccuccuccuccaccagcaccacucccuccggggcaccccggucccugcagagucccuggccggcgccgccuccgcugcggcccccugaaucccgagccugccucgcccaagcugguaggacagaaggacagaca

SEQ ID NO: 20305 - RNA, 2541 nt, Homo sapiens
uguccacguacaggaaucuuugaggcugacaauuaaaaugccuuccacgcaagcaauucuguuggcaaaaccgaacccaacacuucguaaggauugauuucggcccgcgguguccguuuccagugccacaggaagugucagauggccagaaauacccaagucugucugcacucaccacccaccaccuucuggggugggccauuuccuccuagucuuuacucccaggccauuuuaaggaucuuucuccaaaagacuaccccuagaaccaaauaccacacuaccccuccucuagcgucuucucaaaacgaaaaaagggggggaaaacacagcuaaaaccccgagcugucuagucuagacgcagcgaggcugugcgaauaccuauuugaagcgcguugguuucuuuuuaagguuuguuucuaaauacacauaacccuccuccuuccuucuucgcucuuccauuccccccacccccacccuccagacgccggcggcgcgcgcccuggcgcgcgggcacucacagccucuagcuggagaucgcggacuuucuggaaaagauucauuaacagcaaauuacgccucgcccggccacggccuacacgcugccagacucguccgucuccgggaccccgggaagggcccacucgagcgugcgagcggcgggaagcccgccgggaccacgcgugacuucggccgcccuacuccacacacggugccccaaggcucucuccguaaacagcaggcgcucgucaccgccgccgcgagcccccgaguuggcggaggcucugcggcgcagccgcccgccggcuccgagcgcgggccccgcggcgccucgcccuccccgccuuggccgaggaucuugccccggugcgcaaguuccucuucgccuacagccuccuugccacacgcccuccgagugggaccaacuuccuccggccgcagacuuucacacgcccaucagggcuacccaccagacuccccauugcccagcggagggcccaggucucgcccgcccccgcccucccuccacgacgcugcccccgcacaagcacauucuacacccaccccugggggcucauaacuuaaaaccuacgcugaacaucggggagggagaggagggggaaagcgggagggggaucgcagauuauaaucuuaaaagaacauuuacaaaacaaagcgucugaccuggcuggcgggcgggccaagucggaaccccuugcucugcucgauuucuuaguaguuuuuuuuuuuaauccacgugauucgugcuuuggggcaagccaagaaaaaacgggacuccccucccgaguugcgcggcagcggcggcaggucgagcucggcucggcccgaggcacucgccacacacccucgcgcacgcacacgccgacguuccacuuggaggaacgaccggcccccggagaggcgagacgaggcggcgguggcggcggcuggggguuuuuacaguucuuucccgagucgaaaaagaaagcagacggcaacccgcugcccuccccuuccugcucgcgagcuaacgccgaacccagcuucccagcuuccagcccaccuccccccccuccgcccgacucgcggcgcucagcggcgaccgcgcucccgcgcacagacacacacaggcugcaaacuuccacucugcgaacucccugcucuccuccuggcccaccgggaggcgccaggcccccagccgcgcccccucccucccuggugcccacgcggggccgcuuagguuggcugcauuuuaaauaacauagcuaugaaauaaaaacgaaagcgagccaagcagccaaagggaagcgcgaggcaaaagcuucgcgggguacgcugcgggagggggccccgggagagggggccgacugcagcccucagcgcgcccgcccgcccacccguccgcggucucccgggggaaagguguuccgggcacugaccugaaauccccggugggggaguaggcagggagccugcgauccggcucuuugaaguuuucccccaagcggacucgaggcggcgagaaggagcggggggcgguuggguggguggagagagauaugaggggugggggggguuggcgacguuaacgagcggagaaggagccgggccggagaagcgcggcgagcagcaaaguuugcgguccccggcugcccgcagcccgcucgcggcgccgcgcucacucgacucccucgccgucugcuggcagccggcugcccucggggucggccccgccgaggggugggcucugggccgggugggggcggggcggggcgggcucggggccuccgggcagguggcgacagccccgugcgauccuccgggcucccgcagcuggacugggcuuggccgagcucagcagcucccgcgcugccgccgccgcccgcgcucgggcaggagccccagcgccauguugacgguucgccgcgagcgcccgcucgggcugggugugugugagugugugugaguguuggccaagucgucccugcgcggcgacagcgcggcuugggcucuccgcccggcggcucgcgggcucccccuccg

SEQ ID NO: 20306 - RNA, 2541 nt, Homo sapiens
cggagggggagcccgcgagccgccgggcggagagcccaagccgcgcugucgccgcgcagggacgacuuggccaacacucacacacacucacacacacccagcccgagcgggcgcucgcggcgaaccgucaacauggcgcuggggcuccugcccgagcgcgggcggcggcggcagcgcgggagcugcugagcucggccaagcccaguccagcugcgggagcccggaggaucgcacggggcugucgccaccugcccggaggccccgagcccgccccgccccgcccccacccggcccagagcccaccccucggcggggccgaccccgagggcagccggcugccagcagacggcgagggagucgagugagcgcggcgccgcgagcgggcugcgggcagccggggaccgcaaacuuugcugcucgccgcgcuucuccggcccggcuccuucuccgcucguuaacgucgccaaccccccccaccccucauaucucucuccacccacccaaccgccccccgcuccuucucgccgccucgaguccgcuugggggaaaacuucaaagagccggaucgcaggcucccugccuacucccccaccggggauuucaggucagugcccggaacaccuuucccccgggagaccgcggacgggugggcgggcgggcgcgcugagggcugcagucggcccccucucccggggcccccucccgcagcguaccccgcgaagcuuuugccucgcgcuucccuuuggcugcuuggcucgcuuucguuuuuauuucauagcuauguuauuuaaaaugcagccaaccuaagcggccccgcgugggcaccagggagggagggggcgcggcugggggccuggcgccucccggugggccaggaggagagcagggaguucgcagaguggaaguuugcagccugugugugucugugcgcgggagcgcggucgccgcugagcgccgcgagucgggcggaggggggggaggugggcuggaagcugggaagcuggguucggcguuagcucgcgagcaggaaggggagggcagcggguugccgucugcuuucuuuuucgacucgggaaagaacuguaaaaacccccagccgccgccaccgccgccucgucucgccucuccgggggccggucguuccuccaaguggaacgucggcgugugcgugcgcgaggguguguggcgagugccucgggccgagccgagcucgaccugccgccgcugccgcgcaacucgggaggggagucccguuuuuucuuggcuugccccaaagcacgaaucacguggauuaaaaaaaaaaacuacuaagaaaucgagcagagcaagggguuccgacuuggcccgcccgccagccaggucagacgcuuuguuuuguaaauguucuuuuaagauuauaaucugcgaucccccucccgcuuucccccuccucucccuccccgauguucagcguagguuuuaaguuaugagcccccagggguggguguagaaugugcuugugcgggggcagcgucguggagggagggcgggggcgggcgagaccugggcccuccgcugggcaauggggagucugguggguagcccugaugggcgugugaaagucugcggccggaggaaguuggucccacucggagggcguguggcaaggaggcuguaggcgaagaggaacuugcgcaccggggcaagauccucggccaaggcggggagggcgaggcgccgcggggcccgcgcucggagccggcgggcggcugcgccgcagagccuccgccaacucgggggcucgcggcggcggugacgagcgccugcuguuuacggagagagccuuggggcaccguguguggaguagggcggccgaagucacgcguggucccggcgggcuucccgccgcucgcacgcucgagugggcccuucccggggucccggagacggacgagucuggcagcguguaggccguggccgggcgaggcguaauuugcuguuaaugaaucuuuuccagaaaguccgcgaucuccagcuagaggcugugagugcccgcgcgccagggcgcgcgccgccggcgucuggaggguggggguggggggaauggaagagcgaagaaggaaggaggaggguuauguguauuuagaaacaaaccuuaaaaagaaaccaacgcgcuucaaauagguauucgcacagccucgcugcgucuagacuagacagcucgggguuuuagcuguguuuucccccccuuuuuucguuuugagaagacgcuagaggagggguagugugguauuugguucuagggguagucuuuuggagaaagauccuuaaaauggccugggaguaaagacuaggaggaaauggcccaccccagaaggugguggguggugagugcagacagacuuggguauuucuggccaucugacacuuccuguggcacuggaaacggacaccgcgggccgaaaucaauccuuacgaaguguuggguucgguuuugccaacagaauugcuugcguggaaggcauuuuaauugucagccucaaagauuccuguacguggaca

SEQ ID NO: 20307 - RNA, 2433 nt, Homo sapiens
gcaaggaacccaggcggggcucccagggcucucgggcugggacuggguugugugugugugggggggcuucacggauaccccucccaaccugcuuccuuucccugacagcagccaucucccccaagagggagagucuuaggcgucccggaagacccugcggacugugcaccucgagguaccagccucuccugggaggaguggggggccgcuggucagcggcuggcagaggggaccuguuugcuggcccguuuggaggugggauggagugggguuuggagacugagaagcccaagagaagacacugaguuucuccccaccccacaaccccacuuccgaaaaagaaccagguggugaggaggaauaaggcgaaguguaaacacaaacaaccucaaaaagaagccaagaaaagcgaagcccaaagaagcaagagcaacacuguuacaaaacugucugguuuuguaacaauuuccccgccgccggccaaugaacagcguggcggcacgucacgugguaccguuuuauauaacacuuugcugagacaagacaguuauuaggcggcgcggggcggccggcauggagcucccggaggcgcggcagggucaggagcucgguggcauggcggcgguggcugccccgauuuccuccagcugccacuccuugcuucguguccccggucccuagacgccucgucuccucccgugucccucuucccauggagucaguacggaucgaacagaugcugagcuugcccgcugaggucagcagcgacaacuuggagucggcggagcgaggggcaucagcggcccaaguagacaugggcccccacccaaagguggcugcagagggccccgcaccucuaccgacgcgggagccagagcaagagcagucuccggggaccucaacgccggagagcaaaguccugcucacgcaggcagacgccuuggcgucccgggggcgaauccgugaagcccucgagguguauagacagcucuccgagcggcagcagcugguggcugagcagcuggagcagcuggugcgcugccuggcggagaaagucccgcaaggcgaggcgcuggcgccggcgcccccggacgaggguagcacugcaagcggcaccguggcggcggaagagacgggggccgccgcggcugcggcggccaccgaggugugggacggcuuuaagugccggaaaugucauggguuucuaucagaccccguguccuugucguguggccacaccuuuuguaaacugugccuggaacgugggcgggccgccgaccggcgcugugcgcugugcggggucaagcucuccgccuugaugguggccacugggcgggcgcguggagcccggcgggcugggcagcagccgccgccgccgcugcgagucaacguggugcucagcggccuccucggcaaguuguuuccaggcccagcgcgagcgucgcaacuccggcacgagggcaaccgacuguaccgcgagcgccagguggaggcggcacugcucaaguacaacgaggcaguuaaguugggugaguccaacgcgcugccgggccggggcuggggcucgguggcuacaugagggagcgggagaacaaaccccgcagcgagaagggauuuggaccagggcagaagagggggcgggggacccauggacuguggcggggugggggaggggugauucuggggcugggucucugaguuuguucuguuuucacugcuuaucuguguuucacuguguuuguguugaucucgguugcuuuuugucuuuuccugcuacuucuguuagcuuuuguguuccugucucucaguccccguuccugucugugucuccuugcuucugguucuuuuucuccgucucuucguaucuuugucacuguuucuuucuuuuucggugucacugucucuguuccucugacucuccuucucccgcugcacuccuggucuccucuuacaccugcucgcaccuucccagcgaggagaggaacuucgcgcgcuccucgcacuugcgcccgguccucugggcuguagccagcaggagauguccggucggcgccugcguccgccgcucgcgccgccggguguugccccuuccggggccgcggcucccugugggguggguccggcauggaauuaggucaggagagcacugguugcauaagggccgcgagcggcccgggucgggcgccccucccccgcgcgagcgggcgggauuguguaaccgcugagguaacugaagugggccaccacgcucgcuucggaaaccaucccacgagcaugugcggggggagggggagcgcuugcgccccgcugcccugugacucauugucaccgcuuccuaucacacgauccucggcugaaauagaugcccccccuugcccgccccgccaacccguagccugugcccucgccuccaaccccuuuaaccuggccagc

SEQ ID NO: 20308 - RNA, 2433 nt, Homo sapiens
gcuggccagguuaaagggguuggaggcgagggcacaggcuacggguuggcggggcgggcaagggggggcaucuauuucagccgaggaucgugugauaggaagcggugacaaugagucacagggcagcggggcgcaagcgcucccccuccccccgcacaugcucgugggaugguuuccgaagcgagcgugguggcccacuucaguuaccucagcgguuacacaaucccgcccgcucgcgcgggggaggggcgcccgacccgggccgcucgcggcccuuaugcaaccagugcucuccugaccuaauuccaugccggacccaccccacagggagccgcggccccggaaggggcaacacccggcggcgcgagcggcggacgcaggcgccgaccggacaucuccugcuggcuacagcccagaggaccgggcgcaagugcgaggagcgcgcgaaguuccucuccucgcugggaaggugcgagcagguguaagaggagaccaggagugcagcgggagaaggagagucagaggaacagagacagugacaccgaaaaagaaagaaacagugacaaagauacgaagagacggagaaaaagaaccagaagcaaggagacacagacaggaacggggacugagagacaggaacacaaaagcuaacagaaguagcaggaaaagacaaaaagcaaccgagaucaacacaaacacagugaaacacagauaagcagugaaaacagaacaaacucagagacccagccccagaaucaccccucccccaccccgccacaguccaugggucccccgcccccucuucugcccugguccaaaucccuucucgcugcgggguuuguucucccgcucccucauguagccaccgagccccagccccggcccggcagcgcguuggacucacccaacuuaacugccucguuguacuugagcagugccgccuccaccuggcgcucgcgguacagucgguugcccucgugccggaguugcgacgcucgcgcugggccuggaaacaacuugccgaggaggccgcugagcaccacguugacucgcagcggcggcggcggcugcugcccagcccgccgggcuccacgcgcccgcccaguggccaccaucaaggcggagagcuugaccccgcacagcgcacagcgccggucggcggcccgcccacguuccaggcacaguuuacaaaagguguggccacacgacaaggacacggggucugauagaaacccaugacauuuccggcacuuaaagccgucccacaccucgguggccgccgcagccgcggcggcccccgucucuuccgccgccacggugccgcuugcagugcuacccucguccgggggcgccggcgccagcgccucgccuugcgggacuuucuccgccaggcagcgcaccagcugcuccagcugcucagccaccagcugcugccgcucggagagcugucuauacaccucgagggcuucacggauucgcccccgggacgccaaggcgucugccugcgugagcaggacuuugcucuccggcguugagguccccggagacugcucuugcucuggcucccgcgucgguagaggugcggggcccucugcagccaccuuugggugggggcccaugucuacuugggccgcugaugccccucgcuccgccgacuccaaguugucgcugcugaccucagcgggcaagcucagcaucuguucgauccguacugacuccaugggaagagggacacgggaggagacgaggcgucuagggaccggggacacgaagcaaggaguggcagcuggaggaaaucggggcagccaccgccgccaugccaccgagcuccugacccugccgcgccuccgggagcuccaugccggccgccccgcgccgccuaauaacugucuugucucagcaaaguguuauauaaaacgguaccacgugacgugccgccacgcuguucauuggccggcggcggggaaauuguuacaaaaccagacaguuuuguaacaguguugcucuugcuucuuugggcuucgcuuuucuuggcuucuuuuugagguuguuuguguuuacacuucgccuuauuccuccucaccaccugguucuuuuucggaagugggguugugggguggggagaaacucagugucuucucuugggcuucucagucuccaaaccccacuccaucccaccuccaaacgggccagcaaacagguccccucugccagccgcugaccagcggccccccacuccucccaggagaggcugguaccucgaggugcacaguccgcagggucuuccgggacgccuaagacucucccucuugggggagauggcugcugucagggaaaggaagcagguugggagggguauccgugaagcccccccacacacacacaacccagucccagcccgagagcccugggagccccgccuggguuccuugc

SEQ ID NO: 20309 - RNA, 2401 nt, Homo sapiens
gcugguaugguguaucauucguaucuuacauucguaucuuuugcucccucuguuaccugccugacaggaguuucuguggaaaaagccuacccacuucuuacuguggugguggcucacuucguguucaggucuugaauagagaaaucaccggccagcuaccuggaggcaggaggugccagccccaaccacugcaccuuucugagaagccaggcaguguucccagagccacagcagggccaaaaagcaagagcagagaaaggagguggccugcgaugagaggcaggcagagcuggcugggccccucggaggcuccugggcugcaugccauccuccuguucuggaggguuuggaaccacuuagggcccugugcccuugccccaggaaacucacugcccugccuucuccuucuuucugcucccaccucccugugacuccagccaugguccuggcguuaguccaccuggucuuggccuuccccuuguguggugccaggcaggcagcaaugacagccagaucauaggacuguggcagcuggaggugggagcuggcagccccaggagacauugacacagaggacaggcagccugggauggggcugcuggggcgugguuggggaccaggcuaggggcggacaugggcacuagugccaaguauuggcaggugagggcaaaaggacuccccuuuccugagcugcagggaggggucgggucaggugcugugcuuccuccuuuggugccuagcggcagggagacuaaagugaagcauguccgugccugggacagaaaggaaggcuggagccaggauguaagagaaccaagucucugggggugggauggaggcuauggggagggcauccugugcaggggaggagaccagccaggaccuugggguuagggaggagaagaccagcccagcccggcugggcccggcccugccugggggaggcugccucugcucacacaugcaggccgaaaggagcaacagcugggcuccaugccgccacccccuccgcgcacuccugccuaugcaacaagugucacgucugcauguuggcacaucauccccgguuucccgcgccccuggacuggcgggaggcucccagccuucagggaccagaagacguucaacaugggagcccagcccacucgacucuggucaguuccuuccaucgauccacgagggagcgggcaugucccccgccuccaccucuaccacgcggggugcagggcgugggacacgcggcgcacaccugugguccugagcuccugggacugcgagcgacgguuaggagggacaaggugacgggcaggugaugccaaaggccgaguugagccccgcaaaagaagcaguccuuguggccagccgccccauggcucggggcgcucugucaaucugcugccuggcgcuggccggcgcguggcugcuacugcacggcucgcgccgggcuccccgggaggcggggagagugcgaauagggcggagggaaaggagcacgccggcugcagcccgggcgagcgggagggcgcgcacucaccuccacacaccgcggucaaggagagccagagcagcaggagcgccugcacgcagagccgcagauucaugcugcuccuugggccgccgcggccccggcgagccggcgcgggggaggagaggucgggcgcccggaggccaagaaaggcgcgagccgcggcuggcgcgugcgggcgcagagcucgggaggcuccccggccgcugagugugcgcgcugagccccgccgcucccgcuggccgccuccgcucuucugcagccuccucucccgccgcggggcagcgccgcgaagcuggccucggcggcuccgggagcggcagcggcgagcucuuucuuagcggcuggcugcucggccgcggcugcaacugcccgugaccccggcugccagagagaaugcuccccgcucacuccaggggcugcauuuuguagcuuguggcuuggccgcgagcccacuuggucauguggucaucgggagggcuagagggggggcaggaagagggagagggagcgagccucccgcaccgccccccuccaggcacgcacucugcagccccagcccgagcgugagcgcgagagggaaccccgagguggccccacaacaaaggcugcgcggccucucugacaaccuacaaccgcuccccggacaaugcccgccuggccgggggccagaggguuugcagagaccugaaggauuucaaacacaggaagcauuuggggcgguggaggggcacacuuaacccuuucucaccuugcuuccuuaacagcugucaggaaaccugggcgcuuagggaaggacucagucuggguugccuucacucacgcccucuaccucugacccugguccuugcccuugccgcuggccagcuucaaggg

SEQ ID NO: 20310 - RNA, 2401 nt, Homo sapiens
cccuugaagcuggccagcggcaagggcaaggaccagggucagagguagagggcgugagugaaggcaacccagacugaguccuucccuaagcgcccagguuuccugacagcuguuaaggaagcaaggugagaaaggguuaagugugccccuccaccgccccaaaugcuuccuguguuugaaauccuucaggucucugcaaacccucuggcccccggccaggcgggcauuguccggggagcgguuguagguugucagagaggccgcgcagccuuuguuguggggccaccucgggguucccucucgcgcucacgcucgggcuggggcugcagagugcgugccuggaggggggcggugcgggaggcucgcucccucucccucuuccugcccccccucuagcccucccgaugaccacaugaccaagugggcucgcggccaagccacaagcuacaaaaugcagccccuggagugagcggggagcauucucucuggcagccggggucacgggcaguugcagccgcggccgagcagccagccgcuaagaaagagcucgccgcugccgcucccggagccgccgaggccagcuucgcggcgcugccccgcggcgggagaggaggcugcagaagagcggaggcggccagcgggagcggcggggcucagcgcgcacacucagcggccggggagccucccgagcucugcgcccgcacgcgccagccgcggcucgcgccuuucuuggccuccgggcgcccgaccucuccucccccgcgccggcucgccggggccgcggcggcccaaggagcagcaugaaucugcggcucugcgugcaggcgcuccugcugcucuggcucuccuugaccgcgguguguggaggugagugcgcgcccucccgcucgcccgggcugcagccggcgugcuccuuucccuccgcccuauucgcacucuccccgccucccggggagcccggcgcgagccgugcaguagcagccacgcgccggccagcgccaggcagcagauugacagagcgccccgagccauggggcggcuggccacaaggacugcuucuuuugcggggcucaacucggccuuuggcaucaccugcccgucaccuugucccuccuaaccgucgcucgcagucccaggagcucaggaccacaggugugcgccgcgugucccacgcccugcaccccgcgugguagagguggaggcgggggacaugcccgcucccucguggaucgauggaaggaacugaccagagucgagugggcugggcucccauguugaacgucuucuggucccugaaggcugggagccucccgccaguccaggggcgcgggaaaccggggaugaugugccaacaugcagacgugacacuuguugcauaggcaggagugcgcggaggggguggcggcauggagcccagcuguugcuccuuucggccugcaugugugagcagaggcagccucccccaggcagggccgggcccagccgggcugggcuggucuucuccucccuaaccccaagguccuggcuggucuccuccccugcacaggaugcccuccccauagccuccaucccacccccagagacuugguucucuuacauccuggcuccagccuuccuuucugucccaggcacggacaugcuucacuuuagucucccugccgcuaggcaccaaaggaggaagcacagcaccugacccgaccccucccugcagcucaggaaaggggaguccuuuugcccucaccugccaauacuuggcacuagugcccauguccgccccuagccugguccccaaccacgccccagcagccccaucccaggcugccuguccucugugucaaugucuccuggggcugccagcucccaccuccagcugccacaguccuaugaucuggcugucauugcugccugccuggcaccacacaaggggaaggccaagaccagguggacuaacgccaggaccauggcuggagucacagggaggugggagcagaaagaaggagaaggcagggcagugaguuuccuggggcaagggcacagggcccuaagugguuccaaacccuccagaacaggaggauggcaugcagcccaggagccuccgaggggcccagccagcucugccugccucucaucgcaggccaccuccuuucucugcucuugcuuuuuggcccugcuguggcucugggaacacugccuggcuucucagaaaggugcagugguuggggcuggcaccuccugccuccagguagcuggccggugauuucucuauucaagaccugaacacgaagugagccaccaccacaguaagaaguggguaggcuuuuuccacagaaacuccugucaggcagguaacagagggagcaaaagauacgaauguaagauacgaaugauacaccauaccagc

SEQ ID NO: 20311 - RNA, 2412 nt, Homo sapiens
gucccacuucggcgccggggcuggggcugcgcccgcgggcggccucggagcuugagcgccagaaccacgcacugaggucgcccaggguggggaaguggggggccgggggaggggcggggcauccggcggggaggucucccccaccgcaugcaagacccuuugcccccccacaacauacacugaggcuaaaacggggaugagagucacacagagcaggagcgaaaucuuucgcucuccgacccgaacggcgcguugcucgaccccccccuuccuggagccaggggcuggccgaggaagguggcuccguucuucccccguggccagugcggggucugcggcugcccggcgagguuccggcuuccccgggacuggcagggggagccccgagaacugcaggcccgcccccccuuccuccuccuccuuccccuccucccccacguguccucccugagcccagcagccugaucccagcaccccccgccaccucccuccucccgcuucgcccgcuuccccggcggcguggagaagagcaaaguugcgacagcggccgggggcucugcccagguaaagggggcgccgugaggcggggguggugggggaacggugcggcccugcggcgggggcggggggaggauaaagaaacuugcuucccgcggcccccaccccgcguggguuccgaucuugcguggaacgagcccgcguggcgagucgcggcaacacugccgggaccgaggccggcaccuggacccggacccggaccgcgcgcuugggccggcucggcgggcgcaggcagcgggccaggccagcacccaggcaagggcgggguggguggccguacaccggaccgaaucggggacuccgguggcgugggcgcgggccgaaccccgaccgggccgaguuggguggcgaaguaggacguggauucgggggcggggcgcggcgggagggggaaaccaggccuggccagacuggccugggcgugggggcggggggcgaguucggggcacuugcugggcucuggaccgagcgguagggcggggcggcgcuaggggcugggccggacccgcagggagagggcgaggggagggagagccggggguggaguaggggcguggaguugugagcggggucuggccucggccgggggcgaagguagaucggcggggccgcgagcggagggagggaggcccgcggcggcgcggcggcagcgaaggccagcuuccgcggaguuugugcccgggcuucccgggcucuggccgccucacgcgcacaaauggggcuaggggacugagugguaagcaacuccgaguguuagacggugaucgggcggcgauuccgggaaaagcgaggaaagacacagucugcgauugugccgcaccccccacccaccucuuagcaucuggauucugcucucguagugggggccgcggacccuccccgccacaguccuuuuacucuccagcacucccaccgccuucccccuucuucagccaucugacucuccuagggguauguguuuuuggggguggacggcgacgggggugggggauacuuuccuucccguggcggcaaccuaguucguaucuuauuccuacaagguagcgucgcuucgagucgcauggacauugggguuuagauaauuuaccccccacccaagcgauuuaauggcuuuuaagcaaaaggcgaauaccuggauuuccaugggagggaugagguuugaagauugggauucaccccuagcucacuuccacuaccaaccccucuuucuugugagccacuuccacggguauucaaaucugggggggaggggggacgggaguauuaauaugcuucucuauuucuacacagggucggcguggcgaaggacggcuagccuuggagggaaaguagccaccaguccaacucgggucgcccccaccauuauuucggugagggggcaacgcuaagaaggggauacugguggguaggggcccaguauaagggagggggcuggguagucguccccagaaggacuccgugucuuggcggggagagagagaggcgagccccggcuucaggggagggguuccggggagggagauggggggguggcgacgacggugggggggggagcgggaagaagggggagucacgcccugccugcaaggggagccucccucaggccccugggagaaggggacugaaugcgucuguucuccgcugcccggcagaggagaucuggggucucgagauuugcacacuggaucggcaccaguggccugagaaagucaggucggggcauaagguggagaacguuggaagaaagagagagaacccuuuggccgcggcucacugacccucucccuuccucaaccucccccuucgaggggcgucgagguggggggggacguggggcuccugcagccccgcaga

SEQ ID NO: 20312 - RNA, 2412 nt, Homo sapiens
ucugcggggcugcaggagccccacguccccccccaccucgacgccccucgaagggggagguugaggaagggagagggucagugagccgcggccaaaggguucucucucuuucuuccaacguucuccaccuuaugccccgaccugacuuucucaggccacuggugccgauccagugugcaaaucucgagaccccagaucuccucugccgggcagcggagaacagacgcauucaguccccuucucccaggggccugagggaggcuccccuugcaggcagggcgugacucccccuucuucccgcucccccccccaccgucgucgccacccccccaucucccuccccggaaccccuccccugaagccggggcucgccucucucucuccccgccaagacacggaguccuucuggggacgacuacccagcccccucccuuauacugggccccuacccaccaguauccccuucuuagcguugcccccucaccgaaauaauggugggggcgacccgaguuggacugguggcuacuuucccuccaaggcuagccguccuucgccacgccgacccuguguagaaauagagaagcauauuaauacucccguccccccucccccccagauuugaauacccguggaaguggcucacaagaaagagggguugguaguggaagugagcuaggggugaaucccaaucuucaaaccucaucccucccauggaaauccagguauucgccuuuugcuuaaaagccauuaaaucgcuugggugggggguaaauuaucuaaaccccaauguccaugcgacucgaagcgacgcuaccuuguaggaauaagauacgaacuagguugccgccacgggaaggaaaguaucccccacccccgucgccguccacccccaaaaacacauaccccuaggagagucagauggcugaagaagggggaaggcggugggagugcuggagaguaaaaggacuguggcggggaggguccgcggcccccacuacgagagcagaauccagaugcuaagagguggguggggggugcggcacaaucgcagacugugucuuuccucgcuuuucccggaaucgccgcccgaucaccgucuaacacucggaguugcuuaccacucaguccccuagccccauuugugcgcgugaggcggccagagcccgggaagcccgggcacaaacuccgcggaagcuggccuucgcugccgccgcgccgccgcgggccucccucccuccgcucgcggccccgccgaucuaccuucgcccccggccgaggccagaccccgcucacaacuccacgccccuacuccacccccggcucucccuccccucgcccucucccugcggguccggcccagccccuagcgccgccccgcccuaccgcucgguccagagcccagcaagugccccgaacucgccccccgcccccacgcccaggccagucuggccaggccugguuucccccucccgccgcgccccgcccccgaauccacguccuacuucgccacccaacucggcccggucgggguucggcccgcgcccacgccaccggaguccccgauucgguccgguguacggccacccaccccgcccuugccugggugcuggccuggcccgcugccugcgcccgccgagccggcccaagcgcgcgguccggguccggguccaggugccggccucggucccggcaguguugccgcgacucgccacgcgggcucguuccacgcaagaucggaacccacgcggggugggggccgcgggaagcaaguuucuuuauccuccccccgcccccgccgcagggccgcaccguucccccaccacccccgccucacggcgcccccuuuaccugggcagagcccccggccgcugucgcaacuuugcucuucuccacgccgccggggaagcgggcgaagcgggaggagggagguggcggggggugcugggaucaggcugcugggcucagggaggacacgugggggaggaggggaaggaggaggaggaagggggggcgggccugcaguucucggggcucccccugccagucccggggaagccggaaccucgccgggcagccgcagaccccgcacuggccacgggggaagaacggagccaccuuccucggccagccccuggcuccaggaaggggggggucgagcaacgcgccguucgggucggagagcgaaagauuucgcuccugcucugugugacucucauccccguuuuagccucaguguauguugugggggggcaaagggucuugcaugcggugggggagaccuccccgccggaugccccgccccucccccggccccccacuuccccacccugggcgaccucagugcgugguucuggcgcucaagcuccgaggccgcccgcgggcgcagccccagccccggcgccgaagugggac

SEQ ID NO: 20313 - RNA, 2519 nt, Homo sapiens
gguguaugguggaucaccaguaguuaaaaggaaaccauuucagauuaugcuugccuccccccaggucccaccccgccccuaggaugggaucucaguuguaaaaccgaguguugguuccuccccaaccugcaaaaaaguuucagggccgcaaaauuaucaggacuccaucauguugguuauaaaauuuauugaucucauuuaggaauuaagaguaaaagcuugaaaacccugaaacaaaguagccccuccccacuacccaaacgaaaucugaacacauuagcgcgaagaaauaucaaacagaucacggcagaaaucaccaacucaacaugauuggacagaagcugucccgcggccaggggcggcgaggcgggagacacacgcacaccuggcuauaaauuaacauuggcuuuagcugccgcgcugcuuggagcggucagcgccccaaaaaaccacgaggaaaacagacgcgacacgacugggggcguaggcguugcaguucuccagcuggccucacccgauacuauguuucucccauucacuccuuggcuaacugcaaacuaacaagacaacauuuucaaauguaacagaauaacccuggaacucaggaggaggagugggggcuguuuuuucuuugcaaauaacacagcgauucccagccuacaaaggugaaaggagcagcggcguggggcaagagagcucucuagaagucccauuuucgcugcuccugacuuauuuuugcuuuuguacaaaacccgacagcuacagcaaaacuuucagcccuccccaucaucgguacaaggcaacagucccaggcaagcaaagcuaaacaaggcgucccaacuugggggugcggggcgggaguggggguggggguggggaacaaggguggacgagcgcaggccggugcucagaugugggucagcggcaccguuccguugacugcagucccggcgcccugguagugcuggugcacgccgugcaggcgaccgccgggcagcggagaggcggcgucggccgcguccccgccggguggcagguacaugcugaucaugucgcgcaggucgccgaggcacgcgcgcugagagugcgaugcgauggcgggcggcggcgagcugggcucagacuucacuaccgagcccauggggcccaggcucauggcggcugcggccgcagcugcggccgcggcgguggcgggcugcugcccguaggcggcggccgcggcugcuguggcugagggcgccaugcccccguagcccgaggcggcggcggccgcggcagcgacguucauguagcucugagcgccgggcggcaucauugggcuguacugcaggccggccaugucguagcggugcaucggcggcagcgcgggcggcggcggcgggcugcucaugcucgggggcugcgcguagcccagcugcuccugcaccagcgaguacgcgccguuggcccagccguucacgugcguguacguguccaggcgcuggcccacgcccaccggacugcuggcggcagcggcugcggccgcggcagcggcggcggcggccgcggcaccgggaggcaggaggccgcugggcagggaguacuuaucuuucuugagcagcgucuuggucuugcggcgcggucgguacuuguaguccggauacuccuucaugugcacggcgcgaagucgcuuggccucgucgaugaauggucgcuucucggcgucggucagcaguuuccagucggcgcccaagcgcuugcugaucucagaauugugcaucuugggguucuccagggccauuuugcgccgcugcccgcgggaccauaccaugaaggcguucaugggccguuucacacgguccuggucuguacccccgccaccuccgcucgcaccaccgcugcugccgccgcccgaguucgcgccgccggcugcguucgcacuacucuugccugcgccucccggggcugcggggccgccggugcccgccgcuugugugggugucccuacgggguucuugaguucagucuccagaaggcuguacauugccggggcgggaagaaggugcgccagcguggcgggaggagaaggcgcucccggggcuggagcggccacggugaaaaggcccugggacuccgucggagcggagcuugggggccugugggccagcgaguccggcgggaaggguaggcuuaucaaaaugcuccgcgccaaaucagcaggaacccgcgggcuucucgcaccugaugaguucucucgaacaggucgcauucacagucugccugggcucuagcugggccccuuauauaccugcucggauuccccgggguuggggcuugguccgccccucgcaacccggaggacccgugauugacagguucgcagugaugcgcccuggccaaucauuaccgagcccccguucggccuggcuggaaaaaaaaaaguucggggagcccuuucguucaccccacgccccucuuuggccuagugacgugguaagaguuacuuaggaggcgggaguccacgaggcccacucagaggc

SEQ ID NO: 20314 - RNA, 2519 nt, Homo sapiens
gccucugagugggccucguggacucccgccuccuaaguaacucuuaccacgucacuaggccaaagaggggcguggggugaacgaaagggcuccccgaacuuuuuuuuuuccagccaggccgaacgggggcucgguaaugauuggccagggcgcaucacugcgaaccugucaaucacggguccuccggguugcgaggggcggaccaagccccaaccccggggaauccgagcagguauauaaggggcccagcuagagcccaggcagacugugaaugcgaccuguucgagagaacucaucaggugcgagaagcccgcggguuccugcugauuuggcgcggagcauuuugauaagccuacccuucccgccggacucgcuggcccacaggcccccaagcuccgcuccgacggagucccagggccuuuucaccguggccgcuccagccccgggagcgccuucuccucccgccacgcuggcgcaccuucuucccgccccggcaauguacagccuucuggagacugaacucaagaaccccguagggacacccacacaagcggcgggcaccggcggccccgcagccccgggaggcgcaggcaagaguagugcgaacgcagccggcggcgcgaacucgggcggcggcagcagcgguggugcgagcggagguggcggggguacagaccaggaccgugugaaacggcccaugaacgccuucaugguauggucccgcgggcagcggcgcaaaauggcccuggagaaccccaagaugcacaauucugagaucagcaagcgcuugggcgccgacuggaaacugcugaccgacgccgagaagcgaccauucaucgacgaggccaagcgacuucgcgccgugcacaugaaggaguauccggacuacaaguaccgaccgcgccgcaagaccaagacgcugcucaagaaagauaaguacucccugcccagcggccuccugccucccggugccgcggccgccgccgccgcugccgcggccgcagccgcugccgccagcaguccggugggcgugggccagcgccuggacacguacacgcacgugaacggcugggccaacggcgcguacucgcuggugcaggagcagcugggcuacgcgcagcccccgagcaugagcagcccgccgccgccgcccgcgcugccgccgaugcaccgcuacgacauggccggccugcaguacagcccaaugaugccgcccggcgcucagagcuacaugaacgucgcugccgcggccgccgccgccucgggcuacgggggcauggcgcccucagccacagcagccgcggccgccgccuacgggcagcagcccgccaccgccgcggccgcagcugcggccgcagccgccaugagccugggccccaugggcucgguagugaagucugagcccagcucgccgccgcccgccaucgcaucgcacucucagcgcgcgugccucggcgaccugcgcgacaugaucagcauguaccugccacccggcggggacgcggccgacgccgccucuccgcugcccggcggucgccugcacggcgugcaccagcacuaccagggcgccgggacugcagucaacggaacggugccgcugacccacaucugagcaccggccugcgcucguccacccuuguuccccacccccacccccacucccgccccgcacccccaaguugggacgccuuguuuagcuuugcuugccugggacuguugccuuguaccgaugauggggagggcugaaaguuuugcuguagcugucggguuuuguacaaaagcaaaaauaagucaggagcagcgaaaaugggacuucuagagagcucucuugccccacgccgcugcuccuuucaccuuuguaggcugggaaucgcuguguuauuugcaaagaaaaaacagcccccacuccuccuccugaguuccaggguuauucuguuacauuugaaaauguugucuuguuaguuugcaguuagccaaggagugaaugggagaaacauaguaucgggugaggccagcuggagaacugcaacgccuacgcccccagucgugucgcgucuguuuuccucgugguuuuuuggggcgcugaccgcuccaagcagcgcggcagcuaaagccaauguuaauuuauagccaggugugcgugugucucccgccucgccgccccuggccgcgggacagcuucuguccaaucauguugaguuggugauuucugccgugaucuguuugauauuucuucgcgcuaauguguucagauuucguuuggguaguggggaggggcuacuuuguuucaggguuuucaagcuuuuacucuuaauuccuaaaugagaucaauaaauuuuauaaccaacaugauggaguccugauaauuuugcggcccugaaacuuuuuugcagguuggggaggaaccaacacucgguuuuacaacugagaucccauccuaggggcggggugggaccuggggggaggcaagcauaaucugaaaugguuuccuuuuaacuacuggugauccaccauacacc

SEQ ID NO: 20315 - RNA, 2569 nt, Homo sapiens
acuggggagcggcuucagcacugcagccacgacccgccugguuaggcugcacgcggagagaacccucuguuuucccccacucucucuccaccuccuccugccuuccccaccccgagugcggagccagagaucaaaagaugaaaaggcagucaggucuucaguagccaaaaaacaaaacaaacaaaaacaaaaaagccgaaauaaaagaaaaagauaauaacucaguucuuauuugcaccuacuucaguggacacugaauuuggaagguggaggauuuuguuuuuuucuuuuaagaucugggcaucuuuugaaucuacccuucaaguauuaagagacagacugugagccuagcagggcagaucuuguccaccgugugucuucuucugcacgagacuuugaggcugucagagcgcuuuuugcgugguugcucccgcaaguuuccuucucuggagcuucccgcaggugggcagcuagcugcagcgacuaccgcaucaucacagccuguugaacucuucugagcaagagaaggggaggcgggguaagggaaguagguggaagauucagccaagcucaaggauggaagugcaguuagggcugggaagggucuacccucggccgccguccaagaccuaccgaggagcuuuccagaaucuguuccagagcgugcgcgaagugauccagaacccgggccccaggcacccagaggccgcgagcgcagcaccucccggcgccaguuugcugcugcugcagcagcagcagcagcagcagcagcagcagcagcagcagcagcagcagcagcagcagcagcagcagcaagagacuagccccaggcagcagcagcagcagcagggugaggaugguucuccccaagcccaucguagaggccccacaggcuaccugguccuggaugaggaacagcaaccuucacagccgcagucggcccuggagugccaccccgagagagguugcgucccagagccuggagccgccguggccgccagcaaggggcugccgcagcagcugccagcaccuccggacgaggaugacucagcugccccauccacguugucccugcugggccccacuuuccccggcuuaagcagcugcuccgcugaccuuaaagacauccugagcgaggccagcaccaugcaacuccuucagcaacagcagcaggaagcaguauccgaaggcagcagcagcgggagagcgagggaggccucgggggcucccacuuccuccaaggacaauuacuuagggggcacuucgaccauuucugacaacgccaaggaguuguguaaggcagugucgguguccaugggccuggguguggaggcguuggagcaucugaguccaggggaacagcuucggggggauugcauguacgccccacuuuugggaguuccacccgcugugcgucccacuccuugugccccauuggccgaaugcaaagguucucugcuagacgacagcgcaggcaagagcacugaagauacugcugaguauuccccuuucaagggagguuacaccaaagggcuagaaggcgagagccuaggcugcucuggcagcgcugcagcagggagcuccgggacacuugaacugccgucuacccugucucucuacaaguccggagcacuggacgaggcagcugcguaccagagucgcgacuacuacaacuuuccacuggcucuggccggaccgccgcccccuccgccgccuccccauccccacgcucgcaucaagcuggagaacccgcuggacuacggcagcgccugggcggcugcggcggcgcagugccgcuauggggaccuggcgagccugcauggcgcgggugcagcgggacccgguucugggucacccucagccgccgcuuccucauccuggcacacucucuucacagccgaagaaggccaguuguauggaccguguggugguggugggggugguggcggcggcggcggcggcggcggcggcggcggcggcggcggcggcggcggcgaggcgggagcuguagcccccuacggcuacacucggcccccucaggggcuggcgggccaggaaagcgacuucaccgcaccugaugugugguacccuggcggcauggugagcagagugcccuaucccagucccacuugugucaaaagcgaaaugggccccuggauggauagcuacuccggaccuuacggggacaugcgguaaguuuuuccuuccagaaaugucgccuuucggcccagggcagagucacucuguguucugggguaucuagcggcuccuaccugcgcgaacacucagauugccccugggagagcucagcaggguaaaccuagagcucucccguggacucccggccugccagagguuuaaccugagcucuccuaauuucugcugcgugcccugggugcugauuccugcccucccagauucuucaacucccccaaccgccccaaauucucacuaccuccugguacucgaggucccaaacagaaauccuauugcacgggccaccuucagagauaaagcucccaagcccuccacucuuccuuuccuccuguccucaaagucugagaaccuc

SEQ ID NO: 20316 - RNA, 2569 nt, Homo sapiens
gagguucucagacuuugaggacaggaggaaaggaagaguggagggcuugggagcuuuaucucugaagguggcccgugcaauaggauuucuguuugggaccucgaguaccaggagguagugagaauuuggggcgguugggggaguugaagaaucugggagggcaggaaucagcacccagggcacgcagcagaaauuaggagagcucagguuaaaccucuggcaggccgggaguccacgggagagcucuagguuuacccugcugagcucucccaggggcaaucugaguguucgcgcagguaggagccgcuagauaccccagaacacagagugacucugcccugggccgaaaggcgacauuucuggaaggaaaaacuuaccgcauguccccguaagguccggaguagcuauccauccaggggcccauuucgcuuuugacacaagugggacugggauagggcacucugcucaccaugccgccaggguaccacacaucaggugcggugaagucgcuuuccuggcccgccagccccugagggggccgaguguagccguagggggcuacagcucccgccucgccgccgccgccgccgccgccgccgccgccgccgccgccgccgccgccgccaccacccccaccaccaccacacgguccauacaacuggccuucuucggcugugaagagagugugccaggaugaggaagcggcggcugagggugacccagaaccgggucccgcugcacccgcgccaugcaggcucgccagguccccauagcggcacugcgccgccgcagccgcccaggcgcugccguaguccagcggguucuccagcuugaugcgagcguggggauggggaggcggcggagggggcggcgguccggccagagccaguggaaaguuguaguagucgcgacucugguacgcagcugccucguccagugcuccggacuuguagagagacaggguagacggcaguucaagugucccggagcucccugcugcagcgcugccagagcagccuaggcucucgccuucuagcccuuugguguaaccucccuugaaaggggaauacucagcaguaucuucagugcucuugccugcgcugucgucuagcagagaaccuuugcauucggccaauggggcacaaggagugggacgcacagcggguggaacucccaaaaguggggcguacaugcaauccccccgaagcuguuccccuggacucagaugcuccaacgccuccacacccaggcccauggacaccgacacugccuuacacaacuccuuggcguugucagaaauggucgaagugcccccuaaguaauuguccuuggaggaagugggagcccccgaggccucccucgcucucccgcugcugcugccuucggauacugcuuccugcugcuguugcugaaggaguugcauggugcuggccucgcucaggaugucuuuaaggucagcggagcagcugcuuaagccggggaaaguggggcccagcagggacaacguggauggggcagcugagucauccucguccggaggugcuggcagcugcugcggcagccccuugcuggcggccacggcggcuccaggcucugggacgcaaccucucucgggguggcacuccagggccgacugcggcugugaagguugcuguuccucauccaggaccagguagccuguggggccucuacgaugggcuuggggagaaccauccucacccugcugcugcugcugcugccuggggcuagucucuugcugcugcugcugcugcugcugcugcugcugcugcugcugcugcugcugcugcugcugcugcugcugcagcagcagcaaacuggcgccgggaggugcugcgcucgcggccucugggugccuggggcccggguucuggaucacuucgcgcacgcucuggaacagauucuggaaagcuccucgguaggucuuggacggcggccgaggguagacccuucccagcccuaacugcacuuccauccuugagcuuggcugaaucuuccaccuacuucccuuaccccgccuccccuucucuugcucagaagaguucaacaggcugugaugaugcgguagucgcugcagcuagcugcccaccugcgggaagcuccagagaaggaaacuugcgggagcaaccacgcaaaaagcgcucugacagccucaaagucucgugcagaagaagacacacgguggacaagaucugcccugcuaggcucacagucugucucuuaauacuugaaggguagauucaaaagaugcccagaucuuaaaagaaaaaaacaaaauccuccaccuuccaaauucaguguccacugaaguaggugcaaauaagaacugaguuauuaucuuuuucuuuuauuucggcuuuuuuguuuuuguuuguuuuguuuuuuggcuacugaagaccugacugccuuuucaucuuuugaucucuggcuccgcacucgggguggggaaggcaggaggagguggagagagagugggggaaaacagaggguucucuccgcgugcagccuaaccaggcgggucguggcugcagugcugaagccgcuccccagu

SEQ ID NO: 20317 - RNA, 2522 nt, Homo sapiens
aggaaagcccacuaaagccuuacgugggacuggacgaggagcagacaggcuguccuugacacggaggugggcacagagcaggacuucagggguccuguguguaaaaagaaaauggaaauacuuuccugggguacuugggacagggucagugggcugggguguugaccagacgcguggagaggagagcaggccggcagcucuugagagugccaacuucccacggguugagcucucugggaacaggacugagagggacccaacccuaaccgcacgagccgcacacucagauuggugccaucgggcgcgcggcguccuuaagagcucccugaaaccccgcccccuuccugcucugggggcgugguauggggcaaggaccccgccacugagcuugcuauuggcuaagagagcaggguuggccuugcguucgccugagcaagggaguagacagcacagcggcagcggagggagucuaugcgagcuggacagcagugggagguuugugaggcucgcacuggccgcagacccucgggcucgaucgcccgggagccaggacucggcgacgcgaggcugccgggcuacccggccgaggcuucgggggcgcaaacuaaugggacuggcucgcucggcagcaucuccccgcucuucuaaguacacugagcagggcccgcgcugaaguagaagcuguccgggggcgcguagcccggagucccaguguggcccggaggaacggagcccgugccagggcggcccagucgggagcccggggaccgagcuugugcuguggggaaacccccacuucuuccaagggacagcgaucccgggacggucgaggcgucggggcggucaccgagaccucugcgggaagaccccgucggggagagggcgcgcagccccgaagcgucucgggaagucgagcggaaucgggcgggaucacccgggggcgcagagcccccgucgcgccucgugcggcagcggagagcccaggagaacgagcccucgggggccgaagcccaugcccggguugggggcggcugcccagugaguccuccuggccggccgggcggagaagagcgacaccgaagccggcgggaggggagcacuucaaggccggcggcugcggaggaugggcgccugagcggcuccgagcgcagcgcggcagaggaaggcgaggcgagcuuuggugaggaggcgccaagggaucccgaagugcagucugcccccgggaagauggcucggccugggcagcguuggcucggcaaguggcuuguggcgauggucgugugggcgcugugccggcucgccacaccgcuggccaagaaccuggagcccguauccuggagcucccucaaccccaagugaguaacuuaucuccucuggacgcuggggugggaggcacuccuucagggugaggccgcacgccccggagugcauguggggaggucuucggaggaggagcggcgccucauuuugucuccggcuuuuucgaguguuuuccugcgggcgggcggauggagcagggugcggcggggugggguaggggcacuuggcuggguugugaccccccgggcuucccacccccugccucugcacgucuuggaugaagucgagguggucgcacaggcggagcuggggaguccgggcgcccgagagcgcaccggagaacugaguggaggcgagaacgcagcucccuccggggccccugggaacguggugauuuucgccgagagccgcuccaggagcgagcuugacucgggcgagggacgaggccagaacacggguuccucguuugcguagcuguggagggaacacagagcgggacccggcgcuugggguggguggcagcgccaacauccccacucgggcuucucccauuuucauuucucuuucuucccuguuuuccucccuggcuuuuugcuuugcugucucuuuuugccccccgccccuccuuucucccugccggagcgguagaaaggcgggcgcugcucccaggcucacaaaggcagcggguggagaggggcggagugggagaguggucguuggguaguggggguucgaaccagugcccgucagggguccaauggagccgguaacagagcuucaagggcccgccagggcggagaguggcggccgagcuguugagggagguggguggagaaggagcgauuccugcccaggcagguccccuuggcccccgagucugucccccagauugggaagcugugcuuaguuuuccccaagggguuggggcggggagugggcagcuauauaaaggacauccuuucuuuucuuucuucuccuuccucugcacaacuaccccaccaccaccacacacacaaccccuccaaacaacacgcacaccuuucagggcgguggcucagugguuucugggcuuuuagugggaagucgcuggggcuguuguagugaccucuggaccuucucuuuuggcauccaggacucagguuggaaccaagggucaaaauugcccuuccucucaauuuucuggaggucccagcaaugugcga

SEQ ID NO: 20318 - RNA, 2522 nt, Homo sapiens
ucgcacauugcugggaccuccagaaaauugagaggaagggcaauuuugacccuugguuccaaccugaguccuggaugccaaaagagaagguccagaggucacuacaacagccccagcgacuucccacuaaaagcccagaaaccacugagccaccgcccugaaaggugugcguguuguuuggagggguuguguguguggugguggugggguaguugugcagaggaaggagaagaaagaaaagaaaggauguccuuuauauagcugcccacuccccgccccaaccccuuggggaaaacuaagcacagcuucccaaucugggggacagacucgggggccaaggggaccugccugggcaggaaucgcuccuucuccacccaccucccucaacagcucggccgccacucuccgcccuggcgggcccuugaagcucuguuaccggcuccauuggaccccugacgggcacugguucgaacccccacuacccaacgaccacucucccacuccgccccucuccacccgcugccuuugugagccugggagcagcgcccgccuuucuaccgcuccggcagggagaaaggaggggcggggggcaaaaagagacagcaaagcaaaaagccagggaggaaaacagggaagaaagagaaaugaaaaugggagaagcccgaguggggauguuggcgcugccacccaccccaagcgccgggucccgcucuguguucccuccacagcuacgcaaacgaggaacccguguucuggccucgucccucgcccgagucaagcucgcuccuggagcggcucucggcgaaaaucaccacguucccaggggccccggagggagcugcguucucgccuccacucaguucuccggugcgcucucgggcgcccggacuccccagcuccgccugugcgaccaccucgacuucauccaagacgugcagaggcagggggugggaagcccggggggucacaacccagccaagugccccuaccccaccccgccgcacccugcuccauccgcccgcccgcaggaaaacacucgaaaaagccggagacaaaaugaggcgccgcuccuccuccgaagaccuccccacaugcacuccggggcgugcggccucacccugaaggagugccucccaccccagcguccagaggagauaaguuacucacuugggguugagggagcuccaggauacgggcuccagguucuuggccagcgguguggcgagccggcacagcgcccacacgaccaucgccacaagccacuugccgagccaacgcugcccaggccgagccaucuucccgggggcagacugcacuucgggaucccuuggcgccuccucaccaaagcucgccucgccuuccucugccgcgcugcgcucggagccgcucaggcgcccauccuccgcagccgccggccuugaagugcuccccucccgccggcuucggugucgcucuucuccgcccggccggccaggaggacucacugggcagccgcccccaacccgggcaugggcuucggcccccgagggcucguucuccugggcucuccgcugccgcacgaggcgcgacgggggcucugcgcccccgggugaucccgcccgauuccgcucgacuucccgagacgcuucggggcugcgcgcccucuccccgacggggucuucccgcagaggucucggugaccgccccgacgccucgaccgucccgggaucgcugucccuuggaagaaguggggguuuccccacagcacaagcucgguccccgggcucccgacugggccgcccuggcacgggcuccguuccuccgggccacacugggacuccgggcuacgcgcccccggacagcuucuacuucagcgcgggcccugcucaguguacuuagaagagcggggagaugcugccgagcgagccagucccauuaguuugcgcccccgaagccucggccggguagcccggcagccucgcgucgccgaguccuggcucccgggcgaucgagcccgagggucugcggccagugcgagccucacaaaccucccacugcuguccagcucgcauagacucccuccgcugccgcugugcugucuacucccuugcucaggcgaacgcaaggccaacccugcucucuuagccaauagcaagcucaguggcgggguccuugccccauaccacgcccccagagcaggaagggggcgggguuucagggagcucuuaaggacgccgcgcgcccgauggcaccaaucugagugugcggcucgugcgguuaggguugggucccucucaguccuguucccagagagcucaacccgugggaaguuggcacucucaagagcugccggccugcucuccucuccacgcgucuggucaacaccccagcccacugacccugucccaaguaccccaggaaaguauuuccauuuucuuuuuacacacaggaccccugaaguccugcucugugcccaccuccgugucaaggacagccugucugcuccucguccagucccacguaaggcuuuagugggcuuuccu

SEQ ID NO: 20319 - RNA, 2523 nt, Homo sapiens
guagaauggugaauuggugccuggaaggccuuccagaagugggacucgauucugguuccuccgucugcuaggcuguauuaugggaggugaugcacccaggaaguuuucggcgugguaaccacuuguggggccagaagucugggaugacgcgugaacaaaggucggcuccaucuccaucagcucaucuaggucaucaucuugggccucauccaguggcuccuccuccaccucaccauaggucuccucagucccuggauccugcuguggcucuccuucugguuucuggcccccauccucaucuucaucuucuucauccuuacucucuccuuccuccucauucuuguuccuuaucuccuccuccuccucuuucuguuucauuuccucuuccuccuccuccuccuucucuuccuucuucuucauuucuuccuccuucuucaucuccuccuccuccuucuccuucaucucuugcugaaaagcccucaugcgcuuccucugguccuuggagugaagccugugccugcgugccucuuggucuucaucuucacuguaguacucuucaucuucacuuucuuccucauugggacucggagcaaaagggaagaugauauuucgaacuccagggagcgggauaggcuugggaacgcgcacuuuucuuucuaucuccacacauucgagaaucagcucauccaggucggccauuucuguugaccauaagagcucuuugcggaagaauuccgacaggccuuugaggaauugguuuuggaggcggcagucaucccaagacaagaauugggccaggaacugaaaagcaucugcauagcugccgaggguacaguggcccugcuugagcuugcgaauggccuuuuuagccacacguggggggauggggccacagaauuccuuacggauuucauccaggaagcgcgggaaguuggcaugcaaggggcuuccuuccugggugaccgagauggcccaguccuuggcuucgccagugaaaaaggagaucagaaaggccacccgcucggcgcccccggggaaaugaaccucauggucggcuaugaaggucucuagcugcaucaggaauucagccagguagacugggucuccugaaaagggcucuaucucaggccgcuccagcggugccagaggggguugcgggggcgguuccuuugacgcgggcggaggcagcgccggcgggggcgggaugggcagcagaggggggucagcgggcccgucgggggugcugcgauccuggaucacguuaaucaaaagaucauccgagauacagucgggcuccgcgcgugggggaggccggcacaagaagggcaguucucccccgggaaugacuucgaucucacugagcgcgaacuccaaguucuccuccgcaaggacgggcacuauggguacuggccagcggauguagcuggagacauugccccgcaaggaauuaaccucggccagggcucucccgagcuggaggcccaaauuggcauucuccccgcgaagggcauuuaauucuucgcgcagggccacauucgccaugcggaggcuguugagauuuccugacgccucagacaucucgacaagcccaggggcccuggggcuccgugguggggaaaggggaacuggaacuacgggcggccggaggaggccgaaaugcggcggcggggcucgggagggaccgaagugcggcagcggggcacgggccaggccgggccacacccaccggggcgagcucggagggcggcgcucugggcggagggcccggcggcucggcccagggcgcguuaccucgucgccggggccggagagggcgggcggaggcacggggcccggaggcgccaggcggaggaugcgggcgacacgguggcggcggcgaccgcgcgaccgggcgggcgggcgggcaggggcgagcggagcgggagggagcggacugcggcaggaucugucgaggaaaaaucuugcggccggcgauuccccgccuuuuaagcgcagccucgcacuccccccaccccacgcaggggcgggccuuggggaaccgcgggcgcccacuggccgccgcgcgccgcuccccuccagcucgccugcgccucucacugacucucuccuucccuagcugcagcuaacucgggucgggaaaaugcgacagcgacugcccacucgaggucgucauggcgacagccagugaacguguuccucuccucgggcaggcccccgaguguagaggagcugcuucgggaggcgcagcucaaucuccagagccuguugcaagguaccgagagggaggggggcugcggccggagcccagaagcgagaugcgcagcggcaggagggaggcaaagaagaaagaggacagggaccagcaagauaaagacagagaguuuaaaaacaaucgacaaagcaguuuccagcuuucaccuuucagccuaaugauucugaaagaggcuauuuccagggcuguuuccccccauccccagccccuuuuuucagcucaguagcccauggggaaacaaggacagagac

SEQ ID NO: 20320 - RNA, 2523 nt, Homo sapiens
gucucuguccuuguuuccccaugggcuacugagcugaaaaaaggggcuggggauggggggaaacagcccuggaaauagccucuuucagaaucauuaggcugaaaggugaaagcuggaaacugcuuugucgauuguuuuuaaacucucugucuuuaucuugcuggucccuguccucuuucuucuuugccucccuccugccgcugcgcaucucgcuucugggcuccggccgcagccccccucccucucgguaccuugcaacaggcucuggagauugagcugcgccucccgaagcagcuccucuacacucgggggccugcccgaggagaggaacacguucacuggcugucgccaugacgaccucgagugggcagucgcugucgcauuuucccgacccgaguuagcugcagcuagggaaggagagagucagugagaggcgcaggcgagcuggaggggagcggcgcgcggcggccagugggcgcccgcgguuccccaaggcccgccccugcgugggguggggggagugcgaggcugcgcuuaaaaggcggggaaucgccggccgcaagauuuuuccucgacagauccugccgcaguccgcucccucccgcuccgcucgccccugcccgcccgcccgcccggucgcgcggucgccgccgccaccgugucgcccgcauccuccgccuggcgccuccgggccccgugccuccgcccgcccucuccggccccggcgacgagguaacgcgcccugggccgagccgccgggcccuccgcccagagcgccgcccuccgagcucgccccgguggguguggcccggccuggcccgugccccgcugccgcacuucggucccucccgagccccgccgccgcauuucggccuccuccggccgcccguaguuccaguuccccuuuccccaccacggagccccagggccccugggcuugucgagaugucugaggcgucaggaaaucucaacagccuccgcauggcgaauguggcccugcgcgaagaauuaaaugcccuucgcggggagaaugccaauuugggccuccagcucgggagagcccuggccgagguuaauuccuugcggggcaaugucuccagcuacauccgcuggccaguacccauagugcccguccuugcggaggagaacuuggaguucgcgcucagugagaucgaagucauucccgggggagaacugcccuucuugugccggccucccccacgcgcggagcccgacuguaucucggaugaucuuuugauuaacgugauccaggaucgcagcacccccgacgggcccgcugaccccccucugcugcccaucccgcccccgccggcgcugccuccgcccgcgucaaaggaaccgcccccgcaacccccucuggcaccgcuggagcggccugagauagagcccuuuucaggagacccagucuaccuggcugaauuccugaugcagcuagagaccuucauagccgaccaugagguucauuuccccgggggcgccgagcggguggccuuucugaucuccuuuuucacuggcgaagccaaggacugggccaucucggucacccaggaaggaagccccuugcaugccaacuucccgcgcuuccuggaugaaauccguaaggaauucuguggccccauccccccacguguggcuaaaaaggccauucgcaagcucaagcagggccacuguacccucggcagcuaugcagaugcuuuucaguuccuggcccaauucuugucuugggaugacugccgccuccaaaaccaauuccucaaaggccugucggaauucuuccgcaaagagcucuuauggucaacagaaauggccgaccuggaugagcugauucucgaauguguggagauagaaagaaaagugcgcguucccaagccuaucccgcucccuggaguucgaaauaucaucuucccuuuugcuccgagucccaaugaggaagaaagugaagaugaagaguacuacagugaagaugaagaccaagaggcacgcaggcacaggcuucacuccaaggaccagaggaagcgcaugagggcuuuucagcaagagaugaaggagaaggaggaggaggagaugaagaaggaggaagaaaugaagaagaaggaagagaaggaggaggaggaggaagaggaaaugaaacagaaagaggaggaggaggagauaaggaacaagaaugaggaggaaggagagaguaaggaugaagaagaugaagaugaggaugggggccagaaaccagaaggagagccacagcaggauccagggacugaggagaccuauggugagguggaggaggagccacuggaugaggcccaagaugaugaccuagaugagcugauggagauggagccgaccuuuguucacgcgucaucccagacuucuggccccacaagugguuaccacgccgaaaacuuccugggugcaucaccucccauaauacagccuagcagacggaggaaccagaaucgagucccacuucuggaaggccuuccaggcaccaauucaccauucuac

SEQ ID NO: 20321 - RNA, 2641 nt, Homo sapiens
gggcugggaauguugggcuuuucaagcguguucgaagcucccuaauugguacuaaauuucaggcauucagacccucuaggaaagaguucuuucuagcucacaacauuaggggaggaguuagacacauaaauggagaaagugauagaagagacauggucagggauggggguucuacccuuccagagacaaugcacauuuucuuugaaacagcuucgggaaaacugcaaaucucaaugauauuuaccaauuuugagaaucuauuaagugccuggcacucuguguagaagcccuccaaucguacccuaaaucugagaaguauuuauuauuauuuccauuuuuacucccuaaugcaucuacucuaagcuccuugcuucacccuaccaaaguuucccuucugcuagugcucuccuuuggugcagaaccaccgcauccacuuucucaggcccaggggaggggcggggcggggcgauuucgccuugccgcagagccagucugcgccugcgcggacugcggcagagggcggggugugagaagcagaguacagugagacuagcauucacugcuggccagugccugccuuuuucaccaccucuaauuucagcuucagcaguugcuuggaacuuugguucuggcagcagcagcaacaucauuaccgcuagcggcaguuuugugccgaggcaccuacacaccucccguccucucugccagaucgcgggccugucggugucugcuccuacacgccaacgccggugggcaggaccaugucucugguaagccagaauucgcgccgccgccgccgccgcguugcaaaggcuacugcgcacaacagcagcuggggcgaaaugcaggccccuaaugcccccggucuccccgcugaugugccaggcucagacgucccccagggucccagcgauucccagauccuccagggccucugcgccucugagggcccaagcaccuccguucugcccaccuccgcugagggcccaagcaccuuugugccgcccaccaucucugaggccucaagcgccuccgggcagcccaccaucucugagggaccuggcaccuccgugcugcccacccccagugagggccuaagcaccuccgggccucccaccaucucuaaggggcugugcaccucugugacgcuugccgccucugagggccggaacaccuccaggccgcccacuuccucugaggaaccuagcaccuccgugccgcccaccgccucugagguaccgagcaccucccugccgcccaccccuggugagggaacgagcaccuccgugccgcccacagccuaugagggaccaagcaccuccguggugcccaccccugaugagggaccaagcaccuccgugcugccuacaccuggugagggaccaggcaccuccgugccgcucgccgccacugagggccugagcaccuccgugcaggccacuccugaugagggaccgagcaccuccgugccgcccaccgccacugagggccuaagcacccccgugccacccacccgugaugagggaccgagcaccuccgugccggccacuccuggugagggaccgagcaccuccgugcugcccgccgccucugacggacaaagcaucuccuuggugcccacccgcgguaagggaucaagcaccuccgugccccccaccgccaccgagggccugagcaccuccgugcagcccacugcuggugagggaucgagcaccuccgugccgcccaccccuggugggggacugagcaccuccgugccgcccaccgccacugaggaguugagcaccuccgugccgcccacucccggugagggaccaagcacuuccguacugccaauccccggugagggacugagcaccucugugccgcccaccgccucugauggaucggacaccuccgugccgcccacuccuggugagggcgcaagcaccuuagugcagcccaccgccccugacggaccgggaagcuccgugcugccuaacccuggugagggcccgagcacauuguuuagcucuagugcuucuguggaccggaaccccuccaaguguucccuuguuuugccaagcccuaggguaaccaaggccuccguggacucagauucugaggguccuaagggugcagaaggcccuauagaauucgagguccugagagacugugagagccccaacuccauuaguauuaugggccucaauacuucccggguugcaauuacccugaagccccaagacccuauggaacagaacguagcugagcuguugcaguuccugcuggugaaggaucagagcaaguacccuauccgggagucugaaaugcgggaauauauuguuaaagaauaucgcaaccaguuuccugagauacucaggcgagcagcagcccaccuggagugcauuuuuagguuugaauugagagaacuugacccugaggcacacaccuacauucuguuaaacaaacugggaccugugcccuuugaaggguuagaagagagcccaaaugggccaaagaugggccuccugaugaugauucuaggccaaauauuccugaauggcaaccaagccaaggaggcugagauuugggaaaugcucuggaggaugggggugcagcgggaaaggaggcuuuccauuuuugggaacccaaagagacu

SEQ ID NO: 20322 - RNA, 2641 nt, Homo sapiens
agucucuuuggguucccaaaaauggaaagccuccuuucccgcugcacccccauccuccagagcauuucccaaaucucagccuccuuggcuugguugccauucaggaauauuuggccuagaaucaucaucaggaggcccaucuuuggcccauuugggcucucuucuaacccuucaaagggcacaggucccaguuuguuuaacagaauguaggugugugccucagggucaaguucucucaauucaaaccuaaaaaugcacuccaggugggcugcugcucgccugaguaucucaggaaacugguugcgauauucuuuaacaauauauucccgcauuucagacucccggauaggguacuugcucugauccuucaccagcaggaacugcaacagcucagcuacguucuguuccauagggucuuggggcuucaggguaauugcaacccgggaaguauugaggcccauaauacuaauggaguuggggcucucacagucucucaggaccucgaauucuauagggccuucugcacccuuaggacccucagaaucugaguccacggaggccuugguuacccuagggcuuggcaaaacaagggaacacuuggagggguuccgguccacagaagcacuagagcuaaacaaugugcucgggcccucaccaggguuaggcagcacggagcuucccgguccgucaggggcggugggcugcacuaaggugcuugcgcccucaccaggagugggcggcacggagguguccgauccaucagaggcggugggcggcacagaggugcucagucccucaccggggauuggcaguacggaagugcuuggucccucaccgggagugggcggcacggaggugcucaacuccucaguggcggugggcggcacggaggugcucagucccccaccaggggugggcggcacggaggugcucgaucccucaccagcagugggcugcacggaggugcucaggcccucgguggcgguggggggcacggaggugcuugaucccuuaccgcgggugggcaccaaggagaugcuuuguccgucagaggcggcgggcagcacggaggugcucggucccucaccaggaguggccggcacggaggugcucggucccucaucacggguggguggcacgggggugcuuaggcccucaguggcggugggcggcacggaggugcucggucccucaucaggaguggccugcacggaggugcucaggcccucaguggcggcgagcggcacggaggugccuggucccucaccagguguaggcagcacggaggugcuuggucccucaucaggggugggcaccacggaggugcuuggucccucauaggcugugggcggcacggaggugcucguucccucaccaggggugggcggcagggaggugcucgguaccucagaggcggugggcggcacggaggugcuagguuccucagaggaagugggcggccuggagguguuccggcccucagaggcggcaagcgucacagaggugcacagccccuuagagauggugggaggcccggaggugcuuaggcccucacugggggugggcagcacggaggugccaggucccucagagauggugggcugcccggaggcgcuugaggccucagagauggugggcggcacaaaggugcuugggcccucagcggaggugggcagaacggaggugcuugggcccucagaggcgcagaggcccuggaggaucugggaaucgcugggacccugggggacgucugagccuggcacaucagcggggagaccgggggcauuaggggccugcauuucgccccagcugcuguugugcgcaguagccuuugcaacgcggcggcggcggcggcgcgaauucuggcuuaccagagacaugguccugcccaccggcguuggcguguaggagcagacaccgacaggcccgcgaucuggcagagaggacgggagguguguaggugccucggcacaaaacugccgcuagcgguaaugauguugcugcugcugccagaaccaaaguuccaagcaacugcugaagcugaaauuagagguggugaaaaaggcaggcacuggccagcagugaaugcuagucucacuguacucugcuucucacaccccgcccucugccgcaguccgcgcaggcgcagacuggcucugcggcaaggcgaaaucgccccgccccgccccuccccugggccugagaaaguggaugcggugguucugcaccaaaggagagcacuagcagaagggaaacuuugguagggugaagcaaggagcuuagaguagaugcauuagggaguaaaaauggaaauaauaauaaauacuucucagauuuaggguacgauuggagggcuucuacacagagugccaggcacuuaauagauucucaaaauugguaaauaucauugagauuugcaguuuucccgaagcuguuucaaagaaaaugugcauugucucuggaaggguagaacccccaucccugaccaugucucuucuaucacuuucuccauuuaugugucuaacuccuccccuaauguugugagcuagaaagaacucuuuccuagagggucugaaugccugaaauuuaguaccaauuagggagcuucgaacacgcuugaaaagcccaacauucccagccc

SEQ ID NO: 20323 - RNA, 2720 nt, Homo sapiens
cuugucuuuuaauaagccacuucaaaaaaguuauuggcuaggugcaguggcucacaccuguaaucccagcacuuugggaggccgagacaggcggaucacuugaggucaggaguuugagaaccuccuggccaacauggugaaaccccccgucucuacuaaaaauacaaaaauuaacugggcaugauggggcacaucuguaaucccagcuacucaggaggcuacuugggaggcugaggcaggagaaucgcuugaacccaggaggcagaggcuucaguaagccuugauugugccacuguacuccagccugggugacacagugagacucugucucaaaaaaaguaaaauaaaaacaauuauuaagguggcuucuaaaaauuagguuugauaauagcuaaaagggaugggccuuaaagguuuuuuaaagugcauccugaaagacugcauugugaucuuugaaagugcuucagaaauaagaaaaaaggagggauaaguaauaaaguagguauaacuuuugaaacacuugaaaaaacaacccauuuagccauauaaacauuuucuucacccauaaucacacauaucaaauuggaacugguuacauagauauaaauaucacaaccacccaacccccaaauccaaacaucauuuccaaaagcaaaagaaaaaggauuccuucuccauaugguacugggucuuaaggcuggaaucucugagagaagagucuugcguuauuguuuaaacaaccuuuauuaccugccucugacauuccccaggguuacagagcagggggcaucugagccucaaguuccacggaugaagcagacacugcaauaacaacugaaucaauagaggagaggcauuuggaaguacuggggugauacacccaguaaugguaauccucagcagaagauggcauagcuaccaaaaaucaggcguuaccacugggaugaaaacuggggaggcaagaaaaucauacgguuggagucauagaucauuucccuccccguugagcacuccucccccuuccgucccccauuaaguucauucuaucccacagacugguccuaguguccugcuagcucccugcugaaagagagagggagggaaaagaugucugaggucucuucauuuccuuugucucugucccuaaggcaacuggaagcuggagcugcugcagucggccuggcaagcccguuggcucugcagagugagcagucccuggcagccccuggagcagcugccaguuagacggcccagaguucugauagaaugcauugcuucaguucagugccaaguguuggacguguuggauucaguucccagagggcuggagcgugcugucagggcugucugaagacaagagagcagaggcaguuuagugcaguuggaugugcgggguagggguggaggcgcaggggugaagagggagaaacuggcccgaauggguaagguggugcuucuccuuccagggccuuccagacaaggucuccuggccucucaccauuaucugggccucagaugaggcgaacccuggaagggaguuggggguggaaggugggaggcgcgcccagggaugagcgagaugaggagggcgcgaaccagcaaucuggggcugugguuuuagacccgcucagcgcccugggcgagggcaggcagccccucggaggcaagcuggcggcggcccucggccugggagcccgcggcagccucggcgucggcggucagggcgccucccggggcccauucgugcucggcgcaagccugggacggcucguccuuggccucgacgagcuuacgggagcggguguaggccaggaugaggccuccggccaagcaggcguagaagaucaugaugagcaggauguagagauaggcgucgucgcccuuggcgcuggucaccucgcggcccacgaaagggucaggcacgacccccaugcccaugcugggacgagggccagcgcccaagccgcuggcauuaccccgguggugcagcucgagcaacaggcggcucagaaggguucgcagccgcuggcucucgcugcaguucauggcuuucggggagugacacggcggcuccaggacgcugcugaccuuucccccugggcgaggggaagcgagcuagcgagcgggccggccggcgggcagggcucagcagcggaaacagcgguagcacccagcucuccggcgagcgcgcaguggcugggggcgccgacggcggggccuccuuauucccucacucccgccccuccuccccuuccccaccacgcccccuccggcccgcggccgccucuucccaggcucuggcugucucgcugcuccagggaaaggggacagcugguggggggaggagaaggggacaagagugggggcgaggcugggagacgggcggagggggcgggggcucggaaugcgcgaggccccaggcagcagacgcuggcagggcagcuugcuggggccaagccuggacccugggcugcggaagagaauuccuuccaaguucuggccaccugcccugcaggccaggcuuuggcccagauacagcauuuggcccccuaaggcagcucugccuuggggcgcucaagggagagggcagacgccuuuccgcagcagagaccccuuguccacauuuuauggaaguuacucccauauacagggacccaggccuaucuuucuaguccucauuccuuuccuuuuccccccgccccccuuuucaccccccuccc

SEQ ID NO: 20324 - RNA, 2720 nt, Homo sapiens
gggaggggggugaaaaggggggcggggggaaaaggaaaggaaugaggacuagaaagauaggccugggucccuguauaugggaguaacuuccauaaaauguggacaaggggucucugcugcggaaaggcgucugcccucucccuugagcgccccaaggcagagcugccuuagggggccaaaugcuguaucugggccaaagccuggccugcagggcagguggccagaacuuggaaggaauucucuuccgcagcccaggguccaggcuuggccccagcaagcugcccugccagcgucugcugccuggggccucgcgcauuccgagcccccgcccccuccgcccgucucccagccucgcccccacucuuguccccuucuccuccccccaccagcuguccccuuucccuggagcagcgagacagccagagccugggaagaggcggccgcgggccggagggggcgugguggggaaggggaggaggggcgggagugagggaauaaggaggccccgccgucggcgcccccagccacugcgcgcucgccggagagcugggugcuaccgcuguuuccgcugcugagcccugcccgccggccggcccgcucgcuagcucgcuuccccucgcccagggggaaaggucagcagcguccuggagccgccgugucacuccccgaaagccaugaacugcagcgagagccagcggcugcgaacccuucugagccgccuguugcucgagcugcaccaccgggguaaugccagcggcuugggcgcuggcccucgucccagcaugggcaugggggucgugccugacccuuucgugggccgcgaggugaccagcgccaagggcgacgacgccuaucucuacauccugcucaucaugaucuucuacgccugcuuggccggaggccucauccuggccuacacccgcucccguaagcucgucgaggccaaggacgagccgucccaggcuugcgccgagcacgaaugggccccgggaggcgcccugaccgccgacgccgaggcugccgcgggcucccaggccgagggccgccgccagcuugccuccgaggggcugccugcccucgcccagggcgcugagcgggucuaaaaccacagccccagauugcugguucgcgcccuccucaucucgcucaucccugggcgcgccucccaccuuccacccccaacucccuuccaggguucgccucaucugaggcccagauaauggugagaggccaggagaccuugucuggaaggcccuggaaggagaagcaccaccuuacccauucgggccaguuucucccucuucaccccugcgccuccaccccuaccccgcacauccaacugcacuaaacugccucugcucucuugucuucagacagcccugacagcacgcuccagcccucugggaacugaauccaacacguccaacacuuggcacugaacugaagcaaugcauucuaucagaacucugggccgucuaacuggcagcugcuccaggggcugccagggacugcucacucugcagagccaacgggcuugccaggccgacugcagcagcuccagcuuccaguugccuuagggacagagacaaaggaaaugaagagaccucagacaucuuuucccucccucucucuuucagcagggagcuagcaggacacuaggaccagucugugggauagaaugaacuuaaugggggacggaagggggaggagugcucaacggggagggaaaugaucuaugacuccaaccguaugauuuucuugccuccccaguuuucaucccagugguaacgccugauuuuugguagcuaugccaucuucugcugaggauuaccauuacuggguguaucaccccaguacuuccaaaugccucuccucuauugauucaguuguuauugcagugucugcuucauccguggaacuugaggcucagaugcccccugcucuguaacccuggggaaugucagaggcagguaauaaagguuguuuaaacaauaacgcaagacucuucucucagagauuccagccuuaagacccaguaccauauggagaaggaauccuuuuucuuuugcuuuuggaaaugauguuuggauuuggggguugggugguugugauauuuauaucuauguaaccaguuccaauuugauaugugugauuaugggugaagaaaauguuuauauggcuaaauggguuguuuuuucaaguguuucaaaaguuauaccuacuuuauuacuuaucccuccuuuuuucuuauuucugaagcacuuucaaagaucacaaugcagucuuucaggaugcacuuuaaaaaaccuuuaaggcccaucccuuuuagcuauuaucaaaccuaauuuuuagaagccaccuuaauaauuguuuuuauuuuacuuuuuuugagacagagucucacugugucacccaggcuggaguacaguggcacaaucaaggcuuacugaagccucugccuccuggguucaagcgauucuccugccucagccucccaaguagccuccugaguagcugggauuacagaugugccccaucaugcccaguuaauuuuuguauuuuuaguagagacgggggguuucaccauguuggccaggagguucucaaacuccugaccucaagugauccgccugucucggccucccaaagugcugggauuacaggugugagccacugcaccuagccaauaacuuuuuugaaguggcuuauuaaaagacaag

SEQ ID NO: 20325 - RNA, 841 nt, Homo sapiens
ccauggagggccagagcguggaggagcugcucgcaaaggcagagcaggacgaggcagagaaguugcaacgcaucacggugcacaaggagcuggagcugcaguuugaccugggcaaccugcuggcgucggaccggaaccccccgaccgggcugcggugcgccggacccacgccggaggccgagcuacaggcccuggcgcgggacaacacgcaacugcucaucaaccagcuguggcagcugcccacggagcgcguggaagaggcgauaguggcgcggcugccggagcccaccacacgccugccgcgagagaagccucugccccgaccgcggccacuuacacgcuggcagcaguucgcgcgccucaagggcauccgucccaagaagaagaccaaccuggugugggacgaggugaguggccaguggcggcggcgcuggggcuaccagcgcgcccgggacgacaccaaagaauggcugauugaggugcccggcaaugccgaccccuuggaggaccaguucgccaagcggauucaggccaagaaggaaaggguggccaagaacgagcugaaccggcugcguaaccuggcccgcgcgcacaagaugcagcugcccagcgcggccggcuugcacccuaccggacaccagaguaaggaggagcugggccgcgccaugcaaguggccaaggucuccaccgccucuguggggcgcuuucaggagcgccuccccaaggagaaggugccccggggcuccggcaagaaaaggaaguuucaaccccuuuucggggacuuugcagccgagaaaaagaaccaguuggagcugcuucgugucaugaacagcaagaagcc

SEQ ID NO: 20326 - RNA, 841 nt, Homo sapiens
ggcuucuugcuguucaugacacgaagcagcuccaacugguucuuuuucucggcugcaaaguccccgaaaagggguugaaacuuccuuuucuugccggagccccggggcaccuucuccuuggggaggcgcuccugaaagcgccccacagaggcgguggagaccuuggccacuugcauggcgcggcccagcuccuccuuacucugguguccgguagggugcaagccggccgcgcugggcagcugcaucuugugcgcgcgggccagguuacgcagccgguucagcucguucuuggccacccuuuccuucuuggccugaauccgcuuggcgaacugguccuccaaggggucggcauugccgggcaccucaaucagccauucuuuggugucgucccgggcgcgcugguagccccagcgccgccgccacuggccacucaccucgucccacaccagguuggucuucuucuugggacggaugcccuugaggcgcgcgaacugcugccagcguguaaguggccgcggucggggcagaggcuucucucgcggcaggcguguggugggcuccggcagccgcgccacuaucgccucuuccacgcgcuccgugggcagcugccacagcugguugaugagcaguugcguguugucccgcgccagggccuguagcucggccuccggcguggguccggcgcaccgcagcccggucgggggguuccgguccgacgccagcagguugcccaggucaaacugcagcuccagcuccuugugcaccgugaugcguugcaacuucucugccucguccugcucugccuuugcgagcagcuccuccacgcucuggcccuccaugg

SEQ ID NO: 20327 - RNA, 2956 nt, Homo sapiens
uugugaccacguuuccaugggggaaaaugugaauagacguaguuacaguagcauuuggaugagacgccuucaagcaccuauacuuuuucgggggaacuugauggaauccaauuuaauuaccugaagaaauuauuugcugaagaaagucuuuccucuuuuuaggguaguuacaguuaaaggcgcagggguaacgaaauccuaacccagagaggagcagagcauguuugggacauaacaaaggaucugaguaguaaacgcagcgaguguuugggguuuuauucagaccgggcugacggugugugucgccgccacgcaccgcugccuguucgaacgcauggcugagcugccgaccggcucgcuaccccaaacaccguacgccacccaacuccucuuguaacgccaucgcgcguggcauuguguuggguucugcguguguggcaucggagucguggaauuuagggggaacaaggcuuuuccccccguccccccggggucucccuugggugggggcgacacggccaaggcggcgcgcccugggggugcccgggggcgcuucuuccccagggcguuacgcaccggcggcccggcgcggaggugcgcgggggcgaucgggagaugcggggcgggcgagggguggugggaugggcgccgccuuaacuucgauccugcggcggcccgagagaagccgucgccgccccgcccgagcugggugccgcggcacucugcucugcgccgcgcgucuccgcggcugccucuuuaaucaggaacacagaaggggcgggcccugagccggcgcguaaucggauagcucugccgcggcucugacauccacaugcugcucggccugaaaaggcaguggggagccggaggggaggcagagaucgcgagcgaggcaccagccugcagccggcccccagcacauccucagccgcacagacacucggcgagguggaggugagggcgggcgccagcgaacucggagaggggcucgcucacucccaggcgaucccagccgccaccgccgccgcaccagcagcagcaacagcagcagcagcuuccuuccucagacuccccucgagaggcuggccaagcggguguagccguugggggaggcucccgccgggggaacccggcgaggacaagagcagggcggccgccuuccacucgggcuguccggcggcggcugccuccgcccguguguccgucaagggugccgcgggaugugugucaguuuacgccucugagaucacacagcugccugggggccgugugaugcccaaggcaagucuugguuuuaauuauuauuauuaucauuauuguuacgcuuggcuuucgggaaauacucgugauauuuguaggauaaaggaaaugacacuuugaggaacuggagagaacauauaugcguuuuguuuuuaagaggaaaaccguguucucuucccggcuuguucccucuuugcugauuucaggagcuacucuccuccuggugagguggaaauuccagcaagaauagaggugaagacaagccaccaggacucaggagggaaacgcugaccauuagaaaccucugcauaagacguuguaaggaggaaaauaaaagagagaaaaacacaaagauuuaaacaagaaaccuacgaacccagcucuggaaagagccaccuucuccaaaauggauauguuuccucucaccuggguuuucuuagcccucuacuuuucaagacaccaagugagaggccaaccagguaagccacugaaaguuuuucuauuuauugcaacaugguuuccccuuuaaaagugaccgcuaaagcaggaaggccacgcagaacggcacagaagaaggcucccucaguacucaauaauuuaaagagagaucccagccggcccuuccuacaccaccacggcugcuaaaacccaacuuuccucuccugcuaggagugugugugugugugugugugugugugugugaguguguuuugaaacagaauuuggcgguguucauaugucacauauggacugaaucaaagguuuaaaaauacuacaaagccuuugcauuacaguuuuugggaauuuuuuuucccugucuugaagcagaacacaucucccuugaguuucuccaacuagccagugaaauauaaaucauuugcauucccuccacuuagcuacauugagcaauguuaacugaagggcuugggaaagacaagaguuuaguuuugguuuucagaugcuguagauucuuuggagaaugacugguuaugcuucagaaucauaaggcucaggcugguggagcaaguuggcuuguggcugagauaggggcuugggguugggugcugcuggcaaccaagacgguuggucucuucucucuucauccauguguugucugggaaaguaaaucguacguucuuuuagaaauuauuauuagcuaaaacaaauugcaggcccucgaaggucucucacucuugugaagugguuagaaacuuuugaguggaauuuguucucaaccacugccaaaaaggguguguggacaggcugcuguggagauaagcauuucgaggcccagaacagucuggggaccgcauuuguggggagcggcaagggguaugcucuggaaaggggaauccauggggaaugcagugggguuugugcuuccuucucggaccacucucuagagugagccucccuaccccucugagaacagugucuggaaucuaacaacaaaacucuuagcagcugcuacaggugauuggagauggagaaaccaucuauggaggaaaugggugaaagaaaggcgaaaaagccuuccugaagugcccucacccaaggcacuugcaaggcgauggcggcagugguagagcuaacucugcagccuccuuggcauccccagaacaucagcuaguggauccuagccuugcaucugguacugucacccuuccuucuccucacgccccccaccagcacacac

SEQ ID NO: 20328 - RNA, 2956 nt, Homo sapiens
gugugugcugguggggggcgugaggagaaggaagggugacaguaccagaugcaaggcuaggauccacuagcugauguucuggggaugccaaggaggcugcagaguuagcucuaccacugccgccaucgccuugcaagugccuugggugagggcacuucaggaaggcuuuuucgccuuucuuucacccauuuccuccauagaugguuucuccaucuccaaucaccuguagcagcugcuaagaguuuuguuguuagauuccagacacuguucucagagggguagggaggcucacucuagagagugguccgagaaggaagcacaaaccccacugcauuccccauggauuccccuuuccagagcauaccccuugccgcuccccacaaaugcgguccccagacuguucugggccucgaaaugcuuaucuccacagcagccuguccacacacccuuuuuggcagugguugagaacaaauuccacucaaaaguuucuaaccacuucacaagagugagagaccuucgagggccugcaauuuguuuuagcuaauaauaauuucuaaaagaacguacgauuuacuuucccagacaacacauggaugaagagagaagagaccaaccgucuugguugccagcagcacccaaccccaagccccuaucucagccacaagccaacuugcuccaccagccugagccuuaugauucugaagcauaaccagucauucuccaaagaaucuacagcaucugaaaaccaaaacuaaacucuugucuuucccaagcccuucaguuaacauugcucaauguagcuaaguggagggaaugcaaaugauuuauauuucacuggcuaguuggagaaacucaagggagauguguucugcuucaagacagggaaaaaaaauucccaaaaacuguaaugcaaaggcuuuguaguauuuuuaaaccuuugauucaguccauaugugacauaugaacaccgccaaauucuguuucaaaacacacucacacacacacacacacacacacacacacacuccuagcaggagaggaaaguuggguuuuagcagccguggugguguaggaagggccggcugggaucucucuuuaaauuauugaguacugagggagccuucuucugugccguucugcguggccuuccugcuuuagcggucacuuuuaaaggggaaaccauguugcaauaaauagaaaaacuuucaguggcuuaccugguuggccucucacuuggugucuugaaaaguagagggcuaagaaaacccaggugagaggaaacauauccauuuuggagaagguggcucuuuccagagcuggguucguagguuucuuguuuaaaucuuuguguuuuucucucuuuuauuuuccuccuuacaacgucuuaugcagagguuucuaauggucagcguuucccuccugaguccugguggcuugucuucaccucuauucuugcuggaauuuccaccucaccaggaggagaguagcuccugaaaucagcaaagagggaacaagccgggaagagaacacgguuuuccucuuaaaaacaaaacgcauauauguucucuccaguuccucaaagugucauuuccuuuauccuacaaauaucacgaguauuucccgaaagccaagcguaacaauaaugauaauaauaauaauuaaaaccaagacuugccuugggcaucacacggcccccaggcagcugugugaucucagaggcguaaacugacacacaucccgcggcacccuugacggacacacgggcggaggcagccgccgccggacagcccgaguggaaggcggccgcccugcucuuguccucgccggguucccccggcgggagccucccccaacggcuacacccgcuuggccagccucucgaggggagucugaggaaggaagcugcugcugcuguugcugcugcuggugcggcggcgguggcggcugggaucgccugggagugagcgagccccucuccgaguucgcuggcgcccgcccucaccuccaccucgccgagugucugugcggcugaggaugugcugggggccggcugcaggcuggugccucgcucgcgaucucugccuccccuccggcuccccacugccuuuucaggccgagcagcauguggaugucagagccgcggcagagcuauccgauuacgcgccggcucagggcccgccccuucuguguuccugauuaaagaggcagccgcggagacgcgcggcgcagagcagagugccgcggcacccagcucgggcggggcggcgacggcuucucucgggccgccgcaggaucgaaguuaaggcggcgcccaucccaccaccccucgcccgccccgcaucucccgaucgcccccgcgcaccuccgcgccgggccgccggugcguaacgcccuggggaagaagcgcccccgggcacccccagggcgcgccgccuuggccgugucgcccccacccaagggagaccccggggggacggggggaaaagccuuguucccccuaaauuccacgacuccgaugccacacacgcagaacccaacacaaugccacgcgcgauggcguuacaagaggaguuggguggcguacgguguuugggguagcgagccggucggcagcucagccaugcguucgaacaggcagcggugcguggcggcgacacacaccgucagcccggucugaauaaaaccccaaacacucgcugcguuuacuacucagauccuuuguuaugucccaaacaugcucugcuccucucuggguuaggauuucguuaccccugcgccuuuaacuguaacuacccuaaaaagaggaaagacuuucuucagcaaauaauuucuucagguaauuaaauuggauuccaucaaguucccccgaaaaaguauaggugcuugaaggcgucucauccaaaugcuacuguaacuacgucuauucacauuuucccccauggaaacguggucacaa

SEQ ID NO: 20329 - RNA, 598 nt, Homo sapiens
guguguuacgugggggagagaauaaaacuccagcgagauccgggccgugaacgaaagcagugacggaggagcuuguaccaccgguaagaggagcaggaggaggaggcaggagccagagagagccggggggacggaggggggacggggaggcgccggacacccgcgcuuggggccuuccccucgcaggaggggccgcgguaaagauggagccuccgcccgagccccacaacaucgccgccgcucgcagcgaacaaagaauaauggcggcggacuggagccagcggcggccggggcggcagcgacucugccugcagccagcggcggcgcucauggcggggggcggcgggcggcgggcggcgggcggggugggagccggcggccgggggugugugcgggcggccggccgcggcgagcuggcgcccgcguucccgccgccgccgccgggccgggcgcggagccgggaacccggagccgccccgggggaggccgcccgcucggcccggcgcugccccccgcgccgcucgcucguccggcccccgccgcccgccucgcccccggcccgacccggccgggccuccggggcagccgccgccuaggu

SEQ ID NO: 20330 - RNA, 598 nt, Homo sapiens
accuaggcggcggcugccccggaggcccggccgggucgggccgggggcgaggcgggcggcgggggccggacgagcgagcggcgcggggggcagcgccgggccgagcgggcggccucccccggggcggcuccggguucccggcuccgcgcccggcccggcggcggcggcgggaacgcgggcgccagcucgccgcggccggccgcccgcacacacccccggccgccggcucccaccccgcccgccgcccgccgcccgccgccccccgccaugagcgccgccgcuggcugcaggcagagucgcugccgccccggccgccgcuggcuccaguccgccgccauuauucuuuguucgcugcgagcggcggcgauguuguggggcucgggcggaggcuccaucuuuaccgcggccccuccugcgaggggaaggccccaagcgcggguguccggcgccuccccguccccccuccguccccccggcucucucuggcuccugccuccuccuccugcuccucuuaccggugguacaagcuccuccgucacugcuuucguucacggcccggaucucgcuggaguuuuauucucucccccacguaacacac

SEQ ID NO: 20331 - RNA, 1056 nt, Homo sapiens
gcgaaagcugggauagacucggcuagacaguucccccggguagcaggauccuccagggcuccaauuccggggugcaaggacccuccccgacuacucccgagcugcaccccagcucgaagccacuugcugcgcaaagcgcgcgggcccagccggucucgugucccccgcccgugcgccgcguaacugacuggcacacugagcgcgcucaccgaucuugacuugcucgcgguagcucuuuucguugaggcaaaccccgcggccgugcagcagggcgugcagcggcuucuccucguccugccgggggaggcagcgcagccccugggcgcagcgcucgguguagacgccgcacgacugccccucggccagggcgcaggucaugcagcagccgcagcccggcuccuugaccagcucgcagcccagggggcugggggggcacauggagagggcuuucucgucgcagggcucgcagugcacgaaggagcccaggcucugggccggccccgcauaggcggccagcagcaggaggaccgcggugagcaacaccaucuucucuuagucgcccccuuuaccucgggguggggcaggagagcgagagugcagggauaaaggggccaagagggcccccggagauuuuuuuguuuuuguuuuuguuuuaaaauuucuggcagguagagcaggugcccucccccagacacuugcaaaaauguagagagagguggagggcuggggugccugcgagcaggucccaguugcaagaauuaaagccuugcaacagguugggggaagcagggcagcgccaggugcacgcagugagcggaggccggagaaacccucaagccugagcgggucagaauuauaggggaaaaaaagccacaaaauuguucacccccaagcaaccaccgaaauaaugagaucggaugcaguggagauggcguugggggugggagagaaaaauggauuuaucuuuaaaauuuuugcuuaaaaucuaaaauacaccccgcuuucuaacccucagcugccagcggugcgcggcgccgcagaacagguaagaggcgu

SEQ ID NO: 20332 - RNA, 1056 nt, Homo sapiens
acgccucuuaccuguucugcggcgccgcgcaccgcuggcagcugaggguuagaaagcgggguguauuuuagauuuuaagcaaaaauuuuaaagauaaauccauuuuucucucccacccccaacgccaucuccacugcauccgaucucauuauuucggugguugcuugggggugaacaauuuuguggcuuuuuuuccccuauaauucugacccgcucaggcuugaggguuucuccggccuccgcucacugcgugcaccuggcgcugcccugcuucccccaaccuguugcaaggcuuuaauucuugcaacugggaccugcucgcaggcaccccagcccuccaccucucucuacauuuuugcaagugucugggggagggcaccugcucuaccugccagaaauuuuaaaacaaaaacaaaaacaaaaaaaucuccgggggcccucuuggccccuuuaucccugcacucucgcucuccugccccaccccgagguaaagggggcgacuaagagaagaugguguugcucaccgcgguccuccugcugcuggccgccuaugcggggccggcccagagccugggcuccuucgugcacugcgagcccugcgacgagaaagcccucuccaugugcccccccagcccccugggcugcgagcuggucaaggagccgggcugcggcugcugcaugaccugcgcccuggccgaggggcagucgugcggcgucuacaccgagcgcugcgcccaggggcugcgcugccucccccggcaggacgaggagaagccgcugcacgcccugcugcacggccgcgggguuugccucaacgaaaagagcuaccgcgagcaagucaagaucggugagcgcgcucagugugccagucaguuacgcggcgcacgggcgggggacacgagaccggcugggcccgcgcgcuuugcgcagcaaguggcuucgagcuggggugcagcucgggaguagucggggaggguccuugcaccccggaauuggagcccuggaggauccugcuacccgggggaacugucuagccgagucuaucccagcuuucgc

SEQ ID NO: 20333 - RNA, 717 nt, Homo sapiens
gcgaggcgcguacuccgccugugccgcguccgcccggcguuuacaagccgcgggggugccgccugcaagucagcgccuggcacuuccugccgcccaucuggcccagccucccgccccgacccgcgggcaggaaccggacucgaacuccuggucucacggaacguggccaagccccaggcgccucugagaaauggggacaauucguaggggggaccacgccgcacugaggaugaacaagccaggcguagcaauggagaaguuaaugugaauaagacgaaacgcacaacaggaaguuguucccaguugcuuuuuaggagagauauuauacauacucagcaaugcauaugaaaagcgucugaaaggacacacaggaaauuuagcagugggugaacuaugaaaaggaagagaaacucaggguguuuuuuuuuuuuacuguaauuugaacuuuuaaaccuaaggcuacugaggaaauucugugaucuuaagcgaauguaaggccucaaaacgugucaacacguccacccaaaaguaaacugcaucuacccaagguuuuguguugaaacccaccucccgccuccgaucucaugcuugaguaggccgaggugggaagaagcuccgauauguggaagugggaaaguuuaaggagauaggaaagaaacaacuuuucugaguagauguuguuuucgagucugucgagucaagcgcugguguguguuu

SEQ ID NO: 20334 - RNA, 717 nt, Homo sapiens
aaacacacaccagcgcuugacucgacagacucgaaaacaacaucuacucagaaaaguuguuucuuuccuaucuccuuaaacuuucccacuuccacauaucggagcuucuucccaccucggccuacucaagcaugagaucggaggcgggagguggguuucaacacaaaaccuuggguagaugcaguuuacuuuuggguggacguguugacacguuuugaggccuuacauucgcuuaagaucacagaauuuccucaguagccuuagguuuaaaaguucaaauuacaguaaaaaaaaaaaacacccugaguuucucuuccuuuucauaguucacccacugcuaaauuuccuguguguccuuucagacgcuuuucauaugcauugcugaguauguauaauaucucuccuaaaaagcaacugggaacaacuuccuguugugcguuucgucuuauucacauuaacuucuccauugcuacgccuggcuuguucauccucagugcggcgugguccccccuacgaauuguccccauuucucagaggcgccuggggcuuggccacguuccgugagaccaggaguucgaguccgguuccugcccgcgggucggggcgggaggcugggccagaugggcggcaggaagugccaggcgcugacuugcaggcggcacccccgcggcuuguaaacgccgggcggacgcggcacaggcggaguacgcgccucgc

SEQ ID NO: 20335 - RNA, 1063 nt, Homo sapiens
aaauuaagccagaguauuaauauauucauagauuucaccaccacacaguaaaacauugaagucaaaugauuuagagcaaaccaccuggcucacacuuucccaacggaaaaagguaaggcucaaagugcugagaugaacauucuguccuagcacuaggaaauaaucauugucugccucaggcuuaaguuuaauaaauagcaaauugcauacagauauuuacaaugaucgaaagacaaacagagguccuauccgugcagucccaacaauaaagacaggcauuggcauaaaguguuuauaaauucuuggguacagcuguucugaaaguaaaguucacuuucaauccuaaaaaaaguccgcuauuccuccagaugugcuuaaaggcaaauguggacuggaauuacuuggugucaauggggagcaacugcucuaugccguuuauuaugaaggacuuuaacucaacucuccaucuuccuccacuuccacccuuucuuggccauucucaaugauucucuugguggugauuuuuuuaccaucaacuauuucaguggaagucgacauggacuugaagcugccugucccaucacuaccguaggacaugcagaaggaagaaaggcccccacuucccagggagccaaaggaacgaaauccuguaucaaaagaagaaaaaccacccucaaaagcuggaaauucacugaaggcagagaaaaggggugcagacccucugcuucugcuucccagggaguuccucugaccccccaaaauauucuccagcggguuucccaagaggucaaaggagaaugggucccggccgccaaagaacucccugaagaccucggcggggucacggaagcugaagaccuacucgaagggguccuugaagggccugccgccugcgcagccgcccuccgcccucgccucgccauagcggucauagauaucgcguuucuacgcguccgacaacaccucguaggccucagccaccugcuugaaucuucucaccgcuuccucccuguccucgggguuuuugucggggugccacuugagcgccagcuugcgguacgcc

SEQ ID NO: 20336 - RNA, 1063 nt, Homo sapiens
ggcguaccgcaagcuggcgcucaaguggcaccccgacaaaaaccccgaggacagggaggaagcggugagaagauucaagcagguggcugaggccuacgagguguugucggacgcguagaaacgcgauaucuaugaccgcuauggcgaggcgagggcggagggcggcugcgcaggcggcaggcccuucaaggaccccuucgaguaggucuucagcuuccgugaccccgccgaggucuucagggaguucuuuggcggccgggacccauucuccuuugaccucuugggaaacccgcuggagaauauuuuggggggucagaggaacucccugggaagcagaagcagagggucugcaccccuuuucucugccuucagugaauuuccagcuuuugagggugguuuuucuucuuuugauacaggauuucguuccuuuggcucccugggaagugggggccuuucuuccuucugcauguccuacgguagugaugggacaggcagcuucaaguccaugucgacuuccacugaaauaguugaugguaaaaaaaucaccaccaagagaaucauugagaauggccaagaaaggguggaaguggaggaagauggagaguugaguuaaaguccuucauaauaaacggcauagagcaguugcuccccauugacaccaaguaauuccaguccacauuugccuuuaagcacaucuggaggaauagcggacuuuuuuuaggauugaaagugaacuuuacuuucagaacagcuguacccaagaauuuauaaacacuuuaugccaaugccugucuuuauuguugggacugcacggauaggaccucuguuugucuuucgaucauuguaaauaucuguaugcaauuugcuauuuauuaaacuuaagccugaggcagacaaugauuauuuccuagugcuaggacagaauguucaucucagcacuuugagccuuaccuuuuuccguugggaaagugugagccaggugguuugcucuaaaucauuugacuucaauguuuuacugugugguggugaaaucuaugaauauauuaauacucuggcuuaauuu

SEQ ID NO: 20337 - RNA, 3149 nt, Homo sapiens
agcuggccucgagcgggcugcgggcgccaccgucggagcgcgcgggccggggagccggagccugcaugccuagcccgugccgcgcaaacuugagacgggcggauggcaccuccaaggcucggaccuuggggcccugcagccuugucgaggccaccucgaaggguagccuccggggcccgcacccccacggcugggccgggggcgcuuuauuucuuuuacuguauuugccauggaaccaaccugccugcggcucacuccagcgcugggugcuccggcugcgccugggguccgggcgaggguccuggaguugggggcaggguccugccccuccggagccacccccggggcgaaggcugggagcuggcagcgccugcccgccgccagaaacccgccggguugcucgcuguagguccgcgcaccggguggggcggggaggcugcugcuucccccaucccgggcugggcccucccgugagcgaucccgucucucauuuuucaugacauucuuaaucaucgcaccuauuuacacacuuugccagcgcgcaccaaaauaacaaccacgauaauuaugauaauaaagagaguccuuuaucugcuccauccucggggaggaaggggggaguugcugugccuccagauuguauaacgugagauuauccugaugaaagcuuuaugauguuugcucaaauaaaagcugcguuuuguaaauaggcgcuaauuaagcacguugcgaacgcaaggagugcucacccuggcgccgccgcccgguuuccagcgcgaggacucgagggcgcgcgguuccucuuugcuaacugcaggauggagccgauccccucaggauguuuccccuguucucgacaacgguaaagacccccaaauuugaaaguaagggaauuuugggguggagggaaacuagggacguacuuauccccucuuccauuuucaaacaaaaaacuuucagcucuugucuucccuuuaaaaauggaaucacuucuugacaacggcagaccgugcagagcgcaccagcgcgagcggggcuuccucgagucuccaaggcccgggcuucaacuucccgggucuagacgucagcccugaaccgccaacagcaccggguuggggagaaggaaagaagggcauuguuaguucggucauuaaaaaucagcucacgccgaggagcuagugguuggggaguuggcccguguuggacguguguuauguaucacuuacaagcacauuuaauugggagauaaagauaaaucgaucuuuaugaauuuaucgacccgauucuuugaagcucuuuuuucgcguucuuccucuuucucucgcucuagccccaaggccccccgggggacgucuuaaucccagaucagcuccucugccaggagucccgccggagacccacugcccacccagcagaccuggaggaaagaggggaggguguguccuuggcgccccgggacgcugggaaaacucgcugguccgccgccagcccucuccuccuccucgccuccucccucccuaccaccacccggacaaagacgucucgaucgcguuuccccacuccaggccgcaguaauagaucgcuccggcagcaggcgguuugaaaggaauucauuaggacgcugccuggauugccuccccugacuucacgcccagaccccgagguggcuuaggcagugugaggggaaaugaauucccuuugggauccauggagaaggaggugucugugggaucuccaggcucuaucccuccuucuucacucccagaaaagaagaaaaagaaaaaaaaaaucgaagcccagggcaaaaggcugauaucuuuaugagcauaauaaauacucccccucauuaugagauaguuacagugacacagccuugggugccauuacccuguuuuuugaauacuaagaaacgcuccauuccuuccuugauuuacguggcuacagccggggcccuuccggcuugccacugacaugccgggggaagcuguuauucauuuuaccuaggcagguuugccaugcacuuugcuauuucgccgcaaaaauauuguucuagggacuuuugucgccugauuacccucugagaggcagggauuccuuugauuauuuuggugauuauucuacauuuaaaguucagcaagaagauuuagguccgucgaauuauagcugcacuugaaauaauuugauggcauguuauuugcauccauaaauugccauagcaaguauugacugcagggguuauaauacuaaucuuuuauuagugaguucagauaauucccaucaauaugaauuuuauuuacuagugccuuuuucgcaaaugcaaugcaguaauacuuucucaucuaaugcuuagcugcuuagaaaacgacuguucgugucauaaaaggauccuuguguuucggcgugauuaacaagaugcauucggggcaccucagcuaccugcaaagcguucagagcguggggacugcggauaauaaaagccuuuagaguuuuuccucggcuccucggauagauuuauggacaggagcgauagaugcauggcuuauccauccuccggauuccuaccugcuuagcucguaacagccucaaacugcagaguccuccgugacucagcucggcccagucuacgcgggaaaaucaccgggcacagauguuugcaacuugguccccuccccccuccaauuaggaaaaaugaagggcgcacccgaagggagagcuggguccuccaacuccaguuaacuucgugaacuucccuccccucuuccccccuagaugaagauagcucagccccugggcacuucacucgacaggugcuaggcuagugucagguucagaugaugccacuuaaaaccucagacauuccgaaaaagugaugguaauuaaguuggccccucgcuucgggguugucccaggcugcgcuugcaugcagauguaugaagguugagggugaaauagaaaacgcacaaguaaaugaauauucaugcagcaaacuugugcuggccugcccagcccagcccagcccaauccggaggaggaagcaccgcgaauggcgcgcuucgcugccgccgccagagucgagguaacggguggucguggagaggguacgguguggccacccguggucucggaggacgcggggaauccugcgggcc

SEQ ID NO: 20338 - RNA, 3149 nt, Homo sapiens
ggcccgcaggauuccccgcguccuccgagaccacggguggccacaccguacccucuccacgaccacccguuaccucgacucuggcggcggcagcgaagcgcgccauucgcggugcuuccuccuccggauugggcugggcugggcugggcaggccagcacaaguuugcugcaugaauauucauuuacuugugcguuuucuauuucacccucaaccuucauacaucugcaugcaagcgcagccugggacaaccccgaagcgaggggccaacuuaauuaccaucacuuuuucggaaugucugagguuuuaaguggcaucaucugaaccugacacuagccuagcaccugucgagugaagugcccaggggcugagcuaucuucaucuaggggggaagaggggagggaaguucacgaaguuaacuggaguuggaggacccagcucucccuucgggugcgcccuucauuuuuccuaauuggaggggggaggggaccaaguugcaaacaucugugcccggugauuuucccgcguagacugggccgagcugagucacggaggacucugcaguuugaggcuguuacgagcuaagcagguaggaauccggaggauggauaagccaugcaucuaucgcuccuguccauaaaucuauccgaggagccgaggaaaaacucuaaaggcuuuuauuauccgcaguccccacgcucugaacgcuuugcagguagcugaggugccccgaaugcaucuuguuaaucacgccgaaacacaaggauccuuuuaugacacgaacagucguuuucuaagcagcuaagcauuagaugagaaaguauuacugcauugcauuugcgaaaaaggcacuaguaaauaaaauucauauugaugggaauuaucugaacucacuaauaaaagauuaguauuauaaccccugcagucaauacuugcuauggcaauuuauggaugcaaauaacaugccaucaaauuauuucaagugcagcuauaauucgacggaccuaaaucuucuugcugaacuuuaaauguagaauaaucaccaaaauaaucaaaggaaucccugccucucagaggguaaucaggcgacaaaagucccuagaacaauauuuuugcggcgaaauagcaaagugcauggcaaaccugccuagguaaaaugaauaacagcuucccccggcaugucaguggcaagccggaagggccccggcuguagccacguaaaucaaggaaggaauggagcguuucuuaguauucaaaaaacaggguaauggcacccaaggcugugucacuguaacuaucucauaaugagggggaguauuuauuaugcucauaaagauaucagccuuuugcccugggcuucgauuuuuuuuuucuuuuucuucuuuucugggagugaagaaggagggauagagccuggagaucccacagacaccuccuucuccauggaucccaaagggaauucauuuccccucacacugccuaagccaccucggggucugggcgugaagucaggggaggcaauccaggcagcguccuaaugaauuccuuucaaaccgccugcugccggagcgaucuauuacugcggccuggaguggggaaacgcgaucgagacgucuuuguccggguggugguagggagggaggaggcgaggaggaggagagggcuggcggcggaccagcgaguuuucccagcgucccggggcgccaaggacacacccuccccucuuuccuccaggucugcugggugggcagugggucuccggcgggacuccuggcagaggagcugaucugggauuaagacgucccccggggggccuuggggcuagagcgagagaaagaggaagaacgcgaaaaaagagcuucaaagaaucgggucgauaaauucauaaagaucgauuuaucuuuaucucccaauuaaaugugcuuguaagugauacauaacacacguccaacacgggccaacuccccaaccacuagcuccucggcgugagcugauuuuuaaugaccgaacuaacaaugcccuucuuuccuucuccccaacccggugcuguuggcgguucagggcugacgucuagacccgggaaguugaagcccgggccuuggagacucgaggaagccccgcucgcgcuggugcgcucugcacggucugccguugucaagaagugauuccauuuuuaaagggaagacaagagcugaaaguuuuuuguuugaaaauggaagaggggauaaguacgucccuaguuucccuccaccccaaaauucccuuacuuucaaauuugggggucuuuaccguugucgagaacaggggaaacauccugaggggaucggcuccauccugcaguuagcaaagaggaaccgcgcgcccucgaguccucgcgcuggaaaccgggcggcggcgccagggugagcacuccuugcguucgcaacgugcuuaauuagcgccuauuuacaaaacgcagcuuuuauuugagcaaacaucauaaagcuuucaucaggauaaucucacguuauacaaucuggaggcacagcaacuccccccuuccuccccgaggauggagcagauaaaggacucucuuuauuaucauaauuaucgugguuguuauuuuggugcgcgcuggcaaaguguguaaauaggugcgaugauuaagaaugucaugaaaaaugagagacgggaucgcucacgggagggcccagcccgggaugggggaagcagcagccuccccgccccacccggugcgcggaccuacagcgagcaacccggcggguuucuggcggcgggcaggcgcugccagcucccagccuucgccccggggguggcuccggaggggcaggacccugcccccaacuccaggacccucgcccggaccccaggcgcagccggagcacccagcgcuggagugagccgcaggcagguugguuccauggcaaauacaguaaaagaaauaaagcgcccccggcccagccgugggggugcgggccccggaggcuacccuucgagguggccucgacaaggcugcagggccccaagguccgagccuuggaggugccauccgcccgucucaaguuugcgcggcacgggcuaggcaugcaggcuccggcuccccggcccgcgcgcuccgacgguggcgcccgcagcccgcucgaggccagcu

SEQ ID NO: 20339 - RNA, 881 nt, Homo sapiens
acuccccggucucggguucaacuucaauaaaagggcccagcccgcccuugaucacgcggcuugccugacagcccggcucaggcccgggccuaauugagcccgggucaccugggaauagguucaaaggcaucaaagccguaaaaaccaccuccaggcccagagccagagcggccuggcgaacaaagagccccccaaccacuucaaacgcgcucgcgcucgccguccagauggcccggggccgggguccguggugucgcucaccgaggccgggccccacacuccagccacccugagccuccugcucggagcugcccgcgggcugccagcgcagcggaggcugggcccggggcagccucgugcagcucccggagcgcccuccguccucugcugacccgcgaagcgaaggcggagcgcagaggcuggggccguacaaggcgggccggcaggcgccccaacccgcgcccagcaacccggguagggccaggcaggcgggcgcggcggguaccgggcgcucccgcagaggcucgcuguggcguuguuuuaaagcuguuagaaggaagguucgggaagggcgucggggccggggcuccccagcaagccaggguaagaaaugguccccgacacgcacgcuggccgaaggguggcaucuccacggaucuuggcggcauguccuugggcacgggcgucuccagggggccccgacuguccuuacacuggcgguccggacaccgagaccccugcccgcgcagcuccccagaccccaggccuaagcuugcgggccgcggugcagacuagcugugcgcccgggggcggccaagacccacacaggucgaggaggcuccuggcugcguccucaucuucugggagcgcaucugggacug

SEQ ID NO: 20340 - RNA, 881 nt, Homo sapiens
cagucccagaugcgcucccagaagaugaggacgcagccaggagccuccucgaccugugugggucuuggccgcccccgggcgcacagcuagucugcaccgcggcccgcaagcuuaggccuggggucuggggagcugcgcgggcaggggucucgguguccggaccgccaguguaaggacagucggggcccccuggagacgcccgugcccaaggacaugccgccaagauccguggagaugccacccuucggccagcgugcgugucggggaccauuucuuacccuggcuugcuggggagccccggccccgacgcccuucccgaaccuuccuucuaacagcuuuaaaacaacgccacagcgagccucugcgggagcgcccgguacccgccgcgcccgccugccuggcccuacccggguugcugggcgcggguuggggcgccugccggcccgccuuguacggccccagccucugcgcuccgccuucgcuucgcgggucagcagaggacggagggcgcuccgggagcugcacgaggcugccccgggcccagccuccgcugcgcuggcagcccgcgggcagcuccgagcaggaggcucaggguggcuggaguguggggcccggccucggugagcgacaccacggaccccggccccgggccaucuggacggcgagcgcgagcgcguuugaagugguuggggggcucuuuguucgccaggccgcucuggcucugggccuggaggugguuuuuacggcuuugaugccuuugaaccuauucccaggugacccgggcucaauuaggcccgggccugagccgggcugucaggcaagccgcgugaucaagggcgggcugggcccuuuuauugaaguugaacccgagaccggggagu

SEQ ID NO: 20341 - RNA, 1487 nt, Homo sapiens
cguggacagccugggcaccagcgaggaggagcucgagaggcagcccaagcgcuucggccggaagcggcgcuacagcaagaagucgagcgaagauggcagcccgaccccgggcaagcgcggcaagaagggcagccccagcgcgcaguccuucgaggagcugcagagccagcgcauccuggccaacgugcgcgagcgccagcgcacccagucgcucaacgaggccuucgcggcgcugcgcaagaucauccccacgcugcccucugacaagcugagcaagauccagacgcucaagcuggccgccagguacauagacuuccucuaccagguccugcagagcgacgagauggacaauaagaugaccagcugcagcuacguggcccacgagcgccucagcuacgccuucuccguguggcgcauggagggcgcgugguccauguccgccucccacuagcgccgcgccacccaccuccggaccggcgcgccaggguaggugcugcgcgcgcgacgggcgcccuccgcugcggggggcgggcggcaggggcgcaggggcauuggggccugcucgugucuccucggcgaggccccgcgggccgcgggggcuuggaugccgugcgcuuuuccucuuagcaaggaaggcgggcgggcgggacgcucacagucccagggacaccccugagugcagacuuccacgcgagggugucaguugggaaccggcggaccggugacucccccggcggguucugaagauacuuagacagauggucgcaguuuucauucucggugguguguggguguccgugguuggcgguggaaggagcgagcaucagaaaaaccuccuggggccggcuggggacugggauaugaggaccagcugcccuuugcguccgccgcagcgcaggccgcccgcgaagcugcccgagccggguguugccgggcgaauggcuucgcuuucuuccugggcaaggguagagcgcguccgucgggcggacacucagaucuacccagcugcucgcgccugggguccccggccgucggcgcccuggccugcccagugggcguagaggugcgggccugcggcuccaggguuugccuggggaggacgggaggaaacugcccugcgcuucggggccagagcagccacagggccgggugugcccgagaagggcccugggccgagagcgcagagccuggagcgcugaggcaggcggguccgacgcagccgcgcggagccccagggcgcccgcaggcagguggagcugaccuaggaacugggagcccugagucccaaccuugacccuggaguacccgggaggggccccgcccauccagccccgcagggaugggcgagggguccaggcugggaaacgggucugggggacagggaggcugugcgcgccgggcccugcgcgaggagaaggcucgggggacacagcugccaggagcacuccaaguucugguuuccucuggaagagcgauuagggcguccu

SEQ ID NO: 20342 - RNA, 1487 nt, Homo sapiens
aggacgcccuaaucgcucuuccagaggaaaccagaacuuggagugcuccuggcagcugugucccccgagccuucuccucgcgcagggcccggcgcgcacagccucccugucccccagacccguuucccagccuggaccccucgcccaucccugcggggcuggaugggcggggccccucccggguacuccagggucaagguugggacucagggcucccaguuccuaggucagcuccaccugccugcgggcgcccuggggcuccgcgcggcugcgucggacccgccugccucagcgcuccaggcucugcgcucucggcccagggcccuucucgggcacacccggcccuguggcugcucuggccccgaagcgcagggcaguuuccucccguccuccccaggcaaacccuggagccgcaggcccgcaccucuacgcccacugggcaggccagggcgccgacggccggggaccccaggcgcgagcagcuggguagaucugaguguccgcccgacggacgcgcucuacccuugcccaggaagaaagcgaagccauucgcccggcaacacccggcucgggcagcuucgcgggcggccugcgcugcggcggacgcaaagggcagcugguccucauaucccaguccccagccggccccaggagguuuuucugaugcucgcuccuuccaccgccaaccacggacacccacacaccaccgagaaugaaaacugcgaccaucugucuaaguaucuucagaacccgccgggggagucaccgguccgccgguucccaacugacacccucgcguggaagucugcacucaggggugucccugggacugugagcgucccgcccgcccgccuuccuugcuaagaggaaaagcgcacggcauccaagcccccgcggcccgcggggccucgccgaggagacacgagcaggccccaaugccccugcgccccugccgcccgccccccgcagcggagggcgcccgucgcgcgcgcagcaccuacccuggcgcgccgguccggagguggguggcgcggcgcuagugggaggcggacauggaccacgcgcccuccaugcgccacacggagaaggcguagcugaggcgcucgugggccacguagcugcagcuggucaucuuauuguccaucucgucgcucugcaggaccugguagaggaagucuauguaccuggcggccagcuugagcgucuggaucuugcucagcuugucagagggcagcguggggaugaucuugcgcagcgccgcgaaggccucguugagcgacugggugcgcuggcgcucgcgcacguuggccaggaugcgcuggcucugcagcuccucgaaggacugcgcgcuggggcugcccuucuugccgcgcuugcccggggucgggcugccaucuucgcucgacuucuugcuguagcgccgcuuccggccgaagcgcuugggcugccucucgagcuccuccucgcuggugcccaggcuguccacg

SEQ ID NO: 20343 - RNA, 1529 nt, Homo sapiens
ggugcccagaggggaccccucccacuggauuccucugggguccgcgaagcccgcggccgcgcguggguagcagacagcgccccuaauuuggcaucuuucucuucuggagcugcacaggcuucagaggcuguacagggucuucgccugggccuccauucucacugcucauccagggaaaaaggguucaucuguccccaagcccgucgcucuccguccuucucggagcuuuaacuccccucccaguuucucccuggagcacccauuuagccagggaugggguaucuuuaggacagcgggcgcuauagaagaugcuugaacuccgaggcuuccccauuucgacucuuccugggccuuugucccauacaguucgcuccccugcucaucuaagucuugugugaucuucagaaauccauggaagccucccuucuacgagaagucuccccuacucugaccccugcagcucuuaauucauuuugugcgguggggcugaucucaccagugagaguccaccgcagggcacacgccagcucucuugaugcccagagaggagcaaaagaggaccugcuguuuaauaaauucagcuuggauuuguugaggcucagaaaaguauaccccaacguauggcacuuugguaugcuaaguuugaacuaaaaaacuaaacaggccucugaagccgccuuagaaacaaagucugucucccccccgacuuucuccccacuaagcaguucacagaaaccagaauuccucuucccuacgguggucauacaaccuagaaauaguacuccaaccucccugguccucugccuuucuguguaggagcuggccaugaagaaauacucagaccuaccuugucugauaguagauccugagacccucauuccagaagagguccugcucuauacaugcugcacagagaggccaagaagaaucugaacaggccucgcuggguucaacccucagucuauuaccauuagaucacacccuuuguccaaucacauuucuauaaggcuguccauucuucacugaaucuaagcauaaaaacaggcaguuuucccugagucuuugcaucuucauuucugaaggcuccuguaucacauaaaacuuugauucaauaaauuuguuacgcuuuucucuuauuagccuaucuuuuguuauaagcauguuugccgugccccuuaugauggggaggaaaguaucacaccuuuucugccccuaccguuucaaugguaucaacauccaagcucuagaguccggcuuucgucuuuagauugauucagucucugaauuuaauccggguacuccaaaaugucaauuccucauuuaaaggaguccuccucguuucuugaagagucacccuuuuccuuuuucuugucugcuuugcuugugauugaaaugagaguaggauuuaaaugccuuuguggugcacuggaaauaucaccagaaauggggagaggggucuuacuuuauuuuguugcugcuguuauuauuguuguugcuggauuggaaugagaagaucugaguugaccuug

SEQ ID NO: 20344 - RNA, 1529 nt, Homo sapiens
caaggucaacucagaucuucucauuccaauccagcaacaacaauaauaacagcagcaacaaaauaaaguaagaccccucuccccauuucuggugauauuuccagugcaccacaaaggcauuuaaauccuacucucauuucaaucacaagcaaagcagacaagaaaaaggaaaagggugacucuucaagaaacgaggaggacuccuuuaaaugaggaauugacauuuuggaguacccggauuaaauucagagacugaaucaaucuaaagacgaaagccggacucuagagcuuggauguugauaccauugaaacgguaggggcagaaaaggugugauacuuuccuccccaucauaaggggcacggcaaacaugcuuauaacaaaagauaggcuaauaagagaaaagcguaacaaauuuauugaaucaaaguuuuaugugauacaggagccuucagaaaugaagaugcaaagacucagggaaaacugccuguuuuuaugcuuagauucagugaagaauggacagccuuauagaaaugugauuggacaaagggugugaucuaaugguaauagacugaggguugaacccagcgaggccuguucagauucuucuuggccucucugugcagcauguauagagcaggaccucuucuggaaugagggucucaggaucuacuaucagacaagguaggucugaguauuucuucauggccagcuccuacacagaaaggcagaggaccagggagguuggaguacuauuucuagguuguaugaccaccguagggaagaggaauucugguuucugugaacugcuuaguggggagaaagucgggggggagacagacuuuguuucuaaggcggcuucagaggccuguuuaguuuuuuaguucaaacuuagcauaccaaagugccauacguugggguauacuuuucugagccucaacaaauccaagcugaauuuauuaaacagcagguccucuuuugcuccucucugggcaucaagagagcuggcgugugcccugcgguggacucucacuggugagaucagccccaccgcacaaaaugaauuaagagcugcaggggucagaguaggggagacuucucguagaagggaggcuuccauggauuucugaagaucacacaagacuuagaugagcaggggagcgaacuguaugggacaaaggcccaggaagagucgaaauggggaagccucggaguucaagcaucuucuauagcgcccgcuguccuaaagauaccccaucccuggcuaaaugggugcuccagggagaaacugggaggggaguuaaagcuccgagaaggacggagagcgacgggcuuggggacagaugaacccuuuuucccuggaugagcagugagaauggaggcccaggcgaagacccuguacagccucugaagccugugcagcuccagaagagaaagaugccaaauuaggggcgcugucugcuacccacgcgcggccgcgggcuucgcggaccccagaggaauccagugggagggguccccucugggcacc

SEQ ID NO: 20345 - RNA, 581 nt, Homo sapiens
gcaauugccagcagggccaggauggagcucugggugaggaugaggaccggacaggcaaccaugaggcagguguggaaguaggucuguggcccaauguugaugaggauggcgagggggaugaccagggcacccacggccacaucagccaccgccagcgacacgaugaagcagaagguggcaucccgcagcgccugguucaccuucaccgcccagaucaccagcacguucccgggcacagagaccagggcgaugagcaccucgaugccgauguaggcggccuggaaagcugagauggagggcggcauggcgggcacaggcugggcacaucagcagacgggcaccaaggggcacgaggcaagcaccuguguggucagggaagccugggauggggagacccgucugggaggggcagggagcucaggcugcccuggaacuccagguacccugugaugugucccacuugucacaugcagcuccuacccaggcuggaggggcacccggacccuucucugccuaaucuuugucccuucccuuuaucauucccagagguuccauucagcaacuuaaaauagcagcgcuca

SEQ ID NO: 20346 - RNA, 581 nt, Homo sapiens
ugagcgcugcuauuuuaaguugcugaauggaaccucugggaaugauaaagggaagggacaaagauuaggcagagaaggguccgggugccccuccagccuggguaggagcugcaugugacaagugggacacaucacaggguaccuggaguuccagggcagccugagcucccugccccucccagacgggucuccccaucccaggcuucccugaccacacaggugcuugccucgugccccuuggugcccgucugcugaugugcccagccugugcccgccaugccgcccuccaucucagcuuuccaggccgccuacaucggcaucgaggugcucaucgcccuggucucugugcccgggaacgugcuggugaucugggcggugaaggugaaccaggcgcugcgggaugccaccuucugcuucaucgugucgcuggcgguggcugauguggccgugggugcccuggucaucccccucgccauccucaucaacauugggccacagaccuacuuccacaccugccucaugguugccuguccgguccucauccucacccagagcuccauccuggcccugcuggcaauugc

SEQ ID NO: 20347 - RNA, 540 nt, Homo sapiens
ccaaggccggccgguaagcuccagagggaugguagcuggcugggacucgacucgggcgccugcggcucugucgcccccggcgcaggagcugagugacaaucgggcuccgcacaccgggagggggcgggggcggcggcggcacccgccagccccucccuccucauccuccgucuccucccccacccccuccucuuaacaaaggaagugauacugggugagaaaagcuggaaaaaaugugagcuuuucgaagggccuggugugugcgcccagccucaggacuggacagaggcgcauccuuccuguguccacucucucccuucucaaugcaggacuccugggagcccuggucuggccuccagcgaccccucaccccucacggcacagcaucucuucugcaggacuucagaaugcccccucugggaucucccaaagcagucgguagcccuggcacccucccccaauccuaaaacccugcucucuccaugaaaccagucccugcaucuucucaucccauauuguuuugcaggcucuacccugagu

SEQ ID NO: 20348 - RNA, 540 nt, Homo sapiens
acucaggguagagccugcaaaacaauaugggaugagaagaugcagggacugguuucauggagagagcaggguuuuaggauugggggagggugccagggcuaccgacugcuuugggagaucccagagggggcauucugaaguccugcagaagagaugcugugccgugaggggugaggggucgcuggaggccagaccagggcucccaggaguccugcauugagaagggagagaguggacacaggaaggaugcgccucuguccaguccugaggcugggcgcacacaccaggcccuucgaaaagcucacauuuuuuccagcuuuucucacccaguaucacuuccuuuguuaagaggagggggugggggaggagacggaggaugaggagggaggggcuggcgggugccgccgccgcccccgcccccucccggugugcggagcccgauugucacucagcuccugcgccgggggcgacagagccgcaggcgcccgagucgagucccagccagcuaccaucccucuggagcuuaccggccggccuugg

SEQ ID NO: 20349 - RNA, 556 nt, Homo sapiens
uaauacacgacauuuguuuucaaccuaauuuucccuugacgcaccgcauccccuuccacuagucuagcagccccauggacaaaccuuucuccucucccucguuauuccucugugauaaauucacccugucuucccacaaagauccuucuuccaaaacccagaucccgggcgacgccucuccgcgcagaagccgcgggagaaggaggagaaagaggaggaguaaagcaggcccucucgacgucggccuguggggagcgaugccgacaagcaggagcggucccggcuucggaaagggcccacccugaggaaugguccggccgggccuagcgaggaugucccuaccgcgaugcugguuccguuacccaggguggacaggcgcggaagcgggacggggaagagcgauaguuucgcggcguuugcccagccucaaccccugggaugcgggugagagacauggaggacuggucagaauuugcgcgucccuggggccgcacaaaaggcucccagccggccucccgcaauguccucaccuguaccuggcagccgacccccugga

SEQ ID NO: 20350 - RNA, 556 nt, Homo sapiens
uccagggggucggcugccagguacaggugaggacauugcgggaggccggcugggagccuuuugugcggccccagggacgcgcaaauucugaccaguccuccaugucucucacccgcaucccagggguugaggcugggcaaacgccgcgaaacuaucgcucuuccccgucccgcuuccgcgccuguccacccuggguaacggaaccagcaucgcgguagggacauccucgcuaggcccggccggaccauuccucagggugggcccuuuccgaagccgggaccgcuccugcuugucggcaucgcuccccacaggccgacgucgagagggccugcuuuacuccuccucuuucuccuccuucucccgcggcuucugcgcggagaggcgucgcccgggaucuggguuuuggaagaaggaucuuugugggaagacagggugaauuuaucacagaggaauaacgagggagaggagaaagguuuguccauggggcugcuagacuaguggaaggggaugcggugcgucaagggaaaauuagguugaaaacaaaugucguguauua

SEQ ID NO: 20351 - RNA, 1209 nt, Homo sapiens
cugacuauuggucaggugucaugggaggcagcaguggggcaagccgcgggcccucagccauggaguauaacaaagaggaucgagagagcuucaggcacaggugauggcugugaggggcaggucuggucggugugagggggcaggagcuggaaggcaggguagaucggaggcaaggaagaugccauccaguagcaucucugucucccauuccagguuauccugacacaucucucuuucuacaggauauugaacaucucacauuugucaagacagggaacacuugugacaacauguguagaaguaauuauucaagaccuuugaaauggguccccuagacccuuuaaugaacauuaauauaucucugcccuucucauauauuuuauccuauaaccucuacaaaaucccacccaucaucuccaucuuuuuuuuguuuuuuucgguagagacaggguuuugccacguugacagacuggucuugaacuccugagcucaagcgauccacccaccuuggccucccaaagugcugggauuacaggcaugagccaucaugccuggccaucucccucauuuuugaucauuuaguauaugaaagguaaaaugccaaacacuucucuuacauuuaauucucauaacucuaaagggcagcuacuauuaaugccccuauuuuaagcugggaaaauggaaacuucuaggugcuaaggcacuuacccaggugauguggccucccacaacaauugugggaggcuaagauuugcuauucccccuaaauagcaccuucaccacucaucuguccuuuaccuuaaaagacagugaacauugccuuucccuuacaaauugcaaguguccuucuccccuccugccccaguagguaacuuggcccuuggcucugagggaagaaaaggccucucugugugucaccacacauuacagggacuccugggaccauaacuguguguacugacaccugcgcuggcuuugaggguggagacguguggcugucaacccgaggucacaacauaaugaccagaaggcagccccacggugggucaguauuccauaggauacagaauauguucuauccacacaaccccauuuugaugcguggcacacgaguggaauagacucgguugccccuacuugacguucuggggugugagaggagccuggaaugcuucauccagccuggagcggagcugaggcucaggccga

SEQ ID NO: 20352 - RNA, 1209 nt, Homo sapiens
ucggccugagccucagcuccgcuccaggcuggaugaagcauuccaggcuccucucacaccccagaacgucaaguaggggcaaccgagucuauuccacucgugugccacgcaucaaaaugggguuguguggauagaacauauucuguauccuauggaauacugacccaccguggggcugccuucuggucauuauguugugaccucggguugacagccacacgucuccacccucaaagccagcgcaggugucaguacacacaguuauggucccaggagucccuguaauguguggugacacacagagaggccuuuucuucccucagagccaagggccaaguuaccuacuggggcaggaggggagaaggacacuugcaauuuguaagggaaaggcaauguucacugucuuuuaagguaaaggacagaugaguggugaaggugcuauuuagggggaauagcaaaucuuagccucccacaauuguugugggaggccacaucaccuggguaagugccuuagcaccuagaaguuuccauuuucccagcuuaaaauaggggcauuaauaguagcugcccuuuagaguuaugagaauuaaauguaagagaaguguuuggcauuuuaccuuucauauacuaaaugaucaaaaaugagggagauggccaggcaugauggcucaugccuguaaucccagcacuuugggaggccaagguggguggaucgcuugagcucaggaguucaagaccagucugucaacguggcaaaacccugucucuaccgaaaaaaacaaaaaaaagauggagaugaugggugggauuuuguagagguuauaggauaaaauauaugagaagggcagagauauauuaauguucauuaaagggucuaggggacccauuucaaaggucuugaauaauuacuucuacacauguugucacaaguguucccugucuugacaaaugugagauguucaauauccuguagaaagagagaugugucaggauaaccuggaaugggagacagagaugcuacuggauggcaucuuccuugccuccgaucuacccugccuuccagcuccugcccccucacaccgaccagaccugccccucacagccaucaccugugccugaagcucucucgauccucuuuguuauacuccauggcugagggcccgcggcuugccccacugcugccucccaugacaccugaccaauagucag

SEQ ID NO: 20353 - RNA, 561 nt, Homo sapiens
gcccggcaccuacaaggccggcucgucgcaggacgaccaggaggacgcguccgacgacgcgcugccgcccuacagcgagcuggagcugacccgcggcccguccuaccgcggccgcgaccugcccuaccacagcaacucggagaagaagaggaaaaaggagcccgccaagaaaaccgugagacugcgucugccuccccuccuccgaggggacugagcgggagccuccaggcagggcgagcagugucgcugucugggggccggggagguggcgaggcgggaggguccuugccggagaggccgcaggggccugccugggcgaguucguccgcggaugcuaggccgggggcuuuuucagccucacucuguccaaggccagaugaaggaaggaagcaagggcugggagaguugaaaaacaggcagaaaguugaaggcguguauaugguuuuacagggagcauuagguauuuaaccaacucagaagccuuuagcaucagggaucucgggagccaucaccaccaccggccuuuagugggcuucugaggucugugugcagaaucuucga

SEQ ID NO: 20354 - RNA, 561 nt, Homo sapiens
ucgaagauucugcacacagaccucagaagcccacuaaaggccggugguggugauggcucccgagaucccugaugcuaaaggcuucugaguugguuaaauaccuaaugcucccuguaaaaccauauacacgccuucaacuuucugccuguuuuucaacucucccagcccuugcuuccuuccuucaucuggccuuggacagagugaggcugaaaaagcccccggccuagcauccgcggacgaacucgcccaggcaggccccugcggccucuccggcaaggacccucccgccucgccaccuccccggcccccagacagcgacacugcucgcccugccuggaggcucccgcucaguccccucggaggaggggaggcagacgcagucucacgguuuucuuggcgggcuccuuuuuccucuucuucuccgaguugcugugguagggcaggucgcggccgcgguaggacgggccgcgggucagcuccagcucgcuguagggcggcagcgcgucgucggacgcguccuccuggucguccugcgacgagccggccuuguaggugccgggc

SEQ ID NO: 20355 - RNA, 885 nt, Homo sapiens
uggcggucaccaagagguauuuauuggugggaugacaacauauugguauugacguuauuuaaaagagaaagaaagagcgaucacggucaaguuugaagguccuuauguuacacccacgcauaauucaauaggugaauaaaccuuguggcccccagacacacgccaacagcuugaauuacccggggugaaaccggcgagacguccacucagggcuuucgguccugaccagccacggaacaaacaacgucaauucauucuaagugccuggugaagguagaaaucagaaaccgugucugugucacguuagucgugacaagcugcguaccugcaaugacgugauggaagccuccuccucgggucccuucucucucucucucucccucucccucugccuucucugaguucucuaguccacagcggggucuaaguuuggucucccgccgccgcuuucaguucgaccgcagccagacugcagcagacgcccauaagagaagcgcgccggcugagggugcaggagaggcgagagcgcgccccgcgccgcgcggucccaggcuggcugcuccugcagaugugaaaggagcccggagacuuagcucugaauccucucggcgcugcauggggauauuaucagagucugggauuucuauuggcucugaacaccaaacaaaucacaccagccaccccccuucucuguuucacucagcgcuuguuucucaucuaacccacaaacauugcagccacaccacacacuucagucgcuugcaauguuucucuuuuccuccuuccagucaguggauuuacaacccuguggucagcucuaacauuuuuuuuagcagacuuccaauucuaaccuucuuguuuauguagagaaauucucccuccauc

SEQ ID NO: 20356 - RNA, 885 nt, Homo sapiens
gauggagggagaauuucucuacauaaacaagaagguuagaauuggaagucugcuaaaaaaaauguuagagcugaccacaggguuguaaauccacugacuggaaggaggaaaagagaaacauugcaagcgacugaagugugugguguggcugcaauguuuguggguuagaugagaaacaagcgcugagugaaacagagaagggggguggcuggugugauuuguuugguguucagagccaauagaaaucccagacucugauaauauccccaugcagcgccgagaggauucagagcuaagucuccgggcuccuuucacaucugcaggagcagccagccugggaccgcgcggcgcggggcgcgcucucgccucuccugcacccucagccggcgcgcuucucuuaugggcgucugcugcagucuggcugcggucgaacugaaagcggcggcgggagaccaaacuuagaccccgcuguggacuagagaacucagagaaggcagagggagagggagagagagagagagaagggacccgaggaggaggcuuccaucacgucauugcagguacgcagcuugucacgacuaacgugacacagacacgguuucugauuucuaccuucaccaggcacuuagaaugaauugacguuguuuguuccguggcuggucaggaccgaaagcccugaguggacgucucgccgguuucaccccggguaauucaagcuguuggcgugugucugggggccacaagguuuauucaccuauugaauuaugcguggguguaacauaaggaccuucaaacuugaccgugaucgcucuuucuuucucuuuuaaauaacgucaauaccaauauguugucaucccaccaauaaauaccucuuggugaccgcca

SEQ ID NO: 20357 - RNA, 1496 nt, Homo sapiens
ccguagccucccgccccaauugugagauugcgacaccguggcagcccuggaggcgucaguccugagauuucugacuguuagucggcucgcccguuaggcaguacucuggaguuuuuccguaccuggaaacgugucuuggaacugaugcugaacugaauuucuuggguucgaguuuaagggacucaggauugcagaagccucguuaaugggaucuagagaugcgaagaacuggccggccgagggcugcaggccugagaggugcaccccggcgggccgcccaccgguuagcagggaagugagaucuggggacaagggaaaaggauagcagguuacaucucgggcacacucacacucuccgcugauuuguuccuccccuuccccuugcccuggauucacuuuuauugagcgaagucaagagagaacccgucuaggcgcugaaaccucucucucccaacaguugccaaggagcgacgcacgaaaaguuccugugugucccucacguccauaugcauguauauaguaaguaaaggcuuuacauaaaucggcuuacggccucacuuucacgugucuuccaagaacgccacagacgcaaaaccuccgccccaagguggccccacucugcccgcucaucuaggcgguuuuguuuauuauuuacauuuccugggugaaauuuuuacuagaaaucagauaagugcgaaaguguuucccaaaaaugcuuuagcugucagaaaauauaauucugucucuagauacauuauuaaagagaucaaagucauguuagcagauaauuacaccaaccacuuuuauaaauauugauucuaagacguguuuuuaaagaaucccuggagucauuuuuuguuuguuuuacauagaacaggugaguuuuagaccuaauguuuuguaguuuucuuacaauucguuuucuucucucccguuuuaccgauuuguccuuaauuguaaaaacacucaaaggcaccccaagccagcccgggguccggggagugggucaguggucagaggccugcagccucccgcccaagaccuaccucucagcguguugccuucuuugacuuuugggucaaauucugcagauaaaaugcggucaauuccaaauuugaggucuuugcuggagggggccggggcagagccacugugguggggguucggaaccacucgcguccccgaggccgggggcugcagggcgccagcccggggcggaggcggaggcuguugcugcugcggcuguugcugcugcuguuguuguugcgggugaugguggugguaggcggcugagagcggagacagccgcugcgggaagccagccgggacuucggagggcgccaccacuggggugggucgaagcggggaucuggccgccgcuuggaaagaggcgugcgggugaaccgagcccaagugcgcggugagggcggcggccgaggccccugccaggcccuccggggccgcccccagaucccccacgccggcgugcagaaugu

SEQ ID NO: 20358 - RNA, 1496 nt, Homo sapiens
acauucugcacgccggcgugggggaucugggggcggccccggagggccuggcaggggccucggccgccgcccucaccgcgcacuugggcucgguucacccgcacgccucuuuccaagcggcggccagauccccgcuucgacccaccccagugguggcgcccuccgaagucccggcuggcuucccgcagcggcugucuccgcucucagccgccuaccaccaccaucacccgcaacaacaacagcagcagcaacagccgcagcagcaacagccuccgccuccgccccgggcuggcgcccugcagcccccggccucggggacgcgagugguuccgaacccccaccacaguggcucugccccggcccccuccagcaaagaccucaaauuuggaauugaccgcauuuuaucugcagaauuugacccaaaagucaaagaaggcaacacgcugagagguaggucuugggcgggaggcugcaggccucugaccacugacccacuccccggaccccgggcuggcuuggggugccuuugaguguuuuuacaauuaaggacaaaucgguaaaacgggagagaagaaaacgaauuguaagaaaacuacaaaacauuaggucuaaaacucaccuguucuauguaaaacaaacaaaaaaugacuccagggauucuuuaaaaacacgucuuagaaucaauauuuauaaaagugguugguguaauuaucugcuaacaugacuuugaucucuuuaauaauguaucuagagacagaauuauauuuucugacagcuaaagcauuuuugggaaacacuuucgcacuuaucugauuucuaguaaaaauuucacccaggaaauguaaauaauaaacaaaaccgccuagaugagcgggcagaguggggccaccuuggggcggagguuuugcgucuguggcguucuuggaagacacgugaaagugaggccguaagccgauuuauguaaagccuuuacuuacuauauacaugcauauggacgugagggacacacaggaacuuuucgugcgucgcuccuuggcaacuguugggagagagagguuucagcgccuagacggguucucucuugacuucgcucaauaaaagugaauccagggcaaggggaaggggaggaacaaaucagcggagagugugagugugcccgagauguaaccugcuauccuuuucccuuguccccagaucucacuucccugcuaaccggugggcggcccgccggggugcaccucucaggccugcagcccucggccggccaguucuucgcaucucuagaucccauuaacgaggcuucugcaauccugagucccuuaaacucgaacccaagaaauucaguucagcaucaguuccaagacacguuuccagguacggaaaaacuccagaguacugccuaacgggcgagccgacuaacagucagaaaucucaggacugacgccuccagggcugccacggugucgcaaucucacaauuggggcgggaggcuacgg

SEQ ID NO: 20359 - RNA, 1489 nt, Homo sapiens
gaggagugaacugccugagcucugugcccugaagcccccccgggggcggggggagccagcuaugucagugucucccugggaggcugugcccuucucuagggcagggcugcacuguauucauuuucgcaucucuacugcucagcacaaugccugacgcauaaugagugcccccaaaauaucuucaaguccuaguccuugagcugagguuucugcaguaucaguucaccaauggagagggacaugauggcuucuuugugcucaacugggacccaaagcagagaugaaucguccuagcagggcucuaagccugaaagacccaacuuuauaguuuuaccccugccuguauucugcuccagaagcugcugacauaccuuuaaagaggaugauaaaccuaagcucccaggcauggagacugaauggcuucagguguaagacggcauugggcaacacagauaaauagacaauaaaucagauggggcccguggccuuuggccaggacacaguaacuucugugacuuuauucuggguggccuuguccaggccagcagagcuuccggcagcagcuucgacuguuuccaugcagagacaccugggaacugcaucugcgcuuugauuuccgcgaaggaaacugucauuuucucccauauucauucuuccuaaccccaucuccccgagacaaacggcagaauguuuugaaggccccagaguacacugauaguuggcuagacgagaaaaauucaacgagcgccuauuuauguauuuguugcgcucccaggcucgggaaauaaccuugggaauauuugggagaguaacccaaacauuucucaacuagugggauauccuggaggggauguuacuggaaaacaaauacacuggguugcaauuucuuucuuuccaacugggccaccuucuccaagucaccugccgcgcuaacgcuucaguauucccaucuguaaucaggaaacugauuccugaucuuacauaaaaaccaccgcgguaggagccccuugagaauguucuuaagaagccaggagcgcaauagcaggcacagcagggaccacccagcgcaacccccgauuuaaguuucuaucacgacucgcaacucgcggcuucccuccggcgagggaaugggagcgggggcggaggggucgcaggugcagcccggagaaacugggugagucgaugguaaggacccggcucccgcucccccgcgggacaccacacccgcgccccccgggcagugguggcgcagggccccuaccuugccguacuucuucagcuuccuccgguaccucuuccugggcugcucgcucggcgccggcuccuccaguggcucguagcgcucgggcaggagggcgaagugcacccuccgcgcgccccggguccccgggccccgcucguccgccgcgcucgucccgcucucggccgccgccuccgccucguccgcguacuccaggugcuccaggauggcggccgccuccucgucccc

SEQ ID NO: 20360 - RNA, 1489 nt, Homo sapiens
ggggacgaggaggcggccgccauccuggagcaccuggaguacgcggacgaggcggaggcggcggccgagagcgggacgagcgcggcggacgagcggggcccggggacccggggcgcgcggagggugcacuucgcccuccugcccgagcgcuacgagccacuggaggagccggcgccgagcgagcagcccaggaagagguaccggaggaagcugaagaaguacggcaagguaggggcccugcgccaccacugcccggggggcgcggguguggugucccgcgggggagcgggagccggguccuuaccaucgacucacccaguuucuccgggcugcaccugcgaccccuccgcccccgcucccauucccucgccggagggaagccgcgaguugcgagucgugauagaaacuuaaaucggggguugcgcuggguggucccugcugugccugcuauugcgcuccuggcuucuuaagaacauucucaaggggcuccuaccgcggugguuuuuauguaagaucaggaaucaguuuccugauuacagaugggaauacugaagcguuagcgcggcaggugacuuggagaagguggcccaguuggaaagaaagaaauugcaacccaguguauuuguuuuccaguaacauccccuccaggauaucccacuaguugagaaauguuuggguuacucucccaaauauucccaagguuauuucccgagccugggagcgcaacaaauacauaaauaggcgcucguugaauuuuucucgucuagccaacuaucaguguacucuggggccuucaaaacauucugccguuugucucggggagaugggguuaggaagaaugaauaugggagaaaaugacaguuuccuucgcggaaaucaaagcgcagaugcaguucccaggugucucugcauggaaacagucgaagcugcugccggaagcucugcuggccuggacaaggccacccagaauaaagucacagaaguuacuguguccuggccaaaggccacgggccccaucugauuuauugucuauuuaucuguguugcccaaugccgucuuacaccugaagccauucagucuccaugccugggagcuuagguuuaucauccucuuuaaagguaugucagcagcuucuggagcagaauacaggcagggguaaaacuauaaaguugggucuuucaggcuuagagcccugcuaggacgauucaucucugcuuugggucccaguugagcacaaagaagccaucaugucccucuccauuggugaacugauacugcagaaaccucagcucaaggacuaggacuugaagauauuuugggggcacucauuaugcgucaggcauugugcugagcaguagagaugcgaaaaugaauacagugcagcccugcccuagagaagggcacagccucccagggagacacugacauagcuggcuccccccgcccccgggggggcuucagggcacagagcucaggcaguucacuccuc

SEQ ID NO: 20361 - RNA, 4741 nt, Homo sapiens
uuaagguagcuguaacucauacacucugagggguacauuuaaaaagcaagugcaaauccacacacuucuugaucuuuaaagccaguaccugccucagcauuugacauucgauucaaccauuaagaacaauacugaaacuaaaaucuuaagggagaggaaggggaggggaguggagagggaaagagaguucucugaacaccaagggucaagauucauauuaugcaggaaguaguauaguaaauaauauuaagucugccucuaccgcauuuccaccuaacugcugauccgcacagaacgugggcaaagagcgccccauccgcagaaacgauuguuuaaaaccuggcgacagcaggguagaggacgccugcugccggaggggcuaugucauccgugucaaggcaggcucugaguaggggaaucagggcagaauucggucuggcuggacucagaaagccccacacuuuuucugcccgauguuuuaccccuguuucuucuuuaggaacaaacuuagagcuggaaaguguucgaucuuuuuuccucaaacuacacaggccuggucuucuuuuuuuacauuucagaacucuccugaacuucuccaggugaaagggagaaagaggugguacuggaauugccuuuauuuaaacggggguguauccuacaucuuaggugggaggcuaauggagggcaguacccagagacagaguaaggcaagaguugcaggcaaggaggcgacuugaaagcaaagacgcaagaaaauucugugcagccgggaaucugggaaaucucagaucccucaaacuuaagacaggggucuucccccccaaaccccuucagcaucagaauuccauuccugaagccaggagguaagagaccugucuaaaaaccaaaggcacuagcucugggaaaaggucaaggagaagggugugaauaaauaggucucuggggccuuucugaaaaugugcgaauugagggacgcuggcagagggcccccuccaccccgcccacccgccuagaaagagcuagcggguaacagggaacgccagguuuuuuggaagagccggguuccagccgugcuuguccggcgccggcuaccgggcccagagagcccggacccgcggaggcagagccagggcaccccgcgcuuggggacaucccgagaccccccaccccaaaaccugcagccgcgcagagacggagggcugcggccuggcgcccgccaggugagcgccaggccccagggccaccagccgggagaggcgccugcugcgacucuuucaaaacacacucucgcgacgagccagaggccuuccucgcccauuuccgggccccaauuuuuuuguaaaugaaccaggaacggcagaugggggcuuucgcuugaccucuccccgcccucaggucccucccgaccuccccgagccgggacggcugaagcggccggcgggagccccggcaccccgggcgcacucaccguggugggucggaggguaccucugcaccguggcccugaccgaguuuccguaguagggcgggacgugguugccuugaccgucgauguuaaaaagcacauccaccuccuccggcagcggguacugcgccgcguccauguaggaguggcugaggcccggguggugcguguccgggugcugcccguugagcacggcgggguggugguggcucacccagcgcggcugguccgccgucaccuccauggccucggcugugcucgcgcccucucgccgggcccggaacccgcgcgcggggagggagggcgguccgccugggaggucggggggcuccugccgucggagggucgggggucguugaaugauuugcuuucgguggggggaugggaaggcugggaagcaaaggugagcaaaggagaagguuuuuuaaaaauuaucuuggaggggucguuuagcaaagagaagaaggggaagacaaaaauccaaaaacuggguacggcagaauaaaacgggaccagguuguaaaaaggggcgacgacucugcaauucugcgagccaggcuccucugcaccgggguccucagccgcucggaggcggagucccuccucgggucaccugcaagggagagaaugggagaccuggaugagccccugaguugcuggaguggcacaaccuccccucgcgccgcccgcccgcccagcgcacccgagacccgcacgggagcgcggggacacggccgcggagcccgcagggcucucggggacgucccugcagcccggcucgcgggagccggggcuggcugagcaacuuggagggcaagucccagggcugacuguuacgacuuggagggcaagucccucccucggggacaccggucccgggaccguccucucagccccuagaaaaccuccaaaagaggagaguugaguuuuuaaaauugauuuagguccucccaagugguugggggcaaaaaaucaaacuuaaaaaaaaaaaaagucaccaguaccaaccuggguagcgaagagcagagaggaggaggaggcggcggcguacgaccugcucggucagauugcguugcucgcucugucucgcucucccuccgucucucucucuucuucucucucucucucccucucucaguauuuuuuuuuuuuuuuuacagggaaugcauucuuucugaaaguaucaagacggcgccaggcagcucaguguucgcagacagcuguggcgcgacgcaacuuaaggagguucuagugucauccgcgccgggggggaggagccuggcgcuggcgaguaggggacaggauccccggcacaaggaaacugcaacccaaacccgcuccaggacuucuccccccgccccgcgcacccccgccccuccucccgccccuccacugaccggaaaggggcgccgcagagggcggccgccggcggaggggcggcgggcagggugggcgaggcccgcggggcuugggggcggacgggagggaacgcgcgcucuggcccuuuaaauguggccgcggcuccugccaauucauucgggucggguggacgauuccgucccggugcagccagccugccccauucaugaaguucauuucgaugggcagaauuuucuuuuucagacuuuuaaaaaauaggcacgcauggaucauuauuaggaucuaaugcaggguguuugggagagcgcaucgauguggggaaacgugcgcguuaaauugaucagaaaaacaaaauguuucaugucaagguauuuugagauuugccucucgggccgacuuccuaagagggugagucaucggauaaaggggagaugccuuugacuggagcguccgcgucaauuuuguugucauugucaccucuuucccgagccuucugcgcucucaagcccccagagugaacacgcuucagcuguugcagcugcccuuuccagaccuaauauuuguaaucaaugugugcuuuugacuugaguggcaacagugagggaugagaaggggggaggggaggaagagacuggcucuaacucauuccccgaguacgcucaguguagacggacagaaagaacucggucuucacucuagggacccaacuuuuccuuucgccccgcccggagcccuacuuacuccggcucccggcguuucucccacagucaaggaaaccagcccucggucugcaccgaccccaaccccggccucuggucgggacuccacggcgaccuuccccggcucgcgggucuccaggccacgcucugcgcaaugggcaccccggggcggagggcacgcggcuccgaggcgccccagcgagaggggcggggcgagcgggggcggggccuggagggaccaaucagcgggcgaggcuguggccgagccgcgauugguccgccccgcggguuccaaccugcaccgcccgcucgguccuuugagccacugcauccccuagcggcgcccggguggcugcagccgcuggcccgaaaaugcugcucgggcgagcaggggucaggcgggaaaagaagacuccaaauccacucucugcucgcccccagggcaaugcugccaggagagggaguggguucccccgcaggcuaucccaccgauggggcugagagcuuaauuugggguuuuauuugaauuggagacauuguucccucuucgcuccucuaccccauaaaauucccuacaaaugcaaaaauucgagauagaagaagccgucccugaaaguaaguucugaaggauuccuuucaugcggugaaggaacaacaacaauauucaacuucaccuuggugugugagggucgucguguuuuaaaacacuaucccuguagaaagauuagugaaauguauuggaagaaguaguggaaacgugaaucuuccuggucucgcguuuggaucuucuuuggaguccucaccuucuuaaaucugauguuuguuugaaaucagggcugaauuuccauauauaggacagaaagaaagaaccccaauuuuuuaaagaaagcuccccccccccccgccacguuucuccugagcccacuuggucucccguuauuaggcggcccaguuaagaggcaucgauuuuccuuucauucucugaccacucgucucuccugggccagccaggcugcccgcaucuucuccugcucacagcgcucucuaaaccuuuuaauuauuuaguugcugucuaacauucaccggaaaccucuccauaaacaaggagaaacgaaugcacacgcauuuuugcuaagaagcccgggauuaagauuuaaggauacaagcugaaagaaaa

SEQ ID NO: 20362 - RNA, 4741 nt, Homo sapiens
uuuucuuucagcuuguauccuuaaaucuuaaucccgggcuucuuagcaaaaaugcgugugcauucguuucuccuuguuuauggagagguuuccggugaauguuagacagcaacuaaauaauuaaaagguuuagagagcgcugugagcaggagaagaugcgggcagccuggcuggcccaggagagacgaguggucagagaaugaaaggaaaaucgaugccucuuaacugggccgccuaauaacgggagaccaagugggcucaggagaaacguggcggggggggggggagcuuucuuuaaaaaauugggguucuuucuuucuguccuauauauggaaauucagcccugauuucaaacaaacaucagauuuaagaaggugaggacuccaaagaagauccaaacgcgagaccaggaagauucacguuuccacuacuucuuccaauacauuucacuaaucuuucuacagggauaguguuuuaaaacacgacgacccucacacaccaaggugaaguugaauauuguuguuguuccuucaccgcaugaaaggaauccuucagaacuuacuuucagggacggcuucuucuaucucgaauuuuugcauuuguagggaauuuuaugggguagaggagcgaagagggaacaaugucuccaauucaaauaaaaccccaaauuaagcucucagccccaucggugggauagccugcgggggaacccacucccucuccuggcagcauugcccugggggcgagcagagaguggauuuggagucuucuuuucccgccugaccccugcucgcccgagcagcauuuucgggccagcggcugcagccacccgggcgccgcuaggggaugcaguggcucaaaggaccgagcgggcggugcagguuggaacccgcggggcggaccaaucgcggcucggccacagccucgcccgcugauuggucccuccaggccccgcccccgcucgccccgccccucucgcuggggcgccucggagccgcgugcccuccgccccggggugcccauugcgcagagcguggccuggagacccgcgagccggggaaggucgccguggagucccgaccagaggccgggguuggggucggugcagaccgagggcugguuuccuugacugugggagaaacgccgggagccggaguaaguagggcuccgggcggggcgaaaggaaaaguugggucccuagagugaagaccgaguucuuucuguccgucuacacugagcguacucggggaaugaguuagagccagucucuuccuccccuccccccuucucaucccucacuguugccacucaagucaaaagcacacauugauuacaaauauuaggucuggaaagggcagcugcaacagcugaagcguguucacucugggggcuugagagcgcagaaggcucgggaaagaggugacaaugacaacaaaauugacgcggacgcuccagucaaaggcaucuccccuuuauccgaugacucacccucuuaggaagucggcccgagaggcaaaucucaaaauaccuugacaugaaacauuuuguuuuucugaucaauuuaacgcgcacguuuccccacaucgaugcgcucucccaaacacccugcauuagauccuaauaaugauccaugcgugccuauuuuuuaaaagucugaaaaagaaaauucugcccaucgaaaugaacuucaugaauggggcaggcuggcugcaccgggacggaaucguccacccgacccgaaugaauuggcaggagccgcggccacauuuaaagggccagagcgcgcguucccucccguccgcccccaagccccgcgggccucgcccacccugcccgccgccccuccgccggcggccgcccucugcggcgccccuuuccggucaguggaggggcgggaggaggggcgggggugcgcggggcggggggagaaguccuggagcggguuuggguugcaguuuccuugugccggggauccuguccccuacucgccagcgccaggcuccucccccccggcgcggaugacacuagaaccuccuuaaguugcgucgcgccacagcugucugcgaacacugagcugccuggcgccgucuugauacuuucagaaagaaugcauucccuguaaaaaaaaaaaaaaaauacugagagagggagagagagagagaagaagagagagagacggagggagagcgagacagagcgagcaacgcaaucugaccgagcaggucguacgccgccgccuccuccuccucucugcucuucgcuacccagguugguacuggugacuuuuuuuuuuuuuaaguuugauuuuuugcccccaaccacuugggaggaccuaaaucaauuuuaaaaacucaacucuccucuuuuggagguuuucuaggggcugagaggacggucccgggaccgguguccccgagggagggacuugcccuccaagucguaacagucagcccugggacuugcccuccaaguugcucagccagccccggcucccgcgagccgggcugcagggacguccccgagagcccugcgggcuccgcggccguguccccgcgcucccgugcgggucucgggugcgcugggcgggcgggcggcgcgaggggagguugugccacuccagcaacucaggggcucauccaggucucccauucucucccuugcaggugacccgaggagggacuccgccuccgagcggcugaggaccccggugcagaggagccuggcucgcagaauugcagagucgucgccccuuuuuacaaccuggucccguuuuauucugccguacccaguuuuuggauuuuugucuuccccuucuucucuuugcuaaacgaccccuccaagauaauuuuuaaaaaaccuucuccuuugcucaccuuugcuucccagccuucccauccccccaccgaaagcaaaucauucaacgacccccgacccuccgacggcaggagccccccgaccucccaggcggaccgcccucccuccccgcgcgcggguuccgggcccggcgagagggcgcgagcacagccgaggccauggaggugacggcggaccagccgcgcugggugagccaccaccaccccgccgugcucaacgggcagcacccggacacgcaccacccgggccucagccacuccuacauggacgcggcgcaguacccgcugccggaggagguggaugugcuuuuuaacaucgacggucaaggcaaccacgucccgcccuacuacggaaacucggucagggccacggugcagagguacccuccgacccaccacggugagugcgcccggggugccggggcucccgccggccgcuucagccgucccggcucggggaggucgggagggaccugagggcggggagaggucaagcgaaagcccccaucugccguuccugguucauuuacaaaaaaauuggggcccggaaaugggcgaggaaggccucuggcucgucgcgagaguguguuuugaaagagucgcagcaggcgccucucccggcugguggcccuggggccuggcgcucaccuggcgggcgccaggccgcagcccuccgucucugcgcggcugcagguuuugggguggggggucucgggauguccccaagcgcggggugcccuggcucugccuccgcggguccgggcucucugggcccgguagccggcgccggacaagcacggcuggaacccggcucuuccaaaaaaccuggcguucccuguuacccgcuagcucuuucuaggcgggugggcgggguggagggggcccucugccagcgucccucaauucgcacauuuucagaaaggccccagagaccuauuuauucacacccuucuccuugaccuuuucccagagcuagugccuuugguuuuuagacaggucucuuaccuccuggcuucaggaauggaauucugaugcugaagggguuugggggggaagaccccugucuuaaguuugagggaucugagauuucccagauucccggcugcacagaauuuucuugcgucuuugcuuucaagucgccuccuugccugcaacucuugccuuacucugucucuggguacugcccuccauuagccucccaccuaagauguaggauacacccccguuuaaauaaaggcaauuccaguaccaccucuuucucccuuucaccuggagaaguucaggagaguucugaaauguaaaaaaagaagaccaggccuguguaguuugaggaaaaaagaucgaacacuuuccagcucuaaguuuguuccuaaagaagaaacagggguaaaacaucgggcagaaaaaguguggggcuuucugaguccagccagaccgaauucugcccugauuccccuacucagagccugccuugacacggaugacauagccccuccggcagcaggcguccucuacccugcugucgccagguuuuaaacaaucguuucugcggauggggcgcucuuugcccacguucugugcggaucagcaguuagguggaaaugcgguagaggcagacuuaauauuauuuacuauacuacuuccugcauaauaugaaucuugacccuugguguucagagaacucucuuucccucuccacuccccuccccuuccucucccuuaagauuuuaguuucaguauuguucuuaaugguugaaucgaaugucaaaugcugaggcagguacuggcuuuaaagaucaagaaguguguggauuugcacuugcuuuuuaaauguaccccucagaguguaugaguuacagcuaccuuaa

SEQ ID NO: 20363 - RNA, 2531 nt, Homo sapiens
gagcagccggcggagcucggguggaggaaagcgaggaggcgaccaggaggaugccgccgccgccgccgcagggcccggggcuucugcagggcgcaaggccucccucaccaggguaaggggcuggcgaucaaccuggacgccugggaccuugggagcaagcaucccgcagccgagcaggcgacggcgcggccaccgccuagagaggagccggggcccggggcggcgugcgggucggcagcagccggcuuggccuauccgaaaccccaggccuggaagcggcugcuuuaggcgucaaguugagcgggguauguguguccucuugggaaaaaggugagaaauggagccggacuuucuccacucgguagggguuaagcuaccacacacacccccaaacacaugcccacgugcaagucccucccacccgcccucccaggggcgaagagacccugucccaguggaaguggggaaacccagucggguacagaaagcagaggccauggcgcagagcggaggcgcggcuuucuggggcucagcccuagggcuacagacccagggcgcggagaugcucgcggccgggccacccaccagagccaggcaaccggcgcuuccaggcgagcuccgcggggccgaggugccgggagaagcggccccgggcgcccgcgcgcugcccgaccuggguaacaggcaaagcggagccccggggucgaaguccuaaaguuacuaaucccgcggagggggagagagcgugccucgggccgcccggggcggucauuugagcguguuuacuuaaagacuuugcaagcagagcgcgcgcgaaaucgucggauuuccagcgaggcagcaaauauuugcaggcagaagaaagaagcggagccgagccgagccgccgagucccuccccccggagccccggagccccggcgccugccugggcggucccggccgcgcagacagaaaagaagccgggaaucugcggggcuggggggcggggagcgacaccaaaggccagaaacugcagcacggcccgaggcccuggcgagcugggccugggggaggagaagucccuucccauuccagcucgaucaaucuugcugggcugcgaucggucaauaaaaacggugugaagcggccgcugucgcugugagucuggggaggaaguggaggccaaaggugucgaggccggcgccaguaccccgcaccagccggguccgcggccccgcggucugcacgucgcaggccgggggccagagcuuugccggcagccgagagcggcccggcggggccuuuaauugggugucuccauuuuaauagaggccauuguuggagcaauuagagaaagacaauaaccgcccagagacguuuaauucgauucccugcgcccgccgcaguacgcaccggggcgcucuggaagaguggccgaggcugcgcggaagggaggguccgcuuggggaggcgccggcuucuuuccuugcuugcuuugccuucggugugggaauuguaaagggcgacuggggcaagaugaaagcggggcgagggcgaccugagccaggccagggccggccucucuagcccacgccgggcgcccgcgggaccgccgcgccuuucgcggcgcgcguccagcuguggccgccgcggagguccccagcgccuguucaaaggagagaagccggaggaccgggccgugaaaacuggccuccuuccuccuuagccccggguccccauuucugucacccgaaccauguccauauuuccuucccuauggugggaggaggggcaaaggagagaucccggguauuggagcgcgcacaccuccgucuccaacccagccagccucaccgcccccuccuccgccucggccccuggauuagguuacccuggccgcgcaaggguuucuacuggauaggacuauagcacagguaaagcuguauaaacagcucgccggcugccgggcgggaggguuaugccggggacacggcuccaggcgccgccgcuggccccggcugcgcgggccacaccgcggggagcccgcugcggcagggcgccccggaccgcgcagguuaaauacauauuaucucugucucugccacucgggcccccguuuucuuucccuugcgagcugaaaugcggagagcggggagcaagaccuaaacgggaagaaaaggcagucgggcagugggcaauacugguugaggaucccggcccagcaaggcuggcucucuucaaacaaaacccagagagcagggaacuugggggaaagcagagaaagagggacccuaaaacucacuggcaaugggaagaugauggaggcgggugcguccaaggggcaacucuccucgcggcucccacgcccacgcgccccgggccaggagucuaccuuccccgugaaaugagcuaucguuuuggggaugguaugugauuugauuuacccuuuuuucuuuuccuuccuuuaguucuuuuuucuuuuucuuuuuucuuuuuuuuucuguuuguuuguuuguuuugcuuauucaucgaucaccguuuaaaacucgg

SEQ ID NO: 20364 - RNA, 2531 nt, Homo sapiens
ccgaguuuuaaacggugaucgaugaauaagcaaaacaaacaaacaaacagaaaaaaaaagaaaaaagaaaaagaaaaaagaacuaaaggaaggaaaagaaaaaaggguaaaucaaaucacauaccauccccaaaacgauagcucauuucacggggaagguagacuccuggcccggggcgcgugggcgugggagccgcgaggagaguugccccuuggacgcacccgccuccaucaucuucccauugccagugaguuuuagggucccucuuucucugcuuucccccaaguucccugcucucuggguuuuguuugaagagagccagccuugcugggccgggauccucaaccaguauugcccacugcccgacugccuuuucuucccguuuaggucuugcuccccgcucuccgcauuucagcucgcaagggaaagaaaacgggggcccgaguggcagagacagagauaauauguauuuaaccugcgcgguccggggcgcccugccgcagcgggcuccccgcgguguggcccgcgcagccggggccagcggcggcgccuggagccguguccccggcauaacccucccgcccggcagccggcgagcuguuuauacagcuuuaccugugcuauaguccuauccaguagaaacccuugcgcggccaggguaaccuaauccaggggccgaggcggaggagggggcggugaggcuggcuggguuggagacggaggugugcgcgcuccaauacccgggaucucuccuuugccccuccucccaccauagggaaggaaauauggacaugguucgggugacagaaauggggacccggggcuaaggaggaaggaggccaguuuucacggcccgguccuccggcuucucuccuuugaacaggcgcuggggaccuccgcggcggccacagcuggacgcgcgccgcgaaaggcgcggcggucccgcgggcgcccggcgugggcuagagaggccggcccuggccuggcucaggucgcccucgccccgcuuucaucuugccccagucgcccuuuacaauucccacaccgaaggcaaagcaagcaaggaaagaagccggcgccuccccaagcggacccucccuuccgcgcagccucggccacucuuccagagcgccccggugcguacugcggcgggcgcagggaaucgaauuaaacgucucugggcgguuauugucuuucucuaauugcuccaacaauggccucuauuaaaauggagacacccaauuaaaggccccgccgggccgcucucggcugccggcaaagcucuggcccccggccugcgacgugcagaccgcggggccgcggacccggcuggugcgggguacuggcgccggccucgacaccuuuggccuccacuuccuccccagacucacagcgacagcggccgcuucacaccguuuuuauugaccgaucgcagcccagcaagauugaucgagcuggaaugggaagggacuucuccucccccaggcccagcucgccagggccucgggccgugcugcaguuucuggccuuuggugucgcuccccgccccccagccccgcagauucccggcuucuuuucugucugcgcggccgggaccgcccaggcaggcgccggggcuccggggcuccggggggagggacucggcggcucggcucggcuccgcuucuuucuucugccugcaaauauuugcugccucgcuggaaauccgacgauuucgcgcgcgcucugcuugcaaagucuuuaaguaaacacgcucaaaugaccgccccgggcggcccgaggcacgcucucucccccuccgcgggauuaguaacuuuaggacuucgaccccggggcuccgcuuugccuguuacccaggucgggcagcgcgcgggcgcccggggccgcuucucccggcaccucggccccgcggagcucgccuggaagcgccgguugccuggcucugguggguggcccggccgcgagcaucuccgcgcccugggucuguagcccuagggcugagccccagaaagccgcgccuccgcucugcgccauggccucugcuuucuguacccgacuggguuuccccacuuccacugggacagggucucuucgccccugggagggcgggugggagggacuugcacgugggcauguguuugggggugugugugguagcuuaaccccuaccgaguggagaaaguccggcuccauuucucaccuuuuucccaagaggacacacauaccccgcucaacuugacgccuaaagcagccgcuuccaggccugggguuucggauaggccaagccggcugcugccgacccgcacgccgccccgggccccggcuccucucuaggcgguggccgcgccgucgccugcucggcugcgggaugcuugcucccaaggucccaggcguccagguugaucgccagccccuuacccuggugagggaggccuugcgcccugcagaagccccgggcccugcggcggcggcggcggcauccuccuggucgccuccucgcuuuccuccacccgagcuccgccggcugcuc

SEQ ID NO: 20365 - RNA, 847 nt, Homo sapiens
gcuacuucuagacccgaccucuccuccgucccagggggccgcucagccacaccgcuauagcacccaggacuccggccccugcaccaaggaaaggcuccagccuggcagaaauucacccauuucaaggcuuggcccaccaggccuuagcauugccgggugagguggggugcacgcgguguucagucuggccagucggagucaccugcuccacucccccggccuggucacccacauccucacagccacccagcuccugagcccccuggccaaccacagccccaacccccagcgcuggccucagccgagucuccuccgucugcuucaguuuggccuuuuaggaggagaaggagggcuuuaucuggggacuauuguguuuugacucaucuagauuagccuaggagcuggagugugauuguagcgggacacucuggcaggggauguguucacagcacggauaggaaaagagggggagggggacuccauucagaucuuggagacaguagaggcgcgcuuuuaaaagcacaaaccguucuugucuuccuuuggacaugcuagagaccaccuggugaaaaaaaaaauccauguuugugcccgacucagaggugcaaaggaggagguuuggcaugcgcacccuucucccggccucccuuggucccggacugcccccuacccgcagccccucccuccgggcagcucagcucuaggcugccuuccaccucgcggacccuaagcaauuuguuauauaaaacaaaacagcaaccagacgcaugugccuguucuucacuaacgccagcagaccggcagcgacggauacccgguggaccucagccgggacgccucgggcagc

SEQ ID NO: 20366 - RNA, 847 nt, Homo sapiens
gcugcccgaggcgucccggcugagguccaccggguauccgucgcugccggucugcuggcguuagugaagaacaggcacaugcgucugguugcuguuuuguuuuauauaacaaauugcuuaggguccgcgagguggaaggcagccuagagcugagcugcccggagggaggggcugcggguagggggcaguccgggaccaagggaggccgggagaagggugcgcaugccaaaccuccuccuuugcaccucugagucgggcacaaacauggauuuuuuuuuucaccagguggucucuagcauguccaaaggaagacaagaacgguuugugcuuuuaaaagcgcgccucuacugucuccaagaucugaauggagucccccucccccucuuuuccuauccgugcugugaacacauccccugccagagugucccgcuacaaucacacuccagcuccuaggcuaaucuagaugagucaaaacacaauaguccccagauaaagcccuccuucuccuccuaaaaggccaaacugaagcagacggaggagacucggcugaggccagcgcuggggguuggggcugugguuggccagggggcucaggagcuggguggcugugaggaugugggugaccaggccgggggaguggagcaggugacuccgacuggccagacugaacaccgcgugcaccccaccucacccggcaaugcuaaggccuggugggccaagccuugaaaugggugaauuucugccaggcuggagccuuuccuuggugcaggggccggaguccugggugcuauagcgguguggcugagcggcccccugggacggaggagaggucgggucuagaaguagc

SEQ ID NO: 20367 - RNA, 532 nt, Homo sapiens
cacuccccagaaagcccguaagcuacccucuguugcggaggaucccacggccaggggucgcuucccgcgccgggacuccccagcgcacgagcuguccccgggacccagcucccggcuucccgccccucgagggucgcgcucgcaggggcgcgcaccgaucgagggucccagacuccggaacugcccucuccaggccgcggggcgcccuccugcgcgcacgacccccgccucuccagggugggacggcguccccccuugccgucgcuccagggagcccggccgccgcgcccuuccuccgcgggcucccacccccauuuccggggucuccucccucucgcccgcaccuucccgcgcucccuccccgcccuccccgccgcccgcccgcgcucaccugguuguuuuugcagagaucagcccacaugcuggugccguccccuccgcgcaucaggacgugguaggugaagaaguagaugcccgggauggagcaggugaacuugccggugguggggucguagugguuuccgagguuggu

SEQ ID NO: 20368 - RNA, 532 nt, Homo sapiens
accaaccucggaaaccacuacgaccccaccaccggcaaguucaccugcuccaucccgggcaucuacuucuucaccuaccacguccugaugcgcggaggggacggcaccagcaugugggcugaucucugcaaaaacaaccaggugagcgcgggcgggcggcggggagggcggggagggagcgcgggaaggugcgggcgagagggaggagaccccggaaaugggggugggagcccgcggaggaagggcgcggcggccgggcucccuggagcgacggcaaggggggacgccgucccacccuggagaggcgggggucgugcgcgcaggagggcgccccgcggccuggagagggcaguuccggagucugggacccucgaucggugcgcgccccugcgagcgcgacccucgaggggcgggaagccgggagcugggucccggggacagcucgugcgcuggggagucccggcgcgggaagcgaccccuggccgugggauccuccgcaacagaggguagcuuacgggcuuucuggggagug

SEQ ID NO: 20369 - RNA, 81 nt, Homo sapiens
gcucgcccgggcagcucacacuuuuaugccgccgccgccugcgaucgacuuuuccguuuuugcagacugcgccuguucgca

SEQ ID NO: 20370 - RNA, 81 nt, Homo sapiens
ugcgaacaggcgcagucugcaaaaacggaaaagucgaucgcaggcggcggcggcauaaaagugugagcugcccgggcgagc

SEQ ID NO: 20371 - RNA, 534 nt, Homo sapiens
uacuguauaaggugucaagcugaggcacuuuucacuugcagguaugaauggagaguguuggugugaaacaagaucuucgggaucuugacccaaagaaaaggagccaaagggcaugucaagcaauugaaguuaagcucauguuuuuaaagaucguuuauugagaugauuuugaaaugcuccuuuaccauucauaauuuaaaaauaaaguuuaacaaugguuuaaauucagaauggauuaaaauggaguuggggguggaaaguagagccauucuuaguaaauauaaauaacugaaaaguucuucugaggagacuauguacgaaguuaucauugcaucuuucaguauaggcagaucucucccucauauaacggauguuucuuggcgcuuggaauaucagauaaagguaaaguuuaagaaacuucucuagcgggggauuuagggaacuucuuaaaaccuagaguuaaaagcuguugcguguuuguuguguuauuuuagaccaaucaacuucauaggauguacagaccugcauauuugg

SEQ ID NO: 20372 - RNA, 534 nt, Homo sapiens
ccaaauaugcaggucuguacauccuaugaaguugauuggucuaaaauaacacaacaaacacgcaacagcuuuuaacucuagguuuuaagaaguucccuaaaucccccgcuagagaaguuucuuaaacuuuaccuuuaucugauauuccaagcgccaagaaacauccguuauaugagggagagaucugccuauacugaaagaugcaaugauaacuucguacauagucuccucagaagaacuuuucaguuauuuauauuuacuaagaauggcucuacuuuccacccccaacuccauuuuaauccauucugaauuuaaaccauuguuaaacuuuauuuuuaaauuaugaaugguaaaggagcauuucaaaaucaucucaauaaacgaucuuuaaaaacaugagcuuaacuucaauugcuugacaugcccuuuggcuccuuuucuuugggucaagaucccgaagaucuuguuucacaccaacacucuccauucauaccugcaagugaaaagugccucagcuugacaccuuauacagua

SEQ ID NO: 20373 - RNA, 1265 nt, Homo sapiens
gaagauugguuaaggauuuaaugggaaaggggcaucaaaaguaguauuuuaagauaggcuucacuugaaauuaagauguuauuaauagagaauuggucuguauuugcuguucuugcugauugaaauaaacuucuguaguguuuaguguaaauuucuucuauucaugaugaguuugguccaauaagauaaacaaaauuaagagcauggcuuugaaaaugucuuugcuuucagaaauugaauuaaacugucaaaauuggauuuugaaacuuuuuaaaugacuuuauaaagggggaaguauacauaacauucuaaaacuguuuauauugcccauuuaagacugggaaaauucaaaacuacauuuauuaguggauaugacaacgaauuuauuucauaguuuuuaaaaaaugaagcucauuacuggaaauuuaagugaaauugaauuuuucaaaggcaucuucugcagagucguuuuaauguaacuaugaaucaaacuuucaacuuucagaaaauguguauacagcauaaccuuuguuagauaacuugagaaaauucagauguaucugggcgguuaaggauccgguuagaaaucauguuucagugugagggcaaauaaccgauuugaacaugagguauuuccgaggaaacgcuuuuuuugcccgauaguaguuugucaaaaguuaaaaucuuguugaauuuuaaacuuguuuggaagguguguccugauuuuuuuucuugcaucuuucuugagcuuggauacuucuuuccauguuuuauccuaaaaacgugguauuguauacacgucuuuuaggacuugguggggaaacuuaaagaugcuucgaaaagccuggaaagagcaacucaguuguaacuuggggaaguuaacgauccgcccgagugcagaggaaaaccagaaacgccuugccuucagcugaaccaccguuugugcgagcuggauguccuuuucaguagaaaagaauuuuccuuuugaauuuauaccauucaucaauuuugacacuuuaaaaacgugugaaaggguuaagagggaaagauacugcccaaguauuugaaucguuuaguaguaacuguccauuuauccuauuuugaucuuuuucaagucuucugaaaggaaguagacaguauuacacccugaauaaauaagguguuguuuuccacaaagagugaugauauuuuguuuggaucugaguucguguguuauuacuuugugugaagcuagauaggaguagugugaacuuuuaacgauagcc

SEQ ID NO: 20374 - RNA, 1265 nt, Homo sapiens
ggcuaucguuaaaaguucacacuacuccuaucuagcuucacacaaaguaauaacacacgaacucagauccaaacaaaauaucaucacucuuuguggaaaacaacaccuuauuuauucaggguguaauacugucuacuuccuuucagaagacuugaaaaagaucaaaauaggauaaauggacaguuacuacuaaacgauucaaauacuugggcaguaucuuucccucuuaacccuuucacacguuuuuaaagugucaaaauugaugaaugguauaaauucaaaaggaaaauucuuuucuacugaaaaggacauccagcucgcacaaacggugguucagcugaaggcaaggcguuucugguuuuccucugcacucgggcggaucguuaacuuccccaaguuacaacugaguugcucuuuccaggcuuuucgaagcaucuuuaaguuuccccaccaaguccuaaaagacguguauacaauaccacguuuuuaggauaaaacauggaaagaaguauccaagcucaagaaagaugcaagaaaaaaaaucaggacacaccuuccaaacaaguuuaaaauucaacaagauuuuaacuuuugacaaacuacuaucgggcaaaaaaagcguuuccucggaaauaccucauguucaaaucgguuauuugcccucacacugaaacaugauuucuaaccggauccuuaaccgcccagauacaucugaauuuucucaaguuaucuaacaaagguuaugcuguauacacauuuucugaaaguugaaaguuugauucauaguuacauuaaaacgacucugcagaagaugccuuugaaaaauucaauuucacuuaaauuuccaguaaugagcuucauuuuuuaaaaacuaugaaauaaauucguugucauauccacuaauaaauguaguuuugaauuuucccagucuuaaaugggcaauauaaacaguuuuagaauguuauguauacuucccccuuuauaaagucauuuaaaaaguuucaaaauccaauuuugacaguuuaauucaauuucugaaagcaaagacauuuucaaagccaugcucuuaauuuuguuuaucuuauuggaccaaacucaucaugaauagaagaaauuuacacuaaacacuacagaaguuuauuucaaucagcaagaacagcaaauacagaccaauucucuauuaauaacaucuuaauuucaagugaagccuaucuuaaaauacuacuuuugaugccccuuucccauuaaauccuuaaccaaucuuc

SEQ ID NO: 20375 - RNA, 1161 nt, Homo sapiens
ccgugggacaggaacugccugagcucgggccagagaguuaauauuugugcaggcgccgcaggaacgggcuccgcggacgacgggcuccagggacgcacaggcagcgggccucccaccgcgggugccgggggcgggggggcugcccccaugcggggcccuuccuggucgcggccucggccgcugcugcugcuguugcugcugcugucgccuuggccugucugggcccaggugucggccacggccucgcccucggggucccugggcgccccggacugccccgaggugugcacgugcgugccgggaggccuggccagcugcucggcacucucgcugcccgccgugcccccgggccugagccugcgccugcgcgcgcugcugcuggaccacaaccgcguccgugcgcugccgccaggugccuucgcgggagcgggcgcgcuacagcgccuggaccugcgcgagaacgggcugcacucggugcaugugcgagccuucuggggccugggcgcgcugcagcugcuggaccugagcgccaaccagcuggaagcacuggcaccagggacuuucgcgccgcugcgcgcgcugcgcaaccucucauuggccggcaaccggcuggcgcgccuggagcccgcggcgcuaggcgcgcucccgcugcugcgcucacucagccugcaggacaacgagcuggcggcacucgcgccggggcugcugggccgccugcccgcucuagacgcgcugcaccugcgcggcaacccuuggggcugcgggugcgcgcugcgcccgcucugcgccuggcugcgccggcacccgcugcccgcgucaggugagcugcuggggacgcgggucggggucugcagggcggugcggcagccgccaccugacgccgcgccuuugucugugucccacagaggccgagacggugcucugcguguggccgggacgccugacgcucagcccccugacugccuuuuccgacgccgccuuuagccauugcgcgcagccgcucgcccugcgggaccuggccgugguuuacacgcucgggccggccuccuuccucgucagccuggcuuccugccuggcgcugggcucugggcucaccgccugccgugcgcgccgccgccgccuccgcaccgccgcccuccgcccgccgagaccgccagaccc

SEQ ID NO: 20376 - RNA, 1161 nt, Homo sapiens
gggucuggcggucucggcgggcggagggcggcggugcggaggcggcggcggcgcgcacggcaggcggugagcccagagcccagcgccaggcaggaagccaggcugacgaggaaggaggccggcccgagcguguaaaccacggccaggucccgcagggcgagcggcugcgcgcaauggcuaaaggcggcgucggaaaaggcagucagggggcugagcgucaggcgucccggccacacgcagagcaccgucucggccucugugggacacagacaaaggcgcggcgucagguggcggcugccgcaccgcccugcagaccccgacccgcguccccagcagcucaccugacgcgggcagcgggugccggcgcagccaggcgcagagcgggcgcagcgcgcacccgcagccccaaggguugccgcgcaggugcagcgcgucuagagcgggcaggcggcccagcagccccggcgcgagugccgccagcucguuguccugcaggcugagugagcgcagcagcgggagcgcgccuagcgccgcgggcuccaggcgcgccagccgguugccggccaaugagagguugcgcagcgcgcgcagcggcgcgaaagucccuggugccagugcuuccagcugguuggcgcucagguccagcagcugcagcgcgcccaggccccagaaggcucgcacaugcaccgagugcagcccguucucgcgcagguccaggcgcuguagcgcgcccgcucccgcgaaggcaccuggcggcagcgcacggacgcgguugugguccagcagcagcgcgcgcaggcgcaggcucaggcccgggggcacggcgggcagcgagagugccgagcagcuggccaggccucccggcacgcacgugcacaccucggggcaguccggggcgcccagggaccccgagggcgaggccguggccgacaccugggcccagacaggccaaggcgacagcagcagcaacagcagcagcagcggccgaggccgcgaccaggaagggccccgcaugggggcagcccccccgcccccggcacccgcggugggaggcccgcugccugugcgucccuggagcccgucguccgcggagcccguuccugcggcgccugcacaaauauuaacucucuggcccgagcucaggcaguuccugucccacgg

SEQ ID NO: 20377 - RNA, 561 nt, Homo sapiens
uaccggcgcgacucggacaucuuugugcccuauggccgccuggagccccacugggggcccucgccaccgcugccagccaagagcaggguggccgccuggguggucagcaacuuccaggagcggcagcugcgugccaggcuguaccggcagcuggcgccucaucugcggguggaugucuuuggccgugccaauggacggccacugugcgccagcugccuggugcccaccguggcccaguaccgcuucuaccuguccuuugagaacucucagcaccgcgacuacauuacggagaaauucuggcgcaacgcacugguggcuggcacugugccaguggugcuggggcccccacgggccaccuaugaggccuucgugccggcugacgccuucgugcauguggaugacuuuggcucagcccgagagcuggcggcuuuccucacuggcaugaaugagagccgauaccaacgcuucuuugccuggcgugacaggcuccgcgugcgacuguucaccgacuggcgggaacguuucugugccaucugugaccgcuacccacaccuaccccgc

SEQ ID NO: 20378 - RNA, 561 nt, Homo sapiens
gcgggguagguguggguagcggucacagauggcacagaaacguucccgccagucggugaacagucgcacgcggagccugucacgccaggcaaagaagcguugguaucggcucucauucaugccagugaggaaagccgccagcucucgggcugagccaaagucauccacaugcacgaaggcgucagccggcacgaaggccucauagguggcccgugggggccccagcaccacuggcacagugccagccaccagugcguugcgccagaauuucuccguaauguagucgcggugcugagaguucucaaaggacagguagaagcgguacugggccacggugggcaccaggcagcuggcgcacaguggccguccauuggcacggccaaagacauccacccgcagaugaggcgccagcugccgguacagccuggcacgcagcugccgcuccuggaaguugcugaccacccaggcggccacccugcucuuggcuggcagcgguggcgagggcccccaguggggcuccaggcggccauagggcacaaagauguccgagucgcgccggua

SEQ ID NO: 20379 - RNA, 2729 nt, Homo sapiens
gggggcggccgcgcggggcugccggccgccagcgcuaccuuggcgaacuugcgcacuguuggcccguggcugcguggcgcgggcgcgggcagggccgguguccccgguggcgcggugccgggucccacggccacggacacgcugagcaggaagcacucugccgguucguagaggcgcccagcggccgccagcucgcgcgcguagcugcccaggggcgccgcguguguggccagcucacgcagcgauagguaggugggggauagcagcagccccuccaggccaaagcgcaggaaguugucggccgagccuggacuugggaagcccaggaagagcacgccgcggccgcgcgacaggaagccgacacgcgcgaugcgcgagaaagcgcggugcaccgggccgcugucgcggcaaaacugcaguacguggcggcacacgcugcccacgcggccguacacgcagcgcgccuugugggcgucccaguccucgcggcggcacaggcgcgagcaguaguagguguagcagcuguggcaggacuugaaguagaggcaggcguugaacauggucucggugcgccggcagcgcgcauuggagcaggucaucaggucguccucgucggcgcuggguucgggggacgcgucggccgccucucccggggccgcgggcuccucggcgcugccggccgaggcggggggcgagcguggcggcgccagcgcgggggccccggagcccgcgggccgcgaguccagcagucggcgcaguugggggcccaggcagucggccgcgggcucugaggccuggccggcggugggucgcgagucgaugaccagguccgugaugagcucguccagcugcucuaggcuccgcuggcggccagagguggggccgucgggggccgcguggggagguggccgcgugcggcccccgggcaacucccaggcccuggcgcucgggcgcucgguggcgcgcaggucauugucagugauggugaucucgggcgucacguaccaguugcggcccaggcccucgcccgcgcggcccuucuccgucagcgacgucucggacagggacagugcggcguagcgucugggagagguggacagguucacgacgacgggcgggcgccggccuucgggggacacgccucgcggcucccgcaccucgcgccccagcagguucucguagcugcggccgcggcccaacgggucuucucggcgcggccccggggccagaauguugucccaggagcgcgaguaguggcggcugucgguggccagccggggcggacuggugccggugccgccgugccaggaggcgagcaacgggucggggucagagggcggcaccacuugcagggugcgguacggucgcgggccccaguccgcccaggccgggcugcugcgcgggugcggguacguccgagccaggacgucacgcucgcgguaccuuccgaaguccuccguguaaaaggggcgggcgguggagugggcccggggcuccucggggacauagcggggcccguagggcaggccguaggcucguggagccuccccauaguaggagcgggagggcgguuccuggauugggaaggugcgcaccucuccugcguaguagccgcccaugcgccuuggacugggccccgagagcuccucggacggauagggccugggguaguaggcgucgaagguugggccgggacuggcugcaaagcugccccggaagccuuggggcuccucuguauagaagaacuggguggggcccggcgggguggugaagggcagacugcggcgcucggcguagucccggggcccaggcaggggcccgucgcaguagaacgcccggggauccgcacaguaugagucgcugggcgucggggugcgcgacagcgccauguggcggggcccgggcaccgugaggccguggaacugcggggcggggcgggcccagugcgcggccucggugggcccgcaggaccgcgagccccggguggcgugcuggagcacugcgucgucuggcuugauguccaggcggcagcgcacguggggggcgggacccgcggguggcucgggcggugcgcagcggcccgcggcggcgcacaggggcgcgacgcggccggggccgccccgcugcggcugcaacuugaugggaugcagcucguuggcaagggcgcggagcgccggguacgcgggcucccggcgcggcgaugccucggcccgcgccgcacgcugggccucccgcccucggcggggcaacaccggcggcgaggcgggcgcgggcgucaggcccgggggcgcgcggggcgcacucuuggagcgggcgcggcggcguggcucggcuucgcggguccgggcgcgcggcacagcggacuccggcggcgguggcuccggcagggucuccauggccggcccguccagcgccuccaggaagucgaagcugcggcaguggcgcuuguugaaaggcgcgggcucagcaggccgggccacggaucgcucacauggcgagcacuuggacgcgggucccggggucgccaccuugauguccugguacacggucgacaccagcagguccggaggguccguacgggucaucuuaaaagagguccccaggcuggcggcuccagcucacacugccuugcggggcuuuugcccuggggggagacgcgggucagggcggcccccuccgcagcccaggccccgcuacucccccacgcuggcccggcuuaccuggggcgc

SEQ ID NO: 20380 - RNA, 2729 nt, Homo sapiens
gcgccccagguaagccgggccagcgugggggaguagcggggccugggcugcggagggggccgcccugacccgcgucuccccccagggcaaaagccccgcaaggcagugugagcuggagccgccagccuggggaccucuuuuaagaugacccguacggacccuccggaccugcuggugucgaccguguaccaggacaucaagguggcgaccccgggacccgcguccaagugcucgccaugugagcgauccguggcccggccugcugagcccgcgccuuucaacaagcgccacugccgcagcuucgacuuccuggaggcgcuggacgggccggccauggagacccugccggagccaccgccgccggaguccgcugugccgcgcgcccggacccgcgaagccgagccacgccgccgcgcccgcuccaagagugcgccccgcgcgcccccgggccugacgcccgcgcccgccucgccgccgguguugccccgccgagggcgggaggcccagcgugcggcgcgggccgaggcaucgccgcgccgggagcccgcguacccggcgcuccgcgcccuugccaacgagcugcaucccaucaaguugcagccgcagcggggcggccccggccgcgucgcgccccugugcgccgccgcgggccgcugcgcaccgcccgagccacccgcgggucccgccccccacgugcgcugccgccuggacaucaagccagacgacgcagugcuccagcacgccacccggggcucgcgguccugcgggcccaccgaggccgcgcacugggcccgccccgccccgcaguuccacggccucacggugcccgggccccgccacauggcgcugucgcgcaccccgacgcccagcgacucauacugugcggauccccgggcguucuacugcgacgggccccugccugggccccgggacuacgccgagcgccgcagucugcccuucaccaccccgccgggccccacccaguucuucuauacagaggagccccaaggcuuccggggcagcuuugcagccagucccggcccaaccuucgacgccuacuaccccaggcccuauccguccgaggagcucucggggcccaguccaaggcgcaugggcggcuacuacgcaggagaggugcgcaccuucccaauccaggaaccgcccucccgcuccuacuauggggaggcuccacgagccuacggccugcccuacgggccccgcuauguccccgaggagccccgggcccacuccaccgcccgccccuuuuacacggaggacuucggaagguaccgcgagcgugacguccuggcucggacguacccgcacccgcgcagcagcccggccugggcggacuggggcccgcgaccguaccgcacccugcaaguggugccgcccucugaccccgacccguugcucgccuccuggcacggcggcaccggcaccaguccgccccggcuggccaccgacagccgccacuacucgcgcuccugggacaacauucuggccccggggccgcgccgagaagacccguugggccgcggccgcagcuacgagaaccugcuggggcgcgaggugcgggagccgcgaggcgugucccccgaaggccggcgcccgcccgucgucgugaaccuguccaccucucccagacgcuacgccgcacugucccuguccgagacgucgcugacggagaagggccgcgcgggcgagggccugggccgcaacugguacgugacgcccgagaucaccaucacugacaaugaccugcgcgccaccgagcgcccgagcgccagggccugggaguugcccgggggccgcacgcggccaccuccccacgcggcccccgacggccccaccucuggccgccagcggagccuagagcagcuggacgagcucaucacggaccuggucaucgacucgcgacccaccgccggccaggccucagagcccgcggccgacugccugggcccccaacugcgccgacugcuggacucgcggcccgcgggcuccggggcccccgcgcuggcgccgccacgcucgccccccgccucggccggcagcgccgaggagcccgcggccccgggagaggcggccgacgcgucccccgaacccagcgccgacgaggacgaccugaugaccugcuccaaugcgcgcugccggcgcaccgagaccauguucaacgccugccucuacuucaaguccugccacagcugcuacaccuacuacugcucgcgccugugccgccgcgaggacugggacgcccacaaggcgcgcugcguguacggccgcgugggcagcgugugccgccacguacugcaguuuugccgcgacagcggcccggugcaccgcgcuuucucgcgcaucgcgcgugucggcuuccugucgcgcggccgcggcgugcucuuccugggcuucccaaguccaggcucggccgacaacuuccugcgcuuuggccuggaggggcugcugcuaucccccaccuaccuaucgcugcgugagcuggccacacacgcggcgccccugggcagcuacgcgcgcgagcuggcggccgcugggcgccucuacgaaccggcagagugcuuccugcucagcguguccguggccgugggacccggcaccgcgccaccggggacaccggcccugcccgcgcccgcgccacgcagccacgggccaacagugcgcaaguucgccaagguagcgcuggcggccggcagccccgcgcggccgccccc

SEQ ID NO: 20381 - RNA, 563 nt, Homo sapiens
ucccgcccuacccuaccugcgugugugucgguggguaucugugugugucugugcgugucgggcccccgccucugcggcucuugccuccgugugcuccuuggcucugcacacacgguaugugugucccugcaaccuuccagacucccaggggugaaucuguggaucugugucugaguccccugcacccguguguaugugaauguguggguccuucgugccugugucugggguguguguccgcaucauuucaugcgggggccuaagucuuugugcgugucucagccucuguguugugucugcgauccuuuucuguaugggugucucugucagcuuugcguaucugugcuuaucuccgggguucugaaugcuucugugugcucgcgugucuccuagcguguguguguguguguguguuugugugugguggggggcuuugugccuucguguauuucuaggcgccuuuguguggcuaggucggggagaguggacagucaauguggaguuucucucccacaucucgguccccucuuugcuugaccuggaaaccccaggccuggacccgc

SEQ ID NO: 20382 - RNA, 563 nt, Homo sapiens
gcggguccaggccugggguuuccaggucaagcaaagaggggaccgagaugugggagagaaacuccacauugacuguccacucuccccgaccuagccacacaaaggcgccuagaaauacacgaaggcacaaagccccccaccacacacaaacacacacacacacacacacgcuaggagacacgcgagcacacagaagcauucagaaccccggagauaagcacagauacgcaaagcugacagagacacccauacagaaaaggaucgcagacacaacacagaggcugagacacgcacaaagacuuaggcccccgcaugaaaugaugcggacacacaccccagacacaggcacgaaggacccacacauucacauacacacgggugcaggggacucagacacagauccacagauucaccccugggagucuggaagguugcagggacacacauaccgugugugcagagccaaggagcacacggaggcaagagccgcagaggcgggggcccgacacgcacagacacacacagauacccaccgacacacacgcagguaggguagggcggga

SEQ ID NO: 20383 - RNA, 2973 nt, Homo sapiens
caaggcggauauaggguggucugccgccaugcggcccgcgcccagauaggggcgcuggcucgguggacgccagagccuggcugccuucucuggucugggguggggcugcugaguccacaccccuugggccccucugcaugccuuccccgcuguccauucauucccccuacacacacacacacacacacacacacacacacacacacacacacacacacacacacacacacccucccuauaggccccguuccuugcccuuuguccucacuccucgugucccgugcucccagcugaguuggccggucucggguccuucgcacgcagacgcgcaggggucccagaucucuccagcacaaucggggcucccgcgccucuccaccgcuucccuugccgaagaagcgaagaagcggccgacuggacggcacagcaggggccgaggcccagagccggcuccugcccgcaggcggcgaacggcaccuugcuccgccaggccccugcgggugugauccgugacccgcagauucucccgggcgccucuggcccaugacgcgggggcugcucgcuccacgcaggcggcuucgggaugcucucccgcucagauuucagcggcagaaacagccucggauucucucuaccugggggaaagacugagucgggggcucggaaucacuggaagaagcgagaauggaaagggaggcucuggagcgggggucccggcuccuuccagucugcggacgccccagcuccauugagccccgcccuaguccccccgcuccucuucuuagggccuugcacccucuccucugcgcuacccgccucccucgagcacggcucuaugagcugcccucccccaccccacccagcccuguccaucccgcuccgggcugucuggauuguuuugugcuucugaccagagccagagccacacugcccccucccaguuuaccauuccagcuggaggcacggaucuggggcagcgcagggugcaguccuggccggguucggaggagugggaaggcaaggaccaggagcugcgagugucucuauuccacucugcccggagaaccagggcugcagagagccugggccgucccacgcugucccggcgccaucagcccugccaagccucagauccuugacaggcggccagauuggggggaccagagccgcccaagcagugggccagguugggggcugauauuccugggagguggccccgggucuaggguccugggagaaccacacugacuccggaaguggagcgggaacacccagagacugagugcuggaaacuuuccagccagcagugaccauguuaugcuuuuuggaccccagcggggcuggaccccagggcacaugggccaaagggucaggcccuucucagcuagagauggccgugugugaucgucacagaguaacacagccaccuugccgcagagcggugcaaaugucuguggucuugcugugccggugggagaccucacagcgaccuugaacccagguggaggcccacacacaggaguaaagugauggcgcccagcugggguccuuugaaucagggcugggaacugguucucucucccauugggguuuuccagccugaugggagaggggcugcagggagacaggauuuguggcagaauuugcuggugaggcagagcuggggcucugaggcugcaugcaagugugugugucugugugcaguggggagacagccagccccagcaaagccccuaaguccuuccuguagcuuccccuucaguggguaggggcucuggccacagacccaugacuuuccagcacaaggucugggucuuuagucaugggauuccuccacauugggucaggagacggugcucccuuagagcccaggcugcugucagcucucgggacuggagcucugagggagacggugcccuggcgggguggcccagugcugaggucucgcaguggcuaggaguggucaagagcagaucuuggggagccacccagaucugguucaggaucuggccaugggaccucaggaagguccugcccuacucucugcaccucagcuuccucauuugucccacaggguugucgagaggcugaaacauaagugcucaccacaacacccagcaccuaccaggccucuauacauauuugguaaauaauuggauggacacuuugggagggugaggcugguggaucacgaggucaggaguucaagaccaaccuggccaacauggugaaaccccaucuuuacuaaaaauacaaaaauuagcugggcaugguggcacgugucuguaauccuagcuauuugggaagcugaggcaggagaaccacuugaauccgggagguggagguugcagugaaccgaaauugcaccacugcacuccagccugggugacagagcaagacuccaucucaaguagucauaauaauuggauggaagaggggccaugcuaccaagacuuggggagaacacagcucccugcuucuccuucaaccagggcuugagggcaaacagacccccugggcucaccugcguaccuuccuccagggcaggcgaagcuuagcuccaggaaggugugagcugggcgcaggagaccuccaggcagugccuagaggcccggcacagccuuugccacuggcccugcucuagagccugggccugcaaguagcugcucagagcuggacccuggcggggacacagaauuaggggcguuagcccauuacaucaaaagcaaccacgugggauucucaagaugucacauauuuuaaaauuuauuuucuucaagaaucuuuggcuuucuugccaaauggaugggcuggauuauuucugcagccugucuggaaccgggagcuuccccagcugaggaccacagugagagcagagaagacccaggaucguauuugaaaccauaaaagccacaugaagacacuaagaauaacuugcagaaagacauuuucuaugaauugaacacagagucc

SEQ ID NO: 20384 - RNA, 2973 nt, Homo sapiens
ggacucuguguucaauucauagaaaaugucuuucugcaaguuauucuuagugucuucauguggcuuuuaugguuucaaauacgauccugggucuucucugcucucacugugguccucagcuggggaagcucccgguuccagacaggcugcagaaauaauccagcccauccauuuggcaagaaagccaaagauucuugaagaaaauaaauuuuaaaauaugugacaucuugagaaucccacgugguugcuuuugauguaaugggcuaacgccccuaauucuguguccccgccaggguccagcucugagcagcuacuugcaggcccaggcucuagagcagggccaguggcaaaggcugugccgggccucuaggcacugccuggaggucuccugcgcccagcucacaccuuccuggagcuaagcuucgccugcccuggaggaagguacgcaggugagcccagggggucuguuugcccucaagcccugguugaaggagaagcagggagcuguguucuccccaagucuugguagcauggccccucuuccauccaauuauuaugacuacuugagauggagucuugcucugucacccaggcuggagugcaguggugcaauuucgguucacugcaaccuccaccucccggauucaagugguucuccugccucagcuucccaaauagcuaggauuacagacacgugccaccaugcccagcuaauuuuuguauuuuuaguaaagaugggguuucaccauguuggccagguuggucuugaacuccugaccucgugauccaccagccucacccucccaaaguguccauccaauuauuuaccaaauauguauagaggccugguaggugcuggguguuguggugagcacuuauguuucagccucucgacaacccugugggacaaaugaggaagcugaggugcagagaguagggcaggaccuuccugaggucccauggccagauccugaaccagaucuggguggcuccccaagaucugcucuugaccacuccuagccacugcgagaccucagcacugggccaccccgccagggcaccgucucccucagagcuccagucccgagagcugacagcagccugggcucuaagggagcaccgucuccugacccaauguggaggaaucccaugacuaaagacccagaccuugugcuggaaagucaugggucuguggccagagccccuacccacugaaggggaagcuacaggaaggacuuaggggcuuugcuggggcuggcugucuccccacugcacacagacacacacacuugcaugcagccucagagccccagcucugccucaccagcaaauucugccacaaauccugucucccugcagccccucucccaucaggcuggaaaaccccaaugggagagagaaccaguucccagcccugauucaaaggaccccagcugggcgccaucacuuuacuccugugugugggccuccaccuggguucaaggucgcugugaggucucccaccggcacagcaagaccacagacauuugcaccgcucugcggcaagguggcuguguuacucugugacgaucacacacggccaucucuagcugagaagggccugacccuuuggcccaugugcccugggguccagccccgcugggguccaaaaagcauaacauggucacugcuggcuggaaaguuuccagcacucagucucuggguguucccgcuccacuuccggagucagugugguucucccaggacccuagacccggggccaccucccaggaauaucagcccccaaccuggcccacugcuugggcggcucugguccccccaaucuggccgccugucaaggaucugaggcuuggcagggcugauggcgccgggacagcgugggacggcccaggcucucugcagcccugguucuccgggcagaguggaauagagacacucgcagcuccugguccuugccuucccacuccuccgaacccggccaggacugcacccugcgcugccccagauccgugccuccagcuggaaugguaaacugggagggggcaguguggcucuggcucuggucagaagcacaaaacaauccagacagcccggagcgggauggacagggcuggguggggugggggagggcagcucauagagccgugcucgagggaggcggguagcgcagaggagagggugcaaggcccuaagaagaggagcggggggacuagggcggggcucaauggagcuggggcguccgcagacuggaaggagccgggacccccgcuccagagccucccuuuccauucucgcuucuuccagugauuccgagcccccgacucagucuuucccccagguagagagaauccgaggcuguuucugccgcugaaaucugagcgggagagcaucccgaagccgccugcguggagcgagcagcccccgcgucaugggccagaggcgcccgggagaaucugcgggucacggaucacacccgcaggggccuggcggagcaaggugccguucgccgccugcgggcaggagccggcucugggccucggccccugcugugccguccagucggccgcuucuucgcuucuucggcaagggaagcgguggagaggcgcgggagccccgauugugcuggagagaucugggaccccugcgcgucugcgugcgaaggacccgagaccggccaacucagcugggagcacgggacacgaggagugaggacaaagggcaaggaacggggccuauagggaggguguguguguguguguguguguguguguguguguguguguguguguguguguguguguguguagggggaaugaauggacagcggggaaggcaugcagaggggcccaagggguguggacucagcagccccaccccagaccagagaaggcagccaggcucuggcguccaccgagccagcgccccuaucugggcgcgggccgcauggcggcagaccacccuauauccgccuug

SEQ ID NO: 20385 - RNA, 2298 nt, Homo sapiens
auucaggcgccuuucgagggccagucggagggaaacccggagcaaaaagagagcgagaucggggcgaaacgggaccaaaaagagaaaagagaggcgcucaaggggaggaaaaagcacccuccagccccucggcgcgccggguaccggccccgcgucgggauucucagcgcugcgccggcacaacccccggcgcaucggcgcuaucagcgccuauucagacggacaauaccggccucgccuccucuugauucgccugugucuuuacuaaaucgcuuuuugagaaauuccuccaacauuugcauaauguguucccgcuuuccgcgaccccccccccccgcucgcgcgcgcgcucccacacucacaagcacacacucacaggcgcacccucguaccccuccuuccugcaaccgcccgccacccugcucggcccggcugggucccggacccugcccgaccccggcccgggccgcucacccagucguucgccggcucaccuggucgguggcggggccgcccucggccggcagccggcagcccucgggcaacgccggggcggcguucucaugcuuccaguacaugggccggggaaccucgggcucagcgggcgcgcagcgcggagagcugcgccgagggggaccacagccgcagugggagcagaggcugcugcaggagcaggaggagagccgaggcgccggccccgccgccccgggcccggccucagcccccgcccccggcccgcgcgcagccccggccucccuggcugcugccgccgcugccucggaagaaggucccgacaaacuuggagaggcccccgcccccuccuucuucuccuccucccccucuugguaguccuccuccuccucucccuccuccuuguccuccucccccuccagcugcaacggcggccgcccugccgcuggagccccgcucgguucaagaugagucaugcgugaccaauccccuccccgccaagggagagcaagacacacacgacgaggcagagacccagagagagagacacacacacagacacagagacacacagaaacucagagcugccgacagagagacucggagacacgccaguacacaaaggcaccggcgggcacacauccacccagcucucacuaccgcuccucccucaaggggcacccaucuuccucagacacugccccacucacagguacaggagggacccauggccauaccaucugcggagauagauuccguaggaggucacacguuauuacacuguguugaugcaaucccaugccugguacauuuguguacacacuaauguaagugauuaccuguucacaucauuuacacgggcacgaggcaccacacuuacucucacacaccugcacagauaccucugcucuauaagaaccagacagugcaccagcucccagggacugaggugaaacgggaggguaguuucccugaauucucuuggaagggauugcuuggcacauuccccuucccuucaggauuugcuuaaccacacaguccaaugcccaucccuucuucucuaggguucuacugacaaugagaaugguagggaaggcaggaaggcccaggcauuuagacagaagacacugcccccagacacacagacacagaaccuucaaacccaaagauggagccuuacacacacuaacgcccugcagcauacacaaguggacacuuagagucucagcccccuucuccacacacaaacugagccuaaagagacacauguaaacauacaucaucuaaaaacaaauaagcacacucagacauagauccagcccuacagacaccaugacagccuacccucaccacaucacacaugucaucaccuccauaauugcccucauuuacagauguaaacacccccccacacacaauuguucuuccauuuguacacacagccauacucaagagggcacagauuuucacagagcuccaaacccauguauaaccuuauguccucuacucaggcacccucaaauauguacuuacauccuuacagauggugagacaacuauugauaggcauuuauaggcagacacaucacacacacuucugcagccauagauucccaauaguuauagucucaguuugcacacacacaggcagguucugacaggcgcagguaguagaggaugccugcacaccaacacgauacuaaagauccacacccauauuccccaaagauacaaauaucuguuccuuuacuggcaucaagguacacaaaaauagccccagccucagcuaauggcauuucccgcccucugcaucccagucauucauugc

SEQ ID NO: 20386 - RNA, 2298 nt, Homo sapiens
gcaaugaaugacugggaugcagagggcgggaaaugccauuagcugaggcuggggcuauuuuuguguaccuugaugccaguaaaggaacagauauuuguaucuuuggggaauauggguguggaucuuuaguaucguguuggugugcaggcauccucuacuaccugcgccugucagaaccugccugugugugugcaaacugagacuauaacuauugggaaucuauggcugcagaagugugugugaugugucugccuauaaaugccuaucaauaguugucucaccaucuguaaggauguaaguacauauuugagggugccugaguagaggacauaagguuauacauggguuuggagcucugugaaaaucugugcccucuugaguauggcuguguguacaaauggaagaacaauuguguguggggggguguuuacaucuguaaaugagggcaauuauggaggugaugacaugugugauguggugaggguaggcugucauggugucuguagggcuggaucuaugucugagugugcuuauuuguuuuuagaugauguauguuuacaugugucucuuuaggcucaguuuguguguggagaagggggcugagacucuaaguguccacuuguguaugcugcagggcguuaguguguguaaggcuccaucuuuggguuugaagguucugugucugugugucugggggcagugucuucugucuaaaugccugggccuuccugccuucccuaccauucucauugucaguagaacccuagagaagaagggaugggcauuggacugugugguuaagcaaauccugaagggaaggggaaugugccaagcaaucccuuccaagagaauucagggaaacuacccucccguuucaccucagucccugggagcuggugcacugucugguucuuauagagcagagguaucugugcaggugugugagaguaaguguggugccucgugcccguguaaaugaugugaacagguaaucacuuacauuaguguguacacaaauguaccaggcaugggauugcaucaacacaguguaauaacgugugaccuccuacggaaucuaucuccgcagaugguauggccaugggucccuccuguaccugugaguggggcagugucugaggaagaugggugccccuugagggaggagcgguagugagagcuggguggaugugugcccgccggugccuuuguguacuggcgugucuccgagucucucugucggcagcucugaguuucugugugucucugugucugugugugugucucucucucugggucucugccucgucgugugugucuugcucucccuuggcggggaggggauuggucacgcaugacucaucuugaaccgagcggggcuccagcggcagggcggccgccguugcagcuggagggggaggaggacaaggaggagggagaggaggaggaggacuaccaagagggggaggaggagaagaaggagggggcgggggccucuccaaguuugucgggaccuucuuccgaggcagcggcggcagcagccagggaggccggggcugcgcgcgggccgggggcgggggcugaggccgggcccggggcggcggggccggcgccucggcucuccuccugcuccugcagcagccucugcucccacugcggcuguggucccccucggcgcagcucuccgcgcugcgcgcccgcugagcccgagguuccccggcccauguacuggaagcaugagaacgccgccccggcguugcccgagggcugccggcugccggccgagggcggccccgccaccgaccaggugagccggcgaacgacugggugagcggcccgggccggggucgggcaggguccgggacccagccgggccgagcaggguggcgggcgguugcaggaaggagggguacgagggugcgccugugagugugugcuugugagugugggagcgcgcgcgcgagcggggggggggggucgcggaaagcgggaacacauuaugcaaauguuggaggaauuucucaaaaagcgauuuaguaaagacacaggcgaaucaagaggaggcgaggccgguauuguccgucugaauaggcgcugauagcgccgaugcgccggggguugugccggcgcagcgcugagaaucccgacgcggggccgguacccggcgcgccgaggggcuggagggugcuuuuuccuccccuugagcgccucucuuuucucuuuuuggucccguuucgccccgaucucgcucucuuuuugcuccggguuucccuccgacuggcccucgaaaggcgccugaau

SEQ ID NO: 20387 - RNA, 1704 nt, Homo sapiens
ugucuauauucauccugagacacacgacugcauauaaauacauguuuaauaaaguaaguugcuaguuuuaugggcaugugugugugugagagagagagacagggcauuugugcuguaaacuuuaucuuugccuguuacuccuaagucuggaguuaguaaucuugccuucaucauuacagggggagcauguaaaauauaucaguaggugggagauaaacacauucauguuagccgggcucaucacuguuccugggaacuccugcuaucucucucucgacuuuucagugccaaaguauggaaugggauauauguguguaugugucuucuauuaaauccaugucuauauuacuuugccacuaaaaauacaauuuuaaaaguuauccuaauuuaaaacccugauauccugacagcaguuuucuucccagcuguagugccccccccuccacuuugguaaacgacucaaguuccaugaggacuuucacuucuuuauuuauaaucacagaagugagguguuacuucacacacauacacacacaaagaaugaaauaaagaaaugaaacucgcuaagcagacaaaaacagacaacuuucugcuuagaaaacagccuucucggugggagaggaugaacugccaugucuaagagaaagacuugcccccgaauuuguaggucuguaacugaccaaguuuuguaauuauuaacagguauuugccaaguccuaauugcugaauauaaugaauuggaacuagaugcgaaaauagagcaggaccucuccccuugaugaguuuuuauuccagccauauaauucucaauaaaacuuuuccugggcuggauagcaaaggacaccuuugguuaccugaaugaacagguacaggggaaauuauuugggggagggaaaaaggagagaaaagcaaggagagagagugugaguguaagagaaagcgaagaagccacucuugagaaaagcuugccauaaaggagcuaaacccaccugaaauuccuacccacggacaccccuucucacuucagacucacauccccacucaaaaugagaaaauuagaaaaggaggauggaggacgagcacaccaaaaagggauaaaaagagagaaaaggggaggaaaaaaaaccuaccugcgaagucuuguuuguaguuuuggccagaaauggugagaagaaaaagcaugaagaagccgcgaagugugggggagaaaaagguggaagcgaagaaacagcucccggagcaaacuguacaaaaaccucgccaagagugucgggaggcaggaccguuauuccugcagagcagguuagaacugaucucuuucggccacuccaggaaacacaaaccuggggacggacugacguguuacgccucuucuaaugacauuuuuuucuuuuucuuuucuguaggagagagacgagagacccugaaacacgcgccaccuaucuuuguggggagggauaauugaagcgcccugagcgugagcaucaugugaaaacgugaucgccaaguuucucucugggaaaggaucugggauagauuauaccuugaagucuccgcaaacgcuuuaguggaagaaaugaaauuccaccucccucccuuccuccucucccucccuuucgccuucgccucccuccccccucccucccuucucccccccuccaccccccccuccccgcccgucaagccuuuggcaucauuauccuc

SEQ ID NO: 20388 - RNA, 1704 nt, Homo sapiens
gaggauaaugaugccaaaggcuugacgggcggggagggggggguggagggggggagaagggagggaggggggagggaggcgaaggcgaaagggagggagaggaggaagggagggagguggaauuucauuucuuccacuaaagcguuugcggagacuucaagguauaaucuaucccagauccuuucccagagagaaacuuggcgaucacguuuucacaugaugcucacgcucagggcgcuucaauuaucccuccccacaaagauagguggcgcguguuucagggucucucgucucucuccuacagaaaagaaaaagaaaaaaaugucauuagaagaggcguaacacgucaguccguccccagguuuguguuuccuggaguggccgaaagagaucaguucuaaccugcucugcaggaauaacgguccugccucccgacacucuuggcgagguuuuuguacaguuugcuccgggagcuguuucuucgcuuccaccuuuuucucccccacacuucgcggcuucuucaugcuuuuucuucucaccauuucuggccaaaacuacaaacaagacuucgcagguagguuuuuuuuccuccccuuuucucucuuuuuaucccuuuuuggugugcucguccuccauccuccuuuucuaauuuucucauuuugaguggggaugugagucugaagugagaagggguguccguggguaggaauuucagguggguuuagcuccuuuauggcaagcuuuucucaagaguggcuucuucgcuuucucuuacacucacacucucucuccuugcuuuucucuccuuuuucccucccccaaauaauuuccccuguaccuguucauucagguaaccaaagguguccuuugcuauccagcccaggaaaaguuuuauugagaauuauauggcuggaauaaaaacucaucaaggggagagguccugcucuauuuucgcaucuaguuccaauucauuauauucagcaauuaggacuuggcaaauaccuguuaauaauuacaaaacuuggucaguuacagaccuacaaauucgggggcaagucuuucucuuagacauggcaguucauccucucccaccgagaaggcuguuuucuaagcagaaaguugucuguuuuugucugcuuagcgaguuucauuucuuuauuucauucuuuguguguguaugugugugaaguaacaccucacuucugugauuauaaauaaagaagugaaaguccucauggaacuugagucguuuaccaaaguggaggggggggcacuacagcugggaagaaaacugcugucaggauaucaggguuuuaaauuaggauaacuuuuaaaauuguauuuuuaguggcaaaguaauauagacauggauuuaauagaagacacauacacacauauaucccauuccauacuuuggcacugaaaagucgagagagagauagcaggaguucccaggaacagugaugagcccggcuaacaugaauguguuuaucucccaccuacugauauauuuuacaugcucccccuguaaugaugaaggcaagauuacuaacuccagacuuaggaguaacaggcaaagauaaaguuuacagcacaaaugcccugucucucucucucacacacacacaugcccauaaaacuagcaacuuacuuuauuaaacauguauuuauaugcagucgugugucucaggaugaauauagaca

SEQ ID NO: 20389 - RNA, 1769 nt, Homo sapiens
cgaagcacaagguggagaagcgcuggccccagggugcugcuccgaggggaucucaccacuuuuccacaucuucuugaacuuggaccggcgguucuggaaccagauuuugaccuuugaggaaaaagaccugagcauuaguggaggaaccuagucuuggggcaguagggguucgaagaggagaaaaaagaaggcagagaaaaaccgcuggcuagcggugggcagcgagcgcccuggggagauaagaggaucacgggcggcggccuucgaggcucugccgguuccugcucccuggggagguaauugccaaaaggccaggacugcugguguacgugcacugugaugauggugacagcgggagggugaggagggccaguuauuucacccgcuuaaucaguagcgagagguacgggauuucuguccacccggucccuuuccuucccucccacggcggccccuuggggguuuccagcuuugggccuagaagcuuacuuagggccgcucgaggcgcaggccuggaaauccuuaaaaguacuuaaaaugaacuuuaaaaagcauuguccuaaacccgccugcuucccagccaucucaggcccgcgcucuccucgccccugcagggcgcgagccccaccugagucugggugaggcccagagaggccgccagcucggcucgcuccggcaaggccaaguauugagucuuuuggaaacgccgcugaagagccgccagcuggaaacuggaguagauggugcgggguuuccggacuuucuuuggcuucccguucacuauccgaauuucaggcucaagguccuccuucucugcaacgauaaagaaucguaagaacagcgcaacccagggguccuggaguucccgcccuccuagagggcccggcgggggggacuuggcuugagcaaagaggugggugcacugaacuguggcgccacgggcaggcgcaacuucgcagcgugcgaucggagccgccaccgaccccgggagcuguacccuccagggaagggggagacaagugcacacccaagagaaagaagcugguggcaaggagaugcccuuaugaggcaggcagagcacgcccacuuggcucuugaggccaccagguccuaccaaaggagagagggacguaaccggcgaccugcggcagauuggaggcuggggaggguaaagggcacaagcgggcggugagcaggcagcgugaaaauccagagcuuucgaaggccccccgccccaaacacguuuacccauccaucccauuaacuagaccgacucggcacucuugacuucagcguuaugcauaccaggcucguuguuggcuggggacgaacugguuccauagggagcguaggagguguaggcggcgguguagcccaggucauagcugcucuuggcggaguaagggacguuguugaggccgcuggcuugguacugguaggaacccaugugcgcguagggcgagcccccgccgccgccgccgcccgccgggugcugcugguugguguaguagcugcugucgguggcgguggacaccggaagggugggcgacuccuggggcuuguggaggcugcugcugcugcugcuguugccacccgggccggcgccgccgccgcucgggggcugcuggugcuggugguacgugcuggaggcggcgaucugggucgagugcauaucagccacuagacugucaaagacuccagucauccuggcccgagacgggaaagagcagagguggcgggcgugcgggggaagccaggcgccuccucug

SEQ ID NO: 20390 - RNA, 1769 nt, Homo sapiens
cagaggaggcgccuggcuucccccgcacgcccgccaccucugcucuuucccgucucgggccaggaugacuggagucuuugacagucuaguggcugauaugcacucgacccagaucgccgccuccagcacguaccaccagcaccagcagcccccgagcggcggcggcgccggcccggguggcaacagcagcagcagcagcagccuccacaagccccaggagucgcccacccuuccgguguccaccgccaccgacagcagcuacuacaccaaccagcagcacccggcgggcggcggcggcggcgggggcucgcccuacgcgcacauggguuccuaccaguaccaagccagcggccucaacaacgucccuuacuccgccaagagcagcuaugaccugggcuacaccgccgccuacaccuccuacgcucccuauggaaccaguucguccccagccaacaacgagccugguaugcauaacgcugaagucaagagugccgagucggucuaguuaaugggauggauggguaaacguguuuggggcggggggccuucgaaagcucuggauuuucacgcugccugcucaccgcccgcuugugcccuuuacccuccccagccuccaaucugccgcaggucgccgguuacgucccucucuccuuugguaggaccugguggccucaagagccaagugggcgugcucugccugccucauaagggcaucuccuugccaccagcuucuuucucuugggugugcacuugucucccccuucccuggaggguacagcucccggggucgguggcggcuccgaucgcacgcugcgaaguugcgccugcccguggcgccacaguucagugcacccaccucuuugcucaagccaagucccccccgccgggcccucuaggagggcgggaacuccaggaccccuggguugcgcuguucuuacgauucuuuaucguugcagagaaggaggaccuugagccugaaauucggauagugaacgggaagccaaagaaaguccggaaaccccgcaccaucuacuccaguuuccagcuggcggcucuucagcggcguuuccaaaagacucaauacuuggccuugccggagcgagccgagcuggcggccucucugggccucacccagacucagguggggcucgcgcccugcaggggcgaggagagcgcgggccugagauggcugggaagcaggcggguuuaggacaaugcuuuuuaaaguucauuuuaaguacuuuuaaggauuuccaggccugcgccucgagcggcccuaaguaagcuucuaggcccaaagcuggaaacccccaaggggccgccgugggagggaaggaaagggaccggguggacagaaaucccguaccucucgcuacugauuaagcgggugaaauaacuggcccuccucacccucccgcugucaccaucaucacagugcacguacaccagcaguccuggccuuuuggcaauuaccuccccagggagcaggaaccggcagagccucgaaggccgccgcccgugauccucuuaucuccccagggcgcucgcugcccaccgcuagccagcgguuuuucucugccuucuuuuuucuccucuucgaaccccuacugccccaagacuagguuccuccacuaaugcucaggucuuuuuccucaaaggucaaaaucugguuccagaaccgccgguccaaguucaagaagauguggaaaaguggugagauccccucggagcagcacccuggggccagcgcuucuccaccuugugcuucg

SEQ ID NO: 20391 - RNA, 644 nt, Homo sapiens
accacccgccuuuucucugucuguccgcacggugggcagagcgcacagcaccggcacugcagcagcccgggccagggagggaaccagcaucacagccagcgccgccugcccuggguauaggacugaggcccaggccccagcgcugggauugccugggcggaggaaucuuggggaaaggggcagccuccugcccucgguucugggauuuggguuugggaagagacgguuuaccuuugaaaagcgucugcucacucggaggugggaucccaggccuugccuggacccaugggcuaggagagggucgcggcaggcugggaggagagugaggccuugggggaguggauggggugccccacgaagagucugccucagagccaggugacacagaggggcuccaggagggagucaggcuccgcugagagcccuuagagagacaaccuaucuugggggaggggcugaagugaccaugcagacccaaggguaccagaagagccucggggaaacgcggcguggauucgcaggccuuggcggggcuccgaagcagugaagggucuagguauaaggcggacacccaggcuaggccugaaagcagaggggugaggaggacgaaggugcgaguguguggggguugucucuugugggga

SEQ ID NO: 20392 - RNA, 644 nt, Homo sapiens
uccccacaagagacaacccccacacacucgcaccuucguccuccucaccccucugcuuucaggccuagccuggguguccgccuuauaccuagacccuucacugcuucggagccccgccaaggccugcgaauccacgccgcguuuccccgaggcucuucugguacccuugggucugcauggucacuucagccccucccccaagauagguugucucucuaagggcucucagcggagccugacucccuccuggagccccucugugucaccuggcucugaggcagacucuucguggggcaccccauccacucccccaaggccucacucuccucccagccugccgcgacccucuccuagcccauggguccaggcaaggccugggaucccaccuccgagugagcagacgcuuuucaaagguaaaccgucucuucccaaacccaaaucccagaaccgagggcaggaggcugccccuuuccccaagauuccuccgcccaggcaaucccagcgcuggggccugggccucaguccuauacccagggcaggcggcgcuggcugugaugcugguucccucccuggcccgggcugcugcagugccggugcugugcgcucugcccaccgugcggacagacagagaaaaggcggguggu

SEQ ID NO: 20393 - RNA, 298 nt, Homo sapiens
cuuuauaagcauucgaagagguuuauacauccuauaagauuuccugggccguuguaaaguguguuuaugguaggaaaccaauuuaggugggcuuaagguagacuucgaggaggacauuaauagcugucgagagccuuuucccaguuuugggcaggggguugcuagauaccauggagggagggagggagggagauuucaagccagugugagugcauacaccggagccuccugcuuuuaagggagagaggcgggggguggggaaguggggggaguuugauccuugcacuggacuuuaucc

SEQ ID NO: 20394 - RNA, 298 nt, Homo sapiens
ggauaaaguccagugcaaggaucaaacuccccccacuuccccaccccccgccucucucccuuaaaagcaggaggcuccgguguaugcacucacacuggcuugaaaucucccucccucccucccuccaugguaucuagcaacccccugcccaaaacugggaaaaggcucucgacagcuauuaauguccuccucgaagucuaccuuaagcccaccuaaauugguuuccuaccauaaacacacuuuacaacggcccaggaaaucuuauaggauguauaaaccucuucgaaugcuuauaaag

SEQ ID NO: 20395 - RNA, 1023 nt, Homo sapiens
caaguucagucucugggccugaaauccaaggccagcccaugccccagcgaguacggggaaaagagaacacagaugcccucccggacugagaacugguucauggucagaguuucugggaccgcuuuaguuucuuggcuggcaggaagggaaccuggcaggccgaaggacggcuccaagcccuggccggccccucacucagggcaagucuuuggaaaucaagguuaaagcuccccgcugcugccccgaggcccgggcuuccgcagggcggcucacccgccugcagcaagagagggagggaggaaguuguugaaguuucucauaaaacucugaguuuccauggugguaguggugguaguggugguaguggugguaguggugguucuuuaaugagccggaccacaaccccagaccauauccucuucauagaaguuucccucaccaaaggaaacagagaacuaagauucccaccuccuuccccucccuuacccaagcaaagccuugucaaauaauuucagaaauuguccaaaacuguaaaacucaacuucugacaaaaguauagcuuuuaauauuugacaauuuguauuaaaacaaaaaugaccuucuugguuagcagcgaagggaaaaaaaucaauaguauaauuuucaauaauucauaaagcgaacgccauuaugguaaauuuaacuauuaaucuuauccuuuacaaagucucgauugauuuguuaauaaaguaucuucccguguguggcaacagcgggcauaacucuuuaaaaaccuucagaagcaagaaaauuaccaaguagcccaagaauguagaugagaauuuuauugaucgcccugauucuucuuaauauguauuaauaaauuccacaaccuuuuguaccuugcacuugucagaaaccagugcuuuuacaaaauccauaaaaggaaaacauuuuucuuugcagaagaaccaaaaugacaccuuugcauuucucucuguccuucuuggcccagucaguuuucuaaaacuucuggauucugag

SEQ ID NO: 20396 - RNA, 1023 nt, Homo sapiens
cucagaauccagaaguuuuagaaaacugacugggccaagaaggacagagagaaaugcaaaggugucauuuugguucuucugcaaagaaaaauguuuuccuuuuauggauuuuguaaaagcacugguuucugacaagugcaagguacaaaagguuguggaauuuauuaauacauauuaagaagaaucagggcgaucaauaaaauucucaucuacauucuugggcuacuugguaauuuucuugcuucugaagguuuuuaaagaguuaugcccgcuguugccacacacgggaagauacuuuauuaacaaaucaaucgagacuuuguaaaggauaagauuaauaguuaaauuuaccauaauggcguucgcuuuaugaauuauugaaaauuauacuauugauuuuuuucccuucgcugcuaaccaagaaggucauuuuuguuuuaauacaaauugucaaauauuaaaagcuauacuuuugucagaaguugaguuuuacaguuuuggacaauuucugaaauuauuugacaaggcuuugcuuggguaagggaggggaaggaggugggaaucuuaguucucuguuuccuuuggugagggaaacuucuaugaagaggauauggucugggguugugguccggcucauuaaagaaccaccacuaccaccacuaccaccacuaccaccacuaccaccauggaaacucagaguuuuaugagaaacuucaacaacuuccucccucccucucuugcugcaggcgggugagccgcccugcggaagcccgggccucggggcagcagcggggagcuuuaaccuugauuuccaaagacuugcccugagugaggggccggccagggcuuggagccguccuucggccugccagguucccuuccugccagccaagaaacuaaagcggucccagaaacucugaccaugaaccaguucucaguccgggagggcaucuguguucucuuuuccccguacucgcuggggcaugggcuggccuuggauuucaggcccagagacugaacuug

SEQ ID NO: 20397 - RNA, 1659 nt, Homo sapiens
ggcagaggcauccacaauuacacggggaauguuuuccuagagaugucagccuacaaaggacacaaucucucuucuucaaauucuuccccaaaauguccuuucccaacagcucuccugcugcuaauacuuuuuuaguagauuccuugaucagugccugcaggagugacaguuuuuauuccagcagcgccagcauguacaugccaccaccuagcgcagacauggggaccuauggaaugcaaaccuguggacugcucccgucucuggccaaaagagaagugaaccaccaaaauauggguaugaaugugcauccuuauauaccucaaguagacaguuggacagauccgaacagaucuugucgaauagagcaaccuguuacacagcaaguccccacuugcuccuucaccaccaacauuaaggaagaauccaauugcugcauguauucugauaagcgcaacaaacucauuucggccgaggucccuucguaccagaggcuggucccugagucuugucccguugagaacccugagguucccgucccuggauauuuuagacugagucagaccuacgccaccgggaaaacccaagaguacaauaauagccccgaaggcagcuccacugucaugcuccagcucaacccucguggcgcggccaagccgcagcucuccgcugcccagcugcagauggaaaagaagaugaacgagcccgugagcggccaggagcccaccaaagucucccagguggagagccccgaggccaaaggcggccuucccgaagagaggagcugccuggcugaggucuccguguccagucccgaagugcaggagaaggaaagcaaaggucgguaugagcagaguugccaccccagcggggcgcgcagcccgggaacccggcagagagggagugccggggugcccagcgccgagccggagcccgacuuggcaggugcugcuccgccugguuuuagaggggugaucucagcccugagauaguccccgcuucuccccugcugcccuggcccucuccgccaguccuggccccacgcugauggcgcccgggcagaggaaaagcuugccgguuuuauuuuuccugagcuagaccugaacacaacaaaagagcgcaaaggagaccugcggcucauaaacacgaccacagagccucuuuucuccugcucagauuugcaguuccaguuuugccuugagcccaaugaucauguuaaggugauccagggcaccguguucguguucaaguguaugcaccccgcauccugcgagcuuggggguggugaggggaaagagauggcugggcugguuggugcuugaguugggaaacagggcuuacugccuuugcugggcuagguaaccuuggcuuuguuuaggaaaagugcugcagucuuugcaauccgucggcaaagagggcaaaggcggagggggagaguggaacccgcauugcccucccugcaaggccagccuuagggcugggcuaaggcaaagagccagggaucuggcuuuuugagaaggaacccuccuccucucccccagugcuuagaggugggccacaguagggggcucccuuucugggggaaugcuuuagugugggggcaagaagacaugaaaauuaaggaaauucuggggaaugcaacaauacccaggcaaggugggg

SEQ ID NO: 20398 - RNA, 1659 nt, Homo sapiens
ccccaccuugccuggguauuguugcauuccccagaauuuccuuaauuuucaugucuucuugcccccacacuaaagcauucccccagaaagggagcccccuacuguggcccaccucuaagcacugggggagaggaggaggguuccuucucaaaaagccagaucccuggcucuuugccuuagcccagcccuaaggcuggccuugcagggagggcaaugcggguuccacucucccccuccgccuuugcccucuuugccgacggauugcaaagacugcagcacuuuuccuaaacaaagccaagguuaccuagcccagcaaaggcaguaagcccuguuucccaacucaagcaccaaccagcccagccaucucuuuccccucaccacccccaagcucgcaggaugcggggugcauacacuugaacacgaacacggugcccuggaucaccuuaacaugaucauugggcucaaggcaaaacuggaacugcaaaucugagcaggagaaaagaggcucuguggucguguuuaugagccgcaggucuccuuugcgcucuuuuguuguguucaggucuagcucaggaaaaauaaaaccggcaagcuuuuccucugcccgggcgccaucagcguggggccaggacuggcggagagggccagggcagcaggggagaagcggggacuaucucagggcugagaucaccccucuaaaaccaggcggagcagcaccugccaagucgggcuccggcucggcgcugggcaccccggcacucccucucugccggguucccgggcugcgcgccccgcugggguggcaacucugcucauaccgaccuuugcuuuccuucuccugcacuucgggacuggacacggagaccucagccaggcagcuccucucuucgggaaggccgccuuuggccucggggcucuccaccugggagacuuuggugggcuccuggccgcucacgggcucguucaucuucuuuuccaucugcagcugggcagcggagagcugcggcuuggccgcgccacgaggguugagcuggagcaugacaguggagcugccuucggggcuauuauuguacucuuggguuuucccgguggcguaggucugacucagucuaaaauauccagggacgggaaccucaggguucucaacgggacaagacucagggaccagccucugguacgaagggaccucggccgaaaugaguuuguugcgcuuaucagaauacaugcagcaauuggauucuuccuuaauguugguggugaaggagcaaguggggacuugcuguguaacagguugcucuauucgacaagaucuguucggaucuguccaacugucuacuugagguauauaaggaugcacauucauacccauauuuuggugguucacuucucuuuuggccagagacgggagcaguccacagguuugcauuccauagguccccaugucugcgcuaggugguggcauguacaugcuggcgcugcuggaauaaaaacugucacuccugcaggcacugaucaaggaaucuacuaaaaaaguauuagcagcaggagagcuguugggaaaggacauuuuggggaagaauuugaagaagagagauuguguccuuuguaggcugacaucucuaggaaaacauuccccguguaauuguggaugccucugcc

SEQ ID NO: 20399 - RNA, 1657 nt, Homo sapiens
guuucaaauagcuuccagcaguuuuacaaaacacauccuuuccauuucuuccuuuuaaauguuucccuaagaacgauccauuuaggugcuauaaguccucagccagggagucucugggacacuggcauucaaaauuuuaaacuuccgccccaaaaccaggaacauuccaagacagaacucuuuuagggggccauuuccugggggugggggagagggcuuggaaucaaugcuagauugaaaacguuguaauagcuuugccccagacuuaacaccgguugggcaggaggaggguaauuuuuauuuagccguuucuccgaucauguggggaauaccauuagcuguugauagcgggccauguauccgaggaaagccugagcuacaaggcaaaggcaucccaucuggaacaaaaucagaaagcuauuggcaaagguaaucaaucaggccauaaauagccauuuacccgcuuccuuuucggggcuggaggugggccgggagcccuccaagggugagcugggcaacuuguagagcaaggaauaugcccuccgcugccggcgccccggccgcuuuugucugggcucccagccgggcuuccgaggcuuuguaccauggauuugggagugacaaugggcauuucccucagauucaaggcugcucaaccucaccucuguagggggaaaaaaaucagaagggagugucccaaggaccuagccauucggccgaauuuuuuagacauuuugggagucuccuccgaggccuuuaagugcgaaccgcgcgaagcggcccugcccggggagacucgcugaggcagggcugaggcggcgggcgggagcaagcugcucuagcauuuggguucugcccuguggcguguucucuuccagggccuuuccagcaucaucggagaagacgaagcacccuggccgccacuguccgugcugcgccaacucgcccggccgcccgcccuuccgagggcaggcagaagccccucuguguccuccaccgccgcgccccggcucgccccucgggccgcggcgugugcccagccucacgucgggguguguguggccgcgcgggcgugugugaguguggcagggggagggggcccuccgaucugcuccauccguccguuuuauuagggacacauuaaucuauaaucaaauacaccucauaaaauuuuuauugaaaggcauaauaucauuacagaggucuuccaccuguuuuaaacaacacgacaagcugugagcaagcguguguguggggauguguggggaggggugggugugaguagggagagaggcgaggggagaacagcuccccucgggcgcuaggggccgccccgagggcccgccugccucgggcgacaccggccuggcgcccccgcggccgcuccgugugcccuggacucgccgcccgcggcucggaagcuggagagucagcgacggggcccgacugcgggaccgagggcugcaagaagaagcgaacaaauaguccccagcgccuccucuggaugcggucgcgucugugguccuggcagccgcugggcgggccaggccaggucgggccgggccgagccgggcacauggaccugggccugcgggcucuaauugcggcgcuuauguugaugauuuuuuuuuuaaucacagcagcccccaguuuagcg

SEQ ID NO: 20400 - RNA, 1657 nt, Homo sapiens
cgcuaaacugggggcugcugugauuaaaaaaaaaaucaucaacauaagcgccgcaauuagagcccgcaggcccagguccaugugcccggcucggcccggcccgaccuggccuggcccgcccagcggcugccaggaccacagacgcgaccgcauccagaggaggcgcuggggacuauuuguucgcuucuucuugcagcccucggucccgcagucgggccccgucgcugacucuccagcuuccgagccgcgggcggcgaguccagggcacacggagcggccgcgggggcgccaggccggugucgcccgaggcaggcgggcccucggggcggccccuagcgcccgaggggagcuguucuccccucgccucucucccuacucacacccaccccuccccacacauccccacacacacgcuugcucacagcuugucguguuguuuaaaacagguggaagaccucuguaaugauauuaugccuuucaauaaaaauuuuaugagguguauuugauuauagauuaaugugucccuaauaaaacggacggauggagcagaucggagggcccccucccccugccacacucacacacgcccgcgcggccacacacaccccgacgugaggcugggcacacgccgcggcccgaggggcgagccggggcgcggcgguggaggacacagaggggcuucugccugcccucggaagggcgggcggccgggcgaguuggcgcagcacggacaguggcggccagggugcuucgucuucuccgaugaugcuggaaaggcccuggaagagaacacgccacagggcagaacccaaaugcuagagcagcuugcucccgcccgccgccucagcccugccucagcgagucuccccgggcagggccgcuucgcgcgguucgcacuuaaaggccucggaggagacucccaaaaugucuaaaaaauucggccgaauggcuagguccuugggacacucccuucugauuuuuuucccccuacagaggugagguugagcagccuugaaucugagggaaaugcccauugucacucccaaauccaugguacaaagccucggaagcccggcugggagcccagacaaaagcggccggggcgccggcagcggagggcauauuccuugcucuacaaguugcccagcucacccuuggagggcucccggcccaccuccagccccgaaaaggaagcggguaaauggcuauuuauggccugauugauuaccuuugccaauagcuuucugauuuuguuccagaugggaugccuuugccuuguagcucaggcuuuccucggauacauggcccgcuaucaacagcuaaugguauuccccacaugaucggagaaacggcuaaauaaaaauuacccuccuccugcccaaccgguguuaagucuggggcaaagcuauuacaacguuuucaaucuagcauugauuccaagcccucucccccacccccaggaaauggcccccuaaaagaguucugucuuggaauguuccugguuuuggggcggaaguuuaaaauuuugaaugccagugucccagagacucccuggcugaggacuuauagcaccuaaauggaucguucuuagggaaacauuuaaaaggaagaaauggaaaggauguguuuuguaaaacugcuggaagcuauuugaaac

SEQ ID NO: 20401 - RNA, 85 nt, Homo sapiens
cagcgacuuggacuucuucuucuuuuuuuuuuucuuuuuagauagaagugacugugugguuggucucugagguauuugggggacu

SEQ ID NO: 20402 - RNA, 85 nt, Homo sapiens
agucccccaaauaccucagagaccaaccacacagucacuucuaucuaaaaagaaaaaaaaaaagaagaagaaguccaagucgcug

SEQ ID NO: 20403 - RNA, 1061 nt, Homo sapiens
gcccggcacccgcagccugcagccugcagcccgcagcccgcagcccggagccagaucgcgggcucagaccgaacccgacucgaccgccgcccccagccaggugagggcagcugaggggaggcagggagccgagguucccccuuuacuggaagcgagggcuggggaggcgcggggaaauuggguccuuuuuccuugaaaggaggaccugggagccuuuucgugaaacaggcacaagggcuuucauuccaaagggauggauggauggagggaaggucucgggggagagggauugguuuuuguuuuuuaaaaauaaggauuaauuggcuucugugaaagugggacuucuuggaaggaugaggggcuuucaagguagguuggggagggggcucuggcagggcuugagggaaggguuaacuggugaguggcagggcaagggggaacucugcgauccccucagccugacaucgcugcaccucccgccuuggcuccggggcucugggucucuccagcucugugucccaguuuuucucuuugaagaugacuauuuugaaccccaccuggacagagccaggaacagccauuuccuucccuggagcuaugacacccaccugacacacccucccacaccucugaccugcucagggaaggggguucagggaaggacgaggauccagggaucugggaauugggcagugugggugaaacggaggcuggguacugggugcacaggaagacccuuggcacugguggggugcaccagccuuggucaggagguugcugggcagcugcuucuggggcaggacccacuaggaaagcagcgguauggaaaagcugagcuguuuuccguguucccagaagacaaaacacuagagaauguguuugcuugcuuuuguuugguuuugcuuucugucuuccucacccuggaucccaagacucauuccucugaucuccucuccuaguuuugcaaaaagguaaacugaggcacagaacaaauuggcuggacauaccugugucuaggagggaagagugacaggaaggcauacggaauuugagucaaaaaa

SEQ ID NO: 20404 - RNA, 1061 nt, Homo sapiens
uuuuuugacucaaauuccguaugccuuccugucacucuucccuccuagacacagguauguccagccaauuuguucugugccucaguuuaccuuuuugcaaaacuaggagaggagaucagaggaaugagucuugggauccagggugaggaagacagaaagcaaaaccaaacaaaagcaagcaaacacauucucuaguguuuugucuucugggaacacggaaaacagcucagcuuuuccauaccgcugcuuuccuaguggguccugccccagaagcagcugcccagcaaccuccugaccaaggcuggugcaccccaccagugccaagggucuuccugugcacccaguacccagccuccguuucacccacacugcccaauucccagaucccuggauccucguccuucccugaacccccuucccugagcaggucagaggugugggagggugugucaggugggugucauagcuccagggaaggaaauggcuguuccuggcucuguccaggugggguucaaaauagucaucuucaaagagaaaaacugggacacagagcuggagagacccagagccccggagccaaggcgggaggugcagcgaugucaggcugaggggaucgcagaguucccccuugcccugccacucaccaguuaacccuucccucaagcccugccagagcccccuccccaaccuaccuugaaagccccucauccuuccaagaagucccacuuucacagaagccaauuaauccuuauuuuuaaaaaacaaaaaccaaucccucucccccgagaccuucccuccauccauccaucccuuuggaaugaaagcccuugugccuguuucacgaaaaggcucccagguccuccuuucaaggaaaaaggacccaauuuccccgcgccuccccagcccucgcuuccaguaaagggggaaccucggcucccugccuccccucagcugcccucaccuggcugggggcggcggucgagucggguucggucugagcccgcgaucuggcuccgggcugcgggcugcgggcugcaggcugcaggcugcgggugccgggc

SEQ ID NO: 20405 - RNA, 1254 nt, Homo sapiens
cuugagccccgacggaaaacaccccugcccuccccgacaccccucccccgcuccgguacuaccccccuuugcugcccagccuccaagccgggguccuccagcuccaggcccccuccuccggccccgcaacggaaguguugggcacaaugucggugccaaaucuucgccucucccucccuuggacucuggagucuccucucccgccccagggacagauccaggggccacagccuucccagagccauggagugaaugcccaagaaccgaagaccuacaccccaaaccaccccacgggcgugcggagcacccccuccggucucgcccggggaagaggggugucgaggacucgggaaacacagugcccacgcccagaggcugcaggaacugcgugcuaggggcuuggagggagggcggggcacccgagagccagggcuccuucgaccacggcggagacauggaggagccuccagauggccuaggaaaacacggcccucgaggcccgcccgacccuagcgugagaaacuggguccccacuuuggucacaggggcuagacagugccucugggguagggugcagggugaggagagaaggaggacaagagucuugcacucgccugacccgagcucuguccgggccuccgccuugugggugcacugcggaugcccucucgccgcgagaaugggcggcuuuuggcaauaacgccucuuaggggaguuauuagagcugagcgugccuggugucccucaaggccagguugggcgacucucgcagaggccccucgacagaugucagucagaggcuaggacucugccacaucuuuaaggacuuggacaccucugggcaccgggcuaagacggcgucccaaaguuagguggcccgucgcaggcagccccuaguagucuggccuccucgcccgcacaacccuucacccacaggccaggugcaaucccgaugcaggcuccuggcccgacccucuacgcgcucaggcggacagcuaaggucuggcugagucuccggcaggggcguuuggaaugugaccggucacccacucucggcccugcauuugcuugugcaugcaaguccacagguguagaggcacccgaaccgugugcauccucccggccacagcacccuaggcacgcacacgcaugcacaugcacgugugcacacggcgcggcaugcucacgcgcucucacgggcggacugguauccaggcguggccgugcgcacacacacgcacaugcauacagcua

SEQ ID NO: 20406 - RNA, 1254 nt, Homo sapiens
uagcuguaugcaugugcgugugugugcgcacggccacgccuggauaccaguccgcccgugagagcgcgugagcaugccgcgccgugugcacacgugcaugugcaugcgugugcgugccuagggugcuguggccgggaggaugcacacgguucgggugccucuacaccuguggacuugcaugcacaagcaaaugcagggccgagagugggugaccggucacauuccaaacgccccugccggagacucagccagaccuuagcuguccgccugagcgcguagagggucgggccaggagccugcaucgggauugcaccuggccugugggugaaggguugugcgggcgaggaggccagacuacuaggggcugccugcgacgggccaccuaacuuugggacgccgucuuagcccggugcccagagguguccaaguccuuaaagauguggcagaguccuagccucugacugacaucugucgaggggccucugcgagagucgcccaaccuggccuugagggacaccaggcacgcucagcucuaauaacuccccuaagaggcguuauugccaaaagccgcccauucucgcggcgagagggcauccgcagugcacccacaaggcggaggcccggacagagcucgggucaggcgagugcaagacucuuguccuccuucucuccucacccugcacccuaccccagaggcacugucuagccccugugaccaaaguggggacccaguuucucacgcuagggucgggcgggccucgagggccguguuuuccuaggccaucuggaggcuccuccaugucuccgccguggucgaaggagcccuggcucucgggugccccgcccucccuccaagccccuagcacgcaguuccugcagccucugggcgugggcacuguguuucccgaguccucgacaccccucuuccccgggcgagaccggagggggugcuccgcacgcccguggggugguuugggguguaggucuucgguucuugggcauucacuccauggcucugggaaggcuguggccccuggaucugucccuggggcgggagaggagacuccagaguccaagggagggagaggcgaagauuuggcaccgacauugugcccaacacuuccguugcggggccggaggagggggccuggagcuggaggaccccggcuuggaggcugggcagcaaagggggguaguaccggagcgggggaggggugucggggagggcagggguguuuuccgucggggcucaag

SEQ ID NO: 20407 - RNA, 533 nt, Homo sapiens
gcggccguacuuggccuuacagugcaaaaugugcuuggcgaggaagucgaggcggcgcuguagcagcugagcgugggggucugcaagggcggccagcucggggaagcgaggcucguggcgccgguagaggcgcagcagccgggccgcggcguccuguccgcggugcagcuccaggacgcgccgcgcgguccgcucgcggaacacgcacacugacugcaacagcggcucguuauacuugucccacaugccugcuacccgguagccgugcaccaagcccgccucauuguccagaaagaccagcgccccgcccggaccgcggugcagguugcugguggcacgcugcaugacgcgcgggucccacugcaggcugaagagguugcuuacgagccggucgaaguuggccgucagguagucgaaaaggauuaagucgguccauuguacuagguccaccagcuccgccuggcugagguuggccagcucacccccggcaucccggagggggcgcagacggccguccuccgagcgccagggcg

SEQ ID NO: 20408 - RNA, 533 nt, Homo sapiens
cgcccuggcgcucggaggacggccgucugcgcccccuccgggaugccgggggugagcuggccaaccucagccaggcggagcugguggaccuaguacaauggaccgacuuaauccuuuucgacuaccugacggccaacuucgaccggcucguaagcaaccucuucagccugcagugggacccgcgcgucaugcagcgugccaccagcaaccugcaccgcgguccgggcggggcgcuggucuuucuggacaaugaggcgggcuuggugcacggcuaccggguagcaggcaugugggacaaguauaacgagccgcuguugcagucagugugcguguuccgcgagcggaccgcgcggcgcguccuggagcugcaccgcggacaggacgccgcggcccggcugcugcgccucuaccggcgccacgagccucgcuuccccgagcuggccgcccuugcagacccccacgcucagcugcuacagcgccgccucgacuuccucgccaagcacauuuugcacuguaaggccaaguacggccgc

SEQ ID NO: 20409 - RNA, 414 nt, Homo sapiens
auguuguagguaucuaaaauaaaugcuaauauuauuuuaaaagauuuaaaaucucauguuuuucaucuauuuagggaagagaaaacacagaagaaucaguguuggaaaucucucuucauagauacuuacucugauguaggaagauacauugaccauuaugcugcuauuaaaaaggccugggaugaucucaagaaauauuuggagcccagguguccucggaugguuuuaucucugaaagguacugggaauucagggucccuuuccccguuuccauuacuguuaguauaaauagguuaguuuaaacaacuuugaaucucugucaucuacgcaacuguguuaacccaacuuugucugugauuuacuguucauauuuggccauggaaguaggaccuucacucuagugcuuacccuguu

SEQ ID NO: 20410 - RNA, 414 nt, Homo sapiens
aacaggguaagcacuagagugaagguccuacuuccauggccaaauaugaacaguaaaucacagacaaaguuggguuaacacaguugcguagaugacagagauucaaaguuguuuaaacuaaccuauuuauacuaacaguaauggaaacggggaaagggacccugaauucccaguaccuuucagagauaaaaccauccgaggacaccugggcuccaaauauuucuugagaucaucccaggccuuuuuaauagcagcauaauggucaauguaucuuccuacaucagaguaaguaucuaugaagagagauuuccaacacugauucuucuguguuuucucuucccuaaauagaugaaaaacaugagauuuuaaaucuuuuaaaauaauauuagcauuuauuuuagauaccuacaacau

SEQ ID NO: 20411 - RNA, 6748 nt, Homo sapiens
cccauagaucgcguccuugucccgcuucaaggcgucguugacagcggaucccauacuggccggcaugacauuggggugcggggcgugcgcgccguagugcuguguggcguggagcggcggcccgugguucagguggugaaccggggggaucggccgcggcgcgugagggucuccguacauggaagcgggaaccccuacuccguccaucccgccguaauggggcagcucaucguacugucagaacccgggaagggggagggggcgcaggaggugagggagaacagaggagggggguggaaagggaaaaagagcagggagaagagggcgaacagaaaagagaggaagggauaaagaugagagagagggagggagguaagagagaagagaggaggaggaggaaaaggaggagagggggagagagagagagagagagagagagagagagagagagagagagagaaaauaaaaauaaaaacaaagucagaaaggagaaaaguaccgagcacaaguugagcacacagaaaccaaaccagccaaaacaacggaguuaaaaguugugaggaaaaaauguuauuaaauuuaaaaaugaaaaagcaugaaccaagagcaacguuuagagaaggaagaggaggcggcgaggccggggauuugagggggcgccgggaggccccgcucccgccggaggcaacagaaccguagcgagccaacggagggagaaguggaguuagugugaggaggaagccccggaucccaccccuaaccccccuucgccuccucugaggauccaauaaaucaaaaggcgaaaugaaacaaaauaaagagaagaaaaacgcuaauaaucagcacgagaacgccgaggacuaggaaagacuagggccagugccuccccgggggcagggagcggagggugggggggcgaauaacgugaaaguuaccagaaacauuauuuagcagcggauucccugcguccuugucaauuucagagacaaaacaagcagcccaggcuaguagucuaggcggcggcgcagcggcugcggcagcgcggccccagcggcggccccggcggcggcuccuacgcagcccgugcccgccccgagccgcgcgagccacggcggcagcggcgcagcagcggcagcaggagaaccgggggaaucgcgcugcugggguaaaagcuggagcgaggcgaaagcguguaacgauugcacacgcacacacacacaccacucacacgcacucgccgcccgcccgcucgcacagcgcuggaacacgcgcgcccagacacgcacacacgcacgcacacacacucgcacacacgcagaggcacgggagggaaagaagccgaugaauaauuuugcuauuuuuuaaaauacuggccgccaucaucaagcagcgagcagcagcagaagcguugaagggagaggaggcaucgggacaggccccucuuaggagaggauuuauaucuagguaaguguuggagauuuaaaccuacccuuugcgccaucagucugcgcuccaauaaacuccuggaugugucguauauuuaauaucccaguccggauaagaaagugaucuaggcugaagauuccuuuuuuuuuuuuccaaaccaaagagacuucucccaauucuccaauaugcuauuuuuuaggggggaaaaaaagcccagucuagacaacgaagaauuuuuuuuucugugauauuucuucuuuuucucuuuuuuccucuucuuccuccuccuccugaucuuccuccuccuccuccaccuccuccuccuccccccuccccuccuccuccucuucgguccuccuuucccccucuuucucuucucuuccccucaguuggaaaaaaaaagaaagaaaagaaaaagaagaaaaagaagaaaaaaauugucaagcccccgaacugaagguuacgagcggcccgucagcagcccacauguaaccgaacugucguguuucauggcuuuuugccacuccagcugucaaucaaagcccggaaugucaagguagugaaugaaugaugguugaugaugaugaagaggaggaaucuuucagacccguuuuuuucuuccaguaaaacuccgcgagggguuucugcuucuugaauuuuuuccuccccccuccccccuuuuuuagcuuugcccccgcgguaucuauaauacgauccucucucuuuaaaguauuguucaaagaaagcagugagaaaaaucaagaaaaaaaaaugaauaguuugcaaaaauuggacuuccucccccccuuuccugguagguauuuugucucucccucucucucuuucucgcucgcucgcucgcucucacucgcgcucgcucucucgcgcucgcucucucucgcucucuuucucucucugggagaugagugagugucaguagguguuggcagguuggcugcugccuggcuuauugaagagccucaguuuggcggcgcgggucggcggcgggagaacgaaaugacggaacccggaagucgugguggccauagcccgucguacggcggagacacaucccgggaguggggagcgggagcgaggaggagcgcgccgcgccgagccucugauaugcaacgagugcgaucggacagccccggcugggggggugggggaggcgggggggcgggagggggaggggaggcucgagccgggcggacccgagcaaaucagcaagccugcuccuccacggggaugggggacggcgggggggaggaaaaggagagugugucugugugugugaguguguguguaugugugugcgugcgcgcguguguguugcgcgcgcgcgcgcgcgaacagggagagagggagagggggagagagaagaggacagggagagcgcagagaggaaaacugcagaaaaccacagggaaaguacgguaccgccucagaucuuuucauuuaaaaaaaaaaaaaaacuuacuucuaguucauuuucccaucacucccggcuccugccuaacugggucuugccggggacguuuggcauggcgcucuagcuuuuguuccuuuuaauuccgcggccucccucuccucugcccgccgauuacagcaccccgaaggcuuccugcuaacguccaagggcagcaagcucugcagacgguaccacugccgggcuaaauuuuuuauuaaguggcacuuucuuuucugcgcagauccagcaaccuugucaauacucauuuuuuuccaggaccagaagagaccagcuuaacucagagcacacucccuccaagcggugcggacaaggggccaccccgagagucuuugggggccgcggcggaaucgggagggaggaagugaggaggcagucaucuggguccgauguagccaaaggcgugugugugugugugugugugugugugugugugugugugugcgcgcgcgcgcccgcgcgcccgugcgcgcgcgcgacuagugugcgucuccaaaguggaucucacucagagcugggaagcacaggaggaaaagacggagagagugggggagaaagaaguugccgggcgaggaggaguggccggcgcucacagcccagcuuuguuguggucgcccgaggcgcagcggcgggccgcgguaacgccugcuaauggcuguguuaauuacacaggggcgauuucgcggggucagggagauggggccagcuccgaaagaacuuuuccaaaaaggaaaaggaaacgaagggaacuaccccacaccguuuggguggaaacuaguuguggccggugcccuguccucccuggcccgagcugcaccaggcuucaccucugcgcggcugguuucccggcggccgcgcgucaaucacuacgagcccggaguugggggcggagccacggucaccccgcgcaagccuugccgcccagcagcccccaugccccucggccccuuguggcgcggccgggcggacaggcgcuggaagcgcguccucuccccaacuucucgcucucgcccucccagucccuggcccagagaguggaaagcggacuguuguucuccaacagccgcaucccuccccaacuuugaacccauucugagaaguggagaguagugucuuccgcgagccgcgucuaaccgacuuucccgcggagggagggugggaugggggagguugauuagagagaauaaaguacucuguguguguguugugugugagagagagagagagagagcgagagagagcggggaggagggcgggugggagggcucuuuuuuuuggcccccguuccauguucccugcuucacuguaagcuuucgagcaacagaaacuaggcuaagauugcagccugcagagacuccaagcggagucggagaaauuuggccucguuuuaauagggcugaggaaugaacuccggaggucaauaaagcccuccaaaaaugaugaaugauugagcaccugugaugaugauagugauuaccagagcaauuaaacaguuugauuaaaugagccaucauaacaaugaugucugcgggaaaucggcccucacauauaaagaaagauagugcgaaggggcuggcagaggcgcggauagcgcgacgccagggagaggggcugcgggccgcgagguuucugcccaauggcccgagcagggacggccagacucacggagcuucagggaggagaguguagcccagguuuucagccacucuuuuuugccgggcuucaagccugcuagagccgacggguaggaaaucugaagguuggggggaggguacuuccuccacguccucuuuuuuuuccuagaagaacuccaagauuaaaaguauccuuauuuguugcugaguugcucgucgacauuuaagagaaggugaguaaaaaagaaaagaagaugaaagagaaaagaaaaaguuggucuccagaauuuuauuucaaucgacaguuacgcgaauucaguuuagccgggaccgggagguuugagagugcggcgggguggggaggggaaaaaaacaaaaacgcugcggagcguuuucgacuuugcaaagcuguugauguugguggguccaaguucccggugcagcgccgcuggcugagaaauuuguacucaguuuuuacucuucuaauuauucuuaaauucaauuuaagaauuuaaguuuaucgucgccaauaggauuauuguuguuuuaaaugucuuguucaauaagugccaguuacguuucuuuuuaaaagaaauuccucaguguccuugauaaaccuuuuuuuguaaagaucaacuucaugcggaaccucugccuugcaggguuuaaacauucaacauugcuaccuucuguuucuuuuucuguuuuuauagugauacuguaaagugaguuagcaucucuauagcuuucauuuagaaaaacuuaagucgcauuuuuagaaaaauauuccuucccuugcagugugaguaaaaacaacucagacagauugaugauuucuauauuuucuuuucuuucuuuaucuucuuuuucuuuuuuucuuuucuuuucuuuuuuuuucuuuuuuuuugagacggagucucgcuuugucgcccaggcuggagugcaauggcgcgaucucggcucacugcaaccuccgccucccggguucaagcgauucuccugccucagccucuugaguagcugggauuacaggggcgcgccaccacgcccggcuaauuuuuugugucuuuaauagagacggggguuucaccauauuggccaggcuggucucgaacuccugaccuccugauccacccgccgcggccucucaaagugcucgaauuacaggcgugagccaucgcacccggccgauuucuauguuuucaaacaauuguaagcuaauaaugaguugauuaucuggugauaaucuuggguuuuacaaaaaaagaaaaguuuaaacuuuauuuucauguguuuuuaucagaugcagaaggcauuuuuaaccuuaacgccuuucucugucucucucuuucauauucuuaacuucuuuugcauuuuauugaauacauuaaagcaaacaacaggaacaauaugguuagguguaggagggagagagaaauaugacauuuuaagauauugucaaaaagucauauuuaacuucaacgacuuuuaguuaaaaaagugugagaguguugaaagugcauuccuacuggaggaaaucuaugucuuuuuaaaauuugccaguugucucaggggagaacccagaauuucuuugaacgaaagagaucuuacugaucuaguugcaugucacuuaugaaacuguuaguuuaaaauagcaguccuaguguaguggauuacacaugaggagaucaaguuggagucgauucaagguauugguucuuggucagucugcugaauucaaaacacuauuaccuuuaaucagcaacuugcggguguuuuauuaauagagcugaaaaaggcucaucuaacauauaagaauuuccugguuucccucauccccaauuuuccaguccaauagaagcgauuccaaaggaguaggguacccgcacuuacugauuuccauccugguggcauuuugcuaaugccccauugucagcguuggcacucccacccaggcuuccaggcucaucugcucucccauauuuggggugaaaggaaaguagguggggcaggcccgggagacaggcacgaaaugggggucgcaggagguggcacacaccuccgucaacagucagcuccuucugcccaggcuggaaaugguuuuaacaggcgguaaaauuucaucuugcggugucaaauuggggucauuuugggguuagaguucucaguguccgagagg

SEQ ID NO: 20412 - RNA, 6748 nt, Homo sapiens
ccucucggacacugagaacucuaaccccaaaaugaccccaauuugacaccgcaagaugaaauuuuaccgccuguuaaaaccauuuccagccugggcagaaggagcugacuguugacggaggugugugccaccuccugcgacccccauuucgugccugucucccgggccugccccaccuacuuuccuuucaccccaaauaugggagagcagaugagccuggaagccugggugggagugccaacgcugacaauggggcauuagcaaaaugccaccaggauggaaaucaguaagugcggguacccuacuccuuuggaaucgcuucuauuggacuggaaaauuggggaugagggaaaccaggaaauucuuauauguuagaugagccuuuuucagcucuauuaauaaaacacccgcaaguugcugauuaaagguaauaguguuuugaauucagcagacugaccaagaaccaauaccuugaaucgacuccaacuugaucuccucauguguaauccacuacacuaggacugcuauuuuaaacuaacaguuucauaagugacaugcaacuagaucaguaagaucucuuucguucaaagaaauucuggguucuccccugagacaacuggcaaauuuuaaaaagacauagauuuccuccaguaggaaugcacuuucaacacucucacacuuuuuuaacuaaaagucguugaaguuaaauaugacuuuuugacaauaucuuaaaaugucauauuucucucucccuccuacaccuaaccauauuguuccuguuguuugcuuuaauguauucaauaaaaugcaaaagaaguuaagaauaugaaagagagagacagagaaaggcguuaagguuaaaaaugccuucugcaucugauaaaaacacaugaaaauaaaguuuaaacuuuucuuuuuuuguaaaacccaagauuaucaccagauaaucaacucauuauuagcuuacaauuguuugaaaacauagaaaucggccgggugcgauggcucacgccuguaauucgagcacuuugagaggccgcggcggguggaucaggaggucaggaguucgagaccagccuggccaauauggugaaacccccgucucuauuaaagacacaaaaaauuagccgggcgugguggcgcgccccuguaaucccagcuacucaagaggcugaggcaggagaaucgcuugaacccgggaggcggagguugcagugagccgagaucgcgccauugcacuccagccugggcgacaaagcgagacuccgucucaaaaaaaaagaaaaaaaaagaaaagaaaagaaaaaaagaaaaagaagauaaagaaagaaaagaaaauauagaaaucaucaaucugucugaguuguuuuuacucacacugcaagggaaggaauauuuuucuaaaaaugcgacuuaaguuuuucuaaaugaaagcuauagagaugcuaacucacuuuacaguaucacuauaaaaacagaaaaagaaacagaagguagcaauguugaauguuuaaacccugcaaggcagagguuccgcaugaaguugaucuuuacaaaaaaagguuuaucaaggacacugaggaauuucuuuuaaaaagaaacguaacuggcacuuauugaacaagacauuuaaaacaacaauaauccuauuggcgacgauaaacuuaaauucuuaaauugaauuuaagaauaauuagaagaguaaaaacugaguacaaauuucucagccagcggcgcugcaccgggaacuuggacccaccaacaucaacagcuuugcaaagucgaaaacgcuccgcagcguuuuuguuuuuuuccccuccccaccccgccgcacucucaaaccucccggucccggcuaaacugaauucgcguaacugucgauugaaauaaaauucuggagaccaacuuuuucuuuucucuuucaucuucuuuucuuuuuuacucaccuucucuuaaaugucgacgagcaacucagcaacaaauaaggauacuuuuaaucuuggaguucuucuaggaaaaaaaagaggacguggaggaaguacccuccccccaaccuucagauuuccuacccgucggcucuagcaggcuugaagcccggcaaaaaagaguggcugaaaaccugggcuacacucuccucccugaagcuccgugagucuggccgucccugcucgggccauugggcagaaaccucgcggcccgcagccccucucccuggcgucgcgcuauccgcgccucugccagccccuucgcacuaucuuucuuuauaugugagggccgauuucccgcagacaucauuguuaugauggcucauuuaaucaaacuguuuaauugcucugguaaucacuaucaucaucacaggugcucaaucauucaucauuuuuggagggcuuuauugaccuccggaguucauuccucagcccuauuaaaacgaggccaaauuucuccgacuccgcuuggagucucugcaggcugcaaucuuagccuaguuucuguugcucgaaagcuuacagugaagcagggaacauggaacgggggccaaaaaaaagagcccucccacccgcccuccuccccgcucucucucgcucucucucucucucucucacacacaacacacacacagaguacuuuauucucucuaaucaaccucccccaucccacccucccuccgcgggaaagucgguuagacgcggcucgcggaagacacuacucuccacuucucagaauggguucaaaguuggggagggaugcggcuguuggagaacaacaguccgcuuuccacucucugggccagggacugggagggcgagagcgagaaguuggggagaggacgcgcuuccagcgccuguccgcccggccgcgccacaaggggccgaggggcaugggggcugcugggcggcaaggcuugcgcggggugaccguggcuccgcccccaacuccgggcucguagugauugacgcgcggccgccgggaaaccagccgcgcagaggugaagccuggugcagcucgggccagggaggacagggcaccggccacaacuaguuuccacccaaacggugugggguaguucccuucguuuccuuuuccuuuuuggaaaaguucuuucggagcuggccccaucucccugaccccgcgaaaucgccccuguguaauuaacacagccauuagcaggcguuaccgcggcccgccgcugcgccucgggcgaccacaacaaagcugggcugugagcgccggccacuccuccucgcccggcaacuucuuucucccccacucucuccgucuuuuccuccugugcuucccagcucugagugagauccacuuuggagacgcacacuagucgcgcgcgcgcacgggcgcgcgggcgcgcgcgcgcacacacacacacacacacacacacacacacacacacacacgccuuuggcuacaucggacccagaugacugccuccucacuuccucccucccgauuccgccgcggcccccaaagacucucgggguggccccuuguccgcaccgcuuggagggagugugcucugaguuaagcuggucucuucugguccuggaaaaaaaugaguauugacaagguugcuggaucugcgcagaaaagaaagugccacuuaauaaaaaauuuagcccggcagugguaccgucugcagagcuugcugcccuuggacguuagcaggaagccuucggggugcuguaaucggcgggcagaggagagggaggccgcggaauuaaaaggaacaaaagcuagagcgccaugccaaacguccccggcaagacccaguuaggcaggagccgggagugaugggaaaaugaacuagaaguaaguuuuuuuuuuuuuuuaaaugaaaagaucugaggcgguaccguacuuucccugugguuuucugcaguuuuccucucugcgcucucccuguccucuucucucucccccucucccucucucccuguucgcgcgcgcgcgcgcgcaacacacacgcgcgcacgcacacacauacacacacacucacacacacagacacacucuccuuuuccucccccccgccgucccccauccccguggaggagcaggcuugcugauuugcucggguccgcccggcucgagccuccccucccccucccgcccccccgccucccccacccccccagccggggcuguccgaucgcacucguugcauaucagaggcucggcgcggcgcgcuccuccucgcucccgcuccccacucccgggaugugucuccgccguacgacgggcuauggccaccacgacuuccggguuccgucauuucguucucccgccgccgacccgcgccgccaaacugaggcucuucaauaagccaggcagcagccaaccugccaacaccuacugacacucacucaucucccagagagagaaagagagcgagagagagcgagcgcgagagagcgagcgcgagugagagcgagcgagcgagcgagaaagagagagagggagagacaaaauaccuaccaggaaagggggggaggaaguccaauuuuugcaaacuauucauuuuuuuuucuugauuuuucucacugcuuucuuugaacaauacuuuaaagagagaggaucguauuauagauaccgcgggggcaaagcuaaaaaaggggggaggggggaggaaaaaauucaagaagcagaaaccccucgcggaguuuuacuggaagaaaaaaacgggucugaaagauuccuccucuucaucaucaucaaccaucauucauucacuaccuugacauuccgggcuuugauugacagcuggaguggcaaaaagccaugaaacacgacaguucgguuacaugugggcugcugacgggccgcucguaaccuucaguucgggggcuugacaauuuuuuucuucuuuuucuucuuuuucuuuucuuucuuuuuuuuuccaacugaggggaagagaagagaaagagggggaaaggaggaccgaagaggaggaggaggggaggggggaggaggaggagguggaggaggaggaggaagaucaggaggaggaggaagaagaggaaaaaagagaaaaagaagaaauaucacagaaaaaaaaauucuucguugucuagacugggcuuuuuuuccccccuaaaaaauagcauauuggagaauugggagaagucucuuugguuuggaaaaaaaaaaaaggaaucuucagccuagaucacuuucuuauccggacugggauauuaaauauacgacacauccaggaguuuauuggagcgcagacugauggcgcaaaggguagguuuaaaucuccaacacuuaccuagauauaaauccucuccuaagaggggccugucccgaugccuccucucccuucaacgcuucugcugcugcucgcugcuugaugauggcggccaguauuuuaaaaaauagcaaaauuauucaucggcuucuuucccucccgugccucugcgugugugcgagugugugugcgugcgugugugcgugucugggcgcgcguguuccagcgcugugcgagcgggcgggcggcgagugcgugugaguggugugugugugugcgugugcaaucguuacacgcuuucgccucgcuccagcuuuuaccccagcagcgcgauucccccgguucuccugcugccgcugcugcgccgcugccgccguggcucgcgcggcucggggcgggcacgggcugcguaggagccgccgccggggccgccgcuggggccgcgcugccgcagccgcugcgccgccgccuagacuacuagccugggcugcuuguuuugucucugaaauugacaaggacgcagggaauccgcugcuaaauaauguuucugguaacuuucacguuauucgcccccccacccuccgcucccugcccccggggaggcacuggcccuagucuuuccuaguccucggcguucucgugcugauuauuagcguuuuucuucucuuuauuuuguuucauuucgccuuuugauuuauuggauccucagaggaggcgaagggggguuaggggugggauccggggcuuccuccucacacuaacuccacuucucccuccguuggcucgcuacgguucuguugccuccggcgggagcggggccucccggcgcccccucaaauccccggccucgccgccuccucuuccuucucuaaacguugcucuugguucaugcuuuuucauuuuuaaauuuaauaacauuuuuuccucacaacuuuuaacuccguuguuuuggcugguuugguuucugugugcucaacuugugcucgguacuuuucuccuuucugacuuuguuuuuauuuuuauuuucucucucucucucucucucucucucucucucucucucucucucucccccucuccuccuuuuccuccuccuccucucuucucucuuaccucccucccucucucucaucuuuaucccuuccucucuuuucuguucgcccucuucucccugcucuuuuucccuuuccaccccccuccucuguucucccucaccuccugcgcccccucccccuucccggguucugacaguacgaugagcugccccauuacggcgggauggacggaguagggguucccgcuuccauguacggagacccucacgcgccgcggccgauccccccgguucaccaccugaaccacgggccgccgcuccacgccacacagcacuacggcgcgcacgccccgcaccccaaugucaugccggccaguaugggauccgcugucaacgacgccuugaagcgggacaaggacgcgaucuauggg

SEQ ID NO: 20413 - RNA, 507 nt, Homo sapiens
cccuugucauacauauuauuaaaugaccaauauuauguaugaaguagacaaaaaaauuuacucaaacuucauucaaauccuaauugugauaauuuuuguuuuauauuuaauuauaaaccaaaauacauuugcauuuuuaagcuaauuugucucaaaauuuugcuuuauauuuuuggaucagguuaaaguccuguggauccccugaauguuauugucccucuugauugguuuuuacuucugagcuauacgucaaaagacacauaagcuucaaaagucaagacaaaccucauuugccauaaaaaucaagauauagauguucuguuccguaaacuccuugaaaaacauuuuaaagucaucaauaugaucuguuucccaugaaacuuaaguuagcuuucuuauuggaguuauuucuuuucuguaagucugaaaaguagagauuuuguuuuacgcauuuuaguaaccugcaacaaccaacucuaaaaaagauuuggcuuguaaugacggucu

SEQ ID NO: 20414 - RNA, 507 nt, Homo sapiens
agaccgucauuacaagccaaaucuuuuuuagaguugguuguugcagguuacuaaaaugcguaaaacaaaaucucuacuuuucagacuuacagaaaagaaauaacuccaauaagaaagcuaacuuaaguuucaugggaaacagaucauauugaugacuuuaaaauguuuuucaaggaguuuacggaacagaacaucuauaucuugauuuuuauggcaaaugagguuugucuugacuuuugaagcuuaugugucuuuugacguauagcucagaaguaaaaaccaaucaagagggacaauaacauucaggggauccacaggacuuuaaccugauccaaaaauauaaagcaaaauuuugagacaaauuagcuuaaaaaugcaaauguauuuugguuuauaauuaaauauaaaacaaaaauuaucacaauuaggauuugaaugaaguuugaguaaauuuuuuugucuacuucauacauaauauuggucauuuaauaauauguaugacaaggg

SEQ ID NO: 20415 - RNA, 1010 nt, Homo sapiens
cugucuggaugucaccugggggaaaggaaaugacuguuuauugggucccaugaaugcauaaucugauacagucccucagccacucuccaaggcuccaagguuauuauuauuauuauuauuauuauuauuauuauuauuauuauuagagacagagucucauucagucgcccaggcuggagugcaguggcaugaucucugcccacugcaaacuccgccucccagcuucaagcaauucuccucccucagccucuugaguagcugggauuacaggcaaacaccaccaugccuggcuacuuuuuguauuuuuuuuugguagagacaggguuucaccauguuggccaggcuggucucgaacuccugaccucaagugaucugcccuccucagccucccaaaaugcugggcuuauaggcaugagccaccacaccggccaucccuauuauuauuaucccauugcacagaugagaaaacugaguguagagcuagaguuagguuacaagcccaagaccacaugguuaggaagugccaagaagcagguccaugucaggcuuauucaccagacucaccuggaggguggggagagacucguuccuccugccuccuccccaucucugcucagucccccugaccaagauucuucagaguucggugucccucagcgcccaugcccuaccccuuccuucucaccggggcccuucuuaucaucagucacugcauccuguuccucccuugaagcccccagaugaguucucaaggccaccaccaagucaucaccuuccucacuccucucuccagucucaggccuguucuauggggaacccacucugucccgcgggaaaaacccucagcaggcgguuccuugugggggcuccagagagaggugaaggaggccacgcggggcaccgccugcugagcgggaaucccgucccuaaccgcuggcgccccucgaggggaggggcgagggcggaggugguucugcugcggcaucugucccaggcgggcgggaagcugc

SEQ ID NO: 20416 - RNA, 1010 nt, Homo sapiens
gcagcuucccgcccgccugggacagaugccgcagcagaaccaccuccgcccucgccccuccccucgaggggcgccagcgguuagggacgggauucccgcucagcaggcggugccccgcguggccuccuucaccucucucuggagcccccacaaggaaccgccugcugaggguuuuucccgcgggacagaguggguuccccauagaacaggccugagacuggagagaggagugaggaaggugaugacuuggugguggccuugagaacucaucugggggcuucaagggaggaacaggaugcagugacugaugauaagaagggccccggugagaaggaagggguagggcaugggcgcugagggacaccgaacucugaagaaucuuggucagggggacugagcagagauggggaggaggcaggaggaacgagucucuccccacccuccaggugagucuggugaauaagccugacauggaccugcuucuuggcacuuccuaaccauguggucuugggcuuguaaccuaacucuagcucuacacucaguuuucucaucugugcaaugggauaauaauaauagggauggccggugugguggcucaugccuauaagcccagcauuuugggaggcugaggagggcagaucacuugaggucaggaguucgagaccagccuggccaacauggugaaacccugucucuaccaaaaaaaaauacaaaaaguagccaggcauggugguguuugccuguaaucccagcuacucaagaggcugagggaggagaauugcuugaagcugggaggcggaguuugcagugggcagagaucaugccacugcacuccagccugggcgacugaaugagacucugucucuaauaauaauaauaauaauaauaauaauaauaauaauaauaauaaccuuggagccuuggagaguggcugagggacuguaucagauuaugcauucaugggacccaauaaacagucauuuccuuucccccaggugacauccagacag

SEQ ID NO: 20417 - RNA, 1481 nt, Homo sapiens
agcggcgccccucaaggcuuaagcgccccgcccaagccaggccugcuuccccgccccuggucugcccagcaggcacgguggcccggcccccaccgcgcuccuacccgggugcagugugccccgcgaagagcgccguccccugagaggggguuggggagaggagaggcaaaaccgcgcugaaggucucggagcugcgccugcggccguggggagggcacagaggcuacgcugcgggggaggagucccgaggcucuacgaggcuccuguugcgccccaauaaccuggggucagcuuggggacaccgcuggaaggcgaccuuagcgcuucccgguccucagugccgguucuuauggcuggaggacuaugcgcaauggccaagcguagggggacagcagaagcagaaggccucuaggggcagaggcggugggccuuucaugaagccaggccucgacccugcgcccgcuuccgacguuggggaguguugagggugcgggucgaauugaggaacccugggccugcggagggucaguggucuuucggacucugggucuaucugugcacccuuuccaugcuguuguggagggucugcgucaggggcgggggcagccgacuucgauggggguccagccccacggugaucgguggccucccaucccaggaccacgcguguagcguucuuccgcccgcaaguccgaaagucccgagugggagaagaaggaaggcgcagccccaguuuugggcugacagaaacacuugcggccuucgcacugggcuccccacccgcagcaugacccucuccugcucagcaaaugugggcaaagcucgaccgcagcgugugggagcgcucguagguacccagggccaaggguggcaguguccuagcccgggaaugagcuucugggacagcgccuccgcaaauagguguuucaugaaugucuuuugaugcugagaauuuaacccuuuccucuucuggucagagccuuucuagaucucugggaucuccugggugcugccucucugaagauaauaaucccaacuuuuguuugguccuugauaauuugcaaaguacauuugggcacauuagucugggcguguaugaggguagagaguguuccagauuuuccaguauugggagagaugccuugugugggacuagaugucucccuugagggucagguaagcaggaccagcgccagaaaaggaggauguuuuuauuaacuccugggccaggauuuggaguugagagaggacagggcuagguagggcuggaugccagcuuggaggggagcaaggggcacccgcuggcaucuuagagaggcaaguccagggauccauaggguauaggcggagagaagaucugggagcccacuugccaggaucgccgggaggcacgccccggacucccccucccucgggccugggacuccgccugcccauaaccuacauuaacucccgagcgcagccugggcccaucugccgcc

SEQ ID NO: 20418 - RNA, 1481 nt, Homo sapiens
ggcggcagaugggcccaggcugcgcucgggaguuaauguagguuaugggcaggcggagucccaggcccgagggagggggaguccggggcgugccucccggcgauccuggcaagugggcucccagaucuucucuccgccuauacccuauggaucccuggacuugccucucuaagaugccagcgggugccccuugcuccccuccaagcuggcauccagcccuaccuagcccuguccucucucaacuccaaauccuggcccaggaguuaauaaaaacauccuccuuuucuggcgcugguccugcuuaccugacccucaagggagacaucuagucccacacaaggcaucucucccaauacuggaaaaucuggaacacucucuacccucauacacgcccagacuaaugugcccaaauguacuuugcaaauuaucaaggaccaaacaaaaguugggauuauuaucuucagagaggcagcacccaggagaucccagagaucuagaaaggcucugaccagaagaggaaaggguuaaauucucagcaucaaaagacauucaugaaacaccuauuugcggaggcgcugucccagaagcucauucccgggcuaggacacugccacccuuggcccuggguaccuacgagcgcucccacacgcugcggucgagcuuugcccacauuugcugagcaggagagggucaugcugcggguggggagcccagugcgaaggccgcaaguguuucugucagcccaaaacuggggcugcgccuuccuucuucucccacucgggacuuucggacuugcgggcggaagaacgcuacacgcgugguccugggaugggaggccaccgaucaccguggggcuggacccccaucgaagucggcugcccccgccccugacgcagacccuccacaacagcauggaaagggugcacagauagacccagaguccgaaagaccacugacccuccgcaggcccaggguuccucaauucgacccgcacccucaacacuccccaacgucggaagcgggcgcagggucgaggccuggcuucaugaaaggcccaccgccucugccccuagaggccuucugcuucugcugucccccuacgcuuggccauugcgcauaguccuccagccauaagaaccggcacugaggaccgggaagcgcuaaggucgccuuccagcgguguccccaagcugaccccagguuauuggggcgcaacaggagccucguagagccucgggacuccucccccgcagcguagccucugugcccuccccacggccgcaggcgcagcuccgagaccuucagcgcgguuuugccucuccucuccccaacccccucucaggggacggcgcucuucgcggggcacacugcacccggguaggagcgcggugggggccgggccaccgugccugcugggcagaccaggggcggggaagcaggccuggcuugggcggggcgcuuaagccuugaggggcgccgcu

SEQ ID NO: 20419 - RNA, 1388 nt, Homo sapiens
aguagcggcgcugcgcgcaggccgggaacacgaggccaagagccgcagccccagccgccuuggugcagcguacaccggcacuagcccgcuugcagccccaggauuagacagaagacgcguccucggcgcggucgccgcccagccguagucaccuggauuaccuacagcggcagcugcagcggagccagcgagaaggccaaaggggagcagcgucccgagaggagcgccucuuuucagggaccccgccggcuggcggacgcgcgggaaagcggcgucgcgaacagagccagauugagggcccgcggguggagagagcgacgcccgaggggauggcggcagcgucccggagcgccucuggcugggcgcuacugcugcugguggcacuuuggcagcagguaacacgucccgcgcccucuccguccccucugccgcgcucugggccucagccccgggcaccagcugagcugaccgguccccucccuccuucccucggucccugugcaauagcgcgcggccggcuccggcgucuuccagcugcagcugcaggaguucaucaacgagcgcggcguacuggccagugggcggccuugcgagcccggcugccggacuuucuuccgcgucugccuuaagcacuuccaggcggucgucucgcccggacccugcaccuucgggaccgucuccacgccgguauugggcaccaacuccuucgcuguccgggacgacaguagcggcggggggcgcaacccucuccaacugcccuucaauuucaccuggccggugagcacagccugggcgcacugggaggucgcagaagccgagagaggaggcgcccugggaccaaagcccccuccccagauuuccuuguacacacacccccacccccaaaaagcccaggaugcauucuuuccuggcucuucccgacucucuccugagacugaucccagaaaaggcucucaccagucuccgucuucccaguuuauguccucccguccccagcucuugggacacgauuuucauuaccuaccacucuggggcgguacccuaccacccccuccuccaguggcucucccuuacacucucccgucucucaacccucccucuaccggggguucuccucucgccuucccugcucaagcgcuacacugugcacagccccguuauguugacccgggcgcaguaacugaauccugcaauuagauuaauuaaacaggcugccgcaaggcacccccaccucuccccgcuugcucaucucgccaucucuccguccccccacccccuuucccaggguaccuucucgcucaucaucgaagcuuggcacgcgccaggagacgaccugcggccaggugaguagcucgcuccgccaccacaggggggcgacacggcgcagc

SEQ ID NO: 20420 - RNA, 1388 nt, Homo sapiens
gcugcgccgugucgccccccugugguggcggagcgagcuacucaccuggccgcaggucgucuccuggcgcgugccaagcuucgaugaugagcgagaagguacccugggaaaggggguggggggacggagagauggcgagaugagcaagcggggagaggugggggugccuugcggcagccuguuuaauuaaucuaauugcaggauucaguuacugcgcccgggucaacauaacggggcugugcacaguguagcgcuugagcagggaaggcgagaggagaacccccgguagagggaggguugagagacgggagaguguaagggagagccacuggaggagggggugguaggguaccgccccagagugguagguaaugaaaaucgugucccaagagcuggggacgggaggacauaaacugggaagacggagacuggugagagccuuuucugggaucagucucaggagagagucgggaagagccaggaaagaaugcauccugggcuuuuuggggguggggguguguguacaaggaaaucuggggagggggcuuuggucccagggcgccuccucucucggcuucugcgaccucccagugcgcccaggcugugcucaccggccaggugaaauugaagggcaguuggagaggguugcgccccccgccgcuacugucgucccggacagcgaaggaguuggugcccaauaccggcguggagacggucccgaaggugcaggguccgggcgagacgaccgccuggaagugcuuaaggcagacgcggaagaaaguccggcagccgggcucgcaaggccgcccacuggccaguacgccgcgcucguugaugaacuccugcagcugcagcuggaagacgccggagccggccgcgcgcuauugcacagggaccgagggaaggagggaggggaccggucagcucagcuggugcccggggcugaggcccagagcgcggcagaggggacggagagggcgcgggacguguuaccugcugccaaagugccaccagcagcaguagcgcccagccagaggcgcuccgggacgcugccgccauccccucgggcgucgcucucuccacccgcgggcccucaaucuggcucuguucgcgacgccgcuuucccgcgcguccgccagccggcggggucccugaaaagaggcgcuccucucgggacgcugcuccccuuuggccuucucgcuggcuccgcugcagcugccgcuguagguaauccaggugacuacggcugggcggcgaccgcgccgaggacgcgucuucugucuaauccuggggcugcaagcgggcuagugccgguguacgcugcaccaaggcggcuggggcugcggcucuuggccucguguucccggccugcgcgcagcgccgcuacu

SEQ ID NO: 20421 - RNA, 1518 nt, Homo sapiens
aacauaugaaaaucagagccucagucuacuuauugaacuugccaugugccuugcacacagggcaauaaacaucugcugucugaucaaggucagguuuaccaugauaagcaaacuuccuuccaacauuaucggaauucuggguuuauuuuccacgaaggccaagauggaaccgaauuaaucauaacuauuuucugugcuauuuuaucacagccuaagugcuuggcucauacaaucaucuuguccuuacuccagacuaggagucaaaaacuggucuggugaguuuacuuuuucuucucauaucugggccauacaaacacaaauuuuacuacauauacaugacuauaacaccucauaacaaaaaaagaguaagugaaaugaacagccacauauccaaguggauaccaucacuuggugacccagagcuauauaauaaagcuacagaaccacucaggaaaagagcaucagcgagaaugguaagaauuuaauacaaaaucucccuauauauacugucugaauuuauuuaacaggcuccuccaagaagauaaaaggggucacugacaguccauccuguuguuuccauggaggcuuuaacuuaaacaacugcagacaaauuucucuuaaaggaaauguauucccacuguccuucaauacaggaaaaugacaacccuuagucaagucuaauuaaaauuuuuccggcugaaacaucuguaacagcggcaugggaagccagugaaauggucaguugcauguacacaacacaaacaccacuaguuaaaaauacucccuuaaggccggccacagcagccuuacugcugcagugaaacggagagccccacacaacucaaaaaaccaguucucagaaccacuugcccuguucugcuuccaauguagacaucuaaaggaagcauugcccagaaaacccaauccguaauuuuaauaagcauaauuuacggaagagucaacuacugugugauuucuccucugacugucaugggaaucccuuccuuuccuugcccccuuucaaauacagcaucuaccaagaugaccccaaggaaaguacuuuccucuagaaacaaccagaauugauauugcagggaaaggaacgggcuucuccucuuaucccacucgcaacuccuccccuucuuccccaaggaacucuucucgccucccaaaaucugccucaacaauggcccaagauuccauuuaaccacguccucuccuuuggggcagaaaucucugggaguaggggcaagguaguuuaaccacgaacgggguggggacuaaacaacccuagcaccucuaaggugcccccaggaggucuugccaaggagucuuccacagggagagucauccugcccguuguucuggaucuugaaacuugggagacccacaccaaaggagggaaccgguuccuuuacccuuuaagcgcgucguguccuccaccgccucuucucuuggcccgacuggcucugguuuccuucacguucccagccuccaaauuggcguccgccccauggc

SEQ ID NO: 20422 - RNA, 1518 nt, Homo sapiens
gccauggggcggacgccaauuuggaggcugggaacgugaaggaaaccagagccagucgggccaagagaagaggcgguggaggacacgacgcgcuuaaaggguaaaggaaccgguucccuccuuuggugugggucucccaaguuucaagauccagaacaacgggcaggaugacucucccuguggaagacuccuuggcaagaccuccugggggcaccuuagaggugcuaggguuguuuaguccccaccccguucgugguuaaacuaccuugccccuacucccagagauuucugccccaaaggagaggacgugguuaaauggaaucuugggccauuguugaggcagauuuugggaggcgagaagaguuccuuggggaagaaggggaggaguugcgagugggauaagaggagaagcccguuccuuucccugcaauaucaauucugguuguuucuagaggaaaguacuuuccuuggggucaucuugguagaugcuguauuugaaagggggcaaggaaaggaagggauucccaugacagucagaggagaaaucacacaguaguugacucuuccguaaauuaugcuuauuaaaauuacggauuggguuuucugggcaaugcuuccuuuagaugucuacauuggaagcagaacagggcaagugguucugagaacugguuuuuugaguuguguggggcucuccguuucacugcagcaguaaggcugcuguggccggccuuaagggaguauuuuuaacuagugguguuuguguuguguacaugcaacugaccauuucacuggcuucccaugccgcuguuacagauguuucagccggaaaaauuuuaauuagacuugacuaaggguugucauuuuccuguauugaaggacagugggaauacauuuccuuuaagagaaauuugucugcaguuguuuaaguuaaagccuccauggaaacaacaggauggacugucagugaccccuuuuaucuucuuggaggagccuguuaaauaaauucagacaguauauauagggagauuuuguauuaaauucuuaccauucucgcugaugcucuuuuccugagugguucuguagcuuuauuauauagcucugggucaccaagugaugguauccacuuggauauguggcuguucauuucacuuacucuuuuuuuguuaugagguguuauagucauguauauguaguaaaauuuguguuuguauggcccagauaugagaagaaaaaguaaacucaccagaccaguuuuugacuccuagucuggaguaaggacaagaugauuguaugagccaagcacuuaggcugugauaaaauagcacagaaaauaguuaugauuaauucgguuccaucuuggccuucguggaaaauaaacccagaauuccgauaauguuggaaggaaguuugcuuaucaugguaaaccugaccuugaucagacagcagauguuuauugcccugugugcaaggcacauggcaaguucaauaaguagacugaggcucugauuuucauauguu

SEQ ID NO: 20423 - RNA, 1266 nt, Homo sapiens
cagccuccgccucggugcggggccucucgcucgcaggauuagcgcagugggaggaggcagaggugaucagguccugcccggccugggacuuuuugucuugagguggggaggggagaaaugggaagagguggaguagcgguuuuagcccgcucugcggcugcgagguuuagauccgagauuaaccucucccgcgauaggugaagcccuaccggagcagaaagcuguuccaccugcaccaagaaugcgcgcuggagacgguugccccggaggcccuggcccgagagaaaaccaguccccgcugcccgcgccucccgguagcgcgcucccugcgccucucccgccggacacucagcagacgccggaggccgggaggcuaagacugggcgcgucgcaggccgggaccgcggcagaggcugcugugccgaccgaggagagggcucugccgcccccacuugcccugggugucgagagcccacuccagacgcggcucuucugaggcucaauucaagccacccaggccugaauccagggugcucucucuaagucgguguccaacccaggggccuguaaauguuggaaccuaggauguaggaugggagcggugaagggaugguccucuugcccagcccagauuaagacugggguucaucuggaggacucuacuuacacccucccgguccccucgcccucccccacacacagcugccucuccccaggauaugcgcggcacagugaauuuaguggcuuugaaagguauaguauuuguggcauccuuauauggauaaugcccaaugaugccugcacccuguaacaguuuaggaaggccugaagucgcacacuggguccuggcugcuguaacuggagacccccagaagauccccugcaagcagccaccagccugcugucaagccaauaauaaaagcucagcacaaacagguacccugggaauguaucuuguugaaagggauuuuccuuauuuguaaccguuuguaaaggggcccagacaguaggguagagagaccugggcaaguuauucaacuucuuuccaaauacaagaugggacuuguaguguccaccacacaggguuguaauggugaugauggacaugcugaacugcugugauacaugaagaugaaacagaaaaacugugggaacuaugagcugaucuaaagccauaguccuguaaguauguaugugguguacuuuaaggucucaccugcaaaaggucucuuagcagauucaugaaugagagccuuggucacacac

SEQ ID NO: 20424 - RNA, 1266 nt, Homo sapiens
gugugugaccaaggcucucauucaugaaucugcuaagagaccuuuugcaggugagaccuuaaaguacaccacauacauacuuacaggacuauggcuuuagaucagcucauaguucccacaguuuuucuguuucaucuucauguaucacagcaguucagcauguccaucaucaccauuacaacccugugugguggacacuacaagucccaucuuguauuuggaaagaaguugaauaacuugcccaggucucucuacccuacugucugggccccuuuacaaacgguuacaaauaaggaaaaucccuuucaacaagauacauucccaggguaccuguuugugcugagcuuuuauuauuggcuugacagcaggcugguggcugcuugcaggggaucuucugggggucuccaguuacagcagccaggacccagugugcgacuucaggccuuccuaaacuguuacagggugcaggcaucauugggcauuauccauauaaggaugccacaaauacuauaccuuucaaagccacuaaauucacugugccgcgcauauccuggggagaggcagcugugugugggggagggcgaggggaccgggaggguguaaguagaguccuccagaugaaccccagucuuaaucugggcugggcaagaggaccaucccuucaccgcucccauccuacauccuagguuccaacauuuacaggccccuggguuggacaccgacuuagagagagcacccuggauucaggccuggguggcuugaauugagccucagaagagccgcgucuggagugggcucucgacacccagggcaagugggggcggcagagcccucuccucggucggcacagcagccucugccgcggucccggccugcgacgcgcccagucuuagccucccggccuccggcgucugcugaguguccggcgggagaggcgcagggagcgcgcuaccgggaggcgcgggcagcggggacugguuuucucucgggccagggccuccggggcaaccgucuccagcgcgcauucuuggugcagguggaacagcuuucugcuccgguagggcuucaccuaucgcgggagagguuaaucucggaucuaaaccucgcagccgcagagcgggcuaaaaccgcuacuccaccucuucccauuucuccccuccccaccucaagacaaaaagucccaggccgggcaggaccugaucaccucugccuccucccacugcgcuaauccugcgagcgagaggccccgcaccgaggcggaggcug

SEQ ID NO: 20425 - RNA, 741 nt, Homo sapiens
ggagcuccggcccgacagcccggcucaugugcugcuggccgcgcugcugcacgagacccgcgcggggcccacugccguguacuuccugcgaggugagcaagccggccgcccuuggcccgccccacccgacuccagcccggcuuucccugcugaucgugcucuuccccuccuugcaggaggcuucgacggcuuccagggcugcugucccgaucugugcucugaggcccccgccccugcgcugccgccaacaggggacaaaaccagccgcuccgacuccagggcuccugucuacgaccaggugaguauugaccccccucccccgaaccucccucucuccccgccgcggacugggcgccucuagggaaagagccugccauuuggggaugcgagcaguuugcccauauacacacacuuuuauacguguguguguugggggaggggguggggcauggcugcucgcgcgugccuguaugggucuguguauguuugcauguguauguugggagcaugaagggaaauguaugucccgguguguccuccgcacauuccugagaccugucucaggucaggaggacuggcugaggaguccucuugucucggccagcccauggggucuccacccgcugcugcuccagcucuccggggcugggcuggaaaggccucaccgccccucuguucccuccaggguggcccuguggagaucuugcccuaccuguuccugggcagcugcagucacucguc

SEQ ID NO: 20426 - RNA, 741 nt, Homo sapiens
gacgagugacugcagcugcccaggaacagguagggcaagaucuccacagggccacccuggagggaacagaggggcggugaggccuuuccagcccagccccggagagcuggagcagcagcggguggagaccccaugggcuggccgagacaagaggacuccucagccaguccuccugaccugagacaggucucaggaaugugcggaggacacaccgggacauacauuucccuucaugcucccaacauacacaugcaaacauacacagacccauacaggcacgcgcgagcagccaugccccacccccucccccaacacacacacguauaaaaguguguguauaugggcaaacugcucgcauccccaaauggcaggcucuuucccuagaggcgcccaguccgcggcggggagagagggagguucgggggaggggggucaauacucaccuggucguagacaggagcccuggagucggagcggcugguuuuguccccuguuggcggcagcgcaggggcgggggccucagagcacagaucgggacagcagcccuggaagccgucgaagccuccugcaaggaggggaagagcacgaucagcagggaaagccgggcuggagucggguggggcgggccaagggcggccggcuugcucaccucgcaggaaguacacggcagugggccccgcgcgggucucgugcagcagcgcggccagcagcacaugagccgggcugucgggccggagcucc

SEQ ID NO: 20427 - RNA, 923 nt, Homo sapiens
augccuagcauugguccgccgucucacuguacugaauuucaagaaucauggccuacugccagccaggucaggaccgaaggcgcuagucuggggagacuggagcaggucucuagugguucaccuguucggaggcucuuccuguucaguucccucugcgcgccagaggguggcaccccaggcacuccagagguggagaggaggggacgacaggggaggcaaagagagaggagcggagggaaggaccagggaggaaggaccaaggagggagcuuuaauaaauucucagaccuuggucucgaguucccggcuaauuugggggcaaagccgaccgaccccacguccacgcccacccccuuacgggaaaagccgggguuuccacugggcuaggugucagaguugggaaugucuaaaacaaaaaaggcuuccgaggguuauucauggccaacaguuuccacaggagaauccaaagggaaacuaguuuccggggccgcugugugugcgggugcuuggugggcugaaagcugcugucacuagauggcuguaagugugccaacaucugaccugucccauuguguuguguuuugcaguugcuggauuugugcgacucggugaaggaugaugcccggagggugaucucgaccuuuaacauuccacacaccuaccuccacgcaccaaucgccggaaucuccaacccgcgggccgcgugggcuuucuacccugcaccgcugcagccgcggccacgggaagaggcgcgcucccggcggcccaagcugggagccaagcucuaacggguguggcgggaagugugguggcccgccagcagcugccacgacgcucgcuccaccgacgcccagagcuguggccgaggccgggggcuggcacccgcugggccgccacucucggggauuuugguggcaaagcgga

SEQ ID NO: 20428 - RNA, 923 nt, Homo sapiens
uccgcuuugccaccaaaauccccgagaguggcggcccagcgggugccagcccccggccucggccacagcucugggcgucgguggagcgagcgucguggcagcugcuggcgggccaccacacuucccgccacacccguuagagcuuggcucccagcuugggccgccgggagcgcgccucuucccguggccgcggcugcagcggugcaggguagaaagcccacgcggcccgcggguuggagauuccggcgauuggugcguggagguagguguguggaauguuaaaggucgagaucacccuccgggcaucauccuucaccgagucgcacaaauccagcaacugcaaaacacaacacaaugggacaggucagauguuggcacacuuacagccaucuagugacagcagcuuucagcccaccaagcacccgcacacacagcggccccggaaacuaguuucccuuuggauucuccuguggaaacuguuggccaugaauaacccucggaagccuuuuuuguuuuagacauucccaacucugacaccuagcccaguggaaaccccggcuuuucccguaagggggugggcguggacguggggucggucggcuuugcccccaaauuagccgggaacucgagaccaaggucugagaauuuauuaaagcucccuccuugguccuuccucccugguccuucccuccgcuccucucucuuugccuccccugucguccccuccucuccaccucuggagugccuggggugccacccucuggcgcgcagagggaacugaacaggaagagccuccgaacaggugaaccacuagagaccugcuccagucuccccagacuagcgccuucgguccugaccuggcuggcaguaggccaugauucuugaaauucaguacagugagacggcggaccaaugcuaggcau

SEQ ID NO: 20429 - RNA, 1795 nt, Homo sapiens
cugcguucucugcgcuccggcccaguuccgggaggaccucccgacggcgcgggagaaggcuguaagggcucuuggcccccgacgcggccugggucucgggggacgcaugaacccgccaccucuggccggcuuccuuuuagugccccaaauagcagcgcuuagcccguugcuucccccgacucuuguuuuucaaaguguucacagggucgcgagagcgagcgacgcgggggcggcgaggcugcaaggcugcacaggaacagacgacaagaaauagggcuuucuucugcgugguucuuuuccggucccugucugagucgcccgaccccgcggggagcgcggagcauugcggcgugcggcgggcuucgggcucucagcccgcgcagcaaguuguguugcuuuuccccgggugcgacgcgggacggccgcgaagagcaaaguucguccgcgguaggaacuucgaggcccgguuaggaccgaucuccggccuccgagucuacuuagccguguccacgcucgugccuuuucccucuugcagcgaaauaacugggcggggcccgacgcgcguccuccagcgacuccgggaacccaaggccuccuucaccucgcucaaaauucacccgaaaaugcgcugagacuuuggcauggggcugcgcugugucccacugacguuacagaagcgcuuaugaauuuaaaaacugcuccaggcggccggacggcgggacaacgccuccucacuugcuccucuacggcaaggccccuuccuucucccugccggcugcggugguguguaggguggucccuuuacagaguuuccuuaauccaucuagccugaccucaccugcgggauguuccauuucccgauccaccucccacacccccgcugcaguugucuagaagcuggggcuggggaacugaggcgcgggaggagcagacaggagggccgggguuggggcgccagccacgcguugggagagcagacccgggugcagacucagaggacuggagaggcggcauggaguuuggucuccugggagguagagugaggugcugcggacuccagggaggaaagggauggguggggaggcgggaggggaggagggacgggguauuuugcgcucccgcaccgcggcccgaacucagcuguucugccuucacuggccucagccagucgagggagcuccuacgagguuaucugcgagcccagcaaaucuuggggguccuagccaaaugcagugcgcaacguucucucucacuuggaggccgccauucaccucguuuuuuuuuuuccuaaaaggauuuuuuuuucugagugcuuuuuucauuucccuauuuuaccugcuuugcacaugccucccgcccucacccgggaggcggcgaagacgcccacugggaccgcgccuggccguuuucugggcgcguccugcccccacggccucugucucuuagggcgacugggcgcggaagaaaagcuggagagccccugcgggguggcaggaggagggugccugagucccgcgagaggcccgggcgaggaagaugcgcagccugcugauccgcgucccgcccggcgccagggacccucagagggaggagagcucaaagaccucgccccgcgccuucgcgaggaccaacccaguccccgcgccugccccagagcggcuuagaaacucagggcacagugagagcgcagggcgccucccgaggcuucacaccgccggccgggccagcggaggcugugaccggagcgcccccucugugccgcgcacgccgcggccgccgccggguugggguaggu

SEQ ID NO: 20430 - RNA, 1795 nt, Homo sapiens
accuaccccaacccggcggcggccgcggcgugcgcggcacagagggggcgcuccggucacagccuccgcuggcccggccggcggugugaagccucgggaggcgcccugcgcucucacugugcccugaguuucuaagccgcucuggggcaggcgcggggacuggguugguccucgcgaaggcgcggggcgaggucuuugagcucuccucccucugagggucccuggcgccgggcgggacgcggaucagcaggcugcgcaucuuccucgcccgggccucucgcgggacucaggcacccuccuccugccaccccgcaggggcucuccagcuuuucuuccgcgcccagucgcccuaagagacagaggccgugggggcaggacgcgcccagaaaacggccaggcgcggucccagugggcgucuucgccgccucccgggugagggcgggaggcaugugcaaagcagguaaaauagggaaaugaaaaaagcacucagaaaaaaaaauccuuuuaggaaaaaaaaaaacgaggugaauggcggccuccaagugagagagaacguugcgcacugcauuuggcuaggacccccaagauuugcugggcucgcagauaaccucguaggagcucccucgacuggcugaggccagugaaggcagaacagcugaguucgggccgcggugcgggagcgcaaaauaccccgucccuccuccccucccgccuccccacccaucccuuuccucccuggaguccgcagcaccucacucuaccucccaggagaccaaacuccaugccgccucuccaguccucugagucugcacccgggucugcucucccaacgcguggcuggcgccccaaccccggcccuccugucugcuccucccgcgccucaguuccccagccccagcuucuagacaacugcagcgggggugugggagguggaucgggaaauggaacaucccgcaggugaggucaggcuagauggauuaaggaaacucuguaaagggaccacccuacacaccaccgcagccggcagggagaaggaaggggccuugccguagaggagcaagugaggaggcguugucccgccguccggccgccuggagcaguuuuuaaauucauaagcgcuucuguaacgucagugggacacagcgcagccccaugccaaagucucagcgcauuuucgggugaauuuugagcgaggugaaggaggccuuggguucccggagucgcuggaggacgcgcgucgggccccgcccaguuauuucgcugcaagagggaaaaggcacgagcguggacacggcuaaguagacucggaggccggagaucgguccuaaccgggccucgaaguuccuaccgcggacgaacuuugcucuucgcggccgucccgcgucgcacccggggaaaagcaacacaacuugcugcgcgggcugagagcccgaagcccgccgcacgccgcaaugcuccgcgcuccccgcggggucgggcgacucagacagggaccggaaaagaaccacgcagaagaaagcccuauuucuugucgucuguuccugugcagccuugcagccucgccgcccccgcgucgcucgcucucgcgacccugugaacacuuugaaaaacaagagucgggggaagcaacgggcuaagcgcugcuauuuggggcacuaaaaggaagccggccagagguggcggguucaugcgucccccgagacccaggccgcgucgggggccaagagcccuuacagccuucucccgcgccgucgggagguccucccggaacugggccggagcgcagagaacgcag

SEQ ID NO: 20431 - RNA, 1440 nt, Homo sapiens
ccacucugugcacccaccucccgggagggggaucuguagggggacacauacacugccgaccacauaugggcagaugcccgcccagauuuucacagacguuuuauuuuuagaggggccagcagcauaagcccaaggcuuggaaaagaagaagggaaggacagaaaaguuagaagccugugaaacgaaccuggcgaggaugaagaaccguuccuuggcacuccacaaaauggugcaugcacaccugccucuuaggagacucaggacuugcuaagucaaccuucuagguucaggugggggucgcccaagucugggugccaggagggcaccgccauaggcucagggagaacaggaggggccggugggagaggggucacucaccgagcggcaggacaaagaagaaagggaaccagcagagcacgaagacacccacgacgauggccagagucuuggccgcuuucuucucacgggagaacuugagcaggcgcacggagagcgagcugcggaagguguggcccuuggcgcugcgcaugccgugcgccccgucggcgcccguggccgcgccgcgacaguggaugcgcagcaccaccucggaggccuugccucgcucgcgcuugacgcccgccucgaggcugcgcguggugcugcgcgcgaccacguacacgcggcaguacaugaccacgaugaccgccaugggcagguagaaggagcacacggaggagaagacagcguagcccgccuccucggugauaccgcagaagcgcucgucagggggcacgggcuccuuccagcccagcaggggcccuacggacaccaccagggcuacgacccagagcagggccaggauggcggccgccuugcgcucggucaugauggcuggguacuugagugaguggcgcacgcccacguaccgguccacggagauggugcagaggcugaggauggaggccgugcagcacagcacguccacggcggcccauacgucgcagaaggcgcggccaaaggcccagaagcccagaaccuccaugguggccgagaagggcaguacgguggcgcucagcagcaggucggccacggccagguucacgaugaaauaguuggugacggucugcagguggcgguugcaggccacugagaggaugacaagcagguuaccugccacggccauaaggaugaaggcugccaggaagacgcccacgcccacgcccugcgcgcucaccaccagucccccgacggccgccgugccauucacgucgccgcccgcgcccgcgcuccccggcucccccgcggagcuccgguuguccucgccgcugccugcgcccaccacgccgccgccgccgcccgcgccccccggcacgccgcccaccgccgggcccuccgagggggccgcgccgcccgcgcugcccccgccgccgcccgcgcuggagcccccugcgcugcugu

SEQ ID NO: 20432 - RNA, 1440 nt, Homo sapiens
acagcagcgcagggggcuccagcgcgggcggcggcgggggcagcgcgggcggcgcggcccccucggagggcccggcggugggcggcgugccggggggcgcgggcggcggcggcggcguggugggcgcaggcagcggcgaggacaaccggagcuccgcgggggagccggggagcgcgggcgcgggcggcgacgugaauggcacggcggccgucgggggacugguggugagcgcgcagggcgugggcgugggcgucuuccuggcagccuucauccuuauggccguggcagguaaccugcuugucauccucucaguggccugcaaccgccaccugcagaccgucaccaacuauuucaucgugaaccuggccguggccgaccugcugcugagcgccaccguacugcccuucucggccaccauggagguucugggcuucugggccuuuggccgcgccuucugcgacguaugggccgccguggacgugcugugcugcacggccuccauccucagccucugcaccaucuccguggaccgguacgugggcgugcgccacucacucaaguacccagccaucaugaccgagcgcaaggcggccgccauccuggcccugcucugggucguagcccuggugguguccguagggccccugcugggcuggaaggagcccgugcccccugacgagcgcuucugcgguaucaccgaggaggcgggcuacgcugucuucuccuccgugugcuccuucuaccugcccauggcggucaucguggucauguacugccgcguguacguggucgcgcgcagcaccacgcgcagccucgaggcgggcgucaagcgcgagcgaggcaaggccuccgagguggugcugcgcauccacugucgcggcgcggccacgggcgccgacggggcgcacggcaugcgcagcgccaagggccacaccuuccgcagcucgcucuccgugcgccugcucaaguucucccgugagaagaaagcggccaagacucuggccaucgucgugggugucuucgugcucugcugguucccuuucuucuuuguccugccgcucggugagugaccccucucccaccggccccuccuguucucccugagccuauggcggugcccuccuggcacccagacuugggcgacccccaccugaaccuagaagguugacuuagcaaguccugagucuccuaagaggcaggugugcaugcaccauuuuguggagugccaaggaacgguucuucauccucgccagguucguuucacaggcuucuaacuuuucuguccuucccuucuucuuuuccaagccuugggcuuaugcugcuggccccucuaaaaauaaaacgucugugaaaaucugggcgggcaucugcccauauguggucggcaguguaugugucccccuacagaucccccucccgggaggugggugcacagagugg

SEQ ID NO: 20433 - RNA, 542 nt, Homo sapiens
ccuuuuggaacccccacuuuuacguugugucccuccgccucccccauggcgcaacaggagucagucucuuucuguacaagggagaaaagcuguacgcguuugucucgugguuggaagccuccccuuggcggggagaagcuuuuuuucuugcuaguauucgcuguguucauggucuagaaaugcggucuggucucgccucgccuaccaaucucugcucucuauguauguagcguacggguuguuuugggugaaucuugaggaauaaaugccuuuauauuucacaggcuguaaauugaacuucccacacgauuagcuuuauuauggcuugugaacugcuggagucuggcuuuaccuuuuuguaugugaacaaaucaaauugcuuaaaaaagaguuuucuuuaguauagccacaaaugccuugaacuguugucugggauuguuuuguggggggagggaagggaguguuccgaagaugcuguaguaacugccucaguguuucacguaagacuuuuugguuugaucaucuuuguugagguaggacua

SEQ ID NO: 20434 - RNA, 542 nt, Homo sapiens
uaguccuaccucaacaaagaugaucaaaccaaaaagucuuacgugaaacacugaggcaguuacuacagcaucuucggaacacucccuucccuccccccacaaaacaaucccagacaacaguucaaggcauuuguggcuauacuaaagaaaacucuuuuuuaagcaauuugauuuguucacauacaaaaagguaaagccagacuccagcaguucacaagccauaauaaagcuaaucgugugggaaguucaauuuacagccugugaaauauaaaggcauuuauuccucaagauucacccaaaacaacccguacgcuacauacauagagagcagagauugguaggcgaggcgagaccagaccgcauuucuagaccaugaacacagcgaauacuagcaagaaaaaaagcuucuccccgccaaggggaggcuuccaaccacgagacaaacgcguacagcuuuucucccuuguacagaaagagacugacuccuguugcgccaugggggaggcggagggacacaacguaaaaguggggguuccaaaagg

SEQ ID NO: 20435 - RNA, 843 nt, Homo sapiens
gcaccccaaauacauuccccuaccccagagucuccccaaacucucccaccagcauacugagcuggcgccgaggcccgaaguccccggacgccaccuccggucgcagcaagcaaccugcgggacaacgcgcggggcgccucgggcugccuccagcgaagacugucccgggcccccucuguccggucucccuccagggacccccucccuugucccagggaaacugcaaggcagugccugugcggagugcgggggcggcuggaggcacugaacggggcaauagggaaagaaccgagaccugaaccacacgcggcugagcuuugcaggcaaaaacuuucuuucucuuuguccacuagucuuugacucugccuccacuucagcccccaacuccuacccaucuucuccuccucagcuccccacccccucgccggccgaccucccaccccuccccagccgcgcgcugccaaacauaacucuguuaggauagugcguggcucggccacgaagaggauuuggaggcgccgcaagucaauauuugaucacaaaguuaauauuaucucaaggcuaacagugugucguauaaaaaagagacccauuugauuccaaggagggcggaaaaggcggcugcccagaaaggcugggguuguggggcggggugggggggugccagcgagggaagcgguccugagguuggggaaggagcgagcgccgccgcuccacuucccccuggaaaagacgagcgcuuaccucgggcucugcauaguagcugcuccagucggacggcucgugcccuuccaucuucaccgcucccagcauacuggaagccgagugcauggcaguuuaaaa

SEQ ID NO: 20436 - RNA, 843 nt, Homo sapiens
uuuuaaacugccaugcacucggcuuccaguaugcugggagcggugaagauggaagggcacgagccguccgacuggagcagcuacuaugcagagcccgagguaagcgcucgucuuuuccagggggaaguggagcggcggcgcucgcuccuuccccaaccucaggaccgcuucccucgcuggcacccccccaccccgccccacaaccccagccuuucugggcagccgccuuuuccgcccuccuuggaaucaaaugggucucuuuuuuauacgacacacuguuagccuugagauaauauuaacuuugugaucaaauauugacuugcggcgccuccaaauccucuucguggccgagccacgcacuauccuaacagaguuauguuuggcagcgcgcggcuggggaggggugggaggucggccggcgaggggguggggagcugaggaggagaagauggguaggaguugggggcugaaguggaggcagagucaaagacuaguggacaaagagaaagaaaguuuuugccugcaaagcucagccgcgugugguucaggucucgguucuuucccuauugccccguucagugccuccagccgcccccgcacuccgcacaggcacugccuugcaguuucccugggacaagggagggggucccuggagggagaccggacagagggggcccgggacagucuucgcuggaggcagcccgaggcgccccgcgcguugucccgcagguugcuugcugcgaccggagguggcguccggggacuucgggccucggcgccagcucaguaugcuggugggagaguuuggggagacucugggguaggggaauguauuuggggugc

SEQ ID NO: 20437 - RNA, 1926 nt, Homo sapiens
ggcggcgcccugcuucuugcgcagguggcagaggagcgccaaaagcgccaccaccaggcacaggcucgcgauggagaugccuaugagcaagcccgaaugcacgagccccacggccggaggagucaagguggagccgggcgucgggcugggcgggggcucgccagagccgcugucgccaccguccaccuugccggagucacagucggugccaauguggcgggcaagggccgagucgggcccgcagaugcacucgaagguaccggggagguuguggcacaccccggagcagaagccgccguuuucgcacucgucgauguccgugcagaugaaaccgucguccaggauguagccuucagggcacucacagcuagccuggguguuggggucgcagucggcuggacaggcagucugguugcaaaacaucuggcaccugugcggcucguggggaaugggcgcgaagcccucggcgcagacgcagagguagcuaguuugguucaggggcuggcacugguacucgcaguuggcucugaagcacggguccacgggcuccacacacucgccguccaccaggucguaguuaggguagcaguggcacucgaagccacccuguguguugacacagcgcugcggacacggacugggcuccaguaugcagucauccacguccucgcaccgguguuggucggccgccagccgguagccggucucgcacaugcacgaguaggagcccggcuggucgggguugggaacgcagaagugcucgcagaggucguugcaggacugcgucgcggaugcggugcaggagcgcccgucugccugcagggcggcgccggcugggcacuggcagcggggagccccagggaucgcauugcacgcgugcucgcagccgccguucuccacgcugcagucccaagcgcccggcgccucccuggcccagugccccuggaccgcuccgggcggcgcggugcacauuagcuguaagccgaggggagccaccgcggcggagcugcccaccggcagcgccuggaaguccgcuccgcgggccgcgaacggggugccguaggugaucgagacggcggcagccgcggcgccgggcuccacagccaguggccugcagguggcugggaaguggaacucgcagaggaagccaucggccuucacuucgcacugcugcuccucccagaucggcucgcugggcacaguggccucagcagcggagacagcgacgcacaacgggccgcagaggggagccccauugaggucgagccgugcccaccugcuauagcugguguuguugucucccguaacccacuggaagccgcgcaggggcccgaggcgcuuggggucgccgcagccggguggcagcugcaggccgauccagaggcgccggcggccaacgccgccgucgccguucaguagcaaggaaaugacaucggcagccaccgaggagcgcacugucauuagguggccccgcaguccgucgcagaucugacuggcauugaggaaggucgcggggcccggguagagcgcgaagcagucgugcucgacgcacuggcugccacccggcugcggcucugcgggugcggggaaccccaggccggccagggccagcgcgccaaggaccaggaccccaagcauguuacccaggcgcgccgcgugcaggcgccggggaaagcgcgggcacugcgacagggccgugccggagcagaggggcacaggacgccgauggcgacagccucuccuguccgucccagcccagacacuucuugccgcugcgcgcagccccugcgaggcagccucugacaugcggaucggccagggcucgaguuuauaagugcccggcccucccucccuggacguucgggaaaaggaaggaagugccuggugggaagggcugaugccgcauacucggauugcuggguucuc

SEQ ID NO: 20438 - RNA, 1926 nt, Homo sapiens
gagaacccagcaauccgaguaugcggcaucagcccuucccaccaggcacuuccuuccuuuucccgaacguccagggagggagggccgggcacuuauaaacucgagcccuggccgauccgcaugucagaggcugccucgcaggggcugcgcgcagcggcaagaagugucugggcugggacggacaggagaggcugucgccaucggcguccugugccccucugcuccggcacggcccugucgcagugcccgcgcuuuccccggcgccugcacgcggcgcgccuggguaacaugcuugggguccugguccuuggcgcgcuggcccuggccggccugggguuccccgcacccgcagagccgcagccggguggcagccagugcgucgagcacgacugcuucgcgcucuacccgggccccgcgaccuuccucaaugccagucagaucugcgacggacugcggggccaccuaaugacagugcgcuccucgguggcugccgaugucauuuccuugcuacugaacggcgacggcggcguuggccgccggcgccucuggaucggccugcagcugccacccggcugcggcgaccccaagcgccucgggccccugcgcggcuuccaguggguuacgggagacaacaacaccagcuauagcaggugggcacggcucgaccucaauggggcuccccucugcggcccguugugcgucgcugucuccgcugcugaggccacugugcccagcgagccgaucugggaggagcagcagugcgaagugaaggccgauggcuuccucugcgaguuccacuucccagccaccugcaggccacuggcuguggagcccggcgccgcggcugccgccgucucgaucaccuacggcaccccguucgcggcccgcggagcggacuuccaggcgcugccggugggcagcuccgccgcgguggcuccccucggcuuacagcuaaugugcaccgcgccgcccggagcgguccaggggcacugggccagggaggcgccgggcgcuugggacugcagcguggagaacggcggcugcgagcacgcgugcaaugcgaucccuggggcuccccgcugccagugcccagccggcgccgcccugcaggcagacgggcgcuccugcaccgcauccgcgacgcaguccugcaacgaccucugcgagcacuucugcguucccaaccccgaccagccgggcuccuacucgugcaugugcgagaccggcuaccggcuggcggccgaccaacaccggugcgaggacguggaugacugcauacuggagcccaguccguguccgcagcgcugugucaacacacaggguggcuucgagugccacugcuacccuaacuacgaccugguggacggcgaguguguggagcccguggacccgugcuucagagccaacugcgaguaccagugccagccccugaaccaaacuagcuaccucugcgucugcgccgagggcuucgcgcccauuccccacgagccgcacaggugccagauguuuugcaaccagacugccuguccagccgacugcgaccccaacacccaggcuagcugugagugcccugaaggcuacauccuggacgacgguuucaucugcacggacaucgacgagugcgaaaacggcggcuucugcuccggggugugccacaaccuccccgguaccuucgagugcaucugcgggcccgacucggcccuugcccgccacauuggcaccgacugugacuccggcaagguggacgguggcgacagcggcucuggcgagcccccgcccagcccgacgcccggcuccaccuugacuccuccggccguggggcucgugcauucgggcuugcucauaggcaucuccaucgcgagccugugccuggugguggcgcuuuuggcgcuccucugccaccugcgcaagaagcagggcgccgcc

SEQ ID NO: 20439 - RNA, 894 nt, Homo sapiens
gauggguggccccugggcuaagcacuauuuggaaccaggagccugauguggcugccccucccugcguggggaagaggccagcccggauucucccucaagugcccugccacacccccccauccuucgcugauuccaaacuccuuaucuuggcauuuaaggcuuccgaguccccacucagugacuccuuugagagcaccaugucuuguccuuccucccugccuggcucccggggaaauccaccucuccucguaguuuugcagccccugccuuugguccuguucccuuacucucagagcaguucuuguaccaccuccuccaggaggcucgcugugauguacccaggcccacugagugucgguacucuuccuccuacaacagcucucaaauucagcuagaauucaaguucagccagcaccccaggcagagccuccagcccacuuaacugaggccaguucgcaagccacugcccacgaaacaccagaagcugaggcggggaaagcaggcuccuugaugagccacaagggcugaggagguggcugccuggcauaagccgaccgcuguggacggcugugccacagcacaggcccggagccaggagcccgcucuggcucugcagcccggccacgcuggggcucccaugggguugcuggggccaggcugacugcgagagggcagcggccgcccggaugcgcagcucuaucuccuaccuggccgggccaggggagagaagggaggcccggggcgggggagccccgcgugcucagcgcgcggaccgccuuuccuccucucccuccaccugguccgcucgcccggagucugcacacagcgcagcuggaaaauguuacuucgcuggaaagguuuccgcuggcacugccaggaucccaagccgccgcg

SEQ ID NO: 20440 - RNA, 894 nt, Homo sapiens
cgcggcggcuugggauccuggcagugccagcggaaaccuuuccagcgaaguaacauuuuccagcugcgcugugugcagacuccgggcgagcggaccagguggagggagaggaggaaaggcgguccgcgcgcugagcacgcggggcucccccgccccgggccucccuucucuccccuggcccggccagguaggagauagagcugcgcauccgggcggccgcugcccucucgcagucagccuggccccagcaaccccaugggagccccagcguggccgggcugcagagccagagcgggcuccuggcuccgggccugugcuguggcacagccguccacagcggucggcuuaugccaggcagccaccuccucagcccuuguggcucaucaaggagccugcuuuccccgccucagcuucugguguuucgugggcaguggcuugcgaacuggccucaguuaagugggcuggaggcucugccuggggugcuggcugaacuugaauucuagcugaauuugagagcuguuguaggaggaagaguaccgacacucagugggccuggguacaucacagcgagccuccuggaggaggugguacaagaacugcucugagaguaagggaacaggaccaaaggcaggggcugcaaaacuacgaggagagguggauuuccccgggagccaggcagggaggaaggacaagacauggugcucucaaaggagucacugaguggggacucggaagccuuaaaugccaagauaaggaguuuggaaucagcgaaggauggggggguguggcagggcacuugagggagaauccgggcuggccucuuccccacgcagggaggggcagccacaucaggcuccugguuccaaauagugcuuagcccaggggccacccauc

SEQ ID NO: 20441 - RNA, 582 nt, Homo sapiens
cccccugcuccuaccacgcuuggagcugcagacagggcuagcugcgggccaggcuggaauucagcuacagcgggagacuggggagaccggggcagccacacuccacagccggaauucauuggaagcuuagaaggcacuucccugaggagagccccaagggguggagcgguccuggcuguggcugcugccugucuggccuggcuuucgagggugcggucuugcgcuguccccuccaggagugaggagagacucugguccugccaagaggaauaagggcucagaaggacagccucaguuuucauggcucuccuugggccucaaccugcuaaccccccaaaucucucccaccuccccuccucuacuugcucccugcaauugcucgggccuacccacccacaccgcucaagacccccagguuaagaagccaccagaccucuaggcucuaaccuggcucacucugcaggaccaaugucaucugccuugacuccuguaaucaaggguaggaaagcccacacagcaacaggccacuucucaugggagaaagggaagaauauggcuuuggccccagaaaggcucagauuc

SEQ ID NO: 20442 - RNA, 582 nt, Homo sapiens
gaaucugagccuuucuggggccaaagccauauucuucccuuucucccaugagaaguggccuguugcugugugggcuuuccuacccuugauuacaggagucaaggcagaugacauugguccugcagagugagccagguuagagccuagaggucugguggcuucuuaaccugggggucuugagcgguguggguggguaggcccgagcaauugcagggagcaaguagaggaggggaggugggagagauuugggggguuagcagguugaggcccaaggagagccaugaaaacugaggcuguccuucugagcccuuauuccucuuggcaggaccagagucucuccucacuccuggaggggacagcgcaagaccgcacccucgaaagccaggccagacaggcagcagccacagccaggaccgcuccaccccuuggggcucuccucagggaagugccuucuaagcuuccaaugaauuccggcuguggaguguggcugccccggucuccccagucucccgcuguagcugaauuccagccuggcccgcagcuagcccugucugcagcuccaagcgugguaggagcaggggg

SEQ ID NO: 20443 - RNA, 1492 nt, Homo sapiens
uacuuuuggucuuagaaacuaaccaacuaaaaaaaaaaaucccuugccaguaagagguaggcuacauuuaaaauaauuucugacugaagaaguccuacguaccgcuugucauauacauauguaaagauaauuuaaaacccuaggguauacccuuuucaaaugcagaguuuauaguuuccaaggggaggagggcaggggaggaguaaccaggaccuuuccugccagucuuccaaucgcgauagcucguuuuggcugugaauuuccccccuuccccucccccucccguuaauuaaauaaacgcuggaagcguguguuuaccgcacacgacucggcccucggggaacucuuuuucuacgucucuccuacucuuaaacuccucaacucacagaggguuggagagcuggcaccaugagcuuccaguuccuacgggugagaaaagaggugucuguguggagggcaggugcgaccccgggggcuagcagagaggagaggcugcgggaggacucgcugcgaagggcgagggguggcgcugggugggacgggcgccuggggccgugcaggguggcuccugggugcugcccgggcugccugucgcccaguacuggcgcaggaagacggguccgcgcagcgucuggcaacaguggccugcuccacgccuggaggcgaccaaguucugaguuaaaggcgccgggcuuagccgggaaguguauggcgacccagaacacggagcggagaaggccucaggggacacgaggcuaccgccuuaguccucgggccugcgcuccgagcgguuagggugcguacggaugggcuccgggauguuaguggagaggugacaggagucuaccaucccacggccaagcgugugaggccuccggcgggcgggggucccccccggggcagggcagggggagagucaggcaugucucuaacgggcucccuaguagaaccgcuaggaaaguggccuucaacccuaggcaccuuuguggcuuucagguaguugggcgacuaaaaauucacuuuugccugcugugaaaugggacaggugguugucagguuagagacugugcccacgaagucucguuuggcgggccgggacugacguggacccgggcccuccucggaagcuugggaaccugugagccccucagcuccucgccucacuuugccuguuugaaaaaaggaguuguuugagaggaagaguuaaggcucaaaagguucuaaacgaagagcaugcggccugacgcggagcgcaaagaagcgagcagugaacugaaucuggugggacugagaccagaggcgucuguaugcggcggccgcuucgcgcccuauuaaagcaaucuguuauuuacgauaaucauuuuuguaauuauuuuggaguggcugugacuugaugucuguggugccccagggcaugcccuuacuggacauagauacuucagggugcccuuugacgccagugucgguccagugggugccagugccgcgaagg

SEQ ID NO: 20444 - RNA, 1492 nt, Homo sapiens
ccuucgcggcacuggcacccacuggaccgacacuggcgucaaagggcacccugaaguaucuauguccaguaagggcaugcccuggggcaccacagacaucaagucacagccacuccaaaauaauuacaaaaaugauuaucguaaauaacagauugcuuuaauagggcgcgaagcggccgccgcauacagacgccucuggucucagucccaccagauucaguucacugcucgcuucuuugcgcuccgcgucaggccgcaugcucuucguuuagaaccuuuugagccuuaacucuuccucucaaacaacuccuuuuuucaaacaggcaaagugaggcgaggagcugaggggcucacagguucccaagcuuccgaggagggcccggguccacgucagucccggcccgccaaacgagacuucgugggcacagucucuaaccugacaaccaccugucccauuucacagcaggcaaaagugaauuuuuagucgcccaacuaccugaaagccacaaaggugccuaggguugaaggccacuuuccuagcgguucuacuagggagcccguuagagacaugccugacucucccccugcccugccccgggggggacccccgcccgccggaggccucacacgcuuggccgugggaugguagacuccugucaccucuccacuaacaucccggagcccauccguacgcacccuaaccgcucggagcgcaggcccgaggacuaaggcgguagccucguguccccugaggccuucuccgcuccguguucugggucgccauacacuucccggcuaagcccggcgccuuuaacucagaacuuggucgccuccaggcguggagcaggccacuguugccagacgcugcgcggacccgucuuccugcgccaguacugggcgacaggcagcccgggcagcacccaggagccacccugcacggccccaggcgcccgucccacccagcgccaccccucgcccuucgcagcgaguccucccgcagccucuccucucugcuagcccccggggucgcaccugcccuccacacagacaccucuuuucucacccguaggaacuggaagcucauggugccagcucuccaacccucugugaguugaggaguuuaagaguaggagagacguagaaaaagaguuccccgagggccgagucgugugcgguaaacacacgcuuccagcguuuauuuaauuaacgggagggggaggggaaggggggaaauucacagccaaaacgagcuaucgcgauuggaagacuggcaggaaagguccugguuacuccuccccugcccuccuccccuuggaaacuauaaacucugcauuugaaaaggguauacccuaggguuuuaaauuaucuuuacauauguauaugacaagcgguacguaggacuucuucagucagaaauuauuuuaaauguagccuaccucuuacuggcaagggauuuuuuuuuuuaguugguuaguuucuaagaccaaaagua

SEQ ID NO: 20445 - RNA, 1070 nt, Homo sapiens
ugggaugggggaugagcaccuucuugcccauuccgggccccagcgugcaggagguaaacuugccagcacagacaagacagcuuguucaagcugcaccucaggccgggucagagaauaaaaccgagggcuagaaggcccagaaugucggacagcccagcggcacccgucagggagucccaggcgcccgaaagaggcgccgcaccucuggcgagucuaggacccaucuuccuggaccugugcucuggagugccugcgggccugggucuaauuucugcuucuggcaggugucccccucccccgccgcuaauaccaggagcgcugcuucugcgguaacuuauuuuacccccagaagccuguuuugggaccgaagugucaggguccugugugucuuuuuaugcacuguucuccuuagugcaaagcccugcagauaugcuuggccgaaaagucucagugguuucaacuuccagauuuuguucccgcguccggucggaaaaucaccugggauuuggcugcugucuaaggccgggggaaaguuucccuuggaggacgccuauuauuauuauuuucuuuuaggcccaccugggucuaaauaaaugcuaaaguucaaacgaacccgagaaggaacagcgaggcaguggaugccgccauuccguggaugggagagucaugucuacugcaggugcggacaccguacugauaggcauugauuauugcaaaaucguauucaguaucaaauagaaauagucuuguccucuaauccccacagaauguuuaaauccagcccagggagccaguuggggcgucccaacaaauacgcccucgagaauuagcgauguuccccuuacaaugaaagucaauugcugcauaauaacugggccaaagaauuucguuaguuuaaauuuuaaaaauuaguauugcacuuugcuuucaaguuuggguggcaaguaccgaaggggagagggaagcagcguuuguguggaaggaaguuucguuuucugucuaaacaugugggaccugggugucuaccucuccagucgagagcucucugcaggcucucucccaacuuccug

SEQ ID NO: 20446 - RNA, 1070 nt, Homo sapiens
caggaaguugggagagagccugcagagagcucucgacuggagagguagacacccaggucccacauguuuagacagaaaacgaaacuuccuuccacacaaacgcugcuucccucuccccuucgguacuugccacccaaacuugaaagcaaagugcaauacuaauuuuuaaaauuuaaacuaacgaaauucuuuggcccaguuauuaugcagcaauugacuuucauuguaaggggaacaucgcuaauucucgagggcguauuuguugggacgccccaacuggcucccugggcuggauuuaaacauucuguggggauuagaggacaagacuauuucuauuugauacugaauacgauuuugcaauaaucaaugccuaucaguacgguguccgcaccugcaguagacaugacucucccauccacggaauggcggcauccacugccucgcuguuccuucucggguucguuugaacuuuagcauuuauuuagacccaggugggccuaaaagaaaauaauaauaauaggcguccuccaagggaaacuuucccccggccuuagacagcagccaaaucccaggugauuuuccgaccggacgcgggaacaaaaucuggaaguugaaaccacugagacuuuucggccaagcauaucugcagggcuuugcacuaaggagaacagugcauaaaaagacacacaggacccugacacuucggucccaaaacaggcuucuggggguaaaauaaguuaccgcagaagcagcgcuccugguauuagcggcgggggagggggacaccugccagaagcagaaauuagacccaggcccgcaggcacuccagagcacagguccaggaagauggguccuagacucgccagaggugcggcgccucuuucgggcgccugggacucccugacgggugccgcugggcuguccgacauucugggccuucuagcccucgguuuuauucucugacccggccugaggugcagcuugaacaagcugucuugucugugcuggcaaguuuaccuccugcacgcuggggcccggaaugggcaagaaggugcucaucccccauccca

SEQ ID NO: 20447 - RNA, 615 nt, Homo sapiens
cgagggcguggaagggagggucccgggggcgggggaggugcgcauuucccgcgccgcgcacucuauccgcgccugccgcgcugccaccuccagcagucccugcgucaugggcgggcuccacgagauagcucugcaccgggcguccggcuccuucgccccgggcucuggcuccuucgccccgggcuccggccacggacuuuucuggcccaagacccaggguucggacuuggcgccuccaagcgccucgggcuugggagcagcgccuagaccuucgccgccgggcuuugagaacucguucccccaggucuuucaccagacucuccucccuccccgcacucuuugcuuacaacgaaauccucggggcgcauugcccccggguaccuuccgacccugggcaagccccgccgggcggggugcgguuggucccccggggcccucugcguagcccggcgaugccggccaguucgcaguagcgggguuucgcacuaacggggucuccuguuuuuuuuuuucccuccaggaucgccacgacgggagcagcaaugggaauccgcgggucccccaccucuccuccgccgggcagcaccucuacagccccgcgccaccccucuccca

SEQ ID NO: 20448 - RNA, 615 nt, Homo sapiens
ugggagagggguggcgcggggcuguagaggugcugcccggcggaggagaggugggggacccgcggauucccauugcugcucccgucguggcgauccuggagggaaaaaaaaaaacaggagaccccguuagugcgaaaccccgcuacugcgaacuggccggcaucgccgggcuacgcagagggccccgggggaccaaccgcaccccgcccggcggggcuugcccagggucggaagguacccgggggcaaugcgccccgaggauuucguuguaagcaaagagugcggggagggaggagagucuggugaaagaccugggggaacgaguucucaaagcccggcggcgaaggucuaggcgcugcucccaagcccgaggcgcuuggaggcgccaaguccgaacccugggucuugggccagaaaaguccguggccggagcccggggcgaaggagccagagcccggggcgaaggagccggacgcccggugcagagcuaucucguggagcccgcccaugacgcagggacugcuggagguggcagcgcggcaggcgcggauagagugcgcggcgcgggaaaugcgcaccucccccgcccccgggacccucccuuccacgcccucg

SEQ ID NO: 20449 - RNA, 444 nt, Homo sapiens
gccacaccgcgccgugaagucauagagcgcaaggaagagcugagggaaggggcugcaaggcucggcggggagcgugggcacugggucaguguugggguccagggacccgggggugccaugguccggcucgccgcccgccggccagaucuugucccagaagaaggacaggaaggccagccgccuccugaggaacggcuccaucccccggggucaccacgcugggcccgagggccaugggagcccgcgagcccggaagaggaacuggcagggccggugggacccgguguccagcgcucccugcccuggccguggggugacaggggaccccggcccugcggucacucagagguccccuggauccaggaggcacacgguucccaccggcguccgggcuggcguuggggcuggguggggcgcagggcggacccccugccucaggcacac

SEQ ID NO: 20450 - RNA, 444 nt, Homo sapiens
gugugccugaggcaggggguccgcccugcgccccacccagccccaacgccagcccggacgccggugggaaccgugugccuccuggauccaggggaccucugagugaccgcagggccgggguccccugucaccccacggccagggcagggagcgcuggacaccgggucccaccggcccugccaguuccucuuccgggcucgcgggcucccauggcccucgggcccagcguggugaccccgggggauggagccguuccucaggaggcggcuggccuuccuguccuucuucugggacaagaucuggccggcgggcggcgagccggaccauggcacccccgggucccuggaccccaacacugacccagugcccacgcuccccgccgagccuugcagccccuucccucagcucuuccuugcgcucuaugacuucacggcgcgguguggc

SEQ ID NO: 20451 - RNA, 3222 nt, Homo sapiens
ccucacauugcaaaagucuuugccacagugacgcuucugaucacugaaacuucuuggaagaaaaguuuaagaguuuaauuaaaaauuaaauauauuguauuagguauauuuuuuaaaagggcaaaguaaaaaauauuaauacaaucugguuguagaaaauacacugcaagaaaaggagcaggugcuucaaaaauguaacccuggcaacucugccaacagguccugggcucgggcuuccuggaaaagccccgggacacgugggaacuccaggcacccucgcaggggccccccgagggcagguggcccagaagcccaggaaggguggccugggagguggaacgggcgcaaggccgagcaucacuggcuccuagggggcugugacauggaaccaaacauacacgcguaugagagagcagagcggcagcgacgcggucggaucggucgcgggggcugcgggaggaagcgcugcagggacccgggcggcgccggcggccuagccggagaugcacgcgcuguaauagaccgcgcugcuggcguccgacagcgcggagaucaggcugcucuccucugggcaggacauggcgcgcgggcccaguuuggccagugccacgugguacgggagcccgggggcgucgggccgaguccggcugcaguugagguacuggucgaacucggugagguccacgucggcccacagaucggcggcgggccccagcggcucggcgcucuccagcggcggggccucgggcggcggcgacagcgggccgggguacgggccgggcgugcccagggugccguaguacaggccagcgagcggcgccgcggggggcgcgguccugagcgccuccgccaggggagccccguagcaaccgccggggucccgcgacaacucggugggcgcguagggcgcgcggaagggccgcagcgcgcaguccucgggcgccgcgggcggugggaagaaggcagccucgccgggcuccaggccguccagaggcgagcgcucgggcgugggcagccccaggccgucgaacucggcgcccagcgggggcagcucgcggaaggcgcgagccgagccagacgccgcggggaaaggcucgggcgguggcugcgggggcgcuaaucccgggagcaggaggccgggcuccagccgccgggccuugcgcgccugcuucuugcggcgcggccgguacuuguaguugggguggucgcgcaagugcugcacgcgcagccguucggcuuccuccacgaagggccgcuucuccgccgcguucagcuccuuccacgcuuugccugcgggccgugggcgccagugaguggaacgccgucgggcgggugggcgccgagcccuccgugcgcccgggacgccccgcgaggguuuggcgcagcccccgcaccccgcggcccgggaccccugccccccccgccccaccccggcccgagccccccccgcccucucccccuucucugccgcccucccgccgcucacccagcaucuugcugagcaccgcguugugcagguccggguucugcugagccagccgcuugcgcucguccuuugcccacaccaugaaggcguucaugggccgccggaugcgcgacucgucugccgccuggcguuccccgcggccggccgggcugaggccauagcgccccggcucggggcugcgcgggggacugcgcugcgggcugggcggcgaggcgggcgcggcgggcgcggcgagggcggcggggccggcggcgaggccgcgcgugucagcggcggccccgugucccggggcccaugcacagucgcggcgggcgggcgggucguccugugcgccguagccgggcggcgaucucugcauuccagcugggcgcggccugggcggaacggagcgcgggagcgcggcgggcgggcggcgggcacuggggagccgggcgcaagggcaggccaggccgggagggcggauggcgguggggacggcgguggccucgggccgggcgggcgcccagauauagcggcucagggccaaucggcggcggggcgggcgggcgggggcgggucggggccgccuccuccccgggggcucccuuucuucucaggccgggcgggauuccgcugaggccucccccgcgcacagcccccccaccucccccgcgaccucucagaaggagagaccccccgggugggaaagaaagggcugcugaugagggccggugcugccagacuuucggaggcgagcugccacccacccacggagucggacccccgggcaguaacugggggagggcggcagugucccgcugguugccguuccccgccccccgcugggaggcuccauggggaggagagggcccuuuuucacaccaaguucuggggaggcugccuucccaacagccgguaaguccuuccuggagugcagcgccuucagaaaaggccccgucuuuggggaggcgcucugaguccccaggggcgcccaugcuggaaacucuacacccauguguaaccgucagcaccagggacuuugagugccuuuaugggacaagauggucuucuguccucacucccaaaccaacucuggcacaaggcaaagcugacacagggagggagagagcagaggcccuggacggagcccacaaagagaagggggagcagggacgcagaggcuguggcguccucccugccccccaagggcccuuggggaaggggcugggacccucaguggcuugcuggcuccccugcccagcccaggccaccgcugcagcaagaggcagggccuaccuggguccuucccacuggccccucccuggacccucugaccugggcgggggcggguuccggaggagcguccagcuuccugaauuuucacuguccccuuccuacuccaucaggaggggaucugggcuccagagcugagggucucccucuggagguccuccccucccacugccacgcaugguucuacuggagaaggguuggguguccccagcagcccuccaggcagggucagaaucucgccaccucgcggcacaucuccucauagccuggaggcuccccagcuccccccgccacacuaugccgggagccccauggguagaggccacaggucuugugacccugagccuguguggccagaagcucuugguucucugucccugccagccucgcuaggccacauccagccuguguuaugaauggggugggccccacgugggccuugcagugccccuuagaggcuguuc

SEQ ID NO: 20452 - RNA, 3222 nt, Homo sapiens
gaacagccucuaaggggcacugcaaggcccacguggggcccaccccauucauaacacaggcuggauguggccuagcgaggcuggcagggacagagaaccaagagcuucuggccacacaggcucagggucacaagaccuguggccucuacccauggggcucccggcauaguguggcggggggagcuggggagccuccaggcuaugaggagaugugccgcgagguggcgagauucugacccugccuggagggcugcuggggacacccaacccuucuccaguagaaccaugcguggcagugggaggggaggaccuccagagggagacccucagcucuggagcccagauccccuccugauggaguaggaaggggacagugaaaauucaggaagcuggacgcuccuccggaacccgcccccgcccaggucagaggguccagggaggggccagugggaaggacccagguaggcccugccucuugcugcagcgguggccugggcugggcaggggagccagcaagccacugagggucccagccccuuccccaagggcccuuggggggcagggaggacgccacagccucugcgucccugcucccccuucucuuugugggcuccguccagggccucugcucucucccucccugugucagcuuugccuugugccagaguugguuugggagugaggacagaagaccaucuugucccauaaaggcacucaaagucccuggugcugacgguuacacauggguguagaguuuccagcaugggcgccccuggggacucagagcgccuccccaaagacggggccuuuucugaaggcgcugcacuccaggaaggacuuaccggcuguugggaaggcagccuccccagaacuuggugugaaaaagggcccucuccuccccauggagccucccagcggggggcggggaacggcaaccagcgggacacugccgcccucccccaguuacugcccggggguccgacuccguggguggguggcagcucgccuccgaaagucuggcagcaccggcccucaucagcagcccuuucuuucccacccggggggucucuccuucugagaggucgcgggggaggugggggggcugugcgcgggggaggccucagcggaaucccgcccggccugagaagaaagggagcccccggggaggaggcggccccgacccgcccccgcccgcccgccccgccgccgauuggcccugagccgcuauaucugggcgcccgcccggcccgaggccaccgccguccccaccgccauccgcccucccggccuggccugcccuugcgcccggcuccccagugcccgccgcccgcccgccgcgcucccgcgcuccguuccgcccaggccgcgcccagcuggaaugcagagaucgccgcccggcuacggcgcacaggacgacccgcccgcccgccgcgacugugcaugggccccgggacacggggccgccgcugacacgcgcggccucgccgccggccccgccgcccucgccgcgcccgccgcgcccgccucgccgcccagcccgcagcgcagucccccgcgcagccccgagccggggcgcuauggccucagcccggccggccgcggggaacgccaggcggcagacgagucgcgcauccggcggcccaugaacgccuucauggugugggcaaaggacgagcgcaagcggcuggcucagcagaacccggaccugcacaacgcggugcucagcaagaugcugggugagcggcgggagggcggcagagaagggggagagggcggggggggcucgggccgggguggggcggggggggcaggggucccgggccgcggggugcgggggcugcgccaaacccucgcggggcgucccgggcgcacggagggcucggcgcccacccgcccgacggcguuccacucacuggcgcccacggcccgcaggcaaagcguggaaggagcugaacgcggcggagaagcggcccuucguggaggaagccgaacggcugcgcgugcagcacuugcgcgaccaccccaacuacaaguaccggccgcgccgcaagaagcaggcgcgcaaggcccggcggcuggagcccggccuccugcucccgggauuagcgcccccgcagccaccgcccgagccuuuccccgcggcgucuggcucggcucgcgccuuccgcgagcugcccccgcugggcgccgaguucgacggccuggggcugcccacgcccgagcgcucgccucuggacggccuggagcccggcgaggcugccuucuucccaccgcccgcggcgcccgaggacugcgcgcugcggcccuuccgcgcgcccuacgcgcccaccgaguugucgcgggaccccggcgguugcuacggggcuccccuggcggaggcgcucaggaccgcgccccccgcggcgccgcucgcuggccuguacuacggcacccugggcacgcccggcccguaccccggcccgcugucgccgccgcccgaggccccgccgcuggagagcgccgagccgcuggggcccgccgccgaucugugggccgacguggaccucaccgaguucgaccaguaccucaacugcagccggacucggcccgacgcccccgggcucccguaccacguggcacuggccaaacugggcccgcgcgccauguccugcccagaggagagcagccugaucuccgcgcugucggacgccagcagcgcggucuauuacagcgcgugcaucuccggcuaggccgccggcgccgcccgggucccugcagcgcuuccucccgcagcccccgcgaccgauccgaccgcgucgcugccgcucugcucucucauacgcguguauguuugguuccaugucacagcccccuaggagccagugaugcucggccuugcgcccguuccaccucccaggccacccuuccugggcuucugggccaccugcccucggggggccccugcgagggugccuggaguucccacgugucccggggcuuuuccaggaagcccgagcccaggaccuguuggcagaguugccaggguuacauuuuugaagcaccugcuccuuuucuugcaguguauuuucuacaaccagauuguauuaauauuuuuuacuuugcccuuuuaaaaaauauaccuaauacaauauauuuaauuuuuaauuaaacucuuaaacuuuucuuccaagaaguuucagugaucagaagcgucacuguggcaaagacuuuugcaaugugagg

SEQ ID NO: 20453 - RNA, 2314 nt, Homo sapiens
uuucccaaagcaaaguuuucagcgacuauuaagcagccaccuccuccgggaagacuagggggauuuucuugaauuacaaaaggaagaggcuuuuggcuccuaccgaguaaaaugaaguugugcaaaaguuuguuccagaagcuuggauggccagggagaggagggagguggcaggaggucguggagauggggucgggaagggccacgagaugcgcucaaguguuuguugccuaagggcgaaagacaaagguccugcgaagauccugggucuagcugagcuggcagggccuuugccgcccucagugucgccccugcucugccaucccggcucugccgcucacagccccgcauggcaccccccaccagucccugacaugaucgauccuucgcccuucaaauguccacuucgggccggcaagaauccuggcgccccgcagaagguggcagcccacaaaaagggcaagcuggcuggagaacuaagucagacauugugagauguguccccauccugcccagagccacgaccgggccagccuccgcccucccgaaagugacccaaggacuuugauaaguuagugucaugcauacacgacccaccuauguuuagagagaaccuuuguuuaugaucccagugaaaacaaagcugcuaauugaaaaacaauaacacuagcgugucuuuagcuuucuaaagggagagguuaacagcugcgaacgccgggggagggacggugggaggggugcggugagcgaggggcugcccugcauguaaacagccucggggucccagacgagacaagugggaccgcucaagccugcagaacccccggucucggucccaggcacaagagccucccguagccccgccugaucuuucucagucuuuagguuccaggacauccaaaggagcguagguaaccgacgucuacguaguauuucuguccccggaagacuggaucucagggaauuauuauggaagauacugcugagccccuuucauccuuuccaggugaaaauacagacauuuuugugucgcccucacccuuccuuuaugaaauaaggugcccaacuguucugauauuaccauucaaaaacagguucuguggcgaaccucauuugugaaucuauuacagagauuaauagauuauuucuccuuuuucaacuaauucucaguggggaaauuuaaccauaugguaaggagagaauuagaauuucaucacauuagagcaaaauguaaugaaaagaguccaacaccuggggccaacuccgaaagccacaauuaaaagguuuuuaaugaaaccagagaaaccaaaaauugcauagucuucaguacuucugccauauaagaaagaguuauuggaagguguugggaaauauuguuuuuacuuaugucauaaggaugaaaaccagcugcuaaauaccauguguacccagagaccgaacucaggagugagaugaccgcguguaccagugcccauccggagaggagcacuuguuuuuacauucucccuucccgaacccuccaagaacaaccgaggcugauccagauguccuuaaauggcuuccggguaaauaaauaugcauaaaugccucacuucgugugggagcggauuugacuccuggugaaguugacucuuuugaagcaaucagauuuucaucuuaaggaaaguuugagaaaccgguuuguuuguuuguuuucuuccuguuuaggaaauuguguacuucacaauuaccaucacuguaacaguuauuuggagaccacugcaaaaucacugccaccccaccuuaaaaaaaaaugggcugcaugaucacuugcucuucauuuugcuuuuuucuuucuuuuuuuccaaucuggguaggaaaugggcaguggcggguguggaaacgaggcagaguguucggggggacgacugcuuugcucucugaccagcugaaaaccuagagugaauuuugggcaagccagcugggacaccaccuucucucggaaagucccauccccaaauccagaccagucauccuacgaacagggguggaguauaauucucgcccggaaggguaauuuagcacaagcugagacagcaguggcgagggaagggcagugggggguggggugcggugggugggggcgucugcuuuccacaggacucccaggcuucgccgccgaucuacaauuugcugaaggagcaaagaacauccucggcucuaaguagggcuuuuagugugcucauugaugagugaaagucgccacacaugucaagcuaaaggcaguuguuggguuacuaacaggacccagcgccuugcaaacauaugcgcuaag

SEQ ID NO: 20454 - RNA, 2314 nt, Homo sapiens
cuuagcgcauauguuugcaaggcgcuggguccuguuaguaacccaacaacugccuuuagcuugacauguguggcgacuuucacucaucaaugagcacacuaaaagcccuacuuagagccgaggauguucuuugcuccuucagcaaauuguagaucggcggcgaagccugggaguccuguggaaagcagacgcccccacccaccgcaccccaccccccacugcccuucccucgccacugcugucucagcuugugcuaaauuacccuuccgggcgagaauuauacuccaccccuguucguaggaugacuggucuggauuuggggaugggacuuuccgagagaagguggugucccagcuggcuugcccaaaauucacucuagguuuucagcuggucagagagcaaagcagucguccccccgaacacucugccucguuuccacacccgccacugcccauuuccuacccagauuggaaaaaaagaaagaaaaaagcaaaaugaagagcaagugaucaugcagcccauuuuuuuuuaaggugggguggcagugauuuugcaguggucuccaaauaacuguuacagugaugguaauugugaaguacacaauuuccuaaacaggaagaaaacaaacaaacaaaccgguuucucaaacuuuccuuaagaugaaaaucugauugcuucaaaagagucaacuucaccaggagucaaauccgcucccacacgaagugaggcauuuaugcauauuuauuuacccggaagccauuuaaggacaucuggaucagccucgguuguucuuggaggguucgggaagggagaauguaaaaacaagugcuccucuccggaugggcacugguacacgcggucaucucacuccugaguucggucucuggguacacaugguauuuagcagcugguuuucauccuuaugacauaaguaaaaacaauauuucccaacaccuuccaauaacucuuucuuauauggcagaaguacugaagacuaugcaauuuuugguuucucugguuucauuaaaaaccuuuuaauuguggcuuucggaguuggccccagguguuggacucuuuucauuacauuuugcucuaaugugaugaaauucuaauucucuccuuaccauaugguuaaauuuccccacugagaauuaguugaaaaaggagaaauaaucuauuaaucucuguaauagauucacaaaugagguucgccacagaaccuguuuuugaaugguaauaucagaacaguugggcaccuuauuucauaaaggaagggugagggcgacacaaaaaugucuguauuuucaccuggaaaggaugaaaggggcucagcaguaucuuccauaauaauucccugagauccagucuuccggggacagaaauacuacguagacgucgguuaccuacgcuccuuuggauguccuggaaccuaaagacugagaaagaucaggcggggcuacgggaggcucuugugccugggaccgagaccggggguucugcaggcuugagcggucccacuugucucgucugggaccccgaggcuguuuacaugcagggcagccccucgcucaccgcaccccucccaccgucccucccccggcguucgcagcuguuaaccucucccuuuagaaagcuaaagacacgcuaguguuauuguuuuucaauuagcagcuuuguuuucacugggaucauaaacaaagguucucucuaaacauaggugggucguguaugcaugacacuaacuuaucaaaguccuugggucacuuucgggagggcggaggcuggcccggucguggcucugggcaggauggggacacaucucacaaugucugacuuaguucuccagccagcuugcccuuuuugugggcugccaccuucugcggggcgccaggauucuugccggcccgaaguggacauuugaagggcgaaggaucgaucaugucagggacugguggggggugccaugcggggcugugagcggcagagccgggauggcagagcaggggcgacacugagggcggcaaaggcccugccagcucagcuagacccaggaucuucgcaggaccuuugucuuucgcccuuaggcaacaaacacuugagcgcaucucguggcccuucccgaccccaucuccacgaccuccugccaccucccuccucucccuggccauccaagcuucuggaacaaacuuuugcacaacuucauuuuacucgguaggagccaaaagccucuuccuuuuguaauucaagaaaaucccccuagucuucccggaggagguggcugcuuaauagucgcugaaaacuuugcuuugggaaa

SEQ ID NO: 20455 - RNA, 273 nt, Homo sapiens
cccgaaaaacacaagaccgacccaaaaucuagaggaaagcgaaaagcugcuccccacccccuuuauuuugguccucucguaguugugaaacacuugcagagcaaacaaagcagaggcaagaacugaggagaaguaucagagacaaacgggacuuuuagccuugacauccccagaaucucggucuuugggguggggagggagggaggagggagguggaguugggauggaguauggaugucuuuuuuuucucagaaaaguggcaacuuugguggc

SEQ ID NO: 20456 - RNA, 273 nt, Homo sapiens
gccaccaaaguugccacuuuucugagaaaaaaaagacauccauacuccaucccaacuccaccucccuccucccucccuccccaccccaaagaccgagauucuggggaugucaaggcuaaaagucccguuugucucugauacuucuccucaguucuugccucugcuuuguuugcucugcaaguguuucacaacuacgagaggaccaaaauaaaggggguggggagcagcuuuucgcuuuccucuagauuuugggucggucuuguguuuuucggg

SEQ ID NO: 20457 - RNA, 2610 nt, Homo sapiens
aaguccaccaaagugcaaagacugcaucugcuggggcagagggauguacgaaauauuuuuuaaauauccuaacuuaaacagggguagaacaucucacacacucagcaauaauuuucagauucaacaaauggagaaaagaaaaaaacauaaguaaaaaaagagcauacuaccuccauaacguuucaaaaaaucauuuuaacauauaggaacauccagaaugagaaaauuacacagguacuccuccaucuaaagccaacuuccauaugccaguagucugcaugaaagaacaaacuuucaaccugcauuuaagaagaccccaaggauuaacagacguuaauuaucuuacucuaaaugcaaguuagugauuuuguuuuagaaaaccccgucaagaucacuaauugauggaugcccauuaauacaccuguauuugcauuucagcgguaaaagacaagcagguuuucggcacagaagagagccgcuuugccaagucuuuucaaaacgucaauaugcuucaaguaauaccaaagcugagagauuccucuugauuuccaaacugucuagguggccugagugguuuuccgccggcagcagccuccuaccuuuaguuugugugccuauauccaugaguggggauuaauuagccggguuggagcugaaggaggcugucgugacgagcccaguggcgauuggccgcccgccugccuggcccugccuuuauaauuuccacacgagugcaucugggcucuuagacaaaccaacagcagcuucuucugacauauacacacgcacacucaccccggacacacacucagcacacuuuuccuccauuugauuaacagugcugcacacacaaugauuacgggaaagcgcaaauaaauacggaaaggggugcuuauuuugacuacuggaagagcuuugcugggucucagcgcaacuuuuguuuuuuauuccugagaaggugaucucuccaugcgguucucucacacaaggauucuuuaaaagaggaagagagacaagcagaggggggaggacagucuuucacuuuaagaacggcugggcucaaagauaaaaggaagggaaaagcagcagcagcagcagcagcagcagcagcagcagcagcagcagcagcagcagcagcagggaaaccaacgcugcagcacuuccgaaaggcauuuuugauccauuucugaguguugcggcccguuucuccaccgaaguuggcuccagcucuagcagccgcauuggaucccacagcuuacugcgagacuccgguguacaauccggaucucugccccaacaugauugcggcccaggccaagcuggucuaccaucugaauaaauacuacaacgaaaaaugccaagccaggaaagcugccauugccaaaacuauccgggaagucugcaaaguaguuuccgacguacugaaggaaguggaagugcaggagccgcgguucaucagcucucucaacgagauggacaaucgcuacgagggccucgaggucaucucccccaccgaauuugaaguggugcuuuaucucaaccaaauggggguguucaacuucguggacgauggcucacugcccggcugcgcggugcugaaguugagcgacgggcgcaagaggagcaugucccucuggguggaauucauuaccgccuccggcuaccucucggcgcgcaaaauccgguccagguuucagacgcugguggcucaagcgguagacaaauguagcuaccgggaugugguaaagaugguggcagacaccagcgaagugaaacugagaauccgagauagguacguggugcagaucacgccggccuuuaaaugcaccgggaucuggccgaggagugcugcccacuggccacuuccccacauccccuggccgggacccaaccggguggcggaggucaaggcggaagguuucaaucucuuguccaaggagugccacuccuuggccggcaagcagagcucggcggagagcgacgccugggugcugcaguucgcggaggcagagaacagacugcagauggggggcugcagaaagaagugccucuccauccucaaaaccuuaagggaucgucaccuugaacugccgggccagcccuugaacaauuaccauaugaagacucugguuuccuacgagugugaaaagcauccccgagagucggacugggacgagucuugccugggugaucggcugaacgggauuuugcugcaacuuaucuccugccugcagugccggcgguguccccacuacuuucuaccgaacuuagaucuguuucaaggcaaaccucacucagcucuggaaaacgcugccaaacaaacguggcgacuggcaagagagauccugaccaacccgaaaaguuuggaaaaacuuuagaggaugauuuaaucaagagccgaaauuauuacccuucucaaaguccuuauuaaguguaaacuucuguucaauuccuaauauuccacuccgcagugcaaacaaucucuuccuuuaaaaaggaauaauaauacaauauuuaaacaucaucucacccacccccacaaggggagaaaaaguaggggaagcggauggagaaaaacccaaagccacuaguauuagaagacuucuuucc

SEQ ID NO: 20458 - RNA, 2610 nt, Homo sapiens
ggaaagaagucuucuaauacuaguggcuuuggguuuuucuccauccgcuuccccuacuuuuucuccccuugugggggugggugagaugauguuuaaauauuguauuauuauuccuuuuuaaaggaagagauuguuugcacugcggaguggaauauuaggaauugaacagaaguuuacacuuaauaaggacuuugagaaggguaauaauuucggcucuugauuaaaucauccucuaaaguuuuuccaaacuuuucggguuggucaggaucucucuugccagucgccacguuuguuuggcagcguuuuccagagcugagugagguuugccuugaaacagaucuaaguucgguagaaaguaguggggacaccgccggcacugcaggcaggagauaaguugcagcaaaaucccguucagccgaucacccaggcaagacucgucccaguccgacucucggggaugcuuuucacacucguaggaaaccagagucuucauaugguaauuguucaagggcuggcccggcaguucaaggugacgaucccuuaagguuuugaggauggagaggcacuucuuucugcagccccccaucugcagucuguucucugccuccgcgaacugcagcacccaggcgucgcucuccgccgagcucugcuugccggccaaggaguggcacuccuuggacaagagauugaaaccuuccgccuugaccuccgccacccgguugggucccggccaggggauguggggaaguggccagugggcagcacuccucggccagaucccggugcauuuaaaggccggcgugaucugcaccacguaccuaucucggauucucaguuucacuucgcuggugucugccaccaucuuuaccacaucccgguagcuacauuugucuaccgcuugagccaccagcgucugaaaccuggaccggauuuugcgcgccgagagguagccggaggcgguaaugaauuccacccagagggacaugcuccucuugcgcccgucgcucaacuucagcaccgcgcagccgggcagugagccaucguccacgaaguugaacacccccauuugguugagauaaagcaccacuucaaauucggugggggagaugaccucgaggcccucguagcgauuguccaucucguugagagagcugaugaaccgcggcuccugcacuuccacuuccuucaguacgucggaaacuacuuugcagacuucccggauaguuuuggcaauggcagcuuuccuggcuuggcauuuuucguuguaguauuuauucagaugguagaccagcuuggccugggccgcaaucauguuggggcagagauccggauuguacaccggagucucgcaguaagcugugggauccaaugcggcugcuagagcuggagccaacuucgguggagaaacgggccgcaacacucagaaauggaucaaaaaugccuuucggaagugcugcagcguugguuucccugcugcugcugcugcugcugcugcugcugcugcugcugcugcugcugcugcugcugcuuuucccuuccuuuuaucuuugagcccagccguucuuaaagugaaagacuguccuccccccucugcuugucucucuuccucuuuuaaagaauccuugugugagagaaccgcauggagagaucaccuucucaggaauaaaaaacaaaaguugcgcugagacccagcaaagcucuuccaguagucaaaauaagcaccccuuuccguauuuauuugcgcuuucccguaaucauugugugugcagcacuguuaaucaaauggaggaaaagugugcugaguguguguccggggugagugugcguguguauaugucagaagaagcugcuguugguuugucuaagagcccagaugcacucguguggaaauuauaaaggcagggccaggcaggcgggcggccaaucgccacugggcucgucacgacagccuccuucagcuccaacccggcuaauuaauccccacucauggauauaggcacacaaacuaaagguaggaggcugcugccggcggaaaaccacucaggccaccuagacaguuuggaaaucaagaggaaucucucagcuuugguauuacuugaagcauauugacguuuugaaaagacuuggcaaagcggcucucuucugugccgaaaaccugcuugucuuuuaccgcugaaaugcaaauacagguguauuaaugggcauccaucaauuagugaucuugacgggguuuucuaaaacaaaaucacuaacuugcauuuagaguaagauaauuaacgucuguuaauccuuggggucuucuuaaaugcagguugaaaguuuguucuuucaugcagacuacuggcauauggaaguuggcuuuagauggaggaguaccuguguaauuuucucauucuggauguuccuauauguuaaaaugauuuuuugaaacguuauggagguaguaugcucuuuuuuuacuuauguuuuuuucuuuucuccauuuguugaaucugaaaauuauugcugagugugugagauguucuaccccuguuuaaguuaggauauuuaaaaaauauuucguacaucccucugccccagcagaugcagucuuugcacuuugguggacuu

SEQ ID NO: 20459 - RNA, 1122 nt, Homo sapiens
ggauggugaaugguauguaguguggacuuuucccacacauccagcaucucuaaagacauccuauuaaauuaaaagaauaagaaauaagaaacuagcagguccagaucuagguuccuuccauucgacugggccaugacuuuaauuaagcugcugggucauggcuuaauuuucccuugaaaaacagcacaguuugagaaaucucugccaaacucuucauuuuuuaagcaacugacaaagucaacaagaaagcaaauaccuagaauccacggaacaaugcuccucagagcagggcuggcagaagcggcggagggcuaccaguuucccugccccgauugcagcugggccuuugacaagagcucggguaaaggacuaucugugcacccgcccaccaaacgcccagcgggacgaugggcuggugcuacgaaguucuaaaccuaaccgcugggaggaagaagcgggaggaugagaaugucaucuccccugacacucuggugccggcaguccugaaacgcucaccucugacgucccugaaggucagagguggcaaccacagugccaauagcucaccaaagccacuuuuccugcccggguggaggcgcggggcaaaguuggccaccggcugcgcgcgucccguuagccguaccuuguaacugggcggagagggacuccuggugcugcugguacuugagcgccaccgccucggcuuuccgcagcugcgucugcagcucguaguagagcaucgcgccguagagaaagccgaacacgacggucagcagcagcagcgucuggaaaauccgcuucugcuuucgggagcacaucccguuucccauagucccgccuggacccaaagccgcggccgcccccgccgucuccuccccuugguccgagcgagcgucucagcagcggccgccgcaguagguggccagacgcagcaugaggaggagaugccagacacaaaagccggcccggaggggaaguggcgcccgcucagcccccgcgcggcgcggggcgcgcagccaucgacgccgcccgggcagcugcagccaaacuucugcgaggcucguucuccgcgaaugcccggggccgggaggaggcccuccgcauacuucagagccggcugcc

SEQ ID NO: 20460 - RNA, 1122 nt, Homo sapiens
ggcagccggcucugaaguaugcggagggccuccucccggccccgggcauucgcggagaacgagccucgcagaaguuuggcugcagcugcccgggcggcgucgauggcugcgcgccccgcgccgcgcgggggcugagcgggcgccacuuccccuccgggccggcuuuugugucuggcaucuccuccucaugcugcgucuggccaccuacugcggcggccgcugcugagacgcucgcucggaccaaggggaggagacggcgggggcggccgcggcuuuggguccaggcgggacuaugggaaacgggaugugcucccgaaagcagaagcggauuuuccagacgcugcugcugcugaccgucguguucggcuuucucuacggcgcgaugcucuacuacgagcugcagacgcagcugcggaaagccgaggcgguggcgcucaaguaccagcagcaccaggagucccucuccgcccaguuacaagguacggcuaacgggacgcgcgcagccgguggccaacuuugccccgcgccuccacccgggcaggaaaaguggcuuuggugagcuauuggcacugugguugccaccucugaccuucagggacgucagaggugagcguuucaggacugccggcaccagagugucaggggagaugacauucucauccucccgcuucuuccucccagcgguuagguuuagaacuucguagcaccagcccaucgucccgcugggcguuuggugggcgggugcacagauaguccuuuacccgagcucuugucaaaggcccagcugcaaucggggcagggaaacugguagcccuccgccgcuucugccagcccugcucugaggagcauuguuccguggauucuagguauuugcuuucuuguugacuuugucaguugcuuaaaaaaugaagaguuuggcagagauuucucaaacugugcuguuuuucaagggaaaauuaagccaugacccagcagcuuaauuaaagucauggcccagucgaauggaaggaaccuagaucuggaccugcuaguuucuuauuucuuauucuuuuaauuuaauaggaugucuuuagagaugcuggaugugugggaaaaguccacacuacauaccauucaccaucc

SEQ ID NO: 20461 - RNA, 908 nt, Homo sapiens
guucugccugaccuggucugucaucacaacaagccuguaucaaauuugaggcaccccucccacgccgcccaagucucgcgcauucuccucccgaguuguaccagcuauacuuaagggcaguuuaaaaauaaaacaaacaaacaaaaacaacaaaacuaaaaaaacgaagaacugaacggcgguuuaaaaaaaaauagauacacgauuauuguuaaagaugcuagcacuggagcugcgcagagcguuggaagugguguuugguggaggaguuuguggugagcauucuggccagaggccccucgcucagccucauucugcaccuuccuaccacugggcaggauucuagucacaggaacauuuccuguacagaaaggaaaaccaggaugcacaaguagauaaccuuuuaagggucuuuuuguccuuugucaauuuagauuuuggaaauaaaaccgggacuggcacggaguguguggaaaauugaacauugguuguaacugcucagauacuugaggaagagggcauaaagggaaucucuggaaaucacuuuucuauugcuaucaguuuuuaacuuaggagugguuuugauuagcuggagaaaaucaugcaaaagagauucccaaguuuuuagaaaacggagggagaguuccugugcaaaaaccaucaaagcaaugaaaaccucaugggcucucaauauuuuuucugaaaggaaaacauauacaaugccucugagcugauuuggguccccuggguuggaaaagggagcuuccuaaucccuuucagggcuucagcagccucucccuuucaaucucuaguaguuuuccuacagacaucauuaguuaaagcaaaugcaaaguucuuuagcaaucuuuccuggcagggaccaugaguuugcaaucaucuuauugguu

SEQ ID NO: 20462 - RNA, 908 nt, Homo sapiens
aaccaauaagaugauugcaaacucauggucccugccaggaaagauugcuaaagaacuuugcauuugcuuuaacuaaugaugucuguaggaaaacuacuagagauugaaagggagaggcugcugaagcccugaaagggauuaggaagcucccuuuuccaacccaggggacccaaaucagcucagaggcauuguauauguuuuccuuucagaaaaaauauugagagcccaugagguuuucauugcuuugaugguuuuugcacaggaacucucccuccguuuucuaaaaacuugggaaucucuuuugcaugauuuucuccagcuaaucaaaaccacuccuaaguuaaaaacugauagcaauagaaaagugauuuccagagauucccuuuaugcccucuuccucaaguaucugagcaguuacaaccaauguucaauuuuccacacacuccgugccagucccgguuuuauuuccaaaaucuaaauugacaaaggacaaaaagacccuuaaaagguuaucuacuugugcauccugguuuuccuuucuguacaggaaauguuccugugacuagaauccugcccagugguaggaaggugcagaaugaggcugagcgaggggccucuggccagaaugcucaccacaaacuccuccaccaaacaccacuuccaacgcucugcgcagcuccagugcuagcaucuuuaacaauaaucguguaucuauuuuuuuuuaaaccgccguucaguucuucguuuuuuuaguuuuguuguuuuuguuuguuuguuuuauuuuuaaacugcccuuaaguauagcugguacaacucgggaggagaaugcgcgagacuugggcggcgugggaggggugccucaaauuugauacaggcuuguugugaugacagaccaggucaggcagaac

SEQ ID NO: 20463 - RNA, 560 nt, Homo sapiens
cguaucagccaccagugggcaguggccuaguuuugauuuuugguuucgugaacgggauuacgcugugaaaggcacaccuggagagcccucgaggaggcgauguuccucuuacccuuaggguaaaacagugcuugguagcccgguugcccacuggaaucagccaggagcccuaaaacccaccaaugucugggucgggucuccagagauucugauuucaucggucuggggugaggcuugggcaucggaagacucaccaccguaaaggcacagucuuucugcccagcugcuccucgcaggcugcagcagaggcaaggaaacgguuuggacuuugcagucagauagaccuggguccccauuuagaccuaccaucuacugugucugugacuucgguucagaaucugagucuccauuuccucaucugucagagauaagaaagccuaugcugcccaggguuauuaggaagguucuguggauggcaccuaaacaccugacacacggucugggccacacgugcucaguagacaucagaacguucauggcugcccuccugacuugacaga

SEQ ID NO: 20464 - RNA, 560 nt, Homo sapiens
ucugucaagucaggagggcagccaugaacguucugaugucuacugagcacguguggcccagaccgugugucagguguuuaggugccauccacagaaccuuccuaauaacccugggcagcauaggcuuucuuaucucugacagaugaggaaauggagacucagauucugaaccgaagucacagacacaguagaugguaggucuaaauggggacccaggucuaucugacugcaaaguccaaaccguuuccuugccucugcugcagccugcgaggagcagcugggcagaaagacugugccuuuacgguggugagucuuccgaugcccaagccucaccccagaccgaugaaaucagaaucucuggagacccgacccagacauugguggguuuuagggcuccuggcugauuccagugggcaaccgggcuaccaagcacuguuuuacccuaaggguaagaggaacaucgccuccucgagggcucuccaggugugccuuucacagcguaaucccguucacgaaaccaaaaaucaaaacuaggccacugcccacugguggcugauacg

SEQ ID NO: 20465 - RNA, 2272 nt, Homo sapiens
guagggggcagggaggauucuaaaaagaacagacacgagacauccaguggaucuguaaugccuuuuugccucaucugcccucuugugaagugucuggagucuagggccugcaagaaaucuggggagggggucucuuaguaucuugggacuccgcagcccucuggcucuuggaggggagaaaugggagaugggaaagaauaggaagaagggagggaggcaaaguuuccuaagugacauccucaaaacgguggcugaagacaaaugccuagauaaugcaaacccaugcguuuuguuuguuuuaauugugggaguuaaugggguaaauuuugccucgauuccauuucuaagccucggcugggugcugcugccucaccaaagccuuccugugguaugggugggcuagacuagcgagcugccccuuucuccaccucucagagggcgaccuuaggcgauuggggcccuggcgaagcuauugcgggcccuggaagguuauucguuccuugaacucacccugagggaaacucggaagguagcuucugcccuaaggggcuugagcugaaauagaggggguacagcacguggaggccuaaggagccgcgaccaccgggcauccuugcuccgaaugcccagcgccuuucucaccagucguguaagacgcggcgccucacccucccgccaccccgcgacuucagauuucagugacaguccugcccgaaucgucuccaacccgucgaagcaacagccuggucccgugagcagccagucccuccaggcgccuccggccucuccuaccaagcgccucacccgcccagccugagagccacacuuaccaccaggacgugucuacgcgggccggcagcgucagcagcagcaggagcagaaggcaggcaagaccuaggcgggccgaagcccgggagccgucgggggccgcgggcgacggcacagggaccggggcgcuggcgcgccgaagcgggagcugcgcagcuuccuccgcaccacccggucucagcauagcuccccgaagacucccgccgcgcagcccggaggggcguggacggggcaccuucuggggguacucaggcugcuccuaccucaccccccuggggggccaugguguucgccggcggcuggggaccuaggaucaccugggguccagagcccgggaggaggauccccgagaggggcgcaaguugcgauguccggaagccgacgacggcgugccgaacccggggucuggggcgcgcugccugaggaccgggugcggugucagggggucugcggcgcugaagggagcugcgggccuagugugcggacagccccuucggccgcgggcucucauuggacgggacggggcggggccgaggccggggacacgcgcggcccuuagggcggcuccgcccgcgccaagcccggggcgcuccgcgacgcccuagguguagcagccgccuccgccccucggggcucccgcgcgccaccgcgcugcacccccaccugcucccgcacgcugcgacgggacgccgcggcucccuccugcgccccaagcgcccagucccugccgacaccgcgccaccggguccuagcgcccuucacucagcagccccacuucuaugggugacggccaggcuggcggagcgggaaggggaugcgggcacuucccuccuguccccaaccuacagugacaccggcgcugagcacggaggaugcacucauuuccuccauccuugcgcuucugugaaauggguagagucccugccaccgggaguuggaggucuuaacuaccuuuucaacacugccuacaggagcgccgugggcagucggcuucuagcaggggaugcuuucagcuagagcucaucgccccugcuucuucugagccacugcaccccccacccccaaugcaucacguuuagaccuggcuccugcuugcccggccugcccggcccgggugcuuuucuuuacggaccgggaaucgacugccgacgcuaagggggcaccugcggacuccccgccccuuacuccugggcucagcggagcucagucucuccccgcucccccucugugccucgguccuccacccucucgggcggggcugagaguaugaaagaaucagaaacagcugggagguuuucccgcaccagaggccaggguggggguccugccgagagaguggaagcccuggagcuuuuucccuccuucgucuucucgcccugccuccuccccacugcuccuucacccucccuccgcccgcacagcgccugggggcgugguaaauagg

SEQ ID NO: 20466 - RNA, 2272 nt, Homo sapiens
ccuauuuaccacgcccccaggcgcugugcgggcggagggagggugaaggagcaguggggaggaggcagggcgagaagacgaaggagggaaaaagcuccagggcuuccacucucucggcaggacccccacccuggccucuggugcgggaaaaccucccagcuguuucugauucuuucauacucucagccccgcccgagaggguggaggaccgaggcacagagggggagcggggagagacugagcuccgcugagcccaggaguaaggggcggggaguccgcaggugcccccuuagcgucggcagucgauucccgguccguaaagaaaagcacccgggccgggcaggccgggcaagcaggagccaggucuaaacgugaugcauuggggguggggggugcaguggcucagaagaagcaggggcgaugagcucuagcugaaagcauccccugcuagaagccgacugcccacggcgcuccuguaggcaguguugaaaagguaguuaagaccuccaacucccgguggcagggacucuacccauuucacagaagcgcaaggauggaggaaaugagugcauccuccgugcucagcgccggugucacuguagguuggggacaggagggaagugcccgcauccccuucccgcuccgccagccuggccgucacccauagaaguggggcugcugagugaagggcgcuaggacccgguggcgcggugucggcagggacugggcgcuuggggcgcaggagggagccgcggcgucccgucgcagcgugcgggagcaggugggggugcagcgcgguggcgcgcgggagccccgaggggcggaggcggcugcuacaccuagggcgucgcggagcgccccgggcuuggcgcgggcggagccgcccuaagggccgcgcguguccccggccucggccccgccccgucccguccaaugagagcccgcggccgaaggggcuguccgcacacuaggcccgcagcucccuucagcgccgcagacccccugacaccgcacccgguccucaggcagcgcgccccagaccccggguucggcacgccgucgucggcuuccggacaucgcaacuugcgccccucucggggauccuccucccgggcucuggaccccaggugauccuagguccccagccgccggcgaacaccauggccccccaggggggugagguaggagcagccugaguacccccagaaggugccccguccacgccccuccgggcugcgcggcgggagucuucggggagcuaugcugagaccggguggugcggaggaagcugcgcagcucccgcuucggcgcgccagcgccccggucccugugccgucgcccgcggcccccgacggcucccgggcuucggcccgccuaggucuugccugccuucugcuccugcugcugcugacgcugccggcccgcguagacacguccuggugguaaguguggcucucaggcugggcgggugaggcgcuugguaggagaggccggaggcgccuggagggacuggcugcucacgggaccaggcuguugcuucgacggguuggagacgauucgggcaggacugucacugaaaucugaagucgcgggguggcgggagggugaggcgccgcgucuuacacgacuggugagaaaggcgcugggcauucggagcaaggaugcccgguggucgcggcuccuuaggccuccacgugcuguacccccucuauuucagcucaagccccuuagggcagaagcuaccuuccgaguuucccucagggugaguucaaggaacgaauaaccuuccagggcccgcaauagcuucgccagggccccaaucgccuaaggucgcccucugagagguggagaaaggggcagcucgcuagucuagcccacccauaccacaggaaggcuuuggugaggcagcagcacccagccgaggcuuagaaauggaaucgaggcaaaauuuaccccauuaacucccacaauuaaaacaaacaaaacgcauggguuugcauuaucuaggcauuugucuucagccaccguuuugaggaugucacuuaggaaacuuugccucccucccuucuuccuauucuuucccaucucccauuucuccccuccaagagccagagggcugcggagucccaagauacuaagagacccccuccccagauuucuugcaggcccuagacuccagacacuucacaagagggcagaugaggcaaaaaggcauuacagauccacuggaugucucgugucuguucuuuuuagaauccucccugcccccuac

SEQ ID NO: 20467 - RNA, 1095 nt, Homo sapiens
acugucaccaagccagagacauuagagagugggggacggccaccauccugugcucgcacccguaggguguacuccuuggucgucucauagucaagagggcucaccacauccagagcuccagucugggcauccagauaaaacuguccccgagcauugccacucaugaugcuauagugcaccacggcauugcuccccuugucucgauccgaggcugugacucggaguacuggggccccuggagucacauccucccucaccuggaccacauagcgcuucucacuaaacuggggggcauuaucauugucauccuccacagaaaggaaaacagcggcugugguacuccgaggacccgggucccgacccuggucacuugccucuaccgucagcugguaggauuccaccucuucccgauccacagggccacggguucggaucaccccagagcgagggucgaucucaaagacuucagaggggcugcccccagaccccuccagcaggcgguacagaauauuggcauugggaggggcaucaccauccguggcccugacagugagcaccucauagccaaccuccagguucucccugaggcucuccuuguacuccugcugcucgaacacagggucauggucauuggugucaguaaccaagauggugaguguagccagggcacuucgucggggcaugccgugguccugcgccgugacccugaagacgugggugcucuuggucucacgauccagcuccucggcugugguuacugcaccagugacuggguccagggagaagaacugguuggagcggcuaucaaagagggcauccaugguguacuccagucgaccugccucacccucguccgggucgauggcccucagggaugcaacaggggugccugcuggcugguucuccggcacuguggccugguagcuggggggcuggaacuggggggcuguauuuacauuccuuuuccgacgcccacccagggacucuucuggugaccuuuccccugcccugagcccgggggccugugccagcuugcaggacuggcaucugagccguggagccuuuaagcacgggugcuccucgggcagugugagc

SEQ ID NO: 20468 - RNA, 1095 nt, Homo sapiens
gcucacacugcccgaggagcacccgugcuuaaaggcuccacggcucagaugccaguccugcaagcuggcacaggcccccgggcucagggcaggggaaaggucaccagaagagucccugggugggcgucggaaaaggaauguaaauacagccccccaguuccagccccccagcuaccaggccacagugccggagaaccagccagcaggcaccccuguugcaucccugagggccaucgacccggacgagggugaggcaggucgacuggaguacaccauggaugcccucuuugauagccgcuccaaccaguucuucucccuggacccagucacuggugcaguaaccacagccgaggagcuggaucgugagaccaagagcacccacgucuucagggucacggcgcaggaccacggcaugccccgacgaagugcccuggcuacacucaccaucuugguuacugacaccaaugaccaugacccuguguucgagcagcaggaguacaaggagagccucagggagaaccuggagguuggcuaugaggugcucacugucagggccacggauggugaugccccucccaaugccaauauucuguaccgccugcuggaggggucugggggcagccccucugaagucuuugagaucgacccucgcucuggggugauccgaacccguggcccuguggaucgggaagagguggaauccuaccagcugacgguagaggcaagugaccagggucgggacccggguccucggaguaccacagccgcuguuuuccuuucuguggaggaugacaaugauaaugccccccaguuuagugagaagcgcuaugugguccaggugagggaggaugugacuccaggggccccaguacuccgagucacagccucggaucgagacaaggggagcaaugccguggugcacuauagcaucaugaguggcaaugcucggggacaguuuuaucuggaugcccagacuggagcucuggauguggugagcccucuugacuaugagacgaccaaggaguacacccuacgggugcgagcacaggaugguggccgucccccacucucuaaugucucuggcuuggugacagu

SEQ ID NO: 20469 - RNA, 2361 nt, Homo sapiens
cagccgagcgcgagccaccaaucacaauggacagcggcggcgacaacagccgcagcuugagccucugcggccgcugcggcuucgccagcuccggccgcagcccggagcuccaacaggagcuuuagaaccauuuuauguugauuagauaaagggggaaaagagaggcggggguggugggaggaggaggauggauggcagggccaagggagggggaaaggcggugaagaaagaggaagaaaugaaugaugauaaugcaaugaaaagaauaagccagaggagggaaaagcgggggagaaggggggcaggacugacaggaggaggaggcgguggcgggggaggagggggcccggggcagaucugauuguuuucuuggugguauauaagggguuuuaaggagagucgugugccagacacgcagccacugaaccacaagcagcuucgcguuaacuggagugccugggagucgcgugccaggagccgcacggccagggacugacugacagacagacacgcaccaccaccacaacacacgagacccgggcgggccgccgccgccgccgccggggcucuuggcaaacucgccggucgcagaggucccccgcggagcugcgccacaguagcgccgggcuugcagcuuucacgccgggcgaaggacccggcgcugcgcucgcagcugcgcggagauucccggcacaggccaaagucacagcaacgcugaggcacaguuagagccaacuaaguaaguauucgagccaccgcuuccaacuacgcaggugguuuccccgcacucaguccaaccacacccgcacgcccucugcuccgcgcagaaucuuugucgcggaggccgcagucccuucucggggagggaacgcaggaccgcccgcggagggcaggacccggcugacuggcagcagggucacagcgagcgcuagcggcgcuccugaccuugguuagcacugccuggguuucuuccuucgccuuccugcuccgcgccauucggagcuggucuucucgggugcgcgccggagcacgccccugugacacgaagaucgcgccucuguuucuuuccuuacaccucacugccuuuuuccccuuucucucuucgguaggauguucgucaaauccgagaccuuggaguugaaggaggaagaggacguguuagugcugcucggaucggccucccccgccuuggcggcccugaccccgcugucauccagcgccgacgaagaagaggaggaggagccgggcgcgucaggcggggcgcgucggcagcgcggggcugaggccgggcagggggcgcggggcggcguggcugcgggugcggagggcugccggcccgcacggcugcugggucugguacacgauugcaaacggcgcccuucccgggcgcgggccgucucccgaggcgccaagacggccgagacggugcagcgcaucaagaagacccguagacugaaggccaacaaccgcgagcgaaaccgcaugcacaaccucaacgcggcacuggacgcgcugcgcgaggugcuccccacguuccccgaggacgccaagcucaccaagaucgagacccugcgcuucgcccacaacuacaucugggcacucaccgagacccugcgccuggcggaucacugcgggggcggcggcgggggccugccgggggcgcucuucuccgaggcaguguugcugagcccgggaggagccagcgccgcccugagcagcagcggagacagccccucgcccgccuccacguggaguugcaccaacagccccgcgccguccuccuccguguccuccaauuccaccucccccuacagcugcacuuuaucgcccgccagcccggccgggucagacauggacuauuggcagcccccaccucccgacaagcaccgcuaugcaccucaccuccccauagccagggauuguaucuagagcugccauuucugcuacccacgccaggccuuaguggguucccuuuccuguccccagucgagcccuccucccuuccccugccccuccuuuccacgcccuggaaaccaucucacuucacagggcagguguagccuuucugauuccucgguuguuucuugcauuucuuggcuuuggguauccuucauucagacgggcucugauuuacugaaggugugauggagcuuauugucaaagccaaggguggcguuuugggggcgcuucuugagacgaaaaagacccugggaagagaugaugguggcauaucuaaagaguuugcagagcggacugacgcuccuccccuuucucuuuaacgccgaaggacuuggugcaguucgugugaaucucacagggggaaugcaacugguuccugugaucucuucaccuuugcuucua

SEQ ID NO: 20470 - RNA, 2361 nt, Homo sapiens
uagaagcaaaggugaagagaucacaggaaccaguugcauucccccugugagauucacacgaacugcaccaaguccuucggcguuaaagagaaaggggaggagcgucaguccgcucugcaaacucuuuagauaugccaccaucaucucuucccagggucuuuuucgucucaagaagcgcccccaaaacgccacccuuggcuuugacaauaagcuccaucacaccuucaguaaaucagagcccgucugaaugaaggauacccaaagccaagaaaugcaagaaacaaccgaggaaucagaaaggcuacaccugcccugugaagugagaugguuuccagggcguggaaaggaggggcaggggaagggaggagggcucgacuggggacaggaaagggaacccacuaaggccuggcguggguagcagaaauggcagcucuagauacaaucccuggcuauggggaggugaggugcauagcggugcuugucgggaggugggggcugccaauaguccaugucugacccggccgggcuggcgggcgauaaagugcagcuguagggggagguggaauuggaggacacggaggaggacggcgcggggcuguuggugcaacuccacguggaggcgggcgaggggcugucuccgcugcugcucagggcggcgcuggcuccucccgggcucagcaacacugccucggagaagagcgcccccggcaggcccccgccgccgcccccgcagugauccgccaggcgcagggucucggugagugcccagauguaguugugggcgaagcgcagggucucgaucuuggugagcuuggcguccucggggaacguggggagcaccucgcgcagcgcguccagugccgcguugagguugugcaugcgguuucgcucgcgguuguuggccuucagucuacgggucuucuugaugcgcugcaccgucucggccgucuuggcgccucgggagacggcccgcgcccgggaagggcgccguuugcaaucguguaccagacccagcagccgugcgggccggcagcccuccgcacccgcagccacgccgccccgcgcccccugcccggccucagccccgcgcugccgacgcgccccgccugacgcgcccggcuccuccuccucuucuucgucggcgcuggaugacagcggggucagggccgccaaggcgggggaggccgauccgagcagcacuaacacguccucuuccuccuucaacuccaaggucucggauuugacgaacauccuaccgaagagagaaaggggaaaaaggcagugagguguaaggaaagaaacagaggcgcgaucuucgugucacaggggcgugcuccggcgcgcacccgagaagaccagcuccgaauggcgcggagcaggaaggcgaaggaagaaacccaggcagugcuaaccaaggucaggagcgccgcuagcgcucgcugugacccugcugccagucagccggguccugcccuccgcgggcgguccugcguucccuccccgagaagggacugcggccuccgcgacaaagauucugcgcggagcagagggcgugcgggugugguuggacugagugcggggaaaccaccugcguaguuggaagcgguggcucgaauacuuacuuaguuggcucuaacugugccucagcguugcugugacuuuggccugugccgggaaucuccgcgcagcugcgagcgcagcgccggguccuucgcccggcgugaaagcugcaagcccggcgcuacuguggcgcagcuccgcgggggaccucugcgaccggcgaguuugccaagagccccggcggcggcggcggcggcccgcccgggucucguguguuguggugguggugcgugucugucugucagucagucccuggccgugcggcuccuggcacgcgacucccaggcacuccaguuaacgcgaagcugcuugugguucaguggcugcgugucuggcacacgacucuccuuaaaaccccuuauauaccaccaagaaaacaaucagaucugccccgggcccccuccucccccgccaccgccuccuccuccugucaguccugccccccuucucccccgcuuuucccuccucuggcuuauucuuuucauugcauuaucaucauucauuucuuccucuuucuucaccgccuuucccccucccuuggcccugccauccauccuccuccucccaccacccccgccucucuuuucccccuuuaucuaaucaacauaaaaugguucuaaagcuccuguuggagcuccgggcugcggccggagcuggcgaagccgcagcggccgcagaggcucaagcugcggcuguugucgccgccgcuguccauugugauugguggcucgcgcucggcug

SEQ ID NO: 20471 - RNA, 481 nt, Homo sapiens
accaaacuuucccuaaaaaauuaaauagccacuucauuuguggaauguuuuacuuuaacucagcaaaauuacacuuaaauuauuuaggugcuuuguuccuuaaguuaagcguguuugucuucaaauguuccuaaagcacuuauauuaauugguuguaaagaacgcauacacaugguaaaauacagaacugaacugagcaguauuuuaauuuccuuaaauaauuacuuacuacaaauuaauuuacuggcuaauuucacaauuuaguucauuuaaaacacauguuccugugcuguuuauuuuuaaacuuuccauuaaagauuuuguuaugggguaacaaaguguaugaaaaggggggaaaugugaaaggaucugggauuauucgaacuguauuuuuccugcacuuucagucuugcgguagucaucagaaauuauuuuuuagcaaauuguuuuauuucuuagggcuugccugccugcuuugcca

SEQ ID NO: 20472 - RNA, 481 nt, Homo sapiens
uggcaaagcaggcaggcaagcccuaagaaauaaaacaauuugcuaaaaaauaauuucugaugacuaccgcaagacugaaagugcaggaaaaauacaguucgaauaaucccagauccuuucacauuuccccccuuuucauacacuuuguuaccccauaacaaaaucuuuaauggaaaguuuaaaaauaaacagcacaggaacauguguuuuaaaugaacuaaauugugaaauuagccaguaaauuaauuuguaguaaguaauuauuuaaggaaauuaaaauacugcucaguucaguucuguauuuuaccauguguaugcguucuuuacaaccaauuaauauaagugcuuuaggaacauuugaagacaaacacgcuuaacuuaaggaacaaagcaccuaaauaauuuaaguguaauuuugcugaguuaaaguaaaacauuccacaaaugaaguggcuauuuaauuuuuuagggaaaguuuggu

SEQ ID NO: 20473 - RNA, 2241 nt, Homo sapiens
aaaacaccuucacagaaauaguucugcuaugaucuaaugucaaauuucagacaguuaaauaccccaucccccaacacacaaggguaggagaaaaaacgggagggaaagaugcuuucuuaaguagaaauagcaccagcuaacaccaacaauucucaaggcugccacucacaggauaguuucugaagcuugaaauaaaacagauuccucaaagacccacaccuguuacuggggugaaagccagguuugacugauucaccauaaacugaaaaguauuaaguaagacaugucaaagcagaaaaaauuucugccucauauaaaagguggaugggggaaggagcagaaagguuucucaaaaaucaaguguaacagagcucuuuuugagacauaacuguggcagaaacaaaaaaaacaaaaaaguacuagaaaaaagucuaaauaaaaccaaggagaguuuaaaguguagcugauaucucaaguauccuugugguuugaaacgugcuuagaucaacaauucauaguauuuuccucucuaauguaaauaaugccuaaagaaaguaauuucaggauacagauuuauccaccugauuacacguugacacauuauuugcuaaauuguuuccuuguuuagagucacaccuaaaugacuuuuuuccucuggguaucaacauuuuaauuugcuguuuuagacaucuuuuuaaaguuacaaaaagcuauaugcauucacaucauaugcauaucuugugauggguuucuuguugcaaauaugugugcaagaaaugcauaacauacccaaaugugagcacagaauugcuuuuaaaaauaaaauaaaaaggucuacacucuggcugcuaucacguuuucuuaaagucuccuuaucuuuuucaauuccccuuuucuuuuaccugccuuucuacccccaggcccaaaguacaaaauaaccccgaacuuucuauuuccuccgaccagguagugaacaagcagcugugcuuuuucuuggcgcuccacugguuccccuccguucgccuccggguacaagaaagcgaaucaauuguggaauugauucguuccaagauuaaagguaaaacaggugcggcaucuuucuuuaggacuaggcagggaccuacacggaggggugggggcagaggucgcugaaggaaggcgaccgggcgacggugugcgccagaguaaaaccucuuuucgcagcagccaucugcacccgggacgagccuagucuguaauugcacagaggugagggggaccgagcacacccucccgacagacccagugucucucacacaccggagcggccccggagcgcgggaggaccggcugagugacagcggagacgcggcccgagguuguuggaaccugucacagcacgccgccgucaggcucgcccgagucugaggagcggcgcagugugugcgcucucacacacacauccacacacucaugcucacauucacggagcgcccacccuccgguccucauuuugagucuccuucccucaagaaaaccaaauggagaggcccacaaaucucccccguagcccagucgcugacucgcacccacucucugugugagcggccccgagagcccugagcagagcccgggccuccccccgggggccuggaagcuuccccagugaagagccgucuaguucaggcgcgggaguuucccggguaagggauguuucgcgcgucaccucggcguagguggcuaaaccgcgcccucagagccgagaucccaggcuccagcggcuccucucccucaguccuaauucccgagccggggcgagucgcccucggggggccgcggauggggucccagacucgcaagggcgcgcccucuccgccucgggcgggcacucggagccgcuggaccgcucuccucgcgccacgcugugcgguggcccaacuucuggauggaggagacgccucucugaccacgaaaccccgcggggaaaagugacccaagacagugagugugaaauuagcgcgggaaggaggagagggcgccccggggcccagcucaccucccgucgaacucggcggccgccugcagguagagcgaggauaccagcaccagcgccaggagaaaauccauguugggcagcggguccuggggcgcagcgcaguggcgcgcgaggaacagguugggguggugggcgccgaugggaggcgccccucugagagucucgaggaacccccagcccucgccgcccgggcuacugcugccgcu

SEQ ID NO: 20474 - RNA, 2241 nt, Homo sapiens
agcggcagcaguagcccgggcggcgagggcuggggguuccucgagacucucagaggggcgccucccaucggcgcccaccaccccaaccuguuccucgcgcgccacugcgcugcgccccaggacccgcugcccaacauggauuuucuccuggcgcuggugcugguauccucgcucuaccugcaggcggccgccgaguucgacgggaggugagcugggccccggggcgcccucuccuccuucccgcgcuaauuucacacucacugucuugggucacuuuuccccgcgggguuucguggucagagaggcgucuccuccauccagaaguugggccaccgcacagcguggcgcgaggagagcgguccagcggcuccgagugcccgcccgaggcggagagggcgcgcccuugcgagucugggaccccauccgcggccccccgagggcgacucgccccggcucgggaauuaggacugagggagaggagccgcuggagccugggaucucggcucugagggcgcgguuuagccaccuacgccgaggugacgcgcgaaacaucccuuacccgggaaacucccgcgccugaacuagacggcucuucacuggggaagcuuccaggcccccggggggaggcccgggcucugcucagggcucucggggccgcucacacagagagugggugcgagucagcgacugggcuacgggggagauuugugggccucuccauuugguuuucuugagggaaggagacucaaaaugaggaccggagggugggcgcuccgugaaugugagcaugaguguguggaugugugugugagagcgcacacacugcgccgcuccucagacucgggcgagccugacggcggcgugcugugacagguuccaacaaccucgggccgcgucuccgcugucacucagccgguccucccgcgcuccggggccgcuccggugugugagagacacugggucugucgggagggugugcucggucccccucaccucugugcaauuacagacuaggcucgucccgggugcagauggcugcugcgaaaagagguuuuacucuggcgcacaccgucgcccggucgccuuccuucagcgaccucugcccccaccccuccguguaggucccugccuaguccuaaagaaagaugccgcaccuguuuuaccuuuaaucuuggaacgaaucaauuccacaauugauucgcuuucuuguacccggaggcgaacggaggggaaccaguggagcgccaagaaaaagcacagcugcuuguucacuaccuggucggaggaaauagaaaguucgggguuauuuuguacuuugggccuggggguagaaaggcagguaaaagaaaaggggaauugaaaaagauaaggagacuuuaagaaaacgugauagcagccagaguguagaccuuuuuauuuuauuuuuaaaagcaauucugugcucacauuuggguauguuaugcauuucuugcacacauauuugcaacaagaaacccaucacaagauaugcauaugaugugaaugcauauagcuuuuuguaacuuuaaaaagaugucuaaaacagcaaauuaaaauguugauacccagaggaaaaaagucauuuaggugugacucuaaacaaggaaacaauuuagcaaauaaugugucaacguguaaucagguggauaaaucuguauccugaaauuacuuucuuuaggcauuauuuacauuagagaggaaaauacuaugaauuguugaucuaagcacguuucaaaccacaaggauacuugagauaucagcuacacuuuaaacucuccuugguuuuauuuagacuuuuuucuaguacuuuuuuguuuuuuuuguuucugccacaguuaugucucaaaaagagcucuguuacacuugauuuuugagaaaccuuucugcuccuucccccauccaccuuuuauaugaggcagaaauuuuuucugcuuugacaugucuuacuuaauacuuuucaguuuauggugaaucagucaaaccuggcuuucaccccaguaacaggugugggucuuugaggaaucuguuuuauuucaagcuucagaaacuauccugugaguggcagccuugagaauuguugguguuagcuggugcuauuucuacuuaagaaagcaucuuucccucccguuuuuucuccuacccuuguguguugggggaugggguauuuaacugucugaaauuugacauuagaucauagcagaacuauuucugugaagguguuuu

SEQ ID NO: 20475 - RNA, 1228 nt, Homo sapiens
aacaaauuucaaaagcaaugcaaaggaauugucaggggagcugguaaaagugaagcuaccugagucucgagguuggagauucagacucaguagagcaccagaggugauucgacagcccauggggaaccaugaucagaaugaaaguuauuuuguccucagcuuuuucuuuccccaacccccuguagugcaguguaucuuuggacuguugucacccauuggacacuggccacuucucuuguuccuuucucauagccaaauuaaacuguuguuuuaguuacuauuacaaagggcaguugaaacagaaguugaauuccagcaucacuggcuagugagacaguuugaacucuuuccugucuacgguuauuucgccuuccucuccccguaccccuuuuccaucccuuugcucucuccuauuuacaggugaggguagggaaugagggaccugagguuaagagagcuggggaacauaaaucuaaagaaaggcaccgaaaugucacuaacaaaaaauuacauuauuugugggaaagaugggaagaugacugcguguggaggggcccuuagcugggauauguuaggaguuguggugacagccaucuuccuucugacagcccaggagagaacccagugcuauccgaggugcugaacagaggacuucucgggguucccgaauucccaggguuaaaacaaacuugguuugugcggcgacaccgcuacccuuaccgguccccagauagucgcggauccccgaagcuaagagccagggcaggacuucagucaguguuccaggaacagcugagacacccaggucaccacgggcucgcgccgcugcggcuccgacccggugcgaaccgccauacgcgccgcgcggugggccggaggcaguccgcguacuguugcggaaacucugucucacaaggugcgcaacacucgccgcgcgcaacacucaccaggaaguugaugucggccgggcgcacuaggcgguagcugcacgucgcgcaauccuggcugcauucggcccgcacggucgccaggagcccggggccgagcaacagcagccaagugcaaagugucaggaaccgcgccauggacugcgaggagagagggacgcgugcuucgagccugccugggcgcagaacggggucccucggcaggacccucgccgcgacagccucagcaggggaucgucgagcaaaagcccgcaggaaugcuccuuucuggggccccgccc

SEQ ID NO: 20476 - RNA, 1228 nt, Homo sapiens
gggcggggccccagaaaggagcauuccugcgggcuuuugcucgacgauccccugcugaggcugucgcggcgaggguccugccgagggaccccguucugcgcccaggcaggcucgaagcacgcgucccucucuccucgcaguccauggcgcgguuccugacacuuugcacuuggcugcuguugcucggccccgggcuccuggcgaccgugcgggccgaaugcagccaggauugcgcgacgugcagcuaccgccuagugcgcccggccgacaucaacuuccuggugaguguugcgcgcggcgaguguugcgcaccuugugagacagaguuuccgcaacaguacgcggacugccuccggcccaccgcgcggcgcguauggcgguucgcaccgggucggagccgcagcggcgcgagcccguggugaccugggugucucagcuguuccuggaacacugacugaaguccugcccuggcucuuagcuucggggauccgcgacuaucuggggaccgguaaggguagcggugucgccgcacaaaccaaguuuguuuuaacccugggaauucgggaaccccgagaaguccucuguucagcaccucggauagcacuggguucucuccugggcugucagaaggaagauggcugucaccacaacuccuaacauaucccagcuaagggccccuccacacgcagucaucuucccaucuuucccacaaauaauguaauuuuuuguuagugacauuucggugccuuucuuuagauuuauguuccccagcucucuuaaccucaggucccucauucccuacccucaccuguaaauaggagagagcaaagggauggaaaagggguacggggagaggaaggcgaaauaaccguagacaggaaagaguucaaacugucucacuagccagugaugcuggaauucaacuucuguuucaacugcccuuuguaauaguaacuaaaacaacaguuuaauuuggcuaugagaaaggaacaagagaaguggccaguguccaaugggugacaacaguccaaagauacacugcacuacaggggguuggggaaagaaaaagcugaggacaaaauaacuuucauucugaucaugguuccccaugggcugucgaaucaccucuggugcucuacugagucugaaucuccaaccucgagacucagguagcuucacuuuuaccagcuccccugacaauuccuuugcauugcuuuugaaauuuguu

SEQ ID NO: 20477 - RNA, 756 nt, Homo sapiens
auggaaauucagaagcggcuuuaacaacguaagcuucauaaagcuugcaacaccucacccaugcuuuauuccauuuaaaacccacaucaucuucaaauaacaccuuucuuguuuuugccauaaacugaagggcagcauugggagaaaaaaaaaaagggaaagaaagaaaacccuugggggggagaacacucaaaacgcaaucagaaauuaucucacauguccuauguccuaugaaacuucgguauuuaugaccccagcguggguccgcggcgccccggaacuacacuucccacaaagcauugaggcgaaccccggcggcgggcggggcggccugggauucagggugaccaccgcucuccccagacagggaccgccguccccgggaaggcugcaccgcguacgaucgagggggcacuaacucuccuuucugaaagcgcugucaccccgugguuucuccugcgguucgaccggcgacccucuccgcccucccugcuccaucugagggucaccgccuauucgugaccuuucggcugauuacuagagugucacaaaaaggcaccuucucccccuucccgaaagcuccauuucuauaacucaaccagccgucggggacccggggccaggcggggucagacgggacgggcggacacugcccgucaccccggggcuccggcccucccgccagccgaggcucagugggcagggggcugggcucccccgaccccgggccagggcggaucgcgggcagagguggcu

SEQ ID NO: 20478 - RNA, 756 nt, Homo sapiens
agccaccucugcccgcgauccgcccuggcccggggucgggggagcccagcccccugcccacugagccucggcuggcgggagggccggagccccggggugacgggcaguguccgcccgucccgucugaccccgccuggccccggguccccgacggcugguugaguuauagaaauggagcuuucgggaagggggagaaggugccuuuuugugacacucuaguaaucagccgaaaggucacgaauaggcggugacccucagauggagcagggagggcggagagggucgccggucgaaccgcaggagaaaccacggggugacagcgcuuucagaaaggagaguuagugcccccucgaucguacgcggugcagccuucccggggacggcggucccugucuggggagagcgguggucacccugaaucccaggccgccccgcccgccgccgggguucgccucaaugcuuugugggaaguguaguuccggggcgccgcggacccacgcuggggucauaaauaccgaaguuucauaggacauaggacaugugagauaauuucugauugcguuuugaguguucucccccccaaggguuuucuuucuuucccuuuuuuuuuuucucccaaugcugcccuucaguuuauggcaaaaacaagaaagguguuauuugaagaugauguggguuuuaaauggaauaaagcaugggugagguguugcaagcuuuaugaagcuuacguuguuaaagccgcuucugaauuuccau

SEQ ID NO: 20479 - RNA, 896 nt, Homo sapiens
gggguccacucagcccugcaaaaguuagauaaggcaagauuccuaaaguucacauggaaguaucuaugccuaugugagcucugagauuuuguucagauacccuauguucuuuucgguaacuagagugauuuauuuucgauaugcugauuuuaacuuucugccuucgcuuuguccgugaggucauguacacuugcaaaaugaaauucaaauucagggguugcauaauugcuguacuuuaagugaugguacugucauaacaaauuagauacaagaucagauacuuuuuuuauauaagaagaaaucaagucuuaaauagauugaaauugcauuuauuccuuaaagcagaaaucuauaaagcccuaaguaaugucuuaaaaauggaauauaugucauuccuguuguaacauaggccaaguacaagguacaacacugaagacauuuuuauuuccuuuauuguuuuuguuauagaaauuauacaugaucuugggccgggcgcgguggcucacgccuguaaucccagcucuuucggaggcuuaggcggguggaucacgaggucaggaguucgagaccagccuggccaacauggugaaacccugucucuaauuaaaaaauacaaaaauuagcugggcguggaggcgcgcgccuguaaucccaacuacucgggaggcugagguaggagaaucgcuugaacccgggaggcggagcuugcagugagccgagaucgcaccacugcacuccagccugggggacagagcgagacuccgucucaaaaagaaaaaaaaaagaaaaauuauacauaauuuuuguaaaaaaaaaaugcaaaugauuuggaguaucauaaaauuaaaagugaaaguccuuccuccuagccccaccaucccacucugcagagaaau

SEQ ID NO: 20480 - RNA, 896 nt, Homo sapiens
auuucucugcagagugggaugguggggcuaggaggaaggacuuucacuuuuaauuuuaugauacuccaaaucauuugcauuuuuuuuuuacaaaaauuauguauaauuuuucuuuuuuuuuucuuuuugagacggagucucgcucugucccccaggcuggagugcaguggugcgaucucggcucacugcaagcuccgccucccggguucaagcgauucuccuaccucagccucccgaguaguugggauuacaggcgcgcgccuccacgcccagcuaauuuuuguauuuuuuaauuagagacaggguuucaccauguuggccaggcuggucucgaacuccugaccucgugauccacccgccuaagccuccgaaagagcugggauuacaggcgugagccaccgcgcccggcccaagaucauguauaauuucuauaacaaaaacaauaaaggaaauaaaaaugucuucaguguuguaccuuguacuuggccuauguuacaacaggaaugacauauauuccauuuuuaagacauuacuuagggcuuuauagauuucugcuuuaaggaauaaaugcaauuucaaucuauuuaagacuugauuucuucuuauauaaaaaaaguaucugaucuuguaucuaauuuguuaugacaguaccaucacuuaaaguacagcaauuaugcaaccccugaauuugaauuucauuuugcaaguguacaugaccucacggacaaagcgaaggcagaaaguuaaaaucagcauaucgaaaauaaaucacucuaguuaccgaaaagaacauaggguaucugaacaaaaucucagagcucacauaggcauagauacuuccaugugaacuuuaggaaucuugccuuaucuaacuuuugcagggcugaguggacccc

SEQ ID NO: 20481 - RNA, 525 nt, Homo sapiens
acugcccccagguaagucuguugggucucgccgcuuuucuauuugaccgucuggcuuaaagugauacaaaucguguuucuaaaaaguauaaaaccaguguuuuauuucauaacauuauuccuaaggucuuaggacaauucucaaagucgaaaaaaaugaccuuacuucuaccagcauuacuuaaaaugccuuacgagcuacgcccaaauaucgucaaaugaacagguuuccacaaaaggaacacguucuaaaaacuccuuaacaaucaccaagaccaacuaacucgugucaacguaaauacugccuuuguggugcggucacuagaaaccccaaagugcagcaggucacuauggaccaggguuucagauccccaaauaaagcaaaggaauggguccccggaccacaaccuccgacucgauucgucgcccgcccaccgccugcagcgcaguccagcggcgcccacacagacucgugcuacaguccccucgcccaaguucacuggcuguuuuuaaaagcuuagucccc

SEQ ID NO: 20482 - RNA, 525 nt, Homo sapiens
ggggacuaagcuuuuaaaaacagccagugaacuugggcgaggggacuguagcacgagucugugugggcgccgcuggacugcgcugcaggcggugggcgggcgacgaaucgagucggagguugugguccggggacccauuccuuugcuuuauuuggggaucugaaacccugguccauagugaccugcugcacuuugggguuucuagugaccgcaccacaaaggcaguauuuacguugacacgaguuaguuggucuuggugauuguuaaggaguuuuuagaacguguuccuuuuguggaaaccuguucauuugacgauauuugggcguagcucguaaggcauuuuaaguaaugcugguagaaguaaggucauuuuuuucgacuuugagaauuguccuaagaccuuaggaauaauguuaugaaauaaaacacugguuuuauacuuuuuagaaacacgauuuguaucacuuuaagccagacggucaaauagaaaagcggcgagacccaacagacuuaccugggggcagu

SEQ ID NO: 20483 - RNA, 625 nt, Homo sapiens
ggagagguugcuguccuggcgaggagaccuagaggccgugcgcgguccacgccggcggcgccuugagccuugcgguggggaggacugugcaggagcugaaguucaggagcagggcgcgugaaggggcgcgcggaauccuggcugggagcugggagccgcugcugcaacgacgcgucccggcccgcccgagccagucucacugccuggcucacuccuccaggcucagacccugaacugaacggcggcgcccgccugcaaccaugagcgccucgacgucgcugcggaaaccuucuagggugugggugcuugacgccuggggcgcgcagaucacgccaccagagccccaucggacgauccuaucugauuaaacauuaacggaacccccggacuggaggaucagguuucggccucgcccuccccaaacagcgucagauuacgcgcagagggaagaaaaaacucccaaauccuaacugggcuggaaggcaggccggcgcccuaggggcuccuccucucccgccucucacccugcgugggaugccagacuccaaguucugccgggcccaccuuuucaguguuuccuggguccaccuugucuccugcugaccagugagacuucugaaucaau

SEQ ID NO: 20484 - RNA, 625 nt, Homo sapiens
auugauucagaagucucacuggucagcaggagacaagguggacccaggaaacacugaaaaggugggcccggcagaacuuggagucuggcaucccacgcagggugagaggcgggagaggaggagccccuagggcgccggccugccuuccagcccaguuaggauuugggaguuuuuucuucccucugcgcguaaucugacgcuguuuggggagggcgaggccgaaaccugauccuccaguccggggguuccguuaauguuuaaucagauaggaucguccgauggggcucugguggcgugaucugcgcgccccaggcgucaagcacccacacccuagaagguuuccgcagcgacgucgaggcgcucaugguugcaggcgggcgccgccguucaguucagggucugagccuggaggagugagccaggcagugagacuggcucgggcgggccgggacgcgucguugcagcagcggcucccagcucccagccaggauuccgcgcgccccuucacgcgcccugcuccugaacuucagcuccugcacaguccuccccaccgcaaggcucaaggcgccgccggcguggaccgcgcacggccucuaggucuccucgccaggacagcaaccucucc

SEQ ID NO: 20485 - RNA, 3615 nt, Homo sapiens
cuauuuugucauuuuucuguuucuaagccuuucaccuaaguuacaugauaacauucagaagaggaaaaaaauuaucagguacaauacuuggcagcuggacaugugucaauuguugccuguaaaucuaauuacugaaaauuagagcacaccacggcaugaccguagagacaaagacacugcagcugagcucugauuagaaaauucaacuuuuuauuccucccgacuccugaaugaguggaugguauuacauuaacuguaaaauguacauccugucccggugcccaggccacccauuccaaacgaggaaaggucguuugucaaaacuugaagcauuugaaggaaaaacacccucaucaguagucaagaaaauuaacguuaaagucuauuauugggggcaaaguacguaaaaccacuaauagcaguguauuuacuucaaauaauaaucauaauaauguguuuacagagcugucuuuaaaaacaaaacaaaacaaacaaaccucggcccuacacugacuacuuuaaaauccccaccgucacaaaaacauuccaaaaacuaagaccaaaucuggaccccacuugauaucaaggauguuauuggauuugaggaguuuguucaaaguacgucauuuugagaaguugcauccacuuaaagauauaaaauauggcaaccaacuagguuuaaaaacagugaaauuuuaugucccugaaagcuuaaaagcuguaaaucuagaaacccgggucacguaggcaacauuauugacuuguuuuccccaccucucuuaauaccaaccugcagcgcaguccuuccaaauccauuuugugcauugacguuuacauuauuuugcaacaaacuaguaaguugcucuagguccccccuggcagcugcggacgccaacucguucccccaaggcucggccauucuuuaggguccugacgaucaggaaaagaugaauuagucguuuuucuuuuuccccuuuccuuugcuccuaaccaggcugcaugauggcaucggagacugacagaaggacugggaugguuaaucuggaguagagcuugguaguaaauacuaguaagaucugccugccaaaagcccgccccucgauucacacgugauuauucagcaaaacugagccauuggagaggggcuccucgccucgcuuuuuuagcuuaaccccuaugaagaauucugacgacuccacagagagacacacagacacacauacauuccugguuaaugacuccggacgucagauguaggcagagcugucacguaccuacgcuacagaucucugugaggaguguguguggagacucaagggacuauagaucggggcagaaaauaccgcggaaggaaagacauucagggggaagaaaaggcauucacccacccuuguucacgguggugacuugagccgugugaggcagaacugcaggggcagguccuccagggggcucgguuuccauccgucucgccgaagggauaguccuggguccuccgcugcugggagagcgccgcgguggcuggaugcugacgugcuccggaggguuaaaagaugaucgccaaaggcgaacgggaguagcaguucgguggcccucaaguuacaggucguaacgauugcccagugcucugggcuucuccagaagagccuuuggucgcguccgggccaagccgugggcuaaugccgcucaggaaagcuccggagcccgcccgccaggcagccgcagccccgccgagccucagaggccgugggagccgggcucggcgcgcgucuccggaggcugccgggcgugcggcgggcccccgagaagcccgucaugccggccccgccaggucccgggacucccggcagcccgaggaaggagagugaugcggaaagcgucuacggagcccggacugcuggggcagcucgcggcagcauugcggcugcacugggcagcccccccgggaacuucccgccuacgaccgagcucguucaggcuuucugcuguaggcacucauugagcugcugccgccgcuguccuuuccuuccuuucccgguuuugugggggccucuggagauggggagaguccugggaaacguaggccaaguucugaguagggagagucgccgcaguuccggggcagccaguccggucgccgucucggcgagcgcucagcagccucggcgcccggugccacuuugccaccucucgcgguccccggccugugccccuuugcugcggacagggcagccgccagccagcugugcccuggagcagagccuggcagcacugcuuccuccuuggccgcaccgcucccagugacaguuucuuuuguagcugaucccccccuagaucgccggucccugcuccuuucaccccuacaggcacuugcgugucgcccccuuuuuugcuuuuuuccuucacucccucccuugcugcuuuuuucgcugaaacaauugcugcuucuguugccucucagagagggugccgguuucuucucccuuuuuuccgaccucaucagcuuuuuuugaaaagaaaaaaauugagcgcuuuuugaguugaaaaacccgcccccauuuuaacggcagaguuuuaaggaggcucggcagaguugcagcgccgcgggagcgggaaggccgggcgccgcccacgccccgcccuccgcccugcuggcgcucgcgcucgcagucucgcacgcuccgcccgcccggucccgcgcccucauucccgccucccgcucuccaccuccucccgucaagucucucgcgccggcucccuccugccggcuaggcggccuguccccagcuggagcgggguucggccccgcgaaguccggccugcccuucugcuggcgggcuugagucugugacgcgaacccccagcugccccaauuccuacgggggcgaggacagggguuuguuauuuaagacgguuguggagggccgcagggucuuugaggcuccgcagcguacgcugcgggaaggcggacagcgagcuggcauaaagggagucguuccucagcgcuagcggggcaggucggcccgccucugugcucccccgccaggcucgcaaaguucgggcggccaggcugcggcugcugcugccuccucuaggcgcgcgcgcucuguaaacucggcguccuucgcugagcccuggccucggccucgcaccugccagauccaugcccgacggcgcggugggcagggguggccgcggggguggagggaaaaauccggacugccacuaagcacagugcucacaaaaagcaagucuuguguagacugaauuuuaugaaaacuuaagacauggcauauguaagaacgaacucugaagccuuaauuaaucaaggacuggaaacugcgaaauaguccuauuauuagagaaaaaggagaaaagcaauuaaauuuaaagcaaaauuuaaaauaagucgugugaaguguuuucuaacaaagccauuucuugguugccgaaguucucucacuacuuagaaguggcuuggauuuuggggaugugggguuggggagggugucuagaauggucucucuccuaauccuuuauuuaaucauccgacaccaauuuccaguacuuuuaacuuccucuuuuagcuaugugagauuaauuaacuauugcuuu

SEQ ID NO: 20486 - RNA, 3615 nt, Homo sapiens
aaagcaauaguuaauuaaucucacauagcuaaaagaggaaguuaaaaguacuggaaauuggugucggaugauuaaauaaaggauuaggagagagaccauucuagacacccuccccaaccccacauccccaaaauccaagccacuucuaaguagugagagaacuucggcaaccaagaaauggcuuuguuagaaaacacuucacacgacuuauuuuaaauuuugcuuuaaauuuaauugcuuuucuccuuuuucucuaauaauaggacuauuucgcaguuuccaguccuugauuaauuaaggcuucagaguucguucuuacauaugccaugucuuaaguuuucauaaaauucagucuacacaagacuugcuuuuugugagcacugugcuuaguggcaguccggauuuuucccuccacccccgcggccaccccugcccaccgcgccgucgggcauggaucuggcaggugcgaggccgaggccagggcucagcgaaggacgccgaguuuacagagcgcgcgcgccuagaggaggcagcagcagccgcagccuggccgcccgaacuuugcgagccuggcgggggagcacagaggcgggccgaccugccccgcuagcgcugaggaacgacucccuuuaugccagcucgcuguccgccuucccgcagcguacgcugcggagccucaaagacccugcggcccuccacaaccgucuuaaauaacaaaccccuguccucgcccccguaggaauuggggcagcuggggguucgcgucacagacucaagcccgccagcagaagggcaggccggacuucgcggggccgaaccccgcuccagcuggggacaggccgccuagccggcaggagggagccggcgcgagagacuugacgggaggagguggagagcgggaggcgggaaugagggcgcgggaccgggcgggcggagcgugcgagacugcgagcgcgagcgccagcagggcggagggcggggcgugggcggcgcccggccuucccgcucccgcggcgcugcaacucugccgagccuccuuaaaacucugccguuaaaaugggggcggguuuuucaacucaaaaagcgcucaauuuuuuucuuuucaaaaaaagcugaugaggucggaaaaaagggagaagaaaccggcacccucucugagaggcaacagaagcagcaauuguuucagcgaaaaaagcagcaagggagggagugaaggaaaaaagcaaaaaagggggcgacacgcaagugccuguaggggugaaaggagcagggaccggcgaucuagggggggaucagcuacaaaagaaacugucacugggagcggugcggccaaggaggaagcagugcugccaggcucugcuccagggcacagcuggcuggcggcugcccuguccgcagcaaaggggcacaggccggggaccgcgagagguggcaaaguggcaccgggcgccgaggcugcugagcgcucgccgagacggcgaccggacuggcugccccggaacugcggcgacucucccuacucagaacuuggccuacguuucccaggacucuccccaucuccagaggcccccacaaaaccgggaaaggaaggaaaggacagcggcggcagcagcucaaugagugccuacagcagaaagccugaacgagcucggucguaggcgggaaguucccgggggggcugcccagugcagccgcaaugcugccgcgagcugccccagcaguccgggcuccguagacgcuuuccgcaucacucuccuuccucgggcugccgggagucccgggaccuggcggggccggcaugacgggcuucucgggggcccgccgcacgcccggcagccuccggagacgcgcgccgagcccggcucccacggccucugaggcucggcggggcugcggcugccuggcgggcgggcuccggagcuuuccugagcggcauuagcccacggcuuggcccggacgcgaccaaaggcucuucuggagaagcccagagcacugggcaaucguuacgaccuguaacuugagggccaccgaacugcuacucccguucgccuuuggcgaucaucuuuuaacccuccggagcacgucagcauccagccaccgcggcgcucucccagcagcggaggacccaggacuaucccuucggcgagacggauggaaaccgagcccccuggaggaccugccccugcaguucugccucacacggcucaagucaccaccgugaacaagggugggugaaugccuuuucuucccccugaaugucuuuccuuccgcgguauuuucugccccgaucuauagucccuugagucuccacacacacuccucacagagaucuguagcguagguacgugacagcucugccuacaucugacguccggagucauuaaccaggaauguaugugugucugugugucucucuguggagucgucagaauucuucauagggguuaagcuaaaaaagcgaggcgaggagccccucuccaauggcucaguuuugcugaauaaucacgugugaaucgaggggcgggcuuuuggcaggcagaucuuacuaguauuuacuaccaagcucuacuccagauuaaccaucccaguccuucugucagucuccgaugccaucaugcagccugguuaggagcaaaggaaaggggaaaaagaaaaacgacuaauucaucuuuuccugaucgucaggacccuaaagaauggccgagccuugggggaacgaguuggcguccgcagcugccaggggggaccuagagcaacuuacuaguuuguugcaaaauaauguaaacgucaaugcacaaaauggauuuggaaggacugcgcugcagguugguauuaagagagguggggaaaacaagucaauaauguugccuacgugacccggguuucuagauuuacagcuuuuaagcuuucagggacauaaaauuucacuguuuuuaaaccuaguugguugccauauuuuauaucuuuaaguggaugcaacuucucaaaaugacguacuuugaacaaacuccucaaauccaauaacauccuugauaucaagugggguccagauuuggucuuaguuuuuggaauguuuuugugacgguggggauuuuaaaguagucaguguagggccgagguuuguuuguuuuguuuuguuuuuaaagacagcucuguaaacacauuauuaugauuauuauuugaaguaaauacacugcuauuagugguuuuacguacuuugcccccaauaauagacuuuaacguuaauuuucuugacuacugaugaggguguuuuuccuucaaaugcuucaaguuuugacaaacgaccuuuccucguuuggaauggguggccugggcaccgggacaggauguacauuuuacaguuaauguaauaccauccacucauucaggagucgggaggaauaaaaaguugaauuuucuaaucagagcucagcugcagugucuuugucucuacggucaugccguggugugcucuaauuuucaguaauuagauuuacaggcaacaauugacacauguccagcugccaaguauuguaccugauaauuuuuuuccucuucugaauguuaucauguaacuuaggugaaaggcuuagaaacagaaaaaugacaaaauag

SEQ ID NO: 20487 - RNA, 1033 nt, Homo sapiens
ccgcgccucgggaacaaaggcgcccgcccgccgcccgccgcccgcgcccgcgccgccgccaugaagccggggccgccgcaccgugccggggccgcccacggggccggcgccggggccggggccgcggccgggcccggggcccgcgggcugcuccugccaccgcugcugcugcugcugcuggcggggcgcgccgcgggggugagugacacgcgcccggauccccgccacggcuccccggggccgccccccgcgcggggugccgguccccgcccgcgacccccccuccgggaccccgcucccucccccccggcugcuucccccggggccgcggucccugccaccccucgacccucccccgagcgccccuuucugcacccugcuccccccccuccggaaucucccccuagcuggcauccgcggggagaggccgcccccgccgcuggucaucuucggggggcgcaucucuccuuccuuuugggaccccuccccagagggaaucccgggagggaacccgaucgcggguccucagcccuguucccccaccucccaguggcuccgggaacugucuccccggggacgaagcgggaccccugcgcuggccugggaggcgcgagaaggacccggcggcgggcugggggucgccgucccggcugggugugucuuggggugggagugagccuggcuuuugccucgugggugugcccagaccauggccacuuuuugggaaucggaucgguuccccuuccgaggggagggugugcauuugguucuucccagggucgcggcagccggccagggcagugggcccgggaaggggagguggagguggagggugacuuggugaaggugaccugaggggggagugaggguaacccugugugugggcgugugugggcguguguggccaacucagugaggggugcggggaccuguggggcgugugcaggugaaggaugugucugccacauggguggaugccagcgugcccucccguccguggucgugggagggugacccauugugcaugaugugu

SEQ ID NO: 20488 - RNA, 1033 nt, Homo sapiens
acacaucaugcacaaugggucacccucccacgaccacggacgggagggcacgcuggcauccacccauguggcagacacauccuucaccugcacacgccccacagguccccgcaccccucacugaguuggccacacacgcccacacacgcccacacacaggguuacccucacuccccccucaggucaccuucaccaagucacccuccaccuccaccuccccuucccgggcccacugcccuggccggcugccgcgacccugggaagaaccaaaugcacacccuccccucggaaggggaaccgauccgauucccaaaaaguggccauggucugggcacacccacgaggcaaaagccaggcucacucccaccccaagacacacccagccgggacggcgacccccagcccgccgccggguccuucucgcgccucccaggccagcgcaggggucccgcuucguccccggggagacaguucccggagccacugggaggugggggaacagggcugaggacccgcgaucggguucccucccgggauucccucuggggaggggucccaaaaggaaggagagaugcgccccccgaagaugaccagcggcgggggcggccucuccccgcggaugccagcuagggggagauuccggaggggggggagcagggugcagaaaggggcgcucgggggagggucgagggguggcagggaccgcggccccgggggaagcagccgggggggagggagcggggucccggagggggggucgcgggcggggaccggcaccccgcgcggggggcggccccggggagccguggcggggauccgggcgcgugucacucacccccgcggcgcgccccgccagcagcagcagcagcagcgguggcaggagcagcccgcgggccccgggcccggccgcggccccggccccggcgccggccccgugggcggccccggcacggugcggcggccccggcuucauggcggcggcgcgggcgcgggcggcgggcggcgggcgggcgccuuuguucccgaggcgcgg

SEQ ID NO: 20489 - RNA, 2549 nt, Homo sapiens
uuugcuccuuccucagcuccccauuuaaauaacguuuuaacuuuauucagcagguuugcucaucucccaccccaaucgugacuccccagaccgggucuccacagggaccaagaggccucucccucccccuucgccgcgggagcagggaagggccuucggcagcaacuuguuccaccuccccaagguucagacgcgaaacugaguuccagaaggaagggcuuacgcaaaggcacccagcgcgccagaagagggguguccuuuuccgugcccggggccagucccggggccaguccggagccgcggcggucacaccucggacucgcgcggcgguccgcgggcgcgcuggcagccguacagccacuggaugacgcgcgcguugcgcuccaccaccgacaccggggggcgccggucccgcgccgagcccgcugccuccgagccgccgccgccgcccgcgccgcccgggcuguccacgccccugucgcuggauguccagucgcuggcguccccggagccgggcggcggcgaaguuccggccugcgggcuggcgucggcuccccagcucugcggggagaagcgcucugcgcccagcaccuccaccagcgcgcgcuccaggccgcaguaguugaagaagcgcuccuucuccgacaggggcagcgagcacgugggacacagcgcccgcuuucccgccgcuuccggggcauccuggggcgcagcccaacccccugaagccgcaggucgcucuguggaggccgggcugcucggggcagcgucccgcggggcacccagaaagaggcgccgcaccagacccuggcccuuggcguucucuuuguucaccgaagccuugcagucccgcuucuggcgguagaagaugagggaaucaggccucggcagccgccugccgcuuccccggcggaccggccugggcguccugggcgaugcagggggccccagcucguugcaggggugcggcgugagcggcccaggacucccacgcagggcuggcuccugucgccuagcuaucaccuggugcgucuugacauacuuggcuuugucggcuuccagccucuccacggcgcuggggguccguccucuggacgggguggagggaggggccaggagcaucuuagcagagcuggucaggacagugccccauaaguagccagccacggggccuagagcaauuggcuugggcucucacugaccugcagggagagaggaaggucaggggaaggguaggaaaugccccugguccucuccugccggcauuccucaguauaggaucagucagccacccucucccauccagguuagccggugccacauccagggagcagaggcucaggccauccccuuucccuguccuucagagacauugaguggggucucucuggccacucagaaacauauuccccuuugaaggugccccaaucuggccacagggucgugcaagcaggccuuagcaagcaggacacuuggaaaaggaaacagggcuggucccggcccaauuccugaaaguggcuucaaccggaaaaaauaccucuucccaacccagcagcuuugagcccaagacaagaaggcucccagccacaggcuggcuccagcagggcccacccuucccgcccccaaacaccgaggucggggauauaaccacaggguaggagccuccaguaauugcagccaacugcccugcccaggcccagcagggccaucggggcaggagagggaggugguccccaggcccuaucagcuacugccagcuacucugccccugccaaggggaucgcagaaugccaaacuguaaacaucaccuuguuuaaccuuugcauuuccauuucaugaagaggaaacuggcuuggagaggaggggggcuugcucagguccuauugagaguuaggagccaggacuggaacccagguuucuuuuuuuuuuuucuuuagacggagucuugcuuugucacccagguuucuugccuugcaguucagauuggaucucucacuugccuaucagaacuucccacugaggccaggcgcgauggcucaugccuguaaucccagcacuuugggaggccgaggugggugaauuaccuuaggugaggaguuccagaccagccuggccaacauggcaaaaccccaucucuacugaaaauacaaaaauuagccaggcgggguggcgcacaccuguaaucccagcuacuugggaagcugaggcaggagaaucgcuugaagcugggaggcggagguugcagugagccgagaucgcgcaccacugcacuccagccugggcaacagagcgagacuccgucucaaaaaaaaaaaaagaaaaaaaaaaagaacucacugauauuuugcguguauucccgcugcuauaaaaccaagcaauuuccguuagaaaugggccccuugccucacuaaaaaguuccuuccacuaauucuuccuaauaaccugcgcucccacucccagaaauuugcccccaggguccuugucccuuuuuuauccuaagaccucaugacccuuuuccaccucccuucugcuggggcaaggagcgagga

SEQ ID NO: 20490 - RNA, 2549 nt, Homo sapiens
uccucgcuccuugccccagcagaagggagguggaaaagggucaugaggucuuaggauaaaaaagggacaaggacccugggggcaaauuucugggagugggagcgcagguuauuaggaagaauuaguggaaggaacuuuuuagugaggcaaggggcccauuucuaacggaaauugcuugguuuuauagcagcgggaauacacgcaaaauaucagugaguucuuuuuuuuuuucuuuuuuuuuuuuugagacggagucucgcucuguugcccaggcuggagugcaguggugcgcgaucucggcucacugcaaccuccgccucccagcuucaagcgauucuccugccucagcuucccaaguagcugggauuacaggugugcgccaccccgccuggcuaauuuuuguauuuucaguagagaugggguuuugccauguuggccaggcuggucuggaacuccucaccuaagguaauucacccaccucggccucccaaagugcugggauuacaggcaugagccaucgcgccuggccucagugggaaguucugauaggcaagugagagauccaaucugaacugcaaggcaagaaaccugggugacaaagcaagacuccgucuaaagaaaaaaaaaaaagaaaccuggguuccaguccuggcuccuaacucucaauaggaccugagcaagccccccuccucuccaagccaguuuccucuucaugaaauggaaaugcaaagguuaaacaaggugauguuuacaguuuggcauucugcgauccccuuggcaggggcagaguagcuggcaguagcugauagggccuggggaccaccucccucuccugccccgauggcccugcugggccugggcagggcaguuggcugcaauuacuggaggcuccuacccugugguuauauccccgaccucgguguuugggggcgggaagggugggcccugcuggagccagccuguggcugggagccuucuugucuugggcucaaagcugcuggguugggaagagguauuuuuuccgguugaagccacuuucaggaauugggccgggaccagcccuguuuccuuuuccaaguguccugcuugcuaaggccugcuugcacgacccuguggccagauuggggcaccuucaaaggggaauauguuucugaguggccagagagaccccacucaaugucucugaaggacagggaaaggggauggccugagccucugcucccuggauguggcaccggcuaaccuggaugggagaggguggcugacugauccuauacugaggaaugccggcaggagaggaccaggggcauuuccuacccuuccccugaccuuccucucucccugcaggucagugagagcccaagccaauugcucuaggccccguggcuggcuacuuauggggcacuguccugaccagcucugcuaagaugcuccuggccccucccuccaccccguccagaggacggacccccagcgccguggagaggcuggaagccgacaaagccaaguaugucaagacgcaccaggugauagcuaggcgacaggagccagcccugcgugggaguccugggccgcucacgccgcaccccugcaacgagcuggggcccccugcaucgcccaggacgcccaggccgguccgccggggaagcggcaggcggcugccgaggccugauucccucaucuucuaccgccagaagcgggacugcaaggcuucggugaacaaagagaacgccaagggccagggucuggugcggcgccucuuucugggugccccgcgggacgcugccccgagcagcccggccuccacagagcgaccugcggcuucaggggguugggcugcgccccaggaugccccggaagcggcgggaaagcgggcgcugugucccacgugcucgcugccccugucggagaaggagcgcuucuucaacuacugcggccuggagcgcgcgcugguggaggugcugggcgcagagcgcuucuccccgcagagcuggggagccgacgccagcccgcaggccggaacuucgccgccgcccggcuccggggacgccagcgacuggacauccagcgacaggggcguggacagcccgggcggcgcgggcggcggcggcggcucggaggcagcgggcucggcgcgggaccggcgccccccggugucggugguggagcgcaacgcgcgcgucauccaguggcuguacggcugccagcgcgcccgcggaccgccgcgcgaguccgaggugugaccgccgcggcuccggacuggccccgggacuggccccgggcacggaaaaggacaccccucuucuggcgcgcugggugccuuugcguaagcccuuccuucuggaacucaguuucgcgucugaaccuuggggagguggaacaaguugcugccgaaggcccuucccugcucccgcggcgaagggggagggagaggccucuuggucccuguggagacccggucuggggagucacgauuggggugggagaugagcaaaccugcugaauaaaguuaaaacguuauuuaaauggggagcugaggaaggagcaaa

SEQ ID NO: 20491 - RNA, 1271 nt, Homo sapiens
ggucaggggcguggucucgcgcagcuuggaggccagcagcaugcagaccgcacccaggagcugcaacugcgccuuucggguggggacgcaagacagguagcgauccagguaguucauggccagggggaagacuuccuccucacagcgcugcuccucacauaccugggggagggcgcacagucacugcugggucuggagcguggggaacacagcagcgggggggugggagcgcugaagugaggugggauagggagcaaaaacggcagagaggguaagcuacuuagagagacaaggaccaauaaaggaggaggaugcgcccuccccaaggugacgccccccacuuccucugcgcggccuccuccccucuccccuugacgggggagugguaaagccaaggagcccuugcucacggaggauuccaaacggagacuccccucccccacagcgaggggaagugggacgcaagggucacccaugguagccagagagcugggaccucacccccaucaccgccaccacugcacacacccgaggggaagggaggaggcuccugccgcugccuccugcacuuuucauuucccugucggccggaacagggcgcgcgccacccccaucgccuuccccgccagaaccccgcgaaagacacaggaaccggcucccgggcgggggcggccgagcccaggguuuuccaggcgcgcucuccggagaaggccgggaggcggagggaagcgggagacgcugugagaagccgaaggggagagaguguccuuggucccguuugcucggcccgaagagaggcacaguuagggugccaagugacuggcagucacugucgggaggagccgauuagggcucgggaaagcaagggaggcagcuggcgugggugcccuagugaaaggccaggccccgggagucuuagccucggagcauccugcagauugcuguggggaccgggaugucccgacagggcggccccgguguguccagacccgggagcggugggggagggggacgcguccgggcgguaccuccagcauccaguaagccagcaucuuccgcaugugcggcuugaucucccgcugcacgcacuggaaguaggaggcgcgggguacguagcgcuccuccaggcggagcaggcucugcaggacacgcuggucccccagcagccgcggguccggcccggcccggggcgcgugccgggugccuucgcaacacagcagcuccauacucgggcagcgaacaggcagggcgggagugcgggcucgcgaguc

SEQ ID NO: 20492 - RNA, 1271 nt, Homo sapiens
gacucgcgagcccgcacucccgcccugccuguucgcugcccgaguauggagcugcuguguugcgaaggcacccggcacgcgccccgggccgggccggacccgcggcugcugggggaccagcguguccugcagagccugcuccgccuggaggagcgcuacguaccccgcgccuccuacuuccagugcgugcagcgggagaucaagccgcacaugcggaagaugcuggcuuacuggaugcuggagguaccgcccggacgcgucccccucccccaccgcucccgggucuggacacaccggggccgcccugucgggacaucccgguccccacagcaaucugcaggaugcuccgaggcuaagacucccggggccuggccuuucacuagggcacccacgccagcugccucccuugcuuucccgagcccuaaucggcuccucccgacagugacugccagucacuuggcacccuaacugugccucucuucgggccgagcaaacgggaccaaggacacucucuccccuucggcuucucacagcgucucccgcuucccuccgccucccggccuucuccggagagcgcgccuggaaaacccugggcucggccgcccccgcccgggagccgguuccugugucuuucgcgggguucuggcggggaaggcgauggggguggcgcgcgcccuguuccggccgacagggaaaugaaaagugcaggaggcagcggcaggagccuccucccuuccccucgggugugugcagugguggcggugaugggggugaggucccagcucucuggcuaccaugggugacccuugcgucccacuuccccucgcugugggggaggggagucuccguuuggaauccuccgugagcaagggcuccuuggcuuuaccacucccccgucaaggggagaggggaggaggccgcgcagaggaaguggggggcgucaccuuggggagggcgcauccuccuccuuuauugguccuugucucucuaaguagcuuacccucucugccguuuuugcucccuaucccaccucacuucagcgcucccacccccccgcugcuguguuccccacgcuccagacccagcagugacugugcgcccucccccagguaugugaggagcagcgcugugaggaggaagucuucccccuggccaugaacuaccuggaucgcuaccugucuugcguccccacccgaaaggcgcaguugcagcuccugggugcggucugcaugcugcuggccuccaagcugcgcgagaccacgccccugacc

SEQ ID NO: 20493 - RNA, 1506 nt, Homo sapiens
ccgccaucuuaguugcugccgcugccuucagcaagacgcugcucugaggcggggagggcgccgcguccugagcgcgcggcccagcgucacggcggcggcggcggcggcuccuccuuggacccccggagcuccccgcgccgcggagcagcuagccccaggccccuagagccccgagagcuccgagagcuccgcucggcgucccgcgcgccucccugccgcucccgccccgggcuggcgaugcugcgccgccccgcucccgcgcuggccccggccgcccggcugcugcuggccgggcugcugugcggcggcggggucugggccgcgcgagguaagccccggggcugggccgggccgcugggucggugcgggauucggguccgggugcaggauucgggucccggugcggggauucggguccgggugcgggaguagggccggaugccgggauucgagccgggaugcggggagucggguccgagcgcagggagccgggucagggcgugggguucggguugggggucgggcucgcggagccggggccagggcgcaggagacugugggcgcgcgcugcaggcgucccggggaagccaggcuccgucccgggcggggcuccugagccugggcugcccccacugcagcccauggugguggcugcgcugauuugggggaacgugcagacgggccgaagggucaguccgcccugcucagcggcgcacgcaggcuggggcugcaccccugggugagaugcucuguguacgugugcucagaugugcaucaggcggggggugcacgcacaguuuuggugugugcuuacauaagagcccacuccuccgcaucccguuuccaagaucccgauucuguguugcugcaccgcggacaccacgacuucgccccuuuccgccuccucccagaguccuucagacguugucuguuuccaguggagccgaggcugaaacuuagugcuucccucccaccuuuucacccaaaggugaaaucgcgaugagauuugcgaccgcgggcucacccaguguuagaaaucuccgucucugcuaccccuggugccuuggugcuguuuuucugacggucauuuagaccguggaggguuagauguucucuacaaaaacgagaaaccucucugguuuuuuaggauuguaggaccgaaauuauuuuauggcucggugggaaguaguauuucuuggcuaauuuauuauuagcuuuuaaccuucauccacuuaaccuuuuaaaccuugcaugccucugcuauugacuggucuugccaacgaaaagcuuacgcauugcagauacaguauuugcuucugaguggaucuugaaaucguaaacauuuuccuuggccuuagagcagaguaaucuagguguagucuguagaaucuacuguaggcuuaaaucuguuguucugauuuuuuuuuaaucaaaagaaauuuuggggaggaggauugauagaaaucuagaugaaauggucauauuugaauuuagcaagcuuuuuaa

SEQ ID NO: 20494 - RNA, 1506 nt, Homo sapiens
uuaaaaagcuugcuaaauucaaauaugaccauuucaucuagauuucuaucaauccuccuccccaaaauuucuuuugauuaaaaaaaaaucagaacaacagauuuaagccuacaguagauucuacagacuacaccuagauuacucugcucuaaggccaaggaaaauguuuacgauuucaagauccacucagaagcaaauacuguaucugcaaugcguaagcuuuucguuggcaagaccagucaauagcagaggcaugcaagguuuaaaagguuaaguggaugaagguuaaaagcuaauaauaaauuagccaagaaauacuacuucccaccgagccauaaaauaauuucgguccuacaauccuaaaaaaccagagagguuucucguuuuuguagagaacaucuaacccuccacggucuaaaugaccgucagaaaaacagcaccaaggcaccagggguagcagagacggagauuucuaacacugggugagcccgcggucgcaaaucucaucgcgauuucaccuuugggugaaaaggugggagggaagcacuaaguuucagccucggcuccacuggaaacagacaacgucugaaggacucugggaggaggcggaaaggggcgaagucgugguguccgcggugcagcaacacagaaucgggaucuuggaaacgggaugcggaggagugggcucuuauguaagcacacaccaaaacugugcgugcaccccccgccugaugcacaucugagcacacguacacagagcaucucacccaggggugcagccccagccugcgugcgccgcugagcagggcggacugacccuucggcccgucugcacguucccccaaaucagcgcagccaccaccaugggcugcagugggggcagcccaggcucaggagccccgcccgggacggagccuggcuuccccgggacgccugcagcgcgcgcccacagucuccugcgcccuggccccggcuccgcgagcccgacccccaacccgaaccccacgcccugacccggcucccugcgcucggacccgacuccccgcaucccggcucgaaucccggcauccggcccuacucccgcacccggacccgaauccccgcaccgggacccgaauccugcacccggacccgaaucccgcaccgacccagcggcccggcccagccccggggcuuaccucgcgcggcccagaccccgccgccgcacagcagcccggccagcagcagccgggcggccggggccagcgcgggagcggggcggcgcagcaucgccagcccggggcgggagcggcagggaggcgcgcgggacgccgagcggagcucucggagcucucggggcucuaggggccuggggcuagcugcuccgcggcgcggggagcuccggggguccaaggaggagccgccgccgccgccgccgugacgcugggccgcgcgcucaggacgcggcgcccuccccgccucagagcagcgucuugcugaaggcagcggcagcaacuaagauggcgg

SEQ ID NO: 20495 - RNA, 1113 nt, Homo sapiens
cacuccgcucagcacaucgccguccaccuggcccagcgccaggauggugauggucuugauggccggcacagcccaggcggccaggugaaaauacugugaguuggcuucgauggccucguggccccacuucaugccagccgccaggaaccaggugagcgacaggaucacccaccagauggagcuggccaugcugaagaaguagagcaucaugaagaggauggugcagcccuccuucuuggugcccugcgccacagugcgugccccguccucggcgaacuugucauuacacaccacucggucuuccaggaggaagccggcgauguaggccacggccacggccguguaacagccggacaagaagaugaugggccgcuccggguagcugaagcgccgcauguccaccagguacguaagcaccgugaagagcguggaggcgcagcacagcacugaccaaaugccaauccaggugcgcgagaagcgcagcuccucgggcccgaaguacaugagcccauacaccuuggucggcucacaaggugcgccgcaguccuucucccccaggaagugguaguugagguaggagggcaccuugagggcgcgcgggcaggagaacuugccucgcuccgacgcgccggcgccccccgggaagccgccacggugcccuccgccgccgugcugaggguugcugguccagaacucuggaagcagcgagggcgucggggugcccuugucggacguguucuggcccacgcacagcucgccggcgccgugcaccgggaacuucucacacuugagcgugucuggccacuggaagccgaacuuguucaugagcgccucgcagcccuggcgcgcgcgcucgcacagggagcggcagggcggcagcgccugcucuagcacggugcacacgggcgcguacauggagcacaggaagaacuugagcucagcggaacacugcacuuucacuagaggguagaacuggugcaccuccaggcccgcguccuccugguucguguggcccagcagguugggcaugauggucugguuguacgcgauguccgugcacagcgggauggagaugggcuggcaauagccgugguccgggacggagaugccccg

SEQ ID NO: 20496 - RNA, 1113 nt, Homo sapiens
cggggcaucuccgucccggaccacggcuauugccagcccaucuccaucccgcugugcacggacaucgcguacaaccagaccaucaugcccaaccugcugggccacacgaaccaggaggacgcgggccuggaggugcaccaguucuacccucuagugaaagugcaguguuccgcugagcucaaguucuuccugugcuccauguacgcgcccgugugcaccgugcuagagcaggcgcugccgcccugccgcucccugugcgagcgcgcgcgccagggcugcgaggcgcucaugaacaaguucggcuuccaguggccagacacgcucaagugugagaaguucccggugcacggcgccggcgagcugugcgugggccagaacacguccgacaagggcaccccgacgcccucgcugcuuccagaguucuggaccagcaacccucagcacggcggcggagggcaccguggcggcuucccggggggcgccggcgcgucggagcgaggcaaguucuccugcccgcgcgcccucaaggugcccuccuaccucaacuaccacuuccugggggagaaggacugcggcgcaccuugugagccgaccaagguguaugggcucauguacuucgggcccgaggagcugcgcuucucgcgcaccuggauuggcauuuggucagugcugugcugcgccuccacgcucuucacggugcuuacguaccugguggacaugcggcgcuucagcuacccggagcggcccaucaucuucuuguccggcuguuacacggccguggccguggccuacaucgccggcuuccuccuggaagaccgagugguguguaaugacaaguucgccgaggacggggcacgcacuguggcgcagggcaccaagaaggagggcugcaccauccucuucaugaugcucuacuucuucagcauggccagcuccaucuggugggugauccugucgcucaccugguuccuggcggcuggcaugaaguggggccacgaggccaucgaagccaacucacaguauuuucaccuggccgccugggcugugccggccaucaagaccaucaccauccuggcgcugggccagguggacggcgaugugcugagcggagug

SEQ ID NO: 20497 - RNA, 1130 nt, Homo sapiens
agggaggagccuugaaaccgacgcagaacuggaggcucagggaccgucgcccaaucgcggcuccggcuucccggcgcaaagggagccggccgccuccucgccagagcgaaagccagcggcaggagggcgggguaggaggaggcgggaggaggaggaaguaguggugguggcacuacucaggcacaaagaguaggauugcucugaagcgggacaggcuugguugcuuuugcuuuuucagaagaaaaaggcgaggauacguaggagaauggucccauaugcugcuggagauaaugaauaggagucagaggaccgcgggacuucgcuuuucuuuuauuuuauccauuaucauguuuaaaaauccugcucuuaacgcugguuaccaacagcaaaccggguucugcuuccagaacagaugccuuugacuuaaggagcgcacgguuuccuuugaguuugugucugucgagguuuuguuuaacauauuacauuaauaaauccuccaguucgcaggcugggcuuggcgggcuuuggucgcgccauuuccccagaggagacguucacgggaucgcugucaaaugaaacaaaacacaaacuuugauggaauuuggaaaguaaagccagaugcgccuucugcuacuaucauucuucuuggagucaaacuccuuuuuuuccgccucuuuaaucaagucagaaacagaagcaaaagaaaacuauccauuaaauuuuuggagagaaaaacuuaagaacccgacgaccgaggcagugggggcgccucucugggaucguccucgccgcuccagaccgcagagguggcgccggcgggagcugcacucgccggcagcuugggccccuggggagccuuucuaaacccuggggacgcccacggcuccgaugggaacuccugggaccugggccauuuagguuccacaggcugggcugcagagcuggagacgccaguuuaauaaacaaaacaaacaaacagucugaaagcaaacagcgaacugcacauucucuuccuaauuccaaaacagcauaauccgucucaacagacgcacauuaauguuguuuuccuuguaagauuauuuuaaaugaugguuugacuauguaauucaguuuuauaagaaaagugccau

SEQ ID NO: 20498 - RNA, 1130 nt, Homo sapiens
auggcacuuuucuuauaaaacugaauuacauagucaaaccaucauuuaaaauaaucuuacaaggaaaacaacauuaaugugcgucuguugagacggauuaugcuguuuuggaauuaggaagagaaugugcaguucgcuguuugcuuucagacuguuuguuuguuuuguuuauuaaacuggcgucuccagcucugcagcccagccuguggaaccuaaauggcccaggucccaggaguucccaucggagccgugggcguccccaggguuuagaaaggcuccccaggggcccaagcugccggcgagugcagcucccgccggcgccaccucugcggucuggagcggcgaggacgaucccagagaggcgcccccacugccucggucgucggguucuuaaguuuuucucuccaaaaauuuaauggauaguuuucuuuugcuucuguuucugacuugauuaaagaggcggaaaaaaaggaguuugacuccaagaagaaugauaguagcagaaggcgcaucuggcuuuacuuuccaaauuccaucaaaguuuguguuuuguuucauuugacagcgaucccgugaacgucuccucuggggaaauggcgcgaccaaagcccgccaagcccagccugcgaacuggaggauuuauuaauguaauauguuaaacaaaaccucgacagacacaaacucaaaggaaaccgugcgcuccuuaagucaaaggcaucuguucuggaagcagaacccgguuugcuguugguaaccagcguuaagagcaggauuuuuaaacaugauaauggauaaaauaaaagaaaagcgaagucccgcgguccucugacuccuauucauuaucuccagcagcauaugggaccauucuccuacguauccucgccuuuuucuucugaaaaagcaaaagcaaccaagccugucccgcuucagagcaauccuacucuuugugccugaguagugccaccaccacuacuuccuccuccucccgccuccuccuaccccgcccuccugccgcuggcuuucgcucuggcgaggaggcggccggcucccuuugcgccgggaagccggagccgcgauugggcgacggucccugagccuccaguucugcgucgguuucaaggcuccucccu

SEQ ID NO: 20499 - RNA, 873 nt, Homo sapiens
cuuauaauacgggagcaaagucugcacaccuuccaccacaggcacuuccuguccccgaaauugcaucgcucauccacgucccaaggccccccaugucucugcucgggugggaaacacuucgcaacuguaaauaaaaugccaagagcgugcgcucuaagccucucucgaacgcacagccacaccaaauccaguauuucugaucggccauggggcccuagguccuucucacucgaggcuccaggacuucgaauuucaccagccgccccucaccccacaccuccccggaccagugcggcggagcggggucgguuuccaggcgcgcguaccuggacucgcgccucugugaggucgaucuucagggccagcuccucccgaguguagaugucgggguagugagucuccgcgaagacccuuuccagcucuuugagcugggcacuggugaaaguggugcggaugcgccgcugcuugcgcuucucguugaggccgccgugguccgugaagaguuuguaaggaacuagaguaugacagaggagacagaaagugagcaaaucagccggcagcucgccggccguggagcuagaaugugaggacuccaaggucaggucauacggcagccgcuaccuacacccgcgcgagagaguugccgagagaagcugcgggaagaaaccgaggaaauuuguuaucugcggaaaccugggcucaaacuucgggcuuggcggaguccuuucuggcacaagcgccuuuggguggauugaaacagcgcgaugugacggacuugagauagugcuuucagcaggaaaaaaccagagaggaaaaaaauccaaaaacaucagucggaauaucagggagccaggaaagaaguuaccaaacagu

SEQ ID NO: 20500 - RNA, 873 nt, Homo sapiens
acuguuugguaacuucuuuccuggcucccugauauuccgacugauguuuuuggauuuuuuuccucucugguuuuuuccugcugaaagcacuaucucaaguccgucacaucgcgcuguuucaauccacccaaaggcgcuugugccagaaaggacuccgccaagcccgaaguuugagcccagguuuccgcagauaacaaauuuccucgguuucuucccgcagcuucucucggcaacucucucgcgcggguguagguagcggcugccguaugaccugaccuuggaguccucacauucuagcuccacggccggcgagcugccggcugauuugcucacuuucugucuccucugucauacucuaguuccuuacaaacucuucacggaccacggcggccucaacgagaagcgcaagcagcggcgcauccgcaccacuuucaccagugcccagcucaaagagcuggaaagggucuucgcggagacucacuaccccgacaucuacacucgggaggagcuggcccugaagaucgaccucacagaggcgcgaguccagguacgcgcgccuggaaaccgaccccgcuccgccgcacugguccggggagguguggggugaggggcggcuggugaaauucgaaguccuggagccucgagugagaaggaccuagggccccauggccgaucagaaauacuggauuugguguggcugugcguucgagagaggcuuagagcgcacgcucuuggcauuuuauuuacaguugcgaaguguuucccacccgagcagagacauggggggccuugggacguggaugagcgaugcaauuucggggacaggaagugccugugguggaaggugugcagacuuugcucccguauuauaag

SEQ ID NO: 20501 - RNA, 3471 nt, Homo sapiens
uacuaccagcagagccuaguuuuaugaaaaagccuccuaugagaugccuugucugaggucucuagagcauauaguccucauaauaaacuuggcucuuuccacuuggacaauagcaaagcgguuggucuuauugcuggcgcuuuuuacaugacaauaacucauccgucuauugggcuggcacuggggaacugagcuguccaaccucccuaucauugauuccugcaucucuaauuagaauuuaauaccacaccauuacgcaccgagccccugauccucccuucuaaccagcucccugcccuuuaauucaaucacacuacuuggaaauaaugaaaguugggugacgauucucccugauccaauuuccccgagcuuuuaagccuuuuuaacugaucauauaccuuaggcauaaauugagauaguguguguguuuucccccuucuucguccucuucuuuuuuucccccucgguuagggagaagaaaccuugaugucauagaaaaccuguuuuguaagaguguuacacgcucaauuuaacaacaagccuaccccccgaagugcaugaaauguuauaaaggacugggacauuggcaagacucaggcgcccuguaacauagaguaagugggccaaggggguuuaugugaacgauaagcggauuucuuuaaaaauacaccugguagaggggguuaaaaaaaagagagacagagagaaagcaucuuauaaauugcauuucuucuugcagcuaaaugugcuuucaagagacucaggguauacagccacuuaaaaauaauaauaaaaaaaucugaggaaagcuuucgaaugugaaacaucuggauucucgaccguuguguucuuugcucucaguucugucuguuugcauuagcgcaagccuugguugguuugaguuucugugagguuguucguuuuaauuacaccauaacuggcaagcgagcaugaaguguacccaaauguaucuccucuuucaucucuuucgggcgcucucccucuuucucgccucuuuuuuuuuuucaggugcccacaauccuccacagacccggggauugugucuguuugccuuuuagguuugcggacuguagugagggaaauucuugccauguaaaugcccaggcaagggcuccaggucgggcaccuuucuuguccgauuccucaggcuuuugggugcuggcagcgaggcacagacaaaggagcgagcagugauuuguggacuucaguggccccaugauuuaagcggaggguaauuuucauuugguuuguuaggcccuagcagaauaagggaaacuauuucauuaaauccuuccucucgguggacaagagggggaaagcuuagcugaaucgccgugugguguaaacaaacccuggauauuuuauaugaauuaaauguguagauaauuaguuuuauugcauucauuacccccuuuaugugcucuguaacaagucaguaauuaaaguaacaaacucauaaagucuuuauaggggcauuuaggcguucaguguuugccaaacuaagugguuuaauucgaugcuagugccggggaguggaugggcucccgcucuccccugccaccguguuuuauugcgcacuaaacugccgcggacgcaguaauggauuaaacggggacagcggucccccagccuugugcuucuuugcagggugaguuucaggcucguuucaggugguugcaaauccucggggcgugaggaagcgcuaaagucgggagugcagggagccggaccuaccgaggauccuggugauaguuuuauggggagggcugauaguuuuauugcaguuguauguuguacaaugcguauuugauaaagaagggcccuuggugaccagugugcacuuuuuugugcacgggggugaaaugaaaauaaauguauacaagguuuuacugcggcgggaaacaaauugcaacgcucuaaaugguuuuucuuuauggucaccagacaagaggagaaaagggaugcaaacaucugucuucaguccccuaaaccuaaaggccagcaaagacggaugcgaauccaagugcuauuacagcggagauuugucuuuauuuaucccgcucucaugaauaugaauuugcauuugggccgggagguggcuguaucccuuuggacuccacacauggaauuucccccacgcucaucccccuccccaaccacuuaagggaggugggggauagguugucaagcacaaggcugagaucguccaaguuucuucguucccucggauuucggguugggggaugugcuugcugguuuucugaacgcaacucugccgccgaggccugcacucaggagauguggauguagggagcacaggccgggguguccaccgccagcccgcuccucugcuguaggguuuaagcgcguuucccugcagaagagagugaccagggguggucaggaggugaugaauuucggcuccaaggccuauuuuugacaguaaccagguucacaccccgcuuggcacuagagccuuacugcaccuggggugugucuccgcguggugcagagcgcgcgcucuacuccggaagcuacggccgggugccgcgccaccgcugugcgcccugggccugaucccuacgcccuagucgagugcagggcagggcaauuucgccguggguccuaguuugcugacaguucccaggccccuuuagcuuuuggggaggaggcgagacuaggaccuaaaaagugcugggagcucggaguagagggguucauguugccaguuucugaggauugcucuuaggugaagauguggaacuuggaaauuuagguggugcacagaggcacuuccugagcgaaagggaguguugggguggggaguucagugggcaccucaggggaccuggaugcugacggggcaucagagggugucaaaaggagaagcuaagggaucugggcgaggucucagccgaagggcgcuggcaagggaagugcuuggccggggagggugcccggggggcggucaaggggcaggcccggggcucugucccucccgguccuggggucccuucccgucccgcgguuccggaacgccucgccagcccucucugggcgcccccugcugccgggcgcccccugcugccggccgccccgggucggggugccgugagccuucucgccuuuguaccaggagaccuuucagcgccgggcccacacggucggaugagcaaaugcgcuugacuucauuuuccccuuuguagaccuuguagguuuauuuuguucagugucaccaucccucccccaccaccccuggccuaucgucccucugcccgucuuuuguggcccgggguccugcuucugcuuggagaugaaaggcgugcggggcugggccaggccagagccccagccccagcgcccuguuuuguuccaguugugcuuucuacacgcgagcucuccccuaaaaguuguacuaaaugguuaauuuaauuauuccaacuauagacc

SEQ ID NO: 20502 - RNA, 3471 nt, Homo sapiens
ggucuauaguuggaauaauuaaauuaaccauuuaguacaacuuuuaggggagagcucgcguguagaaagcacaacuggaacaaaacagggcgcuggggcuggggcucuggccuggcccagccccgcacgccuuucaucuccaagcagaagcaggaccccgggccacaaaagacgggcagagggacgauaggccagggguggugggggagggauggugacacugaacaaaauaaaccuacaaggucuacaaaggggaaaaugaagucaagcgcauuugcucauccgaccgugugggcccggcgcugaaaggucuccugguacaaaggcgagaaggcucacggcaccccgacccggggcggccggcagcagggggcgcccggcagcagggggcgcccagagagggcuggcgaggcguuccggaaccgcgggacgggaagggaccccaggaccgggagggacagagccccgggccugccccuugaccgccccccgggcacccuccccggccaagcacuucccuugccagcgcccuucggcugagaccucgcccagaucccuuagcuucuccuuuugacacccucugaugccccgucagcauccagguccccugaggugcccacugaacuccccaccccaacacucccuuucgcucaggaagugccucugugcaccaccuaaauuuccaaguuccacaucuucaccuaagagcaauccucagaaacuggcaacaugaaccccucuacuccgagcucccagcacuuuuuagguccuagucucgccuccuccccaaaagcuaaaggggccugggaacugucagcaaacuaggacccacggcgaaauugcccugcccugcacucgacuagggcguagggaucaggcccagggcgcacagcgguggcgcggcacccggccguagcuuccggaguagagcgcgcgcucugcaccacgcggagacacaccccaggugcaguaaggcucuagugccaagcggggugugaaccugguuacugucaaaaauaggccuuggagccgaaauucaucaccuccugaccaccccuggucacucucuucugcagggaaacgcgcuuaaacccuacagcagaggagcgggcuggcgguggacaccccggccugugcucccuacauccacaucuccugagugcaggccucggcggcagaguugcguucagaaaaccagcaagcacaucccccaacccgaaauccgagggaacgaagaaacuuggacgaucucagccuugugcuugacaaccuaucccccaccucccuuaagugguuggggagggggaugagcgugggggaaauuccauguguggaguccaaagggauacagccaccucccggcccaaaugcaaauucauauucaugagagcgggauaaauaaagacaaaucuccgcuguaauagcacuuggauucgcauccgucuuugcuggccuuuagguuuaggggacugaagacagauguuugcaucccuuuucuccucuugucuggugaccauaaagaaaaaccauuuagagcguugcaauuuguuucccgccgcaguaaaaccuuguauacauuuauuuucauuucacccccgugcacaaaaaagugcacacuggucaccaagggcccuucuuuaucaaauacgcauuguacaacauacaacugcaauaaaacuaucagcccuccccauaaaacuaucaccaggauccucgguagguccggcucccugcacucccgacuuuagcgcuuccucacgccccgaggauuugcaaccaccugaaacgagccugaaacucacccugcaaagaagcacaaggcugggggaccgcuguccccguuuaauccauuacugcguccgcggcaguuuagugcgcaauaaaacacgguggcaggggagagcgggagcccauccacuccccggcacuagcaucgaauuaaaccacuuaguuuggcaaacacugaacgccuaaaugccccuauaaagacuuuaugaguuuguuacuuuaauuacugacuuguuacagagcacauaaaggggguaaugaaugcaauaaaacuaauuaucuacacauuuaauucauauaaaauauccaggguuuguuuacaccacacggcgauucagcuaagcuuucccccucuuguccaccgagaggaaggauuuaaugaaauaguuucccuuauucugcuagggccuaacaaaccaaaugaaaauuacccuccgcuuaaaucauggggccacugaaguccacaaaucacugcucgcuccuuugucugugccucgcugccagcacccaaaagccugaggaaucggacaagaaaggugcccgaccuggagcccuugccugggcauuuacauggcaagaauuucccucacuacaguccgcaaaccuaaaaggcaaacagacacaauccccgggucuguggaggauugugggcaccugaaaaaaaaaaagaggcgagaaagagggagagcgcccgaaagagaugaaagaggagauacauuuggguacacuucaugcucgcuugccaguuaugguguaauuaaaacgaacaaccucacagaaacucaaaccaaccaaggcuugcgcuaaugcaaacagacagaacugagagcaaagaacacaacggucgagaauccagauguuucacauucgaaagcuuuccucagauuuuuuuauuauuauuuuuaaguggcuguauacccugagucucuugaaagcacauuuagcugcaagaagaaaugcaauuuauaagaugcuuucucucugucucucuuuuuuuuaacccccucuaccagguguauuuuuaaagaaauccgcuuaucguucacauaaacccccuuggcccacuuacucuauguuacagggcgccugagucuugccaaugucccaguccuuuauaacauuucaugcacuucgggggguaggcuuguuguuaaauugagcguguaacacucuuacaaaacagguuuucuaugacaucaagguuucuucucccuaaccgagggggaaaaaaagaagaggacgaagaagggggaaaacacacacacuaucucaauuuaugccuaagguauaugaucaguuaaaaaggcuuaaaagcucggggaaauuggaucagggagaaucgucacccaacuuucauuauuuccaaguagugugauugaauuaaagggcagggagcugguuagaagggaggaucaggggcucggugcguaauggugugguauuaaauucuaauuagagaugcaggaaucaaugauagggagguuggacagcucaguuccccagugccagcccaauagacggaugaguuauugucauguaaaaagcgccagcaauaagaccaaccgcuuugcuauuguccaaguggaaagagccaaguuuauuaugaggacuauaugcucuagagaccucagacaaggcaucucauaggaggcuuuuucauaaaacuaggcucugcugguagua

SEQ ID NO: 20503 - RNA, 661 nt, Homo sapiens
cagccgcgcggcccgugucccggguccuucgggcuccuugugcgcgcugcucgcgcugcugcuccugcugacgccgccggggccccucgccagcggugagagcuccuggcacuggggugcaucccagccucugcggggccgcugcguuccagggaacucucccagcaaccugcccuauaaaaaugucuuucuuccccagcugguccugucucugcugugcugacagagcugcguugcacuuguuuacgcguuacgcugagaguaaaccccaaaacgauugguaaacugcagguguuccccgcaggcccgcagugcuccaagguggaagugguguaaguucuccuguguugcuguguccacugugacuuaggcaaguccuccagccugggucgucaaccuuuguggcucaugggugcauccucuuuuucuuuacuucagagccucccugaagaacgggaagcaaguuugucuggacccggaagccccuuuucuaaagaaagucauccagaaaauuuuggacagguauuugucccuuugaucuuugugguguuuuaauaucuucuauggaaagcauauacuucacaauguccuuauucucucuguaggauuuagacuaugcuuagaauuauaagguuguuaagaagaauaaggaaacuuuuuu

SEQ ID NO: 20504 - RNA, 661 nt, Homo sapiens
aaaaaaguuuccuuauucuucuuaacaaccuuauaauucuaagcauagucuaaauccuacagagagaauaaggacauugugaaguauaugcuuuccauagaagauauuaaaacaccacaaagaucaaagggacaaauaccuguccaaaauuuucuggaugacuuucuuuagaaaaggggcuuccggguccagacaaacuugcuucccguucuucagggaggcucugaaguaaagaaaaagaggaugcacccaugagccacaaagguugacgacccaggcuggaggacuugccuaagucacaguggacacagcaacacaggagaacuuacaccacuuccaccuuggagcacugcgggccugcggggaacaccugcaguuuaccaaucguuuugggguuuacucucagcguaacgcguaaacaagugcaacgcagcucugucagcacagcagagacaggaccagcuggggaagaaagacauuuuuauagggcagguugcugggagaguucccuggaacgcagcggccccgcagaggcugggaugcaccccagugccaggagcucucaccgcuggcgaggggccccggcggcgucagcaggagcagcagcgcgagcagcgcgcacaaggagcccgaaggacccgggacacgggccgcgcggcug

SEQ ID NO: 20505 - RNA, 1089 nt, Homo sapiens
cccaauccaaagaccacucgugcccuggcagccuacaccuccucauuaacacaaagcacugcagugaacuccccugacacaucgccucacuaacucucacggcucugcauccacaucucuacuccagagaacuguuuccagcuaacucggcuaacgagggcucccugcaggaacaaagccacacaccacugcccuauggccccaccacagcagcaccacgcaacccaaauccaugugcggcugccuucaugucagaccuccaccagcaucagccacugccgaguaguauuuugaaaagaaaugugcagaucugaagcaaaacacacagggccuccuuggaauucugauccggcguggcaagccaggagcuugaaacagcuucuuuaugcuagaucucagcacagaaaggcacagcccccccuguuucccuacaaaccacgcaaacgcucuaaucagaccucugcaugacaccucucggaggcugccacagaacugucucaaagcugugccaaugaguuugacuugauuacagacuccgaacuaggggaaacccuggcuuuuuugcucaggaguucagagguuuccuucuacugagccuguuuccccagcagcacagccucaaacuguagaccuauauugugacuacggagcugcuuuuaaagggcaggcucccaggugccugggacucuugagggaaaggccugagggaaccacugaugaccucuuuguggccuuucucacccuuccaauggcaucccuagagugacagccuccuuaaaccaccccaaaguuccaguuugagccacagcucugcaugccccuccaugccuacccagacaccucuucucuuuccucauauuuuuggaucuccuaacuuuucucaggccuucagggacaugauaggcaguggccagugucccucgcccucaaguaauucuguguucucugagguccccucucuugacccccagacuccaaaccgcuugcucuccugagucccucccuggcgguacuggccagaggccagaggaguggguuuggcgccaccugcucggagcgccccuccuugacccccgcaaaucuccagga

SEQ ID NO: 20506 - RNA, 1089 nt, Homo sapiens
uccuggagauuugcgggggucaaggaggggcgcuccgagcagguggcgccaaacccacuccucuggccucuggccaguaccgccagggagggacucaggagagcaagcgguuuggagucugggggucaagagaggggaccucagagaacacagaauuacuugagggcgagggacacuggccacugccuaucaugucccugaaggccugagaaaaguuaggagauccaaaaauaugaggaaagagaagaggugucuggguaggcauggaggggcaugcagagcuguggcucaaacuggaacuuuggggugguuuaaggaggcugucacucuagggaugccauuggaagggugagaaaggccacaaagaggucaucagugguucccucaggccuuucccucaagagucccaggcaccugggagccugcccuuuaaaagcagcuccguagucacaauauaggucuacaguuugaggcugugcugcuggggaaacaggcucaguagaaggaaaccucugaacuccugagcaaaaaagccaggguuuccccuaguucggagucuguaaucaagucaaacucauuggcacagcuuugagacaguucuguggcagccuccgagaggugucaugcagaggucugauuagagcguuugcgugguuuguagggaaacagggggggcugugccuuucugugcugagaucuagcauaaagaagcuguuucaagcuccuggcuugccacgccggaucagaauuccaaggaggcccuguguguuuugcuucagaucugcacauuucuuuucaaaauacuacucggcaguggcugaugcugguggaggucugacaugaaggcagccgcacauggauuuggguugcguggugcugcugugguggggccauagggcagugguguguggcuuuguuccugcagggagcccucguuagccgaguuagcuggaaacaguucucuggaguagagauguggaugcagagccgugagaguuagugaggcgaugugucaggggaguucacugcagugcuuuguguuaaugaggagguguaggcugccagggcacgaguggucuuuggauuggg

SEQ ID NO: 20507 - RNA, 3331 nt, Homo sapiens
gcaggguaaacauacucgccuugggaggaaggagcuggggucgcuuuccccggaccccuccucccucccgggguccgcggcggugggcgccugggggaagagugggggccuggggggugggcaccguccccgccccccagccccuuggcucgcgguguucagccgggcugcugcguaaaccgccgcuuucccgaugcagauuucccuuuuaacaccuucuaaacaaaggcuaaugaggccacugcaucacucuaucaacacacaaucauuagcaagcgagaaauacacgcgcaggcacacacacacacacgcgcacacacacacgcaggcacacacacacacacgcagcgcuggggcugccaaagucgggccaauucuaaaguaacccguauuaggcuaacaaaaaggaggugggauauggaggggcgggagagaggcugggagagaauggagagagagaaggggagagcguguucucuugauaccgaaaaaaaggccaagagaaaagaaagaggaagcagacccagacugaaagauggcucugcugguuggagcgagaucauuagaaaguccgggguucuauuuuggaggauggggucccugcaaagcucuucuucuuggggcacaggagcuggaguggggcugcagcugucuucuuagaaauagcucccaaggccugguucauggccucuaccaucagauagucucaguggggccagaggggcaagacuacagccucucacgaccaaguacugccugcccugagaccccaaaaguccagggccagccuccaggcccaaccaucuaugcgaggaugaagagaagccugacugugcucagugcccagcugggacccacugcuccuccagugcaacuggcagccuggaauccaagcuucacccauggggaagugggccgcucuguguuaaguacagggcuuuccucucagaacaaaaaaaaagucaguguuucccuuacagguuggaggacuggcuugcugcuuuccuucugucucucccaggcccccuucuggcccccagggaucagccccagacuucacccucccagcaacuaaguguguuuugcccggggaaggagcacccagcaggagaaaguagccuguuuuugcuugccagauagcccaaggugugggaccucuaggggaggggugcauuccaggagaggggcuugcaguaaggaaggagggaaacccacgcccugcugcagcuccagagggaccucugagcugacuggcacucaccagcgcacacacucacuccagagagaccucugagcuggccggcacucaccagcgcacacacucacuuggaggcuggaucucagccacugcccucuccaccugcuccaaccaccaagauccagggccuguccccugagggguaguaggcccaguggacuuccacuagcuagggccccugaugcuacagccccagaagucugacucagaguuggcccaccccugccgggucccacaggaagcccccuuaaaguuccagcccggauauuggacugggguuuaguuuagacucagagcccugcuuuccugugcuggggggugaaugcagaggaagauugggcagggagaaaacuuggugggagaugccauuguuuaauucccacuuccugcagcucuccaaaggaaggaaggaaggaagaagggagggagggagggaaggaagaaagggagggagggagggagggagggaaggaaggaaggaagaaaggaaggaaggaaggaagaagggagggagggagggaaggaagaaagggagggagggaggaagggagggagggaaggaaggaaggauguaaggaaggaaggaagggagggagggagggagggagggaaggaaggaagaaacgaaaaggaaaagaaagggaagggggagggagggagggaaggaggagagaagagagggaggaggaauucccugccuuuuugauuaaacgucccgggucgggccugcccaguuaacgagaccguuaauuaagccgagcacgauucaacugacaggaaggcccugcgccccgcagagauguucuggaaaccaagcaauccacggccuagcgccaguggggcacaccagccacgacgcccccgccucccaggguuccacccaggccaggacacucuccccgccugggcuccgggccgcucucagacggccacccccaaggguuccccagaaaauucaccaccaccccccacccaccccacucccacccccgccaucccucucgcaucccugcccggaugucuaggccugagcacccauugcaccccgccggcguccucucuggcccgccugggagcgcgcggucccgagguucucgggcaaacccgaacugcggagggcagaggcugggcucgcugggucucgccggagcgccacaccagccgcucuccuccggccuccagacagcggggcucagccuucacgcccgcuccuacucgggggcccgauuccuuccggcggcgggcggugcucugcggcgcugcgggacgcugagugugugugcgaggcgcggccuauauuuacaccccaaacaaaauaauuacacuuuugucggagggagaaagccagugauuaggcguaggcucuuugcggcaaaacaguuucucagugguacaccaguauaauuuuucacggcuggcugaaaucaaagaggggagguaaugaauccggcgagcaauuuaaauuuacaauuuguaacgccgccgccgccgcgcagacccggccgagagcgcagcucggaggcgcucgcugcguuuguuuaauguuaaagccgcgcuggcucuuggggguggggugggggaaguaugcguguuggggugggagcgguaaugaucgaagucgggagaggacgggcugggucgcacaagaugccaccaagagaagugggcaaagcgcgcgccucuccgguccccccagccaccugggcccccagagcgcgcguuucccaauaaagcugccacucccggccguucgaaggagaggaugcuuuaagaggagccaggagagacacuggcugccagagaagacccccuuuccugcuuggcugcagaaucucccaggccggaggcuuuccggugaggaauagggaggugcaacugaaacgaccucuucaacccgcgggugggucagcuccaaaccucuggaagcgcccucauuccggccgcugcccggugucccgggcuggagaacucaagagagguaugccccacgccccagcucagcgcuccccaaaacucccaccccaggcuagugugcgccuccucgccaguaauuaauuaccgaacucaaggggg

SEQ ID NO: 20508 - RNA, 3331 nt, Homo sapiens
cccccuugaguucgguaauuaauuacuggcgaggaggcgcacacuagccuggggugggaguuuuggggagcgcugagcuggggcguggggcauaccucucuugaguucuccagcccgggacaccgggcagcggccggaaugagggcgcuuccagagguuuggagcugacccacccgcggguugaagaggucguuucaguugcaccucccuauuccucaccggaaagccuccggccugggagauucugcagccaagcaggaaagggggucuucucuggcagccagugucucuccuggcuccucuuaaagcauccucuccuucgaacggccgggaguggcagcuuuauugggaaacgcgcgcucugggggcccagguggcuggggggaccggagaggcgcgcgcuuugcccacuucucuugguggcaucuugugcgacccagcccguccucucccgacuucgaucauuaccgcucccaccccaacacgcauacuucccccaccccacccccaagagccagcgcggcuuuaacauuaaacaaacgcagcgagcgccuccgagcugcgcucucggccgggucugcgcggcggcggcggcguuacaaauuguaaauuuaaauugcucgccggauucauuaccuccccucuuugauuucagccagccgugaaaaauuauacugguguaccacugagaaacuguuuugccgcaaagagccuacgccuaaucacuggcuuucucccuccgacaaaaguguaauuauuuuguuugggguguaaauauaggccgcgccucgcacacacacucagcgucccgcagcgccgcagagcaccgcccgccgccggaaggaaucgggcccccgaguaggagcgggcgugaaggcugagccccgcugucuggaggccggaggagagcggcugguguggcgcuccggcgagacccagcgagcccagccucugcccuccgcaguucggguuugcccgagaaccucgggaccgcgcgcucccaggcgggccagagaggacgccggcggggugcaaugggugcucaggccuagacauccgggcagggaugcgagagggauggcgggggugggagugggguggguggggggugguggugaauuuucuggggaacccuuggggguggccgucugagagcggcccggagcccaggcggggagaguguccuggccuggguggaacccugggaggcgggggcgucguggcuggugugccccacuggcgcuaggccguggauugcuugguuuccagaacaucucugcggggcgcagggccuuccugucaguugaaucgugcucggcuuaauuaacggucucguuaacugggcaggcccgacccgggacguuuaaucaaaaaggcagggaauuccuccucccucucuucucuccuccuucccucccucccucccccuucccuuucuuuuccuuuucguuucuuccuuccuucccucccucccucccucccucccuuccuuccuuccuuacauccuuccuuccuucccucccucccuuccucccucccucccuuucuuccuucccucccucccucccuucuuccuuccuuccuuccuuucuuccuuccuuccuucccucccucccucccucccucccuuucuuccuucccucccucccucccuucuuccuuccuuccuuccuuuggagagcugcaggaagugggaauuaaacaauggcaucucccaccaaguuuucucccugcccaaucuuccucugcauucaccccccagcacaggaaagcagggcucugagucuaaacuaaaccccaguccaauauccgggcuggaacuuuaagggggcuuccugugggacccggcaggggugggccaacucugagucagacuucuggggcuguagcaucaggggcccuagcuaguggaaguccacugggccuacuaccccucaggggacaggcccuggaucuuggugguuggagcagguggagagggcaguggcugagauccagccuccaagugagugugugcgcuggugagugccggccagcucagaggucucucuggagugagugugugcgcuggugagugccagucagcucagaggucccucuggagcugcagcagggcguggguuucccuccuuccuuacugcaagccccucuccuggaaugcaccccuccccuagaggucccacaccuugggcuaucuggcaagcaaaaacaggcuacuuucuccugcugggugcuccuuccccgggcaaaacacacuuaguugcugggagggugaagucuggggcugaucccugggggccagaagggggccugggagagacagaaggaaagcagcaagccaguccuccaaccuguaagggaaacacugacuuuuuuuuuguucugagaggaaagcccuguacuuaacacagagcggcccacuuccccaugggugaagcuuggauuccaggcugccaguugcacuggaggagcagugggucccagcugggcacugagcacagucaggcuucucuucauccucgcauagaugguugggccuggaggcuggcccuggacuuuuggggucucagggcaggcaguacuuggucgugagaggcuguagucuugccccucuggccccacugagacuaucugaugguagaggccaugaaccaggccuugggagcuauuucuaagaagacagcugcagccccacuccagcuccugugccccaagaagaagagcuuugcagggaccccauccuccaaaauagaaccccggacuuucuaaugaucucgcuccaaccagcagagccaucuuucagucugggucugcuuccucuuucuuuucucuuggccuuuuuuucgguaucaagagaacacgcucuccccuucucucucuccauucucucccagccucucucccgccccuccauaucccaccuccuuuuuguuagccuaauacggguuacuuuagaauuggcccgacuuuggcagccccagcgcugcgugugugugugugugccugcgugugugugugcgcgugugugugugugugccugcgcguguauuucucgcuugcuaaugauuguguguugauagagugaugcaguggccucauuagccuuuguuuagaagguguuaaaagggaaaucugcaucgggaaagcggcgguuuacgcagcagcccggcugaacaccgcgagccaaggggcuggggggcggggacggugcccaccccccaggcccccacucuucccccaggcgcccaccgccgcggaccccgggagggaggagggguccggggaaagcgaccccagcuccuuccucccaaggcgaguauguuuacccugc

SEQ ID NO: 20509 - RNA, 580 nt, Homo sapiens
gacaaggaccuggcccucagccuccuuccccuccaccccaggucggccaggcuggcccugccuugcccugguacagugcugagccgggggcgcggggagagccuuccucacuccacacccaguagcuguccccagcucagcuuagaaacccugccugggggcagcgacguggccucuuccuacagcccccuccccuguuccgcagccgggacucgcgucuccuguggacccggaagauuuagagcacacgucguggggucagcgcccccccgcuggggcggccgggugaacucccgcuggguucguugguuccuucugaggcuccugccccaccgcugccuucaauggacuccuacccagggagucgggccaggagccgaggccuccccgccccacacaaguacucggccuggcccucguccgcggacagucucccagugggguccuggcagggccccucgcccagcgcaguggacauucaggagcuccaaaaccuugggguccaagcaagucagcgcagguguauuucaggcagucgaggcauauggaggggccacuuggguggcacccgcagccccug

SEQ ID NO: 20510 - RNA, 580 nt, Homo sapiens
caggggcugcgggugccacccaaguggccccuccauaugccucgacugccugaaauacaccugcgcugacuugcuuggaccccaagguuuuggagcuccugaauguccacugcgcugggcgaggggcccugccaggaccccacugggagacuguccgcggacgagggccaggccgaguacuuguguggggcggggaggccucggcuccuggcccgacucccuggguaggaguccauugaaggcagcgguggggcaggagccucagaaggaaccaacgaacccagcgggaguucacccggccgccccagcgggggggcgcugaccccacgacgugugcucuaaaucuuccggguccacaggagacgcgagucccggcugcggaacaggggagggggcuguaggaagaggccacgucgcugcccccaggcaggguuucuaagcugagcuggggacagcuacuggguguggagugaggaaggcucuccccgcgcccccggcucagcacuguaccagggcaaggcagggccagccuggccgaccugggguggaggggaaggaggcugagggccagguccuuguc

SEQ ID NO: 20511 - RNA, 834 nt, Homo sapiens
cugaguggccagaaaugaaaucgggaguagccccuuuccacugaaaaaugaaauccaaacuccuuccgccggcggcuucaggcucccgggaccuggcucggaaaagugaccggcggcgguggcgcgcugcgccccagcccggacucugccucggcggcugccggguccucccgaaaccggggagggcuccucggcugcgcccagacggcguaaauacaaaccuccuauuuuauuccuaggcgucaaaugcuccgggguuuaaaaccgugaagccuugccacaaacgguccgaagugucucccaaaacacucuggcacuaucugauccgcaaaguuuaauauuuaaccuuuuggagaccucgccucccuuuuccgaguuugguuuuuccugagcucgccuugaaccgccgacggaaugguguuuuucugggggugggaggagggaggguccaaagcggguuuauuauuuuuaaagaggcucgugguccccccccuuucuccccccggggggcacugugagucccagagcucgaguccgaggacccgagacguggcauucucgccuaaggacuggaaagaauccuacaaaacaagcuuugguuucauuuuccaacgcccuggccugagcuccugcagcccgaggaccuggccuggcgugggggauuugggggaugucaagaggggaaggaaagggaucaagggucucgcuccuacucuagcuuccccccccacaaccaccccccaaaauaaccuacaaagaaagccuuugcaacgcgggccugccaaggggcgccucccccaccuuuggguaaaucccccuguaguuccagguuaa

SEQ ID NO: 20512 - RNA, 834 nt, Homo sapiens
uuaaccuggaacuacagggggauuuacccaaaggugggggaggcgccccuuggcaggcccgcguugcaaaggcuuucuuuguagguuauuuuggggggugguuguggggggggaagcuagaguaggagcgagacccuugaucccuuuccuuccccucuugacaucccccaaaucccccacgccaggccagguccucgggcugcaggagcucaggccagggcguuggaaaaugaaaccaaagcuuguuuuguaggauucuuuccaguccuuaggcgagaaugccacgucucggguccucggacucgagcucugggacucacagugccccccggggggagaaaggggggggaccacgagccucuuuaaaaauaauaaacccgcuuuggacccucccuccucccacccccagaaaaacaccauuccgucggcgguucaaggcgagcucaggaaaaaccaaacucggaaaagggaggcgaggucuccaaaagguuaaauauuaaacuuugcggaucagauagugccagaguguuuugggagacacuucggaccguuuguggcaaggcuucacgguuuuaaaccccggagcauuugacgccuaggaauaaaauaggagguuuguauuuacgccgucugggcgcagccgaggagcccuccccgguuucgggaggacccggcagccgccgaggcagaguccgggcuggggcgcagcgcgccaccgccgccggucacuuuuccgagccaggucccgggagccugaagccgccggcggaaggaguuuggauuucauuuuucaguggaaaggggcuacucccgauuucauuucuggccacucag

SEQ ID NO: 20513 - RNA, 531 nt, Homo sapiens
gucguggagcagcucagccgcucgcugcagacccucaaggaccgccuggagagccucgagguagcggcccgcggggagcgcgggggaccuggaauggggacgcucccgagucgggggcggaagacucgggaggauggggaaagggggccuggcccuggggagggugugaucguccgugggggugagcuggacuugagggugaaaggcggggaucuagauccugcucgggaacuccccugcgugguaucccuucccacaccgcugcucuugcuggaaggaaacguuuaaauuccacccccgcgcgucgggacugccagcgggauccgccgagcacuucccgagguccgggcuagcgaacccagacggccaagccgcgggcgccaaauacccggggacgcgguagccucuauccucuugcaaaucuccaaaucuccgcgagccgggaugcgcucccgcaggccgugcggguugcugcgaggcugccgcgggaggucagcugccccgggcaugugguguuucuuucuuuaaauc

SEQ ID NO: 20514 - RNA, 531 nt, Homo sapiens
gauuuaaagaaagaaacaccacaugcccggggcagcugaccucccgcggcagccucgcagcaacccgcacggccugcgggagcgcaucccggcucgcggagauuuggagauuugcaagaggauagaggcuaccgcguccccggguauuuggcgcccgcggcuuggccgucuggguucgcuagcccggaccucgggaagugcucggcggaucccgcuggcagucccgacgcgcggggguggaauuuaaacguuuccuuccagcaagagcagcggugugggaagggauaccacgcaggggaguucccgagcaggaucuagauccccgccuuucacccucaaguccagcucacccccacggacgaucacacccuccccagggccaggcccccuuuccccauccucccgagucuuccgcccccgacucgggagcguccccauuccaggucccccgcgcuccccgcgggccgcuaccucgaggcucuccaggcgguccuugagggucugcagcgagcggcugagcugcuccacgac

SEQ ID NO: 20515 - RNA, 1181 nt, Homo sapiens
gaugcgcgucaccgaccgcaaauucccucggacuggugcaaaguggaaggggggaggaacccucuccccagaggcagggaccgaggcgggagcggagagguugggcagagccgagcagccggugccuggcgcagcgcugcagccgagcccacgugcccgccgcgguccgcagccugugcucggcggcccccggggcuccccgacugcggcggggaagauugggcgcggucccgccggagaaguugcacuggcuccgcggcucugccgccuugcugccccugugaguccccgaacucugucguuuggauccggggcguggggacugcagggagccacaaaccacccuccuagugcgcugggaucuuugaggcccugagaaaggcgcugaauccgcucggcacgcuggcaacucccgccagcgcacaggcgagcauuccauuaagaaccauuccauucuuaauuguggacugauuuccuuugucucugccuccaucuccuaggaugcucaggacccagucagcggcgggaucaagaaaaacaggcaggguuucaaugucaaccaaggcaauuagggagguuaacaaacagccuucaaaacaaaacacacagaaaauacaucccagaggauguugcgaaucauccgcucaauaguucuuguucuucaucgcauaauuuuucgaguugaaaauuauuauuauuuucuuugcaauaaguugaggauuggaaagcucuggaugccaguucugguucuucccuuacuuaacuagccguuugaccuccacaaaccucuguuuacucaucguaaaggaaagggauggaccaaaugguucauaaugucucucccaauucuaggaauuccacgcucuuaauuauuuuaauuauuuucuaauaaagcaugaaaauugacuguuuacucuuggccauacaguucuuuuccuuagauguugucuacaguacaauaauucuuuccccuaggguauggcagaaacuuuagaagugucuaccauggugcagccacuauggaaaacacuauagagguuucucaaaaaauuaaaaaaaauacgguccaacaauuccauuucuggccauguagccaaaagaauugaaagcagggucuugaagagaugucuguacacccguguugaaagcagcauuauucacaguagucaaaaggcagaagu

SEQ ID NO: 20516 - RNA, 1181 nt, Homo sapiens
acuucugccuuuugacuacugugaauaaugcugcuuucaacacggguguacagacaucucuucaagacccugcuuucaauucuuuuggcuacauggccagaaauggaauuguuggaccguauuuuuuuuaauuuuuugagaaaccucuauaguguuuuccauaguggcugcaccaugguagacacuucuaaaguuucugccauacccuaggggaaagaauuauuguacuguagacaacaucuaaggaaaagaacuguauggccaagaguaaacagucaauuuucaugcuuuauuagaaaauaauuaaaauaauuaagagcguggaauuccuagaauugggagagacauuaugaaccauuugguccaucccuuuccuuuacgaugaguaaacagagguuuguggaggucaaacggcuaguuaaguaagggaagaaccagaacuggcauccagagcuuuccaauccucaacuuauugcaaagaaaauaauaauaauuuucaacucgaaaaauuaugcgaugaagaacaagaacuauugagcggaugauucgcaacauccucugggauguauuuucuguguguuuuguuuugaaggcuguuuguuaaccucccuaauugccuugguugacauugaaacccugccuguuuuucuugaucccgccgcugacuggguccugagcauccuaggagauggaggcagagacaaaggaaaucaguccacaauuaagaauggaaugguucuuaauggaaugcucgccugugcgcuggcgggaguugccagcgugccgagcggauucagcgccuuucucagggccucaaagaucccagcgcacuaggagggugguuuguggcucccugcaguccccacgccccggauccaaacgacagaguucggggacucacaggggcagcaaggcggcagagccgcggagccagugcaacuucuccggcgggaccgcgcccaaucuuccccgccgcagucggggagccccgggggccgccgagcacaggcugcggaccgcggcgggcacgugggcucggcugcagcgcugcgccaggcaccggcugcucggcucugcccaaccucuccgcucccgccucggucccugccucuggggagaggguuccuccccccuuccacuuugcaccaguccgagggaauuugcggucggugacgcgcauc

SEQ ID NO: 20517 - RNA, 1497 nt, Homo sapiens
ggccguccguccucgauucuccccuccccucccuuucuucuucccucccagcuuggccaguucagcaucagcaucccgcacccccucgguaaucccguacucccucuagcggcgggccacugcagcguggccaccgcccccacccccaucccccauccccgcaccccccuccacccccuagcccgcggagcacgcugggauuuggcgccccccuccucggugcaaccuauauaaggcucacagucugcgcuccugguacacgcgcuucaacuucgguuggugugugucgaagaaaccugacugcgcccugaggagaacagcggagaagguccaccgagccuggcgaaagguccgcugagcgggcugucguccggagccacuccgggcugcggagcacccaguggagaccgcgccuggcucaggugugggaccccauccuuccugucuucgcagaggaguccucgcguggugaguaugcggugaggacguuuuuuuuuuaaagaucacguucauuccccgugcuuaucgggagcugcgggagauggaguagcaccccagaaugucuccacgcaaaacuugucacgccuucacuggcuguaccccaaaacaaauggggaaaccaagccuuaaaggcuuggguuuccaggaccaaguccagauacgggcuguagacagagaugagcugcggacagugaugagcugcagacggucaggagcuauagaucgauuugcaauuugcucuucaaaugcgcuaccaagugccaugcuuuacaaacagauaagcgcuucaaaugcgcuacaaacuggcgcuucagaugcgcuacaagcacgcuucacgcgggcgacaaacugaugggagcuacaacuggcgcuucauugcgcuauaaacugaugggcgcuuuaugugccacaaacugacggaugggcgcuucaguggcgcuacaauccagaacgaggagcagcgauauaggagcugcagacagaaaacugaauugcgcuuuacaugcgcugcaaaaucugagcugcagaagaguagcacuacaaaaaacgcuacaaaaacgaugcgauuagccagcccgacaacagcgcuucauugcgcugcgaggcacaugaacugcagagguacaugagcugcggaacaauucacaccuaagaugcacuacaaagugguaagagcugcagagguacaggagcugcagaccguuugcgcuacaaauaaagcagccguagugggacaugagcugcggaguacaauuccucuguuuucuuggagcaggaccccacccuuucaccuuuuggaauggcucccacucuauuuuucugcaggacgguucucgcaugauggugcugguagacaaaauggagccccgggcaaaaauuaguguuuaacauucugcccacaccauucccgcuauagcaguggaguggaggggcacugauuggaguggaaaugggaaucuuuuggugauggcagagcaggcugccugccuacuugug

SEQ ID NO: 20518 - RNA, 1497 nt, Homo sapiens
cacaaguaggcaggcagccugcucugccaucaccaaaagauucccauuuccacuccaaucagugccccuccacuccacugcuauagcgggaauggugugggcagaauguuaaacacuaauuuuugcccggggcuccauuuugucuaccagcaccaucaugcgagaaccguccugcagaaaaauagagugggagccauuccaaaaggugaaagggugggguccugcuccaagaaaacagaggaauuguacuccgcagcucaugucccacuacggcugcuuuauuuguagcgcaaacggucugcagcuccuguaccucugcagcucuuaccacuuuguagugcaucuuaggugugaauuguuccgcagcucauguaccucugcaguucaugugccucgcagcgcaaugaagcgcuguugucgggcuggcuaaucgcaucguuuuuguagcguuuuuuguagugcuacucuucugcagcucagauuuugcagcgcauguaaagcgcaauucaguuuucugucugcagcuccuauaucgcugcuccucguucuggauuguagcgccacugaagcgcccauccgucaguuuguggcacauaaagcgcccaucaguuuauagcgcaaugaagcgccaguuguagcucccaucaguuugucgcccgcgugaagcgugcuuguagcgcaucugaagcgccaguuuguagcgcauuugaagcgcuuaucuguuuguaaagcauggcacuugguagcgcauuugaagagcaaauugcaaaucgaucuauagcuccugaccgucugcagcucaucacuguccgcagcucaucucugucuacagcccguaucuggacuugguccuggaaacccaagccuuuaaggcuugguuuccccauuuguuuugggguacagccagugaaggcgugacaaguuuugcguggagacauucuggggugcuacuccaucucccgcagcucccgauaagcacggggaaugaacgugaucuuuaaaaaaaaaacguccucaccgcauacucaccacgcgaggacuccucugcgaagacaggaaggauggggucccacaccugagccaggcgcggucuccacugggugcuccgcagcccggaguggcuccggacgacagcccgcucagcggaccuuucgccaggcucgguggaccuucuccgcuguucuccucagggcgcagucagguuucuucgacacacaccaaccgaaguugaagcgcguguaccaggagcgcagacugugagccuuauauagguugcaccgaggaggggggcgccaaaucccagcgugcuccgcgggcuaggggguggaggggggugcggggaugggggaugggggugggggcgguggccacgcugcaguggcccgccgcuagagggaguacgggauuaccgagggggugcgggaugcugaugcugaacuggccaagcugggagggaagaagaaagggaggggaggggagaaucgaggacggacggcc

SEQ ID NO: 20519 - RNA, 695 nt, Homo sapiens
cccacgacacagcccguucauucauggagcugcagccgcggcuucucagucuucgcuggccggagucgccccuugcuccccgcugcccccagagaacugggggaagggaggcgggcggcugagcccccugcccugugagcucgccagcccuuccuuggcuaggacucugagaagaacugcguagcagccagggguagcgauugggaguggggguggaauucuugcuccuauuucugguaggagacccuaaggcauuugacagacuaguguaggagaaggggacuaggucagcuuuuucccaccccccugaaaaaagacugccccuuucucugccgacugugggugaggcaaucuagcugagcccugggaagccgguccaguagaauauagcaugguuuaauaucccuucccuucaagagcugccuccagacuccucaacccaccccucuccccgugugauuucuggcaggcucgcuugauaaacccucaucaccugcgcgugggcuguugcuuaagaacgaggaggucccagauuucucagcucucugguuucuaccacaccuauuucugaguauugucuuuugcccaguaaccugaaccucuuuaaauacgccauggaauacuugaaguccuggaaacgguuccuuuguaggcaaguuggaguccccauucuuugccaagaccuuucuguuauc

SEQ ID NO: 20520 - RNA, 695 nt, Homo sapiens
gauaacagaaaggucuuggcaaagaauggggacuccaacuugccuacaaaggaaccguuuccaggacuucaaguauuccauggcguauuuaaagagguucagguuacugggcaaaagacaauacucagaaauaggugugguagaaaccagagagcugagaaaucugggaccuccucguucuuaagcaacagcccacgcgcaggugaugaggguuuaucaagcgagccugccagaaaucacacggggagagggguggguugaggagucuggaggcagcucuugaagggaagggauauuaaaccaugcuauauucuacuggaccggcuucccagggcucagcuagauugccucacccacagucggcagagaaaggggcagucuuuuuucaggggggugggaaaaagcugaccuaguccccuucuccuacacuagucugucaaaugccuuagggucuccuaccagaaauaggagcaagaauuccacccccacucccaaucgcuaccccuggcugcuacgcaguucuucucagaguccuagccaaggaagggcuggcgagcucacagggcagggggcucagccgcccgccucccuucccccaguucucugggggcagcggggagcaaggggcgacuccggccagcgaagacugagaagccgcggcugcagcuccaugaaugaacgggcugugucguggg

SEQ ID NO: 20521 - RNA, 790 nt, Homo sapiens
guccgcgcccggcgcgccccgaggguggcgggagcggugccggcuacugcccccaagucuaggccuagacugggccccgcgccccccaggcaccugcgggcggcgggaugaagacuggaguagggcgggguccgcguccagcugcgccuggaaagcgagcucgggggggugccuacagcagggugcgcccggccggccugggacuuccaaagcgccucccacgccccgaucgguuuggggugcuggcgcccggggagcccagugacccaggcggcggagugggcagcgcugcggggggcgccggcucugcugcucucccucccccucgccaucgcccagaauggggguucccgggagccccgcuggaggcuggcuuggaccacagaggagcgaggcccgauccuuacuuucgaugcacucgcccuugcucuuaccgggccacccucacccuuucggaaaagagguugagguuaaagcguucaucccccgggaucuucaggccaauggcaggaacugugcaagaguuugggggaagauggugucagguagaggcugcgucccugggcucgcggccgggaauggcagacucucgucccccgagcagcggaaaaggauggggcgcaauaguuccugggcugguuuccucagguccugucccagaacuuaagaaggcaacaaugaagaggcuaaacguggaggaaaagugaggcuagcauggccgggaugcguggggagaugguugucuccggaccccgggaggggcgggagcggguaccugggagcagaggcu

SEQ ID NO: 20522 - RNA, 790 nt, Homo sapiens
agccucugcucccagguacccgcucccgccccucccgggguccggagacaaccaucuccccacgcaucccggccaugcuagccucacuuuuccuccacguuuagccucuucauuguugccuucuuaaguucugggacaggaccugaggaaaccagcccaggaacuauugcgccccauccuuuuccgcugcucgggggacgagagucugccauucccggccgcgagcccagggacgcagccucuaccugacaccaucuucccccaaacucuugcacaguuccugccauuggccugaagaucccgggggaugaacgcuuuaaccucaaccucuuuuccgaaagggugaggguggcccgguaagagcaagggcgagugcaucgaaaguaaggaucgggccucgcuccucugugguccaagccagccuccagcggggcucccgggaacccccauucugggcgauggcgagggggagggagagcagcagagccggcgccccccgcagcgcugcccacuccgccgccugggucacugggcuccccgggcgccagcaccccaaaccgaucggggcgugggaggcgcuuuggaagucccaggccggccgggcgcacccugcuguaggcacccccccgagcucgcuuuccaggcgcagcuggacgcggaccccgcccuacuccagucuucaucccgccgcccgcaggugccuggggggcgcggggcccagucuaggccuagacuugggggcaguagccggcaccgcucccgccacccucggggcgcgccgggcgcggac

SEQ ID NO: 20523 - RNA, 569 nt, Homo sapiens
gugggcagcugacccggaggggugggauuugggggucagggccuguacagggaaccccuuguccucucccugagcuggguguggguuugcaaggagacaugugacccagaccaacccugggagcagcagggcgccugcugucuggccacucuuacuaggacugcuguggcacuuccuccccuagugggucccuggugcccaugaauugcagcuccugggugguggugggggcacugucuccugggacuccagcauggcccuggggugagcugugggcuuaccccaccucagcagguccucuagggcugcccacuggaugcuucgcugccucacacaauuguagggacuuccucaggcuguuggauuuccccaccuuccggggcucagguccauugacuuaggucuagggcuccauacauuucacccagagacuccggagccuggcaggcagaccuguucugacaccgaacuuccaaagucaugggccuugauugggguggucugaauuagaccuagcccuuuucugggcagaagggagcuucuaggaggauggaugcuguucggguuag

SEQ ID NO: 20524 - RNA, 569 nt, Homo sapiens
cuaacccgaacagcauccauccuccuagaagcucccuucugcccagaaaagggcuaggucuaauucagaccaccccaaucaaggcccaugacuuuggaaguucggugucagaacaggucugccugccaggcuccggagucucugggugaaauguauggagcccuagaccuaagucaauggaccugagccccggaagguggggaaauccaacagccugaggaagucccuacaauugugugaggcagcgaagcauccagugggcagcccuagaggaccugcugaggugggguaagcccacagcucaccccagggccaugcuggagucccaggagacagugcccccaccaccacccaggagcugcaauucaugggcaccagggacccacuaggggaggaagugccacagcaguccuaguaagaguggccagacagcaggcgcccugcugcucccaggguuggucugggucacaugucuccuugcaaacccacacccagcucagggagaggacaagggguucccuguacaggcccugacccccaaaucccaccccuccgggucagcugcccac

SEQ ID NO: 20525 - RNA, 637 nt, Homo sapiens
ugcggcggagccgggucuggggggcgggaggugccgcgguaagaugggggcacccuuggaaagaacaggcucaggccugaguuuuggagagggcggggacagcacccgggagaguuggagggacagaucccgaaacuuugggggcagguuacgugcaggaugggacccucggucaugggaaaaggagggcaaggaaguugacgaagcgggucacaaagggccugagcuggugggugagcaaaggauggcggggaugaggggcccgugaggagguggcucuaagccacgggaaaagacauuuuguaagaagaggagaugcuccaccuauucuggaagcagggugccgggggauucaaggagguguugaagacccuggggaaauuggaguuggagaggaaaaggggagggaugacggaggaagagguuuagacauuuggagggaaggguagggggacaugaucgagugaaguuuugaaggaaaagaaaccucccuagugaugaauuauuaaaagguaaccagaaaguucuggaaaucuugauuugggagacaggaaugaagccuagagaacugugaucuugucuggcuuucacgggagauuucauucaguuugugcaucugaaaaaccggcccucugac

SEQ ID NO: 20526 - RNA, 637 nt, Homo sapiens
gucagagggccgguuuuucagaugcacaaacugaaugaaaucucccgugaaagccagacaagaucacaguucucuaggcuucauuccugucucccaaaucaagauuuccagaacuuucugguuaccuuuuaauaauucaucacuagggagguuucuuuuccuucaaaacuucacucgaucaugucccccuacccuucccuccaaaugucuaaaccucuuccuccgucaucccuccccuuuuccucuccaacuccaauuuccccagggucuucaacaccuccuugaaucccccggcacccugcuuccagaauagguggagcaucuccucuucuuacaaaaugucuuuucccguggcuuagagccaccuccucacgggccccucauccccgccauccuuugcucacccaccagcucaggcccuuugugacccgcuucgucaacuuccuugcccuccuuuucccaugaccgagggucccauccugcacguaaccugcccccaaaguuucgggaucugucccuccaacucucccgggugcuguccccgcccucuccaaaacucaggccugagccuguucuuuccaagggugcccccaucuuaccgcggcaccucccgccccccagacccggcuccgccgca

SEQ ID NO: 20527 - RNA, 3777 nt, Homo sapiens
cagcagaaucccuacccugucugugcuguccccgcaguccuccuggcccuagggugaucacaccaccucagcucuuccugcagacaugugcucaggugggcaaaagagaaugagaaaugcaccucucccguggggcugagcugacucuggcuguucccuaggggcuuaagaacaccuguucugguugaguuugcagccaucgccugucccccaaaagggaaagaguaacauuucaccuugaaaagaaacagggaggggauguuucugaggugcagguguuucaugagagacagguacauuuucuaaggugugucuaaaaugcagcccaauccuauucuacgagagagaaguucccguuugaacaaguucccguuugaacaagaggauucgaggggggucucaccaucguagccacgcacuaagaagcgauuguuuuagggacacggagguaggacccccacucagccaggugacucugggacuguggaagguccacuuacgacucuguaccugccccagcacgggcucaaggaguugagccugcacacauuacuuagaaaaaaccucugcaaacggguaaguacaucgcccgcgugggccguggcuggaggcuugucaccugcuucagggacuuccucgggagccucucgccugccucuuugccuggaauuaacgaauacacacuacagccccucauucccuccaacacgaaggaaagguguaaucagaucccgagagucccgcagaagcguggagccucgcggugcggucucccuuuucuuucccaugcaaacccacuuagcaccggcgcgccccuguuugcccgggcagaauccaccgcccacuccucccgaguggagaguggagacgaaucuacgcccaggcccugcaccugccgcgcugcggaguuuggagggggcguggauggugcaaggucagggcuccgugugugaccccggcggugauagggcugcucggggucggaccacgcggcgcgccgggcuucccugcagcucggccgggcagggggcacaugggcacggugggagucccggcggaacccaggccggccacucaccauucugggagggcgacggcgacggcgacggcgacgacggcagcagcggcggcguugacaacaguagcagcagcgccgagagcgccagcgcgcagcgcaucgugucgucgccucugggccgggagcagguggcugcggugccggcggaggauccgcgcguccgggcgguaggagcgugggcgccgcccggggaggccuguggguggcuccggaggccaggcuguggcccggggcucccgagucgcgcugcggcggcucuuccucccugccgcugcagcagagccgggcuggggcgcagagccaguggcagaggagcggcggcggcggcggcugcguccugggcggcgucugcgcggcugcggccccacuggcggcugcggcuacuccuggcccgucccgucagcgccggcccccgcccccgcccccgccccucccccucccccaggagcccgccagcggcggcggccgggccgggcggggccggggccggggcugggcgggcgcugggccgugaacaaugagcagaggaggaaacuccgcccuggagcgcgacgggcgggagggccggcggccuccgcgccuuggggggcugugugugcgcgggggccagggcggggggcuccugcggugcagccgggccccguccacaggugucccgaacagguguguccccccgagugcuucuaagugggcccggcgggaucccccagcacaccgccggggcccucgcacuacgagcaaauccggagcgggcggacccccagccuugcgugguaacugauaaccauucacggccucccgggcugcugcgcguucugcagcgaccccggagaagcucaucucccaccugccaagugcaauucaccugccuguggggcccccaucccgcacggcuucugagcggggucucucugcagcuaggugugcagcgggcaagcuggacuaauucacuccuucaccucuccaaggguagguuccuuaccugugaaauggagaugaugguuaaaaaacaacagcaacaacaauuucagggaugaaugugugccaggcuuuacauauauuaauucuuuuacucuucaugacaaccauauuuuuagccucauuuugcagacagggcaauugagucaaaaagagguuaagaaacuuccugaggccacauaacggguaaguggcaaaccugccucugagagaaguuuggagaaauaccgugcaccgugccuggaauauaguaauugcucugcaaggagugguuauuacucuuauuccugcuauauaaagaacagcuauaaagauuagggcuuuugggucaaaacaggcuggggcucaaaaccuaacugugccaaucuauuaauuguaaaacccuaggcaagcuauucucaguaccucauuucuuuuuaucuguaaaauagggauaauaacaccuaccucaggggguuguugggaaacuuaaaugugaucuuacaagauaauacuuagccuagggccaggaacacaaaagucucaaugaaugaaguaguucgcccuccaagugaggaucagagauauuugcacacugggggugggaguggguguuggagaauuccguaaacugaguuuauccggugaaagaacaaagaaguuccuuuccccucccccgcuccccuccuuuuuuccacccccaaagcugccugggagacgcagaccccaggcccgccugaagaggaggcacaucggcggagccgggaagcggagggggcgaggggugauuaaccuuggaacccggguacggcguaaauuuggcucacgugacuccgggguugcuaaucuggagucuaucugccagauggggcuggguggagggguuuucuccaggaucuagccgcgucccgggcacaggggacuccgugagccccucaagucggcugcaagcaggcgaugccugcagggcacugcgucccuggagccgcgaaggaagcgcuggagcccuggcugggguuccguggcagccggccucaagcuugggaagggcugacgggguuguuuucaucaggaaguuucugcaggaucguucuggccccguuuuccacaccgcauaugggaaagacagaggguguucccuaugaauacucugggauauuugugugugugacuaucuuugauguuuuuuuaguacuguuccccugauaucaugucaacaaaaggcuuguuucucuucugaaaccaagcaauauauauauauauuuuuuuuuacacugggauuuuaaaaaauguguaucgcacucugauuuaaacaguguuuuugcacucaaucauucaauuuaucuaaaaacucagaagcaaucauguuaacuuuauaaagagagagcguauauuuugaagcuuagggcauuuuaaauucacaugauuugggauuggugccauuacaagaucaugcaaaauuaaaaugagagcagacaucugggcuuagagaagacauagaaaaguuacaauugugcuggacucuccccaguauccaacagccccccucaacuuaugcacaacguggcuuucuggaaugaggcuggcuggguuuugaggucacugguggccacugagaugagcuacccccagguaacuggccugugccuuuggccccauuuagcauugugcucuaacuagcaagcucgccagcccagaacaccugagcuuauauuugaaacccaaagcacuuuaugggugcu

SEQ ID NO: 20528 - RNA, 3777 nt, Homo sapiens
agcacccauaaagugcuuuggguuucaaauauaagcucagguguucugggcuggcgagcuugcuaguuagagcacaaugcuaaauggggccaaaggcacaggccaguuaccuggggguagcucaucucaguggccaccagugaccucaaaacccagccagccucauuccagaaagccacguugugcauaaguugaggggggcuguuggauacuggggagaguccagcacaauuguaacuuuucuaugucuucucuaagcccagaugucugcucucauuuuaauuuugcaugaucuuguaauggcaccaaucccaaaucaugugaauuuaaaaugcccuaagcuucaaaauauacgcucucucuuuauaaaguuaacaugauugcuucugaguuuuuagauaaauugaaugauugagugcaaaaacacuguuuaaaucagagugcgauacacauuuuuuaaaaucccaguguaaaaaaaaauauauauauauauugcuugguuucagaagagaaacaagccuuuuguugacaugauaucaggggaacaguacuaaaaaaacaucaaagauagucacacacacaaauaucccagaguauucauagggaacacccucugucuuucccauaugcgguguggaaaacggggccagaacgauccugcagaaacuuccugaugaaaacaaccccgucagcccuucccaagcuugaggccggcugccacggaaccccagccagggcuccagcgcuuccuucgcggcuccagggacgcagugcccugcaggcaucgccugcuugcagccgacuugaggggcucacggaguccccugugcccgggacgcggcuagauccuggagaaaaccccuccacccagccccaucuggcagauagacuccagauuagcaaccccggagucacgugagccaaauuuacgccguacccggguuccaagguuaaucaccccucgcccccuccgcuucccggcuccgccgaugugccuccucuucaggcgggccuggggucugcgucucccaggcagcuuuggggguggaaaaaaggaggggagcgggggaggggaaaggaacuucuuuguucuuucaccggauaaacucaguuuacggaauucuccaacacccacucccacccccagugugcaaauaucucugauccucacuuggagggcgaacuacuucauucauugagacuuuuguguuccuggcccuaggcuaaguauuaucuuguaagaucacauuuaaguuucccaacaacccccugagguagguguuauuaucccuauuuuacagauaaaaagaaaugagguacugagaauagcuugccuaggguuuuacaauuaauagauuggcacaguuagguuuugagccccagccuguuuugacccaaaagcccuaaucuuuauagcuguucuuuauauagcaggaauaagaguaauaaccacuccuugcagagcaauuacuauauuccaggcacggugcacgguauuucuccaaacuucucucagaggcagguuugccacuuacccguuauguggccucaggaaguuucuuaaccucuuuuugacucaauugcccugucugcaaaaugaggcuaaaaauaugguugucaugaagaguaaaagaauuaauauauguaaagccuggcacacauucaucccugaaauuguuguugcuguuguuuuuuaaccaucaucuccauuucacagguaaggaaccuacccuuggagaggugaaggagugaauuaguccagcuugcccgcugcacaccuagcugcagagagaccccgcucagaagccgugcgggaugggggccccacaggcaggugaauugcacuuggcaggugggagaugagcuucuccggggucgcugcagaacgcgcagcagcccgggaggccgugaaugguuaucaguuaccacgcaaggcuggggguccgcccgcuccggauuugcucguagugcgagggccccggcggugugcugggggaucccgccgggcccacuuagaagcacucggggggacacaccuguucgggacaccuguggacggggcccggcugcaccgcaggagccccccgcccuggcccccgcgcacacacagccccccaaggcgcggaggccgccggcccucccgcccgucgcgcuccagggcggaguuuccuccucugcucauuguucacggcccagcgcccgcccagccccggccccggccccgcccggcccggccgccgccgcuggcgggcuccugggggagggggaggggcgggggcgggggcgggggccggcgcugacgggacgggccaggaguagccgcagccgccaguggggccgcagccgcgcagacgccgcccaggacgcagccgccgccgccgccgcuccucugccacuggcucugcgccccagcccggcucugcugcagcggcagggaggaagagccgccgcagcgcgacucgggagccccgggccacagccuggccuccggagccacccacaggccuccccgggcggcgcccacgcuccuaccgcccggacgcgcggauccuccgccggcaccgcagccaccugcucccggcccagaggcgacgacacgaugcgcugcgcgcuggcgcucucggcgcugcugcuacuguugucaacgccgccgcugcugccgucgucgccgucgccgucgccgucgcccucccagaauggugaguggccggccuggguuccgccgggacucccaccgugcccaugugcccccugcccggccgagcugcagggaagcccggcgcgccgcgugguccgaccccgagcagcccuaucaccgccggggucacacacggagcccugaccuugcaccauccacgcccccuccaaacuccgcagcgcggcaggugcagggccugggcguagauucgucuccacucuccacucgggaggagugggcgguggauucugcccgggcaaacaggggcgcgccggugcuaaguggguuugcaugggaaagaaaagggagaccgcaccgcgaggcuccacgcuucugcgggacucucgggaucugauuacaccuuuccuucguguuggagggaaugaggggcuguaguguguauucguuaauuccaggcaaagaggcaggcgagaggcucccgaggaagucccugaagcaggugacaagccuccagccacggcccacgcgggcgauguacuuacccguuugcagagguuuuuucuaaguaaugugugcaggcucaacuccuugagcccgugcuggggcagguacagagucguaaguggaccuuccacagucccagagucaccuggcugaguggggguccuaccuccgugucccuaaaacaaucgcuucuuagugcguggcuacgauggugagaccccccucgaauccucuuguucaaacgggaacuuguucaaacgggaacuucucucucguagaauaggauugggcugcauuuuagacacaccuuagaaaauguaccugucucucaugaaacaccugcaccucagaaacauccccucccuguuucuuuucaaggugaaauguuacucuuucccuuuugggggacaggcgauggcugcaaacucaaccagaacagguguucuuaagccccuagggaacagccagagucagcucagccccacgggagaggugcauuucucauucucuuuugcccaccugagcacaugucugcaggaagagcugagguggugugaucacccuagggccaggaggacugcggggacagcacagacaggguagggauucugcug

SEQ ID NO: 20529 - RNA, 932 nt, Homo sapiens
gaaacugaaucauguugcuucgaaggcaauuaaaauuaauauguaaagccaaaagaaaaauaaauggggaaaguacuuguagcaaaugugacaugagggugacuccuuggugacucaccucugguaaaagacaggggucauucugcaaaagcaggauccgaagcugguuuucauugagaccaaaaaguccauggcuuuucaggaccugcauguugacagguguguggauaucaugggaaaggguacagguagaccuaaaagaacaaagcccucggucagaugcccaggugaagaaggaccagucuguccaauuccuugccuugagcagcuuucaauguauuuaauacaugugaaguugaguaauuuucaugaaaccggggauaguauggccuaauaagcacugauggaaaauaagaaaauuggguugaaggaacuccucucccagggucauuugaauuuucaguagggaugcuuugaagccaagggucgcccaccucgccugaggaugcacaucuguuccguaggcgacugcaccuggccuucuccccggcaacagcugccacaguccaccaacguuaaaaagaaagcgccccuauccccagcaccgcuuuggcgggguguguggcuagagacaaccaaggaaaauucggggcugugaagcacagccuggggucaggaggcagccccgaaccccagcucuggcagucaggaaccacagggccucacccaagccauccagcccuguuuccuggggugagacuggcucagcgcuguuaaaccuagagggcgcagacccgcuucugcacaaguguguggauaugggggagcagcgauuuccggcuaaaggguccagggaucucaugggauccucagacgccccacgccccccaccucccgccaaauaucaccagaauaagugagcuccgaagucc

SEQ ID NO: 20530 - RNA, 932 nt, Homo sapiens
ggacuucggagcucacuuauucuggugauauuuggcgggagguggggggcguggggcgucugaggaucccaugagaucccuggacccuuuagccggaaaucgcugcucccccauauccacacacuugugcagaagcgggucugcgcccucuagguuuaacagcgcugagccagucucaccccaggaaacagggcuggauggcuugggugaggcccugugguuccugacugccagagcugggguucggggcugccuccugaccccaggcugugcuucacagccccgaauuuuccuugguugucucuagccacacaccccgccaaagcggugcuggggauaggggcgcuuucuuuuuaacguugguggacuguggcagcuguugccggggagaaggccaggugcagucgccuacggaacagaugugcauccucaggcgaggugggcgacccuuggcuucaaagcaucccuacugaaaauucaaaugacccugggagaggaguuccuucaacccaauuuucuuauuuuccaucagugcuuauuaggccauacuauccccgguuucaugaaaauuacucaacuucacauguauuaaauacauugaaagcugcucaaggcaaggaauuggacagacugguccuucuucaccugggcaucugaccgagggcuuuguucuuuuaggucuaccuguacccuuucccaugauauccacacaccugucaacaugcagguccugaaaagccauggacuuuuuggucucaaugaaaaccagcuucggauccugcuuuugcagaaugaccccugucuuuuaccagaggugagucaccaaggagucacccucaugucacauuugcuacaaguacuuuccccauuuauuuuucuuuuggcuuuacauauuaauuuuaauugccuucgaagcaacaugauucaguuuc

SEQ ID NO: 20531 - RNA, 997 nt, Homo sapiens
cuaaauguguuacaaucccuucuuugcacaguagccuuagucugaaaaccaucacucacacacacacacacacacacacacacuccguauacacaaauucacaaagccaugcucacugccugugacugacaaggaaugggggcagguacuagcccucuggcgcuuuuaucaauugauagauaucaauuggccaauaucaauaauugaucaauuaucaguauuauccacccuaucugucuguaauuaguauaaaacuucuuuucucuuucccuucccuaagacucuaccacuggagcuaccaauacuaaaucagaccgugugaaugugcccuuucuauuccuucuaguuacucugaaauauuucccaggauaagucaaaugcugguagcuguuuaccuguaaaugaugggguacaguauaagcaauaugauuaguuacaaaguauugguuuuugucuagcauuacggguaacuuuggucaaaaaagaccaauacuuuucaaacuacugguaucuaggaaucucaaaugcgagucaaccagcaugugugaugaacacuuaaaaaaaagagaaaagagccacugcauuccagccuaggcgacagagugagacacugucugaaaaaaaaaaaaaagagagagaaaaaagaaugcauuacauguagaaggagucagcacuacuucaugaaaugucuauuucaguuacauaaguacuguacguguaugugagcauauugguugugauguaaaauuaacuucacaugauagaucagucaaaagaguuugaaagccauggaauguggcaaagaaacaagcagaagucacaaaggccugaauuguccccacaaacucugucccugcaaauggagcuccacagugaaucccacauucuuccuguguccuacagcugagaaccccaaaauuaccggccuggaacccaucaucagcugccauaccagauuccccuucuccagauccuaaccccuuuuuuucuccacucc

SEQ ID NO: 20532 - RNA, 997 nt, Homo sapiens
ggaguggagaaaaaaagggguuaggaucuggagaaggggaaucugguauggcagcugaugauggguuccaggccgguaauuuugggguucucagcuguaggacacaggaagaaugugggauucacuguggagcuccauuugcagggacagaguuuguggggacaauucaggccuuugugacuucugcuuguuucuuugccacauuccauggcuuucaaacucuuuugacugaucuaucaugugaaguuaauuuuacaucacaaccaauaugcucacauacacguacaguacuuauguaacugaaauagacauuucaugaaguagugcugacuccuucuacauguaaugcauucuuuuuucucucucuuuuuuuuuuuuuucagacagugucucacucugucgccuaggcuggaaugcaguggcucuuuucucuuuuuuuuaaguguucaucacacaugcugguugacucgcauuugagauuccuagauaccaguaguuugaaaaguauuggucuuuuuugaccaaaguuacccguaaugcuagacaaaaaccaauacuuuguaacuaaucauauugcuuauacuguaccccaucauuuacagguaaacagcuaccagcauuugacuuauccugggaaauauuucagaguaacuagaaggaauagaaagggcacauucacacggucugauuuaguauugguagcuccagugguagagucuuagggaagggaaagagaaaagaaguuuuauacuaauuacagacagauaggguggauaauacugauaauugaucaauuauugauauuggccaauugauaucuaucaauugauaaaagcgccagagggcuaguaccugcccccauuccuugucagucacaggcagugagcauggcuuugugaauuuguguauacggagugugugugugugugugugugugugugagugaugguuuucagacuaaggcuacugugcaaagaagggauuguaacacauuuag

SEQ ID NO: 20533 - RNA, 313 nt, Homo sapiens
caccgugggcuuaggugggcaggugaugguccuaaggcuccgagccuggaguagguguggaagugggagcucaggacgggggaggggaggggaggggaggggagggugaugggagaggggguggaggagggcgaggaggcuggggaggacaggcacucgggcugcggggaagggugccaagggagggugcucgcggccgcggagggaggagccggggaaagguggagcgcgaacggguggggggguggcggggaggaguugggggaacgaggaggggccgugucgggggggagccagcgagucgugcgcugcc

SEQ ID NO: 20534 - RNA, 313 nt, Homo sapiens
ggcagcgcacgacucgcuggcucccccccgacacggccccuccucguucccccaacuccuccccgccacccccccacccguucgcgcuccaccuuuccccggcuccucccuccgcggccgcgagcacccucccuuggcacccuuccccgcagcccgagugccuguccuccccagccuccucgcccuccuccacccccucucccaucacccuccccuccccuccccuccccucccccguccugagcucccacuuccacaccuacuccaggcucggagccuuaggaccaucaccugcccaccuaagcccacggug

SEQ ID NO: 20535 - RNA, 2251 nt, Homo sapiens
caaacugggggaauagguuuaccguguucccccucuggggaauuuugagucgccacacucaugucucgaccgagccuggcucgcugcgucugagcgaguacuugaggaaggcugaucuagaaaaaccagcugagagaaggggcagaagccccugaaaccacgggcgggggugggguggggagcgcagcuuugggacccucuagccggagacuuccggcagcugccuccgacuuguucuaaguacaggaaaaaucugugcgcccaguugccucacuccaacagcgcgcaguugugcccggcgaggaugccgcgcuagucguggagaugccccaccacaaagaggauucaggugcuuccuacuccggcacccaguggguugguaguccuguuggcaggagacaagaaucgucugggcugcuccuaucucuggcaggacuagacggggcgugaaggaaagaaggaaagaaggaaagcagggaucgggcacugcccgagggcagauacuugggcuuugguguuguccagcgcgcucggagugcgcugccucgcucacgcggucccaggccccgcuucuucaggcagugccuggggcgggaggguugggguguggguggcucccuaagucgacacucgugcggcugcgguuccagcccccuccccccgccacucaggggcgggaaguggcgggugggagucacccaagcgugacugcccgaggccccuccugccgcggcgaggaagcuccauaaaagcccugucgcgacccgcucucugcaccccauccgcuggcucucaccccucggagacgcucgcccgacagcauaguacuugccgcccagccacgcccgcgcgccagccaccgugagugcuacgacccgucugucuaggggugggagcgaacggggcgcccgcgaacuugcuagagacgcagccucccgcucuguggagcccuggggcccugggaugaucgcgcuccacuccccagcggacuaugccggcuccgcgccccgacgcggaccagcccucuuggcggcuaaauuccacuuguuccucugcuccccucugauuguccacggcccuucucccgggcccuucccgcugggcgguucuucugaguuaccuuuuagcagauauggagggagaacccgggaccgcuaucccaaggcagcuggcggucucccugcgggucgccgccuugaggcccaggaagcggugcgcgguaggaagguuuccccggcagcgccaucgagugaggaaucccuggagcucuagagccccgcgcccugccaccucccuggauucuugggcuccaaaucucuuuggagcaauucuggcccagggagcaauucucuuuccccuuccccaccgcagucgucaccccgaggugaucucugcugucagcguugauccccugaagcuaggcagaccagaaguaacagagaagaaacuuuucuucccagacaagaguuugggcaagaagggagaaaagugacccagcaggaagaacuuccaauucgguuuugaaugcuaaacuggcggggcccccaccuugcacucucgccgcgcgcuucuuggucccugagacuucgaacgaaguugcgcgaaguuuucagguggagcagaggggcaggucccgaccggacggcgcccggagcccgcaagguggugcuagccacuccuggguucucucugcgggacugggacgagagcggauugggggucgcgugugguagcaggaggaggagcgcggggggcagaggagggaggugcugcgcgugggugcucugaauccccaagcccguccguugagccuucugugccugcagaugcuagguaacaagcgacuggggcuguccggacugacccucgcccugucccugcucgugugccugggugcgcuggccgaggcguaccccuccaagccggacaacccgggcgaggacgcaccagcggaggacauggccagauacuacucggcgcugcgacacuacaucaaccucaucaccaggcagaggugggugggaccgcgggaccgauuccgggagcgccagugccugcacaccaggagauccuggggauguuagggaaagggauuguuucuuuuccuucgcucuaucccagggcaggacaguaucaggcacuuagucagcucuagguaaauguuuguacagggcacacucuacacaaaauggguaccuuccauuuugugcaacuacagucacagagucgugauccccagauucagguuccc

SEQ ID NO: 20536 - RNA, 2251 nt, Homo sapiens
gggaaccugaaucuggggaucacgacucugugacuguaguugcacaaaauggaagguacccauuuuguguagagugugcccuguacaaacauuuaccuagagcugacuaagugccugauacuguccugcccugggauagagcgaaggaaaagaaacaaucccuuucccuaacauccccaggaucuccuggugugcaggcacuggcgcucccggaaucggucccgcggucccacccaccucugccuggugaugagguugauguagugucgcagcgccgaguaguaucuggccauguccuccgcuggugcguccucgcccggguuguccggcuuggagggguacgccucggccagcgcacccaggcacacgagcagggacagggcgagggucaguccggacagccccagucgcuuguuaccuagcaucugcaggcacagaaggcucaacggacgggcuuggggauucagagcacccacgcgcagcaccucccuccucugccccccgcgcuccuccuccugcuaccacacgcgacccccaauccgcucucgucccagucccgcagagagaacccaggaguggcuagcaccaccuugcgggcuccgggcgccguccggucgggaccugccccucugcuccaccugaaaacuucgcgcaacuucguucgaagucucagggaccaagaagcgcgcggcgagagugcaaggugggggccccgccaguuuagcauucaaaaccgaauuggaaguucuuccugcugggucacuuuucucccuucuugcccaaacucuugucugggaagaaaaguuucuucucuguuacuucuggucugccuagcuucaggggaucaacgcugacagcagagaucaccucggggugacgacugcgguggggaaggggaaagagaauugcucccugggccagaauugcuccaaagagauuuggagcccaagaauccagggagguggcagggcgcggggcucuagagcuccagggauuccucacucgauggcgcugccggggaaaccuuccuaccgcgcaccgcuuccugggccucaaggcggcgacccgcagggagaccgccagcugccuugggauagcggucccggguucucccuccauaucugcuaaaagguaacucagaagaaccgcccagcgggaagggcccgggagaagggccguggacaaucagaggggagcagaggaacaaguggaauuuagccgccaagagggcugguccgcgucggggcgcggagccggcauaguccgcuggggaguggagcgcgaucaucccagggccccagggcuccacagagcgggaggcugcgucucuagcaaguucgcgggcgccccguucgcucccaccccuagacagacgggucguagcacucacgguggcuggcgcgcgggcguggcugggcggcaaguacuaugcugucgggcgagcgucuccgaggggugagagccagcggauggggugcagagagcgggucgcgacagggcuuuuauggagcuuccucgccgcggcaggaggggccucgggcagucacgcuugggugacucccacccgccacuucccgccccugaguggcggggggagggggcuggaaccgcagccgcacgagugucgacuuagggagccacccacaccccaacccucccgccccaggcacugccugaagaagcggggccugggaccgcgugagcgaggcagcgcacuccgagcgcgcuggacaacaccaaagcccaaguaucugcccucgggcagugcccgaucccugcuuuccuucuuuccuucuuuccuucacgccccgucuaguccugccagagauaggagcagcccagacgauucuugucuccugccaacaggacuaccaacccacugggugccggaguaggaagcaccugaauccucuuugugguggggcaucuccacgacuagcgcggcauccucgccgggcacaacugcgcgcuguuggagugaggcaacugggcgcacagauuuuuccuguacuuagaacaagucggaggcagcugccggaagucuccggcuagagggucccaaagcugcgcuccccaccccacccccgcccgugguuucaggggcuucugccccuucucucagcugguuuuucuagaucagccuuccucaaguacucgcucagacgcagcgagccaggcucggucgagacaugaguguggcgacucaaaauuccccagagggggaacacgguaaaccuauucccccaguuug

SEQ ID NO: 20537 - RNA, 2967 nt, Homo sapiens
guaguaggucgcuuuuugcaucgcguuguuucacgaucuugaucgcacacucugacagggguuugacacccgugagggcgcacauuggcacgcccccgcggucacgugacacuccgccgccaauggccgccccgcgcagaccugguggggcgagaagcgcagcgcggugagggcuccgcgcaaauccaucuuacucucaauagcuaagugacaugaaagccauaaaagaaaaaguggucagcaauauuuagcagcacgacuuggccccgggcgcagggagccgugcuauaaaaaaccgcuggaauuuacuggcagcuacaaauauuugcuuaacuugcgucuggaguugggggauuuuccggggagaaggagaaugagugagggcugcaagcugauucucaggagccgggauccaaaaggagaaaggcuugauaggcuagaaaggaaaaaggcugggaucuuucuuuuccagggaagaagaaacuuggggugucgcuuaguuucugcuccuuggccuccuccagagggcccaagacuccuccacucugggaauguugggaagggaacgaggaggcaaaggggagcuugggucgccaauguuuucuccgcuuuaggacugauguuugccaaaagagcccugagaugggguaacuucccacccagcuccuucuuggaccuuccugcucccaagagagguuugcacaaaaaauuucaggcaauuugccccauccaaccaugcuggauuucagaagcugagcuuguuaggaaguuaauccaccuuguuggggauaugacucaccuccuccaaaugaaccccuuguggccaagccaaggggggagggaaaacuuuguguggaacacauugcguguguguguguguguguguguguguguuuagggugagggaccaacaguaacaccccacccagcaagucacaacuaaaauccuggagaguucuuuacuccuuuccucucccuguuucucaggcacuucccagcaagccacccccacuucuuuacuucuuucccccaguuacagaagguucccagaaccuccugucuuggacuuucuaaggugcuguuauucggggcaacuaucaaauucuaccuguuaaaacaugauggauuagagggggaaaaaaaaccccuccaggaaccugaaaaaccagcguucaucuccaugaccacaguuugaacucuccuuccaacuuaacgauaauagguucugucuuagaaacugcuauguaauuugauguaugggggucauuuggcucccgacgagggauggaagcacaagccauaaaauccugccagaguuuccugaucuuugugugcuguuguuguuguugauauuuuguuacuuggccuauuuaccugcuucagaaauaccaaguaaaggauaacccugaaaaucuaaaaagcaguugaaaaccuccucaacccucuuucauuuagaaagcaguuugcaaaaguuaaaucuguuuucuuuuuguuuucaaccacugcauggucaaccucuaguucucagcacagaaaaguuccaugugaguuucaaauauucacccacacacacacucagaaucuuagucccucugaccacucaagaaaauuauaacaaauucaaaagaaaaugguuaacaugcaauccaacuauguauauugagucccagaguuauucaaguuuuccaggaauauuagaugcuuuguuaacuagaaaaaaaaagauaauguauugcaucuaccaguagaugauuauaauuccauuguugauaauggacuccuuuagauuucauuauuaagccaacaaucuuaccaacaucugcaaaacaggcacaauuaauuuuccagaaccucgauuaaaaauuacagcaucgcuuauccagaguuauugucagugaucaugagcccuggagcauuguuucucuuuuggaaauaggaagcuacacauaccaugguugaaaguaaauaaaggauaaaguaaaacuuaaaacugaauagcaauuuaguguauccguuuccuuuucuuuuacugaaaacaguuccuauuacauuuggcagugucaaugucugccauuacaaauuuuuuagauaccaggcuuguguaaaauaaaaugucagguuaagaaaauuagacacucgaacagcaagauauuagauaaaacaaaauuaagcugauuuugcacaugcaauauuucuagugacuugcuaauccauuaucacguuauaccagccugcuacuuaguuaagccuuuuuaucaaguugugcauugucuuacaaaauaacaaaaauaucuuugaaaaucaaagagcauacaacagcccucguaaacuuaaaauauaaauucgauucugggaucccaccaaaauccuuccuauuguucgaggucagcagaccaccaccuuggagcucauacauccccccaccccaacccagcccccaaaguuugcaaccuaguaaagaaguuggagauuugccagccaggaaacuuugcucuguaccgccaagcaagggcuggggaugaggggagauuccuccacaaagaucuguuucuggacaauaauccccaggugcaagagccgaaagagaguugaagaggcuaaauugagugcaagaagcaagcccuauugucucucuggaagaugugcccaaauucaaccuccguccuucagacaucgcucccucuucccauucccuccucuuucuuagccuucccucaccccaaaucugagcggguucgucggauaggagccccgaguccccugcccaccucuccuucccucugcaacccagaaaaguuaaggcugggcuaggggagaggcaagaggugggggcggggaugggaaagcggccugaacucgaaguguaaggguaucagucacugccgggaaggaagcuccggcuugugaacucuucuugaaccgagauuuaagucugcagccauaaaucaccgagacguaaacuccgcc

SEQ ID NO: 20538 - RNA, 2967 nt, Homo sapiens
ggcggaguuuacgucucggugauuuauggcugcagacuuaaaucucgguucaagaagaguucacaagccggagcuuccuucccggcagugacugauacccuuacacuucgaguucaggccgcuuucccauccccgcccccaccucuugccucuccccuagcccagccuuaacuuuucuggguugcagagggaaggagaggugggcaggggacucggggcuccuauccgacgaacccgcucagauuuggggugagggaaggcuaagaaagaggagggaaugggaagagggagcgaugucugaaggacggagguugaauuugggcacaucuuccagagagacaauagggcuugcuucuugcacucaauuuagccucuucaacucucuuucggcucuugcaccuggggauuauuguccagaaacagaucuuuguggaggaaucuccccucauccccagcccuugcuuggcgguacagagcaaaguuuccuggcuggcaaaucuccaacuucuuuacuagguugcaaacuuugggggcuggguugggguggggggauguaugagcuccaaggugguggucugcugaccucgaacaauaggaaggauuuuggugggaucccagaaucgaauuuauauuuuaaguuuacgagggcuguuguaugcucuuugauuuucaaagauauuuuuguuauuuuguaagacaaugcacaacuugauaaaaaggcuuaacuaaguagcaggcugguauaacgugauaauggauuagcaagucacuagaaauauugcaugugcaaaaucagcuuaauuuuguuuuaucuaauaucuugcuguucgagugucuaauuuucuuaaccugacauuuuauuuuacacaagccugguaucuaaaaaauuuguaauggcagacauugacacugccaaauguaauaggaacuguuuucaguaaaagaaaaggaaacggauacacuaaauugcuauucaguuuuaaguuuuacuuuauccuuuauuuacuuucaaccaugguauguguagcuuccuauuuccaaaagagaaacaaugcuccagggcucaugaucacugacaauaacucuggauaagcgaugcuguaauuuuuaaucgagguucuggaaaauuaauugugccuguuuugcagauguugguaagauuguuggcuuaauaaugaaaucuaaaggaguccauuaucaacaauggaauuauaaucaucuacugguagaugcaauacauuaucuuuuuuuuucuaguuaacaaagcaucuaauauuccuggaaaacuugaauaacucugggacucaauauacauaguuggauugcauguuaaccauuuucuuuugaauuuguuauaauuuucuugaguggucagagggacuaagauucugagugugugugugggugaauauuugaaacucacauggaacuuuucugugcugagaacuagagguugaccaugcagugguugaaaacaaaaagaaaacagauuuaacuuuugcaaacugcuuucuaaaugaaagaggguugaggagguuuucaacugcuuuuuagauuuucaggguuauccuuuacuugguauuucugaagcagguaaauaggccaaguaacaaaauaucaacaacaacaacagcacacaaagaucaggaaacucuggcaggauuuuauggcuugugcuuccaucccucgucgggagccaaaugacccccauacaucaaauuacauagcaguuucuaagacagaaccuauuaucguuaaguuggaaggagaguucaaacuguggucauggagaugaacgcugguuuuucagguuccuggagggguuuuuuuucccccucuaauccaucauguuuuaacagguagaauuugauaguugccccgaauaacagcaccuuagaaaguccaagacaggagguucugggaaccuucuguaacugggggaaagaaguaaagaaguggggguggcuugcugggaagugccugagaaacagggagaggaaaggaguaaagaacucuccaggauuuuaguugugacuugcugggugggguguuacuguuggucccucacccuaaacacacacacacacacacacacacacacgcaauguguuccacacaaaguuuucccuccccccuuggcuuggccacaagggguucauuuggaggaggugagucauauccccaacaagguggauuaacuuccuaacaagcucagcuucugaaauccagcaugguuggauggggcaaauugccugaaauuuuuugugcaaaccucucuugggagcaggaagguccaagaaggagcugggugggaaguuaccccaucucagggcucuuuuggcaaacaucaguccuaaagcggagaaaacauuggcgacccaagcuccccuuugccuccucguucccuucccaacauucccagaguggaggagucuugggcccucuggaggaggccaaggagcagaaacuaagcgacaccccaaguuucuucuucccuggaaaagaaagaucccagccuuuuuccuuucuagccuaucaagccuuucuccuuuuggaucccggcuccugagaaucagcuugcagcccucacucauucuccuucuccccggaaaaucccccaacuccagacgcaaguuaagcaaauauuuguagcugccaguaaauuccagcgguuuuuuauagcacggcucccugcgcccggggccaagucgugcugcuaaauauugcugaccacuuuuucuuuuauggcuuucaugucacuuagcuauugagaguaagauggauuugcgcggagcccucaccgcgcugcgcuucucgccccaccaggucugcgcggggcggccauuggcggcggagugucacgugaccgcgggggcgugccaaugugcgcccucacgggugucaaaccccugucagagugugcgaucaagaucgugaaacaacgcgaugcaaaaagcgaccuacuac

SEQ ID NO: 20539 - RNA, 6059 nt, Homo sapiens
uuggguguuggagaauugcucuuggacacaaacugcacugggcccuuccagucaguggcugagguggcagcaaaccuugagcuuggggaggucuucagcugccagucucacccuggguccuccagcccuaggaugggccaguggugggaauggggauguggaccagacauccuuagcacagggccaggaagcuaccaggcuggccuuaaggagcccaggcagacagguguacaggcaggagugcagcagggucagcugccucccaggaccuggcccuccauuccaggaggguggagaggagggggcacucuucaaaaucagaguuccagaagccgcaguuucccccugucugaaggagaaaguguuccacggugccugccacaguuacacagcugccaccgacuuucucagcagauuccacugcagugcaaggaggugacaggaguggucaacccucaucuaccugcaagugugagauccacucgaccuuauuccccaggggugcacccagcaguggcacuagguucccaaaagggcaucagcagcugccaaggcagaagggggaagcgggucccagaaccacccaccuccggcuguccccaccgcgaggacccagcagucuggcgcccccaccacggccuggaagaugacggagggcccaagacuaauauucacgacagccagaccacgcuuauuguuuagaaggaagcucccuuuguucuuacuuuuuaaccaaagagaagcgaaaacauuuuuuuccugaucacauuuucaccgacaccugagccgacaagccagcuccuggcccccggcucaggacuccucgcucucucccuucucggggcccugucgccguugaaaggcccgcugcaggcuggggagggugaucggggccgcgggccaucucccccgagccgggcgggcagacugcggaggcaggccccacacgcgccgcuuuuccgagcccgguuuucuucaggagcgaagcuguuccagcugacccgcgcgucugggggccuaugcccggcuuccgauuccauuuaaaacgacccgcgcaucuuaucuccgucgccuccccgggguucccacccaccccccuccggcccgggccaggccagcccagccccggcggaagccaagcugggagcuuuugaaguccggagaauuucaauccgagaggagccggcuggaccggagcccgucgccccagcgggggaagggacggggggccugccguguggcaggugggggaugggugucccccgccgcgagaaaugagaagccgccgggccuggagcggccuccaccucagcugcuaucacccccucuccgcugucaugggauugcccaggcuuaaugggguugugcagggcuucacuugcucucggaauuuaccuuccuucucgagccgugccgcgaauaaccuucacgacacagugauaacgauguuauuaaauacuccccccacauucaccgcccaaaaaaccaaaacaguguucuuauccaguccucucuuuuuuugucuucuuuccuuuaaaaacccaaccgcucuuaaugugagguugaugaaaggaugcuuuuggaagaagugacauuugguuaaaacguuuucccccuaaugcgccgguggaaaggggcgggggugggugugguucccuaggcuccuaagacuggccagucagcuuugaaagagcggggcagaagucgggagagggcuggggaaggcuuugggcugaggggaugugucccugaagcuucagaucuggagcccaagggaggcaaccucccucugaaaagccgguccucagcuccauccagcccucuccgcgggauguaagcccugcuccguagggcccgacccaggaagcagacuaaguggcacuccuugaucucucacuccuacucggcuuucaucucacccagaagaaaagcggaucaaacagaggauucccauugaaugcagagcugggggcgggguggggagccaggagucccucugaggacccagcccccaggagaugggggcagcaggcuacucacgagaagguuaagcgcucaaggaggaaaggagggugggcaccucaaaggcccagugcuggagggcccuauagagaguaggcaaccuuggaagcucuaagacagaugcccagggggcuugccauugacaggaaagagagcaagccaggugcucccucaggcuguggcugcugguagggaggacagagaaagauagaauaccuggacagcucuccaaggcaggaaaagguucuaggauuugacuccccucacucccaauugauccucucaccucuaaaacauuucccuggauuuuggggcuagcagugcucagcauauaguggcuucaggagucccaaggaguagaaauaucuauguggacacuaccuuccggaucccgcugccuccgcccccaggcaagauuaaugaacaucgucuuagacugaaagagaaguggaaagccggagugaagaggaaacuuugucuuucuuuggaccccuuacuuccucuaccuuccuuaacccuauggauaggaagauggaggagagaagcaaagaaggagaagaauacagaaagagaaaaaggaggagagaaaaguaggagauaacagauaaaaaggucacggaagaggacuuaccuguaaaagcuggggcuuugcuagggacacagaaaggagggaggugcugggcugcccuuugcagcuggcugccuagggcuagaagcucuucgggaggaggcggagaaagggggguugagcauagaaggugcccaccuccugcucucagcaauguggggauagacucagcccacccaccuggccccagcacacuugcuuggagcucaaaaagggucaguuugaaggaguuuuauaccagcuucuucccugggagaggagccaagagaggccuauggcagcuuccagauauuaaguuccacaaccccugcccccaccuccagcccuucaucagagucccuacuuacuugcuguuuuagggcauuuucagcgacuucacucucuucuaccucaaacgccauccacuuuuggagacagguaccacugccccuaggcagggacuugggagaggaccuuaugagucaaaccucuaugaaccccaaccuuuuuguacucggggaggcugaaccccugcccaaaauagcgcggugaaagcuacugccuucucccaaguaggggccuccaguacugccacagcaggggccgcauuccuggcgccucuucauucgaaaaaccucuuuccaggagacuucgcugauucugaacgaauacuuuaaaauaugggcaagggaaaaaaaaagacaacucuuagaaacucuccccacccaacauaccuggagugcaggcgagguccaggcaaacgggaaagcgacuucuuguacgaauagccaucucaagaugaagccaggcuguggaaaacuuaaggccaucuagaugggaaggagguauuuaaaagaaaucagcacacacucuuacagaagccaaggcgggucuuuaaauuaaaaaauaauaauaagguauuuauuucuugccccuuagggaagaaaaauagcaaaguuugguucgcaggaguaaggagacagagguggguagggagagggaggagaaaagaggaaaagauggcccagccucaagcucuccagucaacuuggggcgggggaauacauuuuuccguagcuuguaaaaagacuuuucagccaguuugagguuagcugccaggggcagacaguuguaauaaugccgacagaauugaggcuuguaagccgggcuucacacuucuaaaaugcaguuauggauucuuucaucgguguuagaucaaggcaccaaguuaagaaaacaaaagucaaaacaacaauaaaagaaaaaaucaaaagcuuauuuaauuaccgagucccgcugccccugcggaacucgccgcgcgcguuaagcucucuuuucuuucugcggaauuccauuugcauccccucugccugggugucucccucucucagugugugugucucucugucuguuuucacacucuccuccccaaucgagcgaggcccacaccuggcgcaucacugccgagccauuagcugcggguuuccuuucaucuucgcuguggcagacguuucuauuuauccacuugcgcucgccgaguggcgucaccagcgguacuguaaugacgauugcagcaggaggaugacagcuuagaaagaagagggcaauggggcuuccucccagaggcggugcggcacagaggagcgcucgcuucacaaggugacccuagcucccaccgccaccgccgcggucgcgguccagaccgcgcuccagcagcuccgcgcccucccaggcacccggccuuucuuucucccucuugcaaccaagauccguccggccgcuggagacccagggagccgggguuaggaacucacuuggggcuuuccccucccccaccggagagccccgggauggagagccgaaaggacaugguuguguuucuggaugggggucagcuuggcacucugguuggcaagagagucucaaauuuguccgaagccgugggcagcccgcugccggagccgcccgagaaaauggugccccgugguugccugagcccucgggccgucccuccggccacccgggagcgcggcgggggaggcccggaggaggagccgguagauggacucgcaggcagcgcggcggggccgggcgccgagccccagguagcuggggcggccaugcucggcccaggacccccggcccccucagucgacagccucuccggacaggggcaacccaguagcucggacaccgagucggauuucuaugaagaaaucgaggugagcugcaccccggacugcgccaccgggaacgccgaguaccagcacagcaaagguagccaccgugccccuccgcuccccgggccucccacugcgcccacccuucacuucggcgcaggccaggaggaagacacucccuuccccuagggcaggauggcuggggggacccaccugagcaacucucucugcuaucugcguucuggcgggggucuccuacuguguucuggcauuggcgggacugagggugacagcagugccuugagugcggggugcugagggggcggaugcaaguccuggacuugggggauucgaagcucaccccaagcacccaguguuucaacugcucggggaaugcuucaauugcucggggaagacacuuuccccaggcgagggcaagaucaaacgccgauccgggcaguuuguggcuggcaggguguaagaggcauggaggcgcggaagccaggaguccauaaaggaccguaaaauugcggcccacuugggcagcccgggugcugcagcccuccgaccaguuugcacgucggucagagguccaaauuaccuugucacuucccgggcuucgcggcgccaggucggaaauggucccaauggucuaauugccuuuggucuccgguugcauuugaaaaggcagagaucggguccuccccccuuccccuuuccuuccuagucccacuucuccacccaaaggaaaaggagcugcagggggcuggagccccacccuucucagagguaggcccaaaggggggcugguuuaacuggagaaccccuccccaccaaaggcuaaugggaaagggguggauagcccggaagggaguuucccucugugccaacaaucaccuccccagaaggggguagaaaacugggcgcggguuggugggggggaggagaggggagcccaccagcagacacuccuccacagaacuguaggaguggguggaaagagccugggggcgggggggagaaagaccacccccuggucuuggcagccaacgccuuguugaauaccugcaccuaccccuuacuaucuuaucaccgauuucacccagccuccuucccauaacccucagaacaaccuggacuccacucacauauacuaagguaauaaauaagauacucaacaugcauucucacuccagcccugcaauacacggaaccuaguacacauucccacaccuguucuggcagcccgu

SEQ ID NO: 20540 - RNA, 6059 nt, Homo sapiens
acgggcugccagaacaggugugggaauguguacuagguuccguguauugcagggcuggagugagaaugcauguugaguaucuuauuuauuaccuuaguauaugugaguggaguccagguuguucugaggguuaugggaaggaggcugggugaaaucggugauaagauaguaagggguaggugcagguauucaacaaggcguuggcugccaagaccaggggguggucuuucucccccccgcccccaggcucuuuccacccacuccuacaguucuguggaggagugucugcuggugggcuccccucuccucccccccaccaacccgcgcccaguuuucuacccccuucuggggaggugauuguuggcacagagggaaacucccuuccgggcuauccaccccuuucccauuagccuuugguggggagggguucuccaguuaaaccagccccccuuugggccuaccucugagaaggguggggcuccagcccccugcagcuccuuuuccuuuggguggagaagugggacuaggaaggaaaggggaaggggggaggacccgaucucugccuuuucaaaugcaaccggagaccaaaggcaauuagaccauugggaccauuuccgaccuggcgccgcgaagcccgggaagugacaagguaauuuggaccucugaccgacgugcaaacuggucggagggcugcagcacccgggcugcccaagugggccgcaauuuuacgguccuuuauggacuccuggcuuccgcgccuccaugccucuuacacccugccagccacaaacugcccggaucggcguuugaucuugcccucgccuggggaaagugucuuccccgagcaauugaagcauuccccgagcaguugaaacacugggugcuuggggugagcuucgaaucccccaaguccaggacuugcauccgcccccucagcaccccgcacucaaggcacugcugucacccucagucccgccaaugccagaacacaguaggagacccccgccagaacgcagauagcagagagaguugcucagguggguccccccagccauccugcccuaggggaagggagugucuuccuccuggccugcgccgaagugaagggugggcgcagugggaggcccggggagcggaggggcacgguggcuaccuuugcugugcugguacucggcguucccgguggcgcaguccggggugcagcucaccucgauuucuucauagaaauccgacucgguguccgagcuacuggguugccccuguccggagaggcugucgacugagggggccggggguccugggccgagcauggccgccccagcuaccuggggcucggcgcccggccccgccgcgcugccugcgaguccaucuaccggcuccuccuccgggccucccccgccgcgcucccggguggccggagggacggcccgagggcucaggcaaccacggggcaccauuuucucgggcggcuccggcagcgggcugcccacggcuucggacaaauuugagacucucuugccaaccagagugccaagcugacccccauccagaaacacaaccauguccuuucggcucuccaucccggggcucuccggugggggaggggaaagccccaagugaguuccuaaccccggcucccugggucuccagcggccggacggaucuugguugcaagagggagaaagaaaggccgggugccugggagggcgcggagcugcuggagcgcggucuggaccgcgaccgcggcgguggcggugggagcuagggucaccuugugaagcgagcgcuccucugugccgcaccgccucugggaggaagccccauugcccucuucuuucuaagcugucauccuccugcugcaaucgucauuacaguaccgcuggugacgccacucggcgagcgcaaguggauaaauagaaacgucugccacagcgaagaugaaaggaaacccgcagcuaauggcucggcagugaugcgccaggugugggccucgcucgauuggggaggagagugugaaaacagacagagagacacacacacugagagagggagacacccaggcagaggggaugcaaauggaauuccgcagaaagaaaagagagcuuaacgcgcgcggcgaguuccgcaggggcagcgggacucgguaauuaaauaagcuuuugauuuuuucuuuuauuguuguuuugacuuuuguuuucuuaacuuggugccuugaucuaacaccgaugaaagaauccauaacugcauuuuagaagugugaagcccggcuuacaagccucaauucugucggcauuauuacaacugucugccccuggcagcuaaccucaaacuggcugaaaagucuuuuuacaagcuacggaaaaauguauucccccgccccaaguugacuggagagcuugaggcugggccaucuuuuccucuuuucuccucccucucccuacccaccucugucuccuuacuccugcgaaccaaacuuugcuauuuuucuucccuaaggggcaagaaauaaauaccuuauuauuauuuuuuaauuuaaagacccgccuuggcuucuguaagagugugugcugauuucuuuuaaauaccuccuucccaucuagauggccuuaaguuuuccacagccuggcuucaucuugagauggcuauucguacaagaagucgcuuucccguuugccuggaccucgccugcacuccagguauguuggguggggagaguuucuaagaguugucuuuuuuuuucccuugcccauauuuuaaaguauucguucagaaucagcgaagucuccuggaaagagguuuuucgaaugaagaggcgccaggaaugcggccccugcuguggcaguacuggaggccccuacuugggagaaggcaguagcuuucaccgcgcuauuuugggcagggguucagccuccccgaguacaaaaagguugggguucauagagguuugacucauaagguccucucccaagucccugccuaggggcagugguaccugucuccaaaaguggauggcguuugagguagaagagagugaagucgcugaaaaugcccuaaaacagcaaguaaguagggacucugaugaagggcuggaggugggggcagggguuguggaacuuaauaucuggaagcugccauaggccucucuuggcuccucucccagggaagaagcugguauaaaacuccuucaaacugacccuuuuugagcuccaagcaagugugcuggggccaggugggugggcugagucuauccccacauugcugagagcaggaggugggcaccuucuaugcucaaccccccuuucuccgccuccucccgaagagcuucuagcccuaggcagccagcugcaaagggcagcccagcaccucccuccuuucugugucccuagcaaagccccagcuuuuacagguaaguccucuuccgugaccuuuuuaucuguuaucuccuacuuuucucuccuccuuuuucucuuucuguauucuucuccuucuuugcuucucuccuccaucuuccuauccauaggguuaaggaagguagaggaaguaagggguccaaagaaagacaaaguuuccucuucacuccggcuuuccacuucucuuucagucuaagacgauguucauuaaucuugccugggggcggaggcagcgggauccggaagguaguguccacauagauauuucuacuccuugggacuccugaagccacuauaugcugagcacugcuagccccaaaauccagggaaauguuuuagaggugagaggaucaauugggagugaggggagucaaauccuagaaccuuuuccugccuuggagagcuguccagguauucuaucuuucucuguccucccuaccagcagccacagccugagggagcaccuggcuugcucucuuuccugucaauggcaagcccccugggcaucugucuuagagcuuccaagguugccuacucucuauagggcccuccagcacugggccuuugaggugcccacccuccuuuccuccuugagcgcuuaaccuucucgugaguagccugcugcccccaucuccugggggcuggguccucagagggacuccuggcuccccaccccgcccccagcucugcauucaaugggaauccucuguuugauccgcuuuucuucugggugagaugaaagccgaguaggagugagagaucaaggagugccacuuagucugcuuccugggucgggcccuacggagcagggcuuacaucccgcggagagggcuggauggagcugaggaccggcuuuucagagggagguugccucccuugggcuccagaucugaagcuucagggacacauccccucagcccaaagccuuccccagcccucucccgacuucugccccgcucuuucaaagcugacuggccagucuuaggagccuagggaaccacacccacccccgccccuuuccaccggcgcauuagggggaaaacguuuuaaccaaaugucacuucuuccaaaagcauccuuucaucaaccucacauuaagagcgguuggguuuuuaaaggaaagaagacaaaaaaagagaggacuggauaagaacacuguuuugguuuuuugggcggugaauguggggggaguauuuaauaacaucguuaucacugugucgugaagguuauucgcggcacggcucgagaaggaagguaaauuccgagagcaagugaagcccugcacaaccccauuaagccugggcaaucccaugacagcggagagggggugauagcagcugagguggaggccgcuccaggcccggcggcuucucauuucucgcggcgggggacacccaucccccaccugccacacggcaggccccccgucccuucccccgcuggggcgacgggcuccgguccagccggcuccucucggauugaaauucuccggacuucaaaagcucccagcuuggcuuccgccggggcugggcuggccuggcccgggccggaggggggugggugggaaccccggggaggcgacggagauaagaugcgcgggucguuuuaaauggaaucggaagccgggcauaggcccccagacgcgcgggucagcuggaacagcuucgcuccugaagaaaaccgggcucggaaaagcggcgcguguggggccugccuccgcagucugcccgcccggcucgggggagauggcccgcggccccgaucacccuccccagccugcagcgggccuuucaacggcgacagggccccgagaagggagagagcgaggaguccugagccgggggccaggagcuggcuugucggcucaggugucggugaaaaugugaucaggaaaaaaauguuuucgcuucucuuugguuaaaaaguaagaacaaagggagcuuccuucuaaacaauaagcguggucuggcugucgugaauauuagucuugggcccuccgucaucuuccaggccguggugggggcgccagacugcuggguccucgcgguggggacagccggaggugggugguucugggacccgcuucccccuucugccuuggcagcugcugaugcccuuuugggaaccuagugccacugcugggugcaccccuggggaauaaggucgaguggaucucacacuugcagguagaugaggguugaccacuccugucaccuccuugcacugcaguggaaucugcugagaaagucgguggcagcuguguaacuguggcaggcaccguggaacacuuucuccuucagacagggggaaacugcggcuucuggaacucugauuuugaagagugcccccuccucuccacccuccuggaauggagggccagguccugggaggcagcugacccugcugcacuccugccuguacaccugucugccugggcuccuuaaggccagccugguagcuuccuggcccugugcuaaggaugucugguccacauccccauucccaccacuggcccauccuagggcuggaggacccagggugagacuggcagcugaagaccuccccaagcucaagguuugcugccaccucagccacugacuggaagggcccagugcaguuuguguccaagagcaauucuccaacacccaa

SEQ ID NO: 20541 - RNA, 2925 nt, Homo sapiens
gcggccccaucccaggccaccccagcuagaaaucgccccugcugcuggagcugcggcugcggcggcagcuccuccgcgagaccugcagguggcgucaucuccuccccugcggccguggguaggggcugccgccugcggucagcggucagggaagcugagggcgagggauccgcgcaggauccauuuugcagcugcuggucauccagguaauccagguauuugccucgcagggccgggggguggcgacacugcacgaagacagugaggagccggcccugcgagugccagucgcccauccagcgcuucaggccucgcagccggcagucgcagguccagccguugccgucuagauccagccgauaaagggcugggcuggcggcgaagauguccccggauagggcgcugagcgcguuguugcgcaggcugagcucgcgcagccggcccagguggccgaagguggccgggugcagggcggacagcucauugccgcucagguccagcgccuccaggcugugcagaggcuccagcagcgcaguuggcagcuggcucagccgauuacccuccaggcgcagcucgcgcagggccuccaagccccaaaaggccucaggcgcgaggugcgugagcugguugccccugagcgagagcaggccgagacguggcaggugcuggaagaugcgcggcccgaggugcugcagguuguuggccgagaggaugagggaggagagggagcgcagcggugcgaagguggccgcguggcgcagggagggcuguagcucguuggcagagagguugaggaagcgcagcuugccuagcugggcgaaggcguucuugcccagaaagcggauccgguuggacuccagauguagguagagcagguugcccaagggagcgaagaccgcguccggcagcgcccccagggcguucccguccagccgcagcuugacuagacucuccaggcccucgaaggagccgcggcuuaggcggcugaucucguucccguuggcguagaggaugcgcagcuugcgcagcggggccagcgugcccggggcgagcgccugcaagagguuguuccccagguacagcucuuccagccgcgagagcuucucgaaggucuuggggugcagagagcggaucugguuguacugcagguccagccgucugagcugccccagacgguggaagucgaaggccgugauguugguuaugaaguugccgccgaggcuguaggugagcacgucgugggggcucggccagcgagcuggucuugggcacuacgcggagcccccuguuggugcacaggagaugcuggggaugcuggcagucgcagcgcuccgggcacacgggcucggcagcggcgggagcgcgaggcagccgcacaccacgagcaggaggcgcaaggcgcgggcagccuccaucgccucccgcccugcgugcagcggccggaucguccucuuggcccgccggcucugugucuccucugcauuccccuuagccuggccagagucgcuaaauggccucuuucggacuucgcagcgccguccagccccuccuccguccuuuguccggaggccggcccgggucucugcaggcgggcuucgcccggccaagucaggcggcgcggggcgcucugcagaccccggguacuacuuguugcauuucuguauaaaacuguuucuccgggugcgcgucggcgggcgggaggagggagcaagacccggcgcuuuuuguuugcagcugaguccggagagcuggauucccuggcgcggauucucccagccgaguggauuccccagcugcaggcgggagccguuccaagagcuucgcggggcgcggcuuggcagcagagccccggcugcucggcccccgcagacggcaccuucucgcucgcggucccggacggggagggcggcuccagugcaauagcucggggagcacgcgggcugcguccggaagggacccaagucugcgagcggagagcaaacggggcggaaauucguucuucccacacucugcccgcggggacgcaggcggagaaagaggagacggcagagggaggacagaccccggcagggggaggaggaaacacuaaguggcuccgcgucuggucagcccgggcccgggaugccaagugagaaaaguagggauuaaaaacagcuguacgggccggacacgcuaggccgggggcgggggaggauuaccgggcuagcaaacgggauuugcagacagagaccuuuuuauuuuagacgaguacaccagccgcuucugagcagugggagcgcgccuggccuuccucguuguuaagucacuugcucuuccaggugccacccugcgggaaguuugggcagcacggaguccgccagcauucuacaggaaguuugggggagcacaagguugccugcagaaggccaucagaaggggguaggugaacccagucugacaguugcugcuuggguuuugacgucguuggacuaguagcugaggagaggcaccacccccuuuuaggugucugaagggaguauuuacuccauccugcugugggcuagaacaugaagaaaucacagaacugguucugccaacaugaaagugucucugccacauuuuggugauucagucgcauuaacucuccuacaguaauagagccccugggguaggcucugcucgugugcacauacauaauaaccuucacagauccuaagguaaacguuccuugcagggcccuccugcuuuacgccuggacuugcagugaucuucaaagucuuuaggcccaaaaauguucaggccuggcucaguuggggaagcauuauuauuuauuaucucuagggaauggagcauuuaaucaacggcuccuuugggaucagccccugcugagaaugagaauacacaaggaggaguuguuaauuauuaauuauuguuucuuuauauaaa

SEQ ID NO: 20542 - RNA, 2925 nt, Homo sapiens
uuuauauaaagaaacaauaauuaauaauuaacaacuccuccuuguguauucucauucucagcaggggcugaucccaaaggagccguugauuaaaugcuccauucccuagagauaauaaauaauaaugcuuccccaacugagccaggccugaacauuuuugggccuaaagacuuugaagaucacugcaaguccaggcguaaagcaggagggcccugcaaggaacguuuaccuuaggaucugugaagguuauuauguaugugcacacgagcagagccuaccccaggggcucuauuacuguaggagaguuaaugcgacugaaucaccaaaauguggcagagacacuuucauguuggcagaaccaguucugugauuucuucauguucuagcccacagcaggauggaguaaauacucccuucagacaccuaaaaggggguggugccucuccucagcuacuaguccaacgacgucaaaacccaagcagcaacugucagacuggguucaccuacccccuucugauggccuucugcaggcaaccuugugcucccccaaacuuccuguagaaugcuggcggacuccgugcugcccaaacuucccgcaggguggcaccuggaagagcaagugacuuaacaacgaggaaggccaggcgcgcucccacugcucagaagcggcugguguacucgucuaaaauaaaaaggucucugucugcaaaucccguuugcuagcccgguaauccucccccgcccccggccuagcguguccggcccguacagcuguuuuuaaucccuacuuuucucacuuggcaucccgggcccgggcugaccagacgcggagccacuuaguguuuccuccucccccugccggggucuguccucccucugccgucuccucuuucuccgccugcguccccgcgggcagagugugggaagaacgaauuuccgccccguuugcucuccgcucgcagacuugggucccuuccggacgcagcccgcgugcuccccgagcuauugcacuggagccgcccuccccguccgggaccgcgagcgagaaggugccgucugcgggggccgagcagccggggcucugcugccaagccgcgccccgcgaagcucuuggaacggcucccgccugcagcuggggaauccacucggcugggagaauccgcgccagggaauccagcucuccggacucagcugcaaacaaaaagcgccgggucuugcucccuccucccgcccgccgacgcgcacccggagaaacaguuuuauacagaaaugcaacaaguaguacccggggucugcagagcgccccgcgccgccugacuuggccgggcgaagcccgccugcagagacccgggccggccuccggacaaaggacggaggaggggcuggacggcgcugcgaaguccgaaagaggccauuuagcgacucuggccaggcuaaggggaaugcagaggagacacagagccggcgggccaagaggacgauccggccgcugcacgcagggcgggaggcgauggaggcugcccgcgccuugcgccuccugcucguggugugcggcugccucgcgcucccgccgcugccgagcccgugugcccggagcgcugcgacugccagcauccccagcaucuccugugcaccaacagggggcuccgcguagugcccaagaccagcucgcuggccgagcccccacgacgugcucaccuacagccucggcggcaacuucauaaccaacaucacggccuucgacuuccaccgucuggggcagcucagacggcuggaccugcaguacaaccagauccgcucucugcaccccaagaccuucgagaagcucucgcggcuggaagagcuguaccuggggaacaaccucuugcaggcgcucgccccgggcacgcuggccccgcugcgcaagcugcgcauccucuacgccaacgggaacgagaucagccgccuaagccgcggcuccuucgagggccuggagagucuagucaagcugcggcuggacgggaacgcccugggggcgcugccggacgcggucuucgcucccuugggcaaccugcucuaccuacaucuggaguccaaccggauccgcuuucugggcaagaacgccuucgcccagcuaggcaagcugcgcuuccucaaccucucugccaacgagcuacagcccucccugcgccacgcggccaccuucgcaccgcugcgcucccucuccucccucauccucucggccaacaaccugcagcaccucgggccgcgcaucuuccagcaccugccacgucucggccugcucucgcucaggggcaaccagcucacgcaccucgcgccugaggccuuuuggggcuuggaggcccugcgcgagcugcgccuggaggguaaucggcugagccagcugccaacugcgcugcuggagccucugcacagccuggaggcgcuggaccugagcggcaaugagcuguccgcccugcacccggccaccuucggccaccugggccggcugcgcgagcucagccugcgcaacaacgcgcucagcgcccuauccggggacaucuucgccgccagcccagcccuuuaucggcuggaucuagacggcaacggcuggaccugcgacugccggcugcgaggccugaagcgcuggaugggcgacuggcacucgcagggccggcuccucacugucuucgugcagugucgccaccccccggcccugcgaggcaaauaccuggauuaccuggaugaccagcagcugcaaaauggauccugcgcggaucccucgcccucagcuucccugaccgcugaccgcaggcggcagccccuacccacggccgcaggggaggagaugacgccaccugcaggucucgcggaggagcugccgccgcagccgcagcuccagcagcaggggcgauuucuagcugggguggccugggauggggccgc

SEQ ID NO: 20543 - RNA, 1711 nt, Homo sapiens
aaauaguaccaugaaaaauuaguauaucuaagcucuaagcaaaaaaaaaaaaaaaaaaaauugaaacacuuaaauucaauaaacacuguuaaaaauuacuuuaauuuggcugggagugguggcucaugccuguaaucccagcacuuugggaggccaaggcggguggaucauuugauggcaggaguuccagaccggccuggccaauguggugaaaccccaccucaacuaaaaauacaaaaauuagcugggcauggugguacaugccuguaaucccagcuauucaggaggcugaggcaggagaaucacuugaacccaggaggcagagguuguugugagccaagauugugccagugcacuccagccugggcaacaagagugaaauuccgucucaaaaaaaaauuacuuuaacuugaaaucaaaauucucagguauauuagguaguaaaacacacgaaaccaguauaaaauuuucaccuaucucuuuuauuaacagauuuacauucccaucacaaaacuacuuaguuuacuggguaaucaaauccuauuguuuuucccuuacacauuuuguaaaaagaaaaaaaccuuuuaccuucuaaaacacguaauaagaaaauuacauagauaaaagacauuacugggccaggcauggugguucauaccuguaaucccagggcuuugagaagccaaugcaggaggauugcuugagccugggauuuugagaccagccugggcaacacagugagaucgugucucuacaaaaaauaaaaauauuggcccagggagugguggcucaugccuguaaucccagcacuuugggaggccaagguggguggaucacgaggucaggagaucgagaccauucuggcuaacaacggugaaaccccaucucuacuaaaaauacaaaaaauuagccggggguggugguaggcaccuguagucccagcuacucgggaggcugaggcaggagaauggcaugaacccagaggcggagcuugcaucugagcugagaucgcgccacuagacuccagccugggugacagaaugauacuccgucucaaaaaaauaaauaaauaaaaauaaauaaauaaauaaauaaauaaaaauaguagcugggcaugguggugcacaccuuuagucaucccagcuacucaggaggcugaagcaggaggaucaccugagcccaugaguucaaggcuucagugaaccaugacugcaccaaugcacuccagccugggugaccgaacgagaccccaucucaaaaacauaaauaaaaaauguuuaacaauguuuccucacaaaauaaaccacauaauaaaccaauaagcuacaacucauguauguaacugaguaaaaaaaugcuuaccuguaggcuggacacaguggcucacgcguguaaucccagcacuuugggaggccaaggcagguggaucacgaggucaggagaucaagaccagccugaccaacauggugaaaccccguacuaaaaauacaaaaauuagcaccuguaaucccagcuacucaggaggcugaggcaggagaaucacuugaaccugggaggcggagguugcagugagcggagaucgugccacugcacuccagccugggcaacagagagagacuccgucuaaaaaaauauauauaugcuuaccuguaggaagcaagcuguuucauaaagcuguucuacagugcugucauucauugccaaguuaccc

SEQ ID NO: 20544 - RNA, 1711 nt, Homo sapiens
ggguaacuuggcaaugaaugacagcacuguagaacagcuuuaugaaacagcuugcuuccuacagguaagcauauauauauuuuuuuagacggagucucucucuguugcccaggcuggagugcaguggcacgaucuccgcucacugcaaccuccgccucccagguucaagugauucuccugccucagccuccugaguagcugggauuacaggugcuaauuuuuguauuuuuaguacgggguuucaccauguuggucaggcuggucuugaucuccugaccucgugauccaccugccuuggccucccaaagugcugggauuacacgcgugagccacuguguccagccuacagguaagcauuuuuuuacucaguuacauacaugaguuguagcuuauugguuuauuaugugguuuauuuugugaggaaacauuguuaaacauuuuuuauuuauguuuuugagauggggucucguucggucacccaggcuggagugcauuggugcagucaugguucacugaagccuugaacucaugggcucaggugauccuccugcuucagccuccugaguagcugggaugacuaaaggugugcaccaccaugcccagcuacuauuuuuauuuauuuauuuauuuauuuauuuuuauuuauuuauuuuuuugagacggaguaucauucugucacccaggcuggagucuaguggcgcgaucucagcucagaugcaagcuccgccucuggguucaugccauucuccugccucagccucccgaguagcugggacuacaggugccuaccaccacccccggcuaauuuuuuguauuuuuaguagagaugggguuucaccguuguuagccagaauggucucgaucuccugaccucgugauccacccaccuuggccucccaaagugcugggauuacaggcaugagccaccacucccugggccaauauuuuuauuuuuuguagagacacgaucucacuguguugcccaggcuggucucaaaaucccaggcucaagcaauccuccugcauuggcuucucaaagcccugggauuacagguaugaaccaccaugccuggcccaguaaugucuuuuaucuauguaauuuucuuauuacguguuuuagaagguaaaagguuuuuuucuuuuuacaaaauguguaagggaaaaacaauaggauuugauuacccaguaaacuaaguaguuuugugaugggaauguaaaucuguuaauaaaagagauaggugaaaauuuuauacugguuucguguguuuuacuaccuaauauaccugagaauuuugauuucaaguuaaaguaauuuuuuuuugagacggaauuucacucuuguugcccaggcuggagugcacuggcacaaucuuggcucacaacaaccucugccuccuggguucaagugauucuccugccucagccuccugaauagcugggauuacaggcauguaccaccaugcccagcuaauuuuuguauuuuuaguugaggugggguuucaccacauuggccaggccggucuggaacuccugccaucaaaugauccacccgccuuggccucccaaagugcugggauuacaggcaugagccaccacucccagccaaauuaaaguaauuuuuaacaguguuuauugaauuuaaguguuucaauuuuuuuuuuuuuuuuuuuugcuuagagcuuagauauacuaauuuuucaugguacuauuu

SEQ ID NO: 20545 - RNA, 2041 nt, Homo sapiens
gcaacauuaucaaagacaacauauguacaaacauuuuacaaaaaagaacauuaccaauaucaguggcaguaagggcaagcugaagaauaaauagacugaguuuccgggcaaugucuguccucaaagacauccaaacugcguucaggcagcugaaacaggcuucuuucccagugacaagcauauguggucaguaauacaaacgaugguaaaugaggcuacuacauaggcccaguuaacaaacuccucuucuccucggguaggccaugauacaaguggaacucaucaaauaauuuaaacccaaggcgauaacaacgcuauuucccaucuaaacucauuuaagccuucacaaugucgcaauggauucaguuacuugcaaacgaucccggguugucauacagauacuuguuuuuuacacauaacgcuaugccaucccuuccuucacugccccagucagguuuccuguuguuggaccgaaaggggauacauuuuagaaaugcuuccuucaagacagaagugagaaagaaaggagacccugaggccaggaucuauuaaaccuggugugugcgcaaaagggagggggaaggcaggaauuugaaaggauaaacgucuccuuugcgccgaggaaucaggaagcgugacucacuugggucugggacgauaccgaaauccgguaccccaccccauccccugccccgccggguaccuacaagcucgguuccuuucucaacucccccaguuccuugaucuccaccuucuuguacuuccccgacuuucuccgguuggugaucaccaggacggccaugccggcgacgagggccaccacgaccaccacgaugacggcgaugaggccggcggugaggcgcuucauggagaacuucgggggaaucucguccagguaauagaugagcgugcgcuccaccugcagggguucuccgcgcacgcgcaaguccaggccgccgcggcccuggaauagagacucgcccuugaugucccucucgaaguaguaggcggcaucgccgauauccacgucaccggcggccuucugagacguguucugccgcagcucgaucuggauggugggcugcucguagugcacggccgccacgaacuuggggugcagccgauagcgcucgcggaagagccgccucagcucggcguccaggucugagugguugaaggcgccggcgguggggcgguggcgcaggucaaugaggauguggugggugcgcaccagcucaucgcagcguaggcucaggucgcccuuguccgugcggcgcacgcccaccgaguucacgcaccagcacaccgacgucugguugcacuggcgcgccuugaagcggcccucggggucgcagucggggucguagaggccaucguuguccacgagcgcgugcucacucggccgcaccagcgugcgggcguucuugggggcgcucaugcgcgccuugagcagcagacacuuggaggucagcguggagcagucgaccgccaugcccgagcccagcgcgcggcacuggcagcggccgccggggccgucggggcugcacacggucaucuuguuggugggacacgugcaguuguccugcgcggccguguggccggucaccgccgccagcaccagcagcagcagcggcagccgcagcgguggcggcgcgaggccggggccccgagccaugguggggcggaggaacgcggaccggacgcgggcggaugaggcgcggggacucgucggggcucgggcuccggcgucugggauggucugcaggcgucugccgcccggccgcucccuccggcucuuauacucuacccgaccugcccggcugguuccaccaccgaccguccccacugguauuugggugacacaucccgccccccuccccgucccacggaaggccaagccggcccugcgccgcccgcgauaggaucagaacagggaagcugcucccgccuccuccggaccgaaagccgggaaggggagaaccgauacucaccuguaggcuucuggggacccgcccucggcgcggccuccugcuacagaccu

SEQ ID NO: 20546 - RNA, 2041 nt, Homo sapiens
aggucuguagcaggaggccgcgccgagggcggguccccagaagccuacaggugaguaucgguucuccccuucccggcuuucgguccggaggaggcgggagcagcuucccuguucugauccuaucgcgggcggcgcagggccggcuuggccuuccgugggacggggaggggggcgggaugugucacccaaauaccaguggggacggucggugguggaaccagccgggcaggucggguagaguauaagagccggagggagcggccgggcggcagacgccugcagaccaucccagacgccggagcccgagccccgacgaguccccgcgccucauccgcccgcguccgguccgcguuccuccgccccaccauggcucggggccccggccucgcgccgccaccgcugcggcugccgcugcugcugcuggugcuggcggcggugaccggccacacggccgcgcaggacaacugcacgugucccaccaacaagaugaccgugugcagccccgacggccccggcggccgcugccagugccgcgcgcugggcucgggcauggcggucgacugcuccacgcugaccuccaagugucugcugcucaaggcgcgcaugagcgcccccaagaacgcccgcacgcuggugcggccgagugagcacgcgcucguggacaacgauggccucuacgaccccgacugcgaccccgagggccgcuucaaggcgcgccagugcaaccagacgucggugugcuggugcgugaacucggugggcgugcgccgcacggacaagggcgaccugagccuacgcugcgaugagcuggugcgcacccaccacauccucauugaccugcgccaccgccccaccgccggcgccuucaaccacucagaccuggacgccgagcugaggcggcucuuccgcgagcgcuaucggcugcaccccaaguucguggcggccgugcacuacgagcagcccaccauccagaucgagcugcggcagaacacgucucagaaggccgccggugacguggauaucggcgaugccgccuacuacuucgagagggacaucaagggcgagucucuauuccagggccgcggcggccuggacuugcgcgugcgcggagaaccccugcagguggagcgcacgcucaucuauuaccuggacgagauucccccgaaguucuccaugaagcgccucaccgccggccucaucgccgucaucgugguggucgugguggcccucgucgccggcauggccguccuggugaucaccaaccggagaaagucggggaaguacaagaagguggagaucaaggaacugggggaguugagaaaggaaccgagcuuguagguacccggcggggcaggggauggggugggguaccggauuucgguaucgucccagacccaagugagucacgcuuccugauuccucggcgcaaaggagacguuuauccuuucaaauuccugccuucccccucccuuuugcgcacacaccagguuuaauagauccuggccucagggucuccuuucuuucucacuucugucuugaaggaagcauuucuaaaauguauccccuuucgguccaacaacaggaaaccugacuggggcagugaaggaagggauggcauagcguuauguguaaaaaacaaguaucuguaugacaacccgggaucguuugcaaguaacugaauccauugcgacauugugaaggcuuaaaugaguuuagaugggaaauagcguuguuaucgccuuggguuuaaauuauuugaugaguuccacuuguaucauggccuacccgaggagaagaggaguuuguuaacugggccuauguaguagccucauuuaccaucguuuguauuacugaccacauaugcuugucacugggaaagaagccuguuucagcugccugaacgcaguuuggaugucuuugaggacagacauugcccggaaacucagucuauuuauucuucagcuugcccuuacugccacugauauugguaauguucuuuuuuguaaaauguuuguacauauguugucuuugauaauguugc

SEQ ID NO: 20547 - RNA, 570 nt, Homo sapiens
caccgcggacacgcgucucucuccuuuggcagaaaugugaggucgcccggcgccgcgccccgccgccccagcuuuugucagguggaaaggacagcgcagacgaaccaggggcgcugccuggagggucagcgcggaacggguggagaggcagaggcggggcucccagugggguuggaaaaauccuccuuuuuaggugucugcaucgacagcggcaaaggcagcugggacaugggaagacgcaugugaaucuuggaguaaacgccuggagcccccggcuccgacuccuuuugcaggggauugagagacaggggcagguaccuccaggaaugcacgggaaauuuucaagugacagccacccgcaugguggcgaugacaccucccaggccuugcaggagagcgcagagucaucuagggugaggucugugugaagucauugggggugggcgugggggccgauuuucuccuucaagccccaggaccuguaggcguuugaagagcuuccccgguggauuuauucuccuuuggagauagacguggcuguuccaagucccuguucuucccuaaccaucc

SEQ ID NO: 20548 - RNA, 570 nt, Homo sapiens
ggaugguuagggaagaacagggacuuggaacagccacgucuaucuccaaaggagaauaaauccaccggggaagcucuucaaacgccuacagguccuggggcuugaaggagaaaaucggcccccacgcccacccccaaugacuucacacagaccucacccuagaugacucugcgcucuccugcaaggccugggaggugucaucgccaccaugcggguggcugucacuugaaaauuucccgugcauuccuggagguaccugccccugucucucaauccccugcaaaaggagucggagccgggggcuccaggcguuuacuccaagauucacaugcgucuucccaugucccagcugccuuugccgcugucgaugcagacaccuaaaaaggaggauuuuuccaaccccacugggagccccgccucugccucuccacccguuccgcgcugacccuccaggcagcgccccugguucgucugcgcuguccuuuccaccugacaaaagcuggggcggcggggcgcggcgccgggcgaccucacauuucugccaaaggagagagacgcguguccgcggug

SEQ ID NO: 20549 - RNA, 1629 nt, Homo sapiens
cuguccggccuuucccugggccuucugccgguggauggcagucucaacugccuggaagaugucauuucccugugccgucuggaaggugaagguuccagggccugaggggcagcggcggccggccucgaaagagaacaugaccuaaggaggguagagggggaaacacauuaccaggagccaucagaggaagugagucacacgccugcacuaguuaggguaucuacaaagaagagaccaccugcgaacagacgcggggucaccggguaggcaagaaagggggauccaaaggucagagcuucccacuuucuguccugccccaccccucccacagcugcccaacccaggaagcccucccggacagccccugcaccuugucccggccauagcgacgcaacagaguguagggccaggacaggaguggcuccaguaucugacucugggcccccacggucaggagagucagccuuucagccuccacccucagcacguaggagccaugcaggccacagcgcucggcggccucaguccucugcaccguuacccagaauugggauccuggaaggcauacacgauuagacagcugcgggggagggacgggggcagcaguggggacccagaggacucaugagcauaguguccaagcacucacucggaagccagaucucagggccuuccuacuucuuacuuccccaugggccccuggguauccacccacuucccaaaggcccucggcccuccuccucuucacuccaucccugcccgggcuucugaggcgucuaccuucccagguagggcuguacaaggaguucuccagcaucuccagggcagaaagcuuagguggguuaucgguaggcgccagaguccagcugccuuucuguaguagagagcaucgagaaacccguaauuuccucagcggggagcgggggucggucugaggcagccccauuucucugccucuguaacugcccccaccccgcaucgccgcagcuccucaccggaaaggcguuucggcacagcgucugcacccaggcugcacuggacggcgcgucggccgccagcaggugcgagcgcugagcaguguccaggcggaaggcaguggcgccgggcucagggggggucuccacggugacgggggccacacucacacacucagccagacggaucacuuugcaguccaggcggcgcgagcucccucggccacccccagagcucgaccccuuauggucaaagaacucgagccgcgcuacgccguggggacuggccggguagagcacggcccaggucuuccuccaccucuagggagagagagagagugcucgagagggaguggcgugcgcaggcggcccgggucccgacggggaaggagguugcggcgcaagucgauuugggaucuggggcuuccaaacgggguugggggcgaaguuucccaaggacgaugccacuccgucuccccaggaccagaaccccuagacuacagacgcuucccgggagugugcaaagcaacuucacgggaaagucacaggcucuccaacucccggcgccgcucuccagcccgcugcccaccucucccuguuucugggcucucucacccacuacuagcccggauaagguucggcauccaugcgccag

SEQ ID NO: 20550 - RNA, 1629 nt, Homo sapiens
cuggcgcauggaugccgaaccuuauccgggcuaguagugggugagagagcccagaaacagggagaggugggcagcgggcuggagagcggcgccgggaguuggagagccugugacuuucccgugaaguugcuuugcacacucccgggaagcgucuguagucuagggguucugguccuggggagacggaguggcaucguccuugggaaacuucgcccccaaccccguuuggaagccccagaucccaaaucgacuugcgccgcaaccuccuuccccgucgggacccgggccgccugcgcacgccacucccucucgagcacucucucucucucccuagagguggaggaagaccugggccgugcucuacccggccaguccccacggcguagcgcggcucgaguucuuugaccauaaggggucgagcucuggggguggccgagggagcucgcgccgccuggacugcaaagugauccgucuggcugagugugugaguguggcccccgucaccguggagacccccccugagcccggcgccacugccuuccgccuggacacugcucagcgcucgcaccugcuggcggccgacgcgccguccagugcagccugggugcagacgcugugccgaaacgccuuuccggugaggagcugcggcgaugcggggugggggcaguuacagaggcagagaaauggggcugccucagaccgacccccgcuccccgcugaggaaauuacggguuucucgaugcucucuacuacagaaaggcagcuggacucuggcgccuaccgauaacccaccuaagcuuucugcccuggagaugcuggagaacuccuuguacagcccuaccugggaagguagacgccucagaagcccgggcagggauggagugaagaggaggagggccgagggccuuugggaaguggguggauacccaggggcccauggggaaguaagaaguaggaaggcccugagaucuggcuuccgagugagugcuuggacacuaugcucaugaguccucuggguccccacugcugcccccgucccucccccgcagcugucuaaucguguaugccuuccaggaucccaauucuggguaacggugcagaggacugaggccgccgagcgcuguggccugcauggcuccuacgugcugaggguggaggcugaaaggcugacucuccugaccgugggggcccagagucagauacuggagccacuccuguccuggcccuacacucuguugcgucgcuauggccgggacaaggugcaggggcuguccgggagggcuuccuggguugggcagcugugggagggguggggcaggacagaaagugggaagcucugaccuuuggaucccccuuucuugccuacccggugaccccgcgucuguucgcagguggucucuucuuuguagauacccuaacuagugcaggcgugugacucacuuccucugauggcuccugguaauguguuucccccucuacccuccuuaggucauguucucuuucgaggccggccgccgcugccccucaggcccuggaaccuucaccuuccagacggcacagggaaaugacaucuuccaggcaguugagacugccauccaccggcagaaggcccagggaaaggccggacag

SEQ ID NO: 20551 - RNA, 704 nt, Homo sapiens
uccgacucgccuccugcccgggcguguugccggaggauguggccagcaggcugaacacacaugacaacgugaggcucaaagucaggaaggaauccuuagcgauuauuuuacaguugagggaugagaugcccgggguggacaacccucugguuucggucacaaucagccagccucucgcgcuccagcacccccucuauugcuucgccguggucggugucuucuuuccuucacaccuuugguacagacccagccggcaccgcgcgcaacgccgcuagagccccucagagccccagcucccgaccacccgccggagaauuucgagucccucaggaaagcagcucccauuggccagcccggcccccuccccgcaccucauuggcuacuguccugcaggucccgcccucucggcgccucagguuccagcgagggcguaacggcagugaagugaaaaauggcgggaaaggccgccucugagcuggccgugcaucugcgcaacgcuggcuugggagccggccggugguggaggagcccucgacgacagccucaaggccugccgcuccucacgcgcccggcugccacuagaccauggacgcaggcagccgcgcgcuccaccgcuccgggcccggcgcuccacgccgaucggacgggcgucgcucacaccaccgaggcgagcccggacacugaagccacuuuguuguccucgg

SEQ ID NO: 20552 - RNA, 704 nt, Homo sapiens
ccgaggacaacaaaguggcuucaguguccgggcucgccucgguggugugagcgacgcccguccgaucggcguggagcgccgggcccggagcgguggagcgcgcggcugccugcguccauggucuaguggcagccgggcgcgugaggagcggcaggccuugaggcugucgucgagggcuccuccaccaccggccggcucccaagccagcguugcgcagaugcacggccagcucagaggcggccuuucccgccauuuuucacuucacugccguuacgcccucgcuggaaccugaggcgccgagagggcgggaccugcaggacaguagccaaugaggugcggggagggggccgggcuggccaaugggagcugcuuuccugagggacucgaaauucuccggcggguggucgggagcuggggcucugaggggcucuagcggcguugcgcgcggugccggcugggucuguaccaaaggugugaaggaaagaagacaccgaccacggcgaagcaauagagggggugcuggagcgcgagaggcuggcugauugugaccgaaaccagaggguuguccaccccgggcaucucaucccucaacuguaaaauaaucgcuaaggauuccuuccugacuuugagccucacguugucauguguguucagccugcuggccacauccuccggcaacacgcccgggcaggaggcgagucgga

SEQ ID NO: 20553 - RNA, 1941 nt, Homo sapiens
gugccagugccgcagguggauauugugccugggcggcucagugaggccgaguggauggcgcuuacagcccucgaggagggcgaggacgucguaggggacaucuuggccgacuugcuggcucgagucauggacucugcuuucaaagucuaccugacucagcaggugggccgggauccggguccuucagacucgucucccucucccgccccucccugccgaccugagauccucucucgccuccgcagugcauuccauucaccaucagccaggcccgggaggccaugcugcagaucaccgaguggcgcuuccuggcccgggacgagggagaaucugcaguagcugaggaccccacauggggugaggacgaggagccuucggcaugcacgacggacuccugggcucaggguucagugcccgugcugcacgcguccaccucggagggccuggagaacuuccaaggcgaaguacacuccucaggagccucuccggacuccucugccauugcuccugcucuccccuuuccgacaucucacugcccgagugcauuuccccaggacccugggggcguggaccggaucccuuuaggaaggucguggaugggucgaggcucccaggagcagauggaaucuugggagccuucuccgcagcugagagucacgucggccccuccucccacaucagagcuguuucaggaggcagggcccggagguccuguagaggaagcggacggccagucuagaggccucuccucggccggguccuugagcgcgagcuuccaacugucgguggaggaggcgccugccgacgaugccgacccuucucuggauccguaccugguagccagcccccaggccucaacugggaggggacacccccucggcuuccauuugucguuggaagaccucuacuguugcaugccucaacuggacgcggcuggggaucggcuggaacucaggucagagggggugcccugcaucgccucgggcguguugguguccuaccccucugugggcggcgccacccgccccuccgcguccugccagcagcagcgggccgggcacucggaugugcggcugagcgcccaccaccacaggaugcgccgcaaggcggccgugaaacgccuggacccugcgaggcucccgugccacugggugcgcccucuggcugagguccuggucccagacucucaaacacgccccuuggaagccuaccgcggacgccagcggggcgagaagaccaaggcccgggccgaaccccaagcccucggccccggcacccgugucuccccggcagcguucuucccucuccggccaggcauuccuuuccgugacuuggacucgggccccgcacuccuguuccccacuuuaaauuuaggccuaucgucgccaucccucgagucaaagcugccacucccaaacuccaggauccgcuuccucaccacacacccggugcucccugauguggcccgcagccgcagccccaagcuguggcccagugucagguggcccagcgguugggaggggaaggccgagcugcugggcgagcugugggcuggccggacccgcgugccuccacagggucuggagcuggcagacagggagggccaggauccuggcagauggccucgaaccacacccccgguccuugaagccacuucccaggugauguggaagcccguguugcugccagaagcccugaagcuggccccuggugugagcauguggaaccggagcacccagguguugcucagcucuggugugccugaacaagaggacaaagaagguagcaccuuuccucccguugagcaacaucccauccagacaggugccccaaagcccaggugaccguagcacagcuaaugaagaacucagcccccaaaguguggucacgcuccucuaagccugcugccucccucugaucccugagccucuggcaguagua

SEQ ID NO: 20554 - RNA, 1941 nt, Homo sapiens
uacuacugccagaggcucagggaucagagggaggcagcaggcuuagaggagcgugaccacacuuugggggcugaguucuucauuagcugugcuacggucaccugggcuuuggggcaccugucuggaugggauguugcucaacgggaggaaaggugcuaccuucuuuguccucuuguucaggcacaccagagcugagcaacaccugggugcuccgguuccacaugcucacaccaggggccagcuucagggcuucuggcagcaacacgggcuuccacaucaccugggaaguggcuucaaggaccgggggugugguucgaggccaucugccaggauccuggcccucccugucugccagcuccagacccuguggaggcacgcggguccggccagcccacagcucgcccagcagcucggccuuccccucccaaccgcugggccaccugacacugggccacagcuuggggcugcggcugcgggccacaucagggagcaccggguguguggugaggaagcggauccuggaguuugggaguggcagcuuugacucgagggauggcgacgauaggccuaaauuuaaaguggggaacaggagugcggggcccgaguccaagucacggaaaggaaugccuggccggagagggaagaacgcugccggggagacacgggugccggggccgagggcuugggguucggcccgggccuuggucuucucgccccgcuggcguccgcgguaggcuuccaaggggcguguuugagagucugggaccaggaccucagccagagggcgcacccaguggcacgggagccucgcaggguccaggcguuucacggccgccuugcggcgcauccugugguggugggcgcucagccgcacauccgagugcccggcccgcugcugcuggcaggacgcggaggggcggguggcgccgcccacagagggguaggacaccaacacgcccgaggcgaugcagggcacccccucugaccugaguuccagccgauccccagccgcguccaguugaggcaugcaacaguagaggucuuccaacgacaaauggaagccgaggggguguccccucccaguugaggccugggggcuggcuaccagguacggauccagagaagggucggcaucgucggcaggcgccuccuccaccgacaguuggaagcucgcgcucaaggacccggccgaggagaggccucuagacuggccguccgcuuccucuacaggaccuccgggcccugccuccugaaacagcucugaugugggaggaggggccgacgugacucucagcugcggagaaggcucccaagauuccaucugcuccugggagccucgacccauccacgaccuuccuaaagggauccgguccacgcccccaggguccuggggaaaugcacucgggcagugagaugucggaaaggggagagcaggagcaauggcagaggaguccggagaggcuccugaggaguguacuucgccuuggaaguucuccaggcccuccgagguggacgcgugcagcacgggcacugaacccugagcccaggaguccgucgugcaugccgaaggcuccucguccucaccccaugugggguccucagcuacugcagauucucccucgucccgggccaggaagcgccacucggugaucugcagcauggccucccgggccuggcugauggugaauggaaugcacugcggaggcgagagaggaucucaggucggcagggaggggcgggagagggagacgagucugaaggacccggaucccggcccaccugcugagucagguagacuuugaaagcagaguccaugacucgagccagcaagucggccaagauguccccuacgacguccucgcccuccucgagggcuguaagcgccauccacucggccucacugagccgcccaggcacaauauccaccugcggcacuggcac

SEQ ID NO: 20555 - RNA, 885 nt, Homo sapiens
cgcguagggacccuugaaggcagagacagcguccagcgcuggcgaggcgggaggcgcccggaggccgggcuugacgucgggcggggagagcugaggcucauacaggcacugcgagggggcacccgcgcaaggcgaggccucccagaacgccucugggaaaggggcagcgcccagauccggggaguaaagguccggcggacccggcagcaaggcaucggaccccgcaggaaaaggggcauccagcggggaucuggacgcugcugccucuggaccggggaagggugccaggccuaagaugcccgacaugagguugaagagugccuccgggucgugcggguguucgggcacugccugaaugaagaagcuaccgcuguagcugaggccgggagggggugugggcgcaggccccuccaggaagcaggagucggcuaaguccccacuugcgccgcagcuguucaaagcccagcucaagaagucgccugcugaggagggagcaggaaucagcucugggcacaucaaagggugcaccugaguccacagccccuaccuacaaaacucuuggugcccacggauauacacaaagugccuuuugcacauucugauucagcaggggcccgcauacgucccaaggagcacauagaaacaugcacacgcaaaacacacgugcacaggcaaaagggcgcuccgauaaccgcacagguuccugcggaggcgcuggcggcccagugugggugggaaugggggugcgcaccccaggacuccuaagcuucccaucgccccuauucucauagcuccaaugucccagucccuccugguucucagguauggugcgcccccgcgcugcgccgucgucgucugagcaccccugcucgcccuccuuaccuc

SEQ ID NO: 20556 - RNA, 885 nt, Homo sapiens
gagguaaggagggcgagcaggggugcucagacgacgacggcgcagcgcgggggcgcaccauaccugagaaccaggagggacugggacauuggagcuaugagaauaggggcgaugggaagcuuaggaguccuggggugcgcacccccauucccacccacacugggccgccagcgccuccgcaggaaccugugcgguuaucggagcgcccuuuugccugugcacguguguuuugcgugugcauguuucuaugugcuccuugggacguaugcgggccccugcugaaucagaaugugcaaaaggcacuuuguguauauccgugggcaccaagaguuuuguagguaggggcuguggacucaggugcacccuuugaugugcccagagcugauuccugcucccuccucagcaggcgacuucuugagcugggcuuugaacagcugcggcgcaaguggggacuuagccgacuccugcuuccuggaggggccugcgcccacacccccucccggccucagcuacagcgguagcuucuucauucaggcagugcccgaacacccgcacgacccggaggcacucuucaaccucaugucgggcaucuuaggccuggcacccuuccccgguccagaggcagcagcguccagauccccgcuggaugccccuuuuccugcgggguccgaugccuugcugccggguccgccggaccuuuacuccccggaucugggcgcugccccuuucccagaggcguucugggaggccucgccuugcgcgggugcccccucgcagugccuguaugagccucagcucuccccgcccgacgucaagcccggccuccgggcgccucccgccucgccagcgcuggacgcugucucugccuucaagggucccuacgcg

SEQ ID NO: 20557 - RNA, 3516 nt, Homo sapiens
cucuugcuccaacauggcuggguaccguggcuggauaaccguucccggugcagguaacagguggacaauaucacaauaucacugcaccccucucgugaaaaagaaagggaacacagucuagcacucaccagagaagcagguuuuucuucaucuuccagaaauguguucuaaaacaccagaaaaaaacaucagccaaucaucgaccuguuaaccuaaccccagcucaagagauggaacucggaucccauugccaagucagcaccggcaggcacaaagguggcagggccgggagacaccacuuucccgagaguccuauccccacccccaacagggaucgggagagagcaguuagcacagggcucgucucagaugggcuucucaccagcggggugccccuaaccuagaccccuugccucuccaagccuguuucccucucuuucccaguuacuacuuggggcucuuugcacggucuaugguggcacaagaaguggguucggaaacccaguagcugaauugaagcggaggggaggcuuuuccgcaccuacggcuacagggcggcgagagcaggcuugccaggcaacccucgaaaggccuuccgggaagagggggaagagugacgcuugggugugggggcacauccccagcaaccggacgaggccgccacccccaaggcccuccugggcuucggaucccgcgccaaccccucgcccaggucucggagcgaacucuccgcgccaggcgggcggggcggagggaggagggaguugagaguggacggccgggagugggaggaaaagcgcagacgccaggaacgccccgugagugaggagaggagagcgugggagucacgcggagaagccagacccagacgccgaccgggcacugguggcgcugccggggucccggggguuccuggacccccuaccccaggccccuccaaagcaacugggguaaaccagacgcacugugaggccagcgcagcugcuggacacgguccccggcgccgcuccaaccagaccgcgaccgcuaagccccuccuuucgagaaacucuggggccgccccuggaaguggcggggcgaagggaccggaggagggaccggaggagcgaggcgcgcggcgcagcgauggagccggucagcacgggcgcggaggccggcauggagggcgcgggaggugacccguaccggcgaccugcgcggcgcacgcaguggcugcugagcgcccuggcgcaccacuacgggcuggaccgcggcguggagaacgagaucguggugcuggccaccggccuggaccaguaccugcaggaggucuuccaccaccuggacugccgcggcgccggccgucugccccgcgccgacuuccgagcgcucugcgcugugcuggggcugcgcgcggagggggccaccacggccgggcaggcagcaggugacgggaacuccagagaugugacccccggggaugcggccgcugaguuggccacggacggggacucagauaccgaugaagaggcgcgccuggcgcugcgcgccgagccgccggagcucaccuuccgccaguuccacgcgcgccucuguggcuacuucggcacccgugcggggccccggcugccccgcggcgcucucagcgagcacaucgagacgcagauccgccugcgccguccgcgccgccgccgccgcccgcccugcgcgccuggccccgacagcgguccugacugugagcgcguugcgcggcuggaggaggagaauagcagcuugcgcgaguugguggaggaccugcgcgccgcgcugcagagcagugaugcgcgcugccuagcacugcaggugcgcgccggccacgaagggagggugguaacgcccgggagagggcucgaacuaaaagcuggcuggcugcggagcccgacaggacagagucagaggaaggggagacagagggcagccccacaccaucccacuccgcaucagcacacuugcaucuugccccuguuccuccccauuccacuccaguccccaacccuauucuuaccaccuauuccauuccugaaaaccccaaucacacucaaacaaccauaccccacuuuucugcuccaccgccacaucaucgcgucuugccccuuuaaccuaggaauugcaccugucuggguagucucacauauucccuuucaacaagcaucuuucucucuccuuccugccaggcuucugggagguuuaggagacagaagugugaagaaggcccuguccucaccuuuagggauaucccugccuccugggguagacugacagcuccuucugucaaucagcaaagacuuauggggcucccugugggagaaacagagacaagugagaaacagacaauguggcucacacuguggaucaggcacucacgggccaccaagugccugcgggaaccagacccgcucugggcuauugagaagaaaccauggggugagauagggacccagccuuagcaucugggagccgucgacaaacacuuaagcacugugccagccgagcaccaagggcagugcugggccgcaggggucagaggaggaaaggaacagccccuaccccaggcgacaacaggccaggaagaaacugacauuauaugaccccgccuuagcucaggacacugcagagugcagggaaguggcaaggugugguuuucagugucagugugcauggaagccaggguggaggcgggaaacuacuccucugauguggaaucccaaguaacguacugggagccaugggaugcgccugaacggucuuccggcaucucucaugcuugguauuuauugagcaccuacuaugugccagguuuguuuuaggcucugggaacacaccaguaaagacagauagaaaccacccucaaaagccucuagugagcaggcacggggagggcuggaaaugccacuggggggagucuaggagaugaggaaccgccacccggcaggcugaacgccgccaauacaguaggccgagaagagucgcgagguugguacuauagagggaacagaauacaggcgucgugucucaguuuccuucagugaaaaaacguuggggggugggggaugaggaggaaucagagcuugggccucccuggggauguggcgaggguuaaaggagcuuggacgcaccggaccuaagggccuggcacccggaagcagacggcgcaagaaacgugcucaagcgcuucugggugcagaggcauggggccgccgucguggcgggcguucgucuggugcaucuggcuggggcacuuacccccugccccugcugcccuguccccgcaggucggacucuggaagagccaggcgagcacccacgagauggggcacggcgggccggaggcugcggugcgggagcugcgucaggcgcagggcgcccuggcugcggcggaggcccgcgcugggcggcugcgccguggccaggccgaggugcggcggcgcgcggaggaggcccggcagguggugcugcgcagccugcaccgcgugcgagagcuggaggcgcuggcgcaac

SEQ ID NO: 20558 - RNA, 3516 nt, Homo sapiens
guugcgccagcgccuccagcucucgcacgcggugcaggcugcgcagcaccaccugccgggccuccuccgcgcgccgccgcaccucggccuggccacggcgcagccgcccagcgcgggccuccgccgcagccagggcgcccugcgccugacgcagcucccgcaccgcagccuccggcccgccgugccccaucucgugggugcucgccuggcucuuccagaguccgaccugcggggacagggcagcaggggcaggggguaagugccccagccagaugcaccagacgaacgcccgccacgacggcggccccaugccucugcacccagaagcgcuugagcacguuucuugcgccgucugcuuccgggugccaggcccuuagguccggugcguccaagcuccuuuaacccucgccacauccccagggaggcccaagcucugauuccuccucaucccccaccccccaacguuuuuucacugaaggaaacugagacacgacgccuguauucuguucccucuauaguaccaaccucgcgacucuucucggccuacuguauuggcggcguucagccugccggguggcgguuccucaucuccuagacuccccccaguggcauuuccagcccuccccgugccugcucacuagaggcuuuugagggugguuucuaucugucuuuacugguguguucccagagccuaaaacaaaccuggcacauaguaggugcucaauaaauaccaagcaugagagaugccggaagaccguucaggcgcaucccauggcucccaguacguuacuugggauuccacaucagaggaguaguuucccgccuccacccuggcuuccaugcacacugacacugaaaaccacaccuugccacuucccugcacucugcaguguccugagcuaaggcggggucauauaaugucaguuucuuccuggccuguugucgccugggguaggggcuguuccuuuccuccucugaccccugcggcccagcacugcccuuggugcucggcuggcacagugcuuaaguguuugucgacggcucccagaugcuaaggcugggucccuaucucaccccaugguuucuucucaauagcccagagcgggucugguucccgcaggcacuugguggcccgugagugccugauccacagugugagccacauugucuguuucucacuugucucuguuucucccacagggagccccauaagucuuugcugauugacagaaggagcugucagucuaccccaggaggcagggauaucccuaaaggugaggacagggccuucuucacacuucugucuccuaaaccucccagaagccuggcaggaaggagagagaaagaugcuuguugaaagggaauaugugagacuacccagacaggugcaauuccuagguuaaaggggcaagacgcgaugauguggcgguggagcagaaaagugggguaugguuguuugagugugauugggguuuucaggaauggaauaggugguaagaauaggguuggggacuggaguggaauggggaggaacaggggcaagaugcaagugugcugaugcggagugggaugguguggggcugcccucugucuccccuuccucugacucuguccugucgggcuccgcagccagccagcuuuuaguucgagcccucucccgggcguuaccacccucccuucguggccggcgcgcaccugcagugcuaggcagcgcgcaucacugcucugcagcgcggcgcgcagguccuccaccaacucgcgcaagcugcuauucuccuccuccagccgcgcaacgcgcucacagucaggaccgcugucggggccaggcgcgcagggcgggcggcggcggcggcgcggacggcgcaggcggaucugcgucucgaugugcucgcugagagcgccgcggggcagccggggccccgcacgggugccgaaguagccacagaggcgcgcguggaacuggcggaaggugagcuccggcggcucggcgcgcagcgccaggcgcgccucuucaucgguaucugaguccccguccguggccaacucagcggccgcauccccgggggucacaucucuggaguucccgucaccugcugccugcccggccgugguggcccccuccgcgcgcagccccagcacagcgcagagcgcucggaagucggcgcggggcagacggccggcgccgcggcaguccaggugguggaagaccuccugcagguacugguccaggccgguggccagcaccacgaucucguucuccacgccgcgguccagcccguaguggugcgccagggcgcucagcagccacugcgugcgccgcgcaggucgccgguacgggucaccucccgcgcccuccaugccggccuccgcgcccgugcugaccggcuccaucgcugcgccgcgcgccucgcuccuccggucccuccuccggucccuucgccccgccacuuccaggggcggccccagaguuucucgaaaggaggggcuuagcggucgcggucugguuggagcggcgccggggaccguguccagcagcugcgcuggccucacagugcgucugguuuaccccaguugcuuuggaggggccugggguaggggguccaggaacccccgggaccccggcagcgccaccagugcccggucggcgucugggucuggcuucuccgcgugacucccacgcucuccucuccucacucacggggcguuccuggcgucugcgcuuuuccucccacucccggccguccacucucaacucccuccucccuccgccccgcccgccuggcgcggagaguucgcuccgagaccugggcgagggguuggcgcgggauccgaagcccaggagggccuuggggguggcggccucguccgguugcuggggaugugcccccacacccaagcgucacucuucccccucuucccggaaggccuuucgaggguugccuggcaagccugcucucgccgcccuguagccguaggugcggaaaagccuccccuccgcuucaauucagcuacuggguuuccgaacccacuucuugugccaccauagaccgugcaaagagccccaaguaguaacugggaaagagagggaaacaggcuuggagaggcaaggggucuagguuaggggcaccccgcuggugagaagcccaucugagacgagcccugugcuaacugcucucucccgaucccuguuggggguggggauaggacucucgggaaaguggugucucccggcccugccaccuuugugccugccggugcugacuuggcaaugggauccgaguuccaucucuugagcugggguuagguuaacaggucgaugauuggcugauguuuuuuucugguguuuuagaacacauuucuggaagaugaagaaaaaccugcuucucuggugagugcuagacuguguucccuuucuuuuucacgagaggggugcagugauauugugauauuguccaccuguuaccugcaccgggaacgguuauccagccacgguacccagccauguuggagcaagag

SEQ ID NO: 20559 - RNA, 3349 nt, Homo sapiens
ucccgccuaaugcagccgcugaccgcccacuccccgacggccaggacuccccagggacagggacguguccccagggcaggccccuggauggacgcggcgacugaccccacuucgcuggacgcugugcugggaaggacacagagagguggcuggggcagccugcggucacaaagcgaggcccaaaggggcgcucuccucacccccacgucuccugggugccgaccugcacccucccuucgccaccggacuggggccaucugggaugucucggggguauccggagggcuaagcaccgccgagggacggcuccgugggaagaguuuucuggacccagaaggcagacgccaguaguacuguccuaggagucggaggucggggugggggaguucucagcucuuugggucgcacggagcuuuucuuggguaaggcaguaaguacuuagguuuaaaggacuuacuuacagcuaccauuuauugaguacugucugcuugucagacacgaugcagagaauuucgcggcguggggcgggucucauugaaucucccgucccacuccgcggggugggccugugauuagcucauuucaccauugagaggucggaaguacaaaggcuacauucgcuuuuacugagagccgccggcgccuucugcuuuguuuguacaggcgaggaaacugaggcucggcugguggcgccgugggcuuggaguccgagccacgcugacugcaaagacgggucucauucccgcagaucgagcucugccggcggcugcgccgcaagccgggcagguggcgagcuugagcccccacgcacagaaagcaggacccccucggcugccuugggccgccaccgccagcaggcccuccgcccgggacuaacuuguuugcuuuucauugguucucauucaguucccgccaucgaaaggccccgucccgcagcuuuccacgcgcgccccacuuuacgccuaagguccucagucucuccaguggggcccugucacagggacaauaagcggcccuccagccggcgucgcucaggcugcggaccucacugcagaccgggccagcggugcggggcccagcggagccugagaaggucaaaggccggagcgcacugcgccucgggagcacagagggagcggaggaggggcgaaggggauggguggggggugccgccgagggagucgcgcgucagagaccccggccacggccagcacucggcuccgggcccgccccucaccgcgcgccccgccccgccccgccuggcucuccccucuaaagcgcccggcgcgcgccucccaccgccgcacuuucacucuccgucagccgcauugcccgcucggcguccggcccccgacccgcgcucguccgcccgcccgcccgcccgcccgcgccaugaacgccaaggucguggucgugcugguccucgugcugaccgcgcucugccucagcgacgguaagugcgcucggcggggaggcccuggcgaggcucugggcuucggcucccgcccggcgcagagccgcggcuccucugccugcgcccgcaguuugcgccgcccgacacaguggggguggaggcagcucgcuuagcugggcgcucuggugcggugucgcguucaaagcccuacuuuugcgccgaggguuugugaccugcagagagcgaccgccugaccucaagcuggcugcagagcgaggucagccgggacaacugggcaggaacgccccaagagagcguucgggacuggcgcgggaaggcgcgaggguggggagccgcggaccccagaccccugccugcccacccuccacccacugccuucccgcugcgggcucgguuuccacaggcgaaugggcuccgagguccugcugcgcacagugcuggaggucgggcggugcauggcgagagcgcgcuuugcaaaguucgccucaugccgcgacuugaggcugugagguccgaugcagccgcgcagccuccgcucccugcgaagccgauccucuccccacacccucgcggggcucuuggccaggcgcgggcgggcugcgcggcgcagcugucgggcuugugccacccgccaggccgcgcuucugcacagcuccgcgguccgcagcgacgcggaccugggcgcgcguccagccgcugucuuccugucucuucucggguucaccugagagaggcccagggacccuccgagccucacacgcccccuccccagcuccccaaacacaccugcagacaggcucuuuugucaccagcuggccaagcgcuuugccccagaaugagagcugcagcaaaguucaaucuccaaggcccugggccacugggaaccguggugucccguuucacugggagagggcuuuuuucuuuucuuucgcugaagagaaacucgcugcgcugucacaggacaccgaugcaaaccaaaauaaacuguugccucugaacacacaaaacaaaacccuguggcucaggccgcugagcuuccuuggcugugaaguuuccugcaaagaguugaaggacacucugagugcucuugcagccgcgggcugugcaggcccagcgcgccucgagcccuuggcuggguuggugcagacguggccccggcguccuagcuggcuuggacugugcgcuggugugagcaggaccagcgcagcugagucgggcuggagaagcugggcagccuggggucguggcggacugccuaaguguuaaggacacagacugaaggcaauugggaauguucgucguugaugaaaagucccugaggcugugucugcacacugacccccccccccccccgcaagucauggggcauguuucuaguuuuuauugcuggauauucuucuguuccuguaaggucucugguuugggcaguuauugacugauuggugggaugagcgcggaggugucacagugcgccgcucugggaaauggugcugcccccuccccggagggcuggagagaggauuggaaugaggaaccucggucuuugaguuaugggugcaacugaccugggggaagcacagagacgugggguucaucccagacuccuccuggccugggaagggugacauggcccucagaguugccccauuggcagccaaguaaccagggcaggagccugggcuccaggcagaucugcuccuuacacacaucgccagaauguuuuguuuuguuuuguuuuccccucaccucacagugccuaugugcccccuauccccacacuuaguccucaagcugcacuacagagagagcuuggccagggguccugccccucccccauuggcugacuuccgucaggcagcugggcccuuggguuucccgggcuuaaacucagggugggcccccuucccaagccug

SEQ ID NO: 20560 - RNA, 3349 nt, Homo sapiens
caggcuugggaagggggcccacccugaguuuaagcccgggaaacccaagggcccagcugccugacggaagucagccaaugggggaggggcaggaccccuggccaagcucucucuguagugcagcuugaggacuaaguguggggauagggggcacauaggcacugugaggugaggggaaaacaaaacaaaacaaaacauucuggcgauguguguaaggagcagaucugccuggagcccaggcuccugcccugguuacuuggcugccaauggggcaacucugagggccaugucacccuucccaggccaggaggagucugggaugaaccccacgucucugugcuucccccaggucaguugcacccauaacucaaagaccgagguuccucauuccaauccucucuccagcccuccggggagggggcagcaccauuucccagagcggcgcacugugacaccuccgcgcucaucccaccaaucagucaauaacugcccaaaccagagaccuuacaggaacagaagaauauccagcaauaaaaacuagaaacaugccccaugacuugcgggggggggggggggucagugugcagacacagccucagggacuuuucaucaacgacgaacauucccaauugccuucagucuguguccuuaacacuuaggcaguccgccacgaccccaggcugcccagcuucuccagcccgacucagcugcgcugguccugcucacaccagcgcacaguccaagccagcuaggacgccggggccacgucugcaccaacccagccaagggcucgaggcgcgcugggccugcacagcccgcggcugcaagagcacucagaguguccuucaacucuuugcaggaaacuucacagccaaggaagcucagcggccugagccacaggguuuuguuuuguguguucagaggcaacaguuuauuuugguuugcaucgguguccugugacagcgcagcgaguuucucuucagcgaaagaaaagaaaaaagcccucucccagugaaacgggacaccacgguucccaguggcccagggccuuggagauugaacuuugcugcagcucucauucuggggcaaagcgcuuggccagcuggugacaaaagagccugucugcagguguguuuggggagcuggggagggggcgugugaggcucggagggucccugggccucucucaggugaacccgagaagagacaggaagacagcggcuggacgcgcgcccagguccgcgucgcugcggaccgcggagcugugcagaagcgcggccuggcggguggcacaagcccgacagcugcgccgcgcagcccgcccgcgccuggccaagagccccgcgaggguguggggagaggaucggcuucgcagggagcggaggcugcgcggcugcaucggaccucacagccucaagucgcggcaugaggcgaacuuugcaaagcgcgcucucgccaugcaccgcccgaccuccagcacugugcgcagcaggaccucggagcccauucgccuguggaaaccgagcccgcagcgggaaggcaguggguggagggugggcaggcaggggucugggguccgcggcuccccacccucgcgccuucccgcgccagucccgaacgcucucuuggggcguuccugcccaguugucccggcugaccucgcucugcagccagcuugaggucaggcggucgcucucugcaggucacaaacccucggcgcaaaaguagggcuuugaacgcgacaccgcaccagagcgcccagcuaagcgagcugccuccacccccacugugucgggcggcgcaaacugcgggcgcaggcagaggagccgcggcucugcgccgggcgggagccgaagcccagagccucgccagggccuccccgccgagcgcacuuaccgucgcugaggcagagcgcggucagcacgaggaccagcacgaccacgaccuuggcguucauggcgcgggcgggcgggcgggcgggcggacgagcgcgggucgggggccggacgccgagcgggcaaugcggcugacggagagugaaagugcggcggugggaggcgcgcgccgggcgcuuuagaggggagagccaggcggggcggggcggggcgcgcggugaggggcgggcccggagccgagugcuggccguggccggggucucugacgcgcgacucccucggcggcaccccccacccauccccuucgccccuccuccgcucccucugugcucccgaggcgcagugcgcuccggccuuugaccuucucaggcuccgcugggccccgcaccgcuggcccggucugcagugagguccgcagccugagcgacgccggcuggagggccgcuuauugucccugugacagggccccacuggagagacugaggaccuuaggcguaaaguggggcgcgcguggaaagcugcgggacggggccuuucgauggcgggaacugaaugagaaccaaugaaaagcaaacaaguuagucccgggcggagggccugcuggcgguggcggcccaaggcagccgaggggguccugcuuucugugcgugggggcucaagcucgccaccugcccggcuugcggcgcagccgccggcagagcucgaucugcgggaaugagacccgucuuugcagucagcguggcucggacuccaagcccacggcgccaccagccgagccucaguuuccucgccuguacaaacaaagcagaaggcgccggcggcucucaguaaaagcgaauguagccuuuguacuuccgaccucucaauggugaaaugagcuaaucacaggcccaccccgcggagugggacgggagauucaaugagacccgccccacgccgcgaaauucucugcaucgugucugacaagcagacaguacucaauaaaugguagcuguaaguaaguccuuuaaaccuaaguacuuacugccuuacccaagaaaagcuccgugcgacccaaagagcugagaacucccccaccccgaccuccgacuccuaggacaguacuacuggcgucugccuucuggguccagaaaacucuucccacggagccgucccucggcggugcuuagcccuccggauacccccgagacaucccagauggccccaguccgguggcgaagggagggugcaggucggcacccaggagacgugggggugaggagagcgccccuuugggccucgcuuugugaccgcaggcugccccagccaccucucuguguccuucccagcacagcguccagcgaaguggggucagucgccgcguccauccaggggccugcccuggggacacgucccugucccuggggaguccuggccgucggggagugggcggucagcggcugcauuaggcggga

SEQ ID NO: 20561 - RNA, 726 nt, Homo sapiens
cgcccgggcuggggaggcaggaaguccgcgccgcgggcuuagaggggcucagagccuugggcacagauaucgcggcgccuggggaggacccucggagcggugggaguugcgguguggaauacgggggggguggguggcacaucgcgcggcgcguguugcacaaccuggcccgccgucgugacuggaggcgggagugacaccuccgcccgggccgcggaguucggggaaggagggcgcggcgcugggccaggccggaggggcggccagggcugauagaaaggggcuguggagaaggggcccggggaggagccaggacgggucuggacccagcuccacgccuugcgccccucacguaccccggcggggcacggucggcccucgggaggcccaucgcgcccucgggagcuucccucaagccgugcccuucaugccgccgacggagccgggcgagcccacgucguccgugcggaagguggagucccucacccgcggcccccagagggaccccgcugucguagagccacgcgggggccggagcgcugagacgcggcaccauguuucggggagagcucugccgagggcggcugagggccaccuccccagaggcgcgaagcccugaggaugggcagaugguucuuaagacggcgcccuucccgccacucccacccccgacuaccaccaccugggucugggaacccggugagagcgcagucggagggucgaacg

SEQ ID NO: 20562 - RNA, 726 nt, Homo sapiens
cguucgacccuccgacugcgcucucaccggguucccagacccagguggugguagucgggggugggaguggcgggaagggcgccgucuuaagaaccaucugcccauccucagggcuucgcgccucuggggagguggcccucagccgcccucggcagagcucuccccgaaacauggugccgcgucucagcgcuccggcccccgcguggcucuacgacagcggggucccucugggggccgcgggugagggacuccaccuuccgcacggacgacgugggcucgcccggcuccgucggcggcaugaagggcacggcuugagggaagcucccgagggcgcgaugggccucccgagggccgaccgugccccgccgggguacgugaggggcgcaaggcguggagcuggguccagacccguccuggcuccuccccgggccccuucuccacagccccuuucuaucagcccuggccgccccuccggccuggcccagcgccgcgcccuccuuccccgaacuccgcggcccgggcggaggugucacucccgccuccagucacgacggcgggccagguugugcaacacgcgccgcgcgaugugccacccaccccccccguauuccacaccgcaacucccaccgcuccgaggguccuccccaggcgccgcgauaucugugcccaaggcucugagccccucuaagcccgcggcgcggacuuccugccuccccagcccgggcg

SEQ ID NO: 20563 - RNA, 847 nt, Homo sapiens
cucccaaacguguaucccuccucuucccgcgaaaggcgcaugcaauacaggugucggggaagaggguccugagaaaggcccugcagucccuggggguugcagcgggaagugaagaggauaagagccgguggggaguggaggcgagcugggccuguccuccccucugcgccucgacagauccccacuucuuccaucucucccccgugcagcagaggggaggaagcgcgaacggagaggggcgccguggggaagagcaggagagaggggaguccaagggaagucugggggaggugaggaacggugagagaagacauuuccccaaaugcaaaccaaaagggacgcucuaggauaaaaaugcaccgcccggagaggcucccaacuuagaaacaaauagaaccguagaugagggcgagcaccgggagagaggcaggcaaggguggagaggcgcaguuagagauaggcgcgcagagggccagaaagcgaaggcagcgggcggggaaggccagggagggaaggcgcccugggcgcgggcggcggagcaggugcgcagcugcaccgggccagagaugcggagaggugcgcagcggcaccggguaaaggaggcaggggcgccgcggcgaagggagggggccacaggggcucugggccuggcgggggcuucaccucgggacugcagacucagacggugguaguggcgguggcgguggcgguggcgacggcggcgcugagagagcgggaguggcaguggcggcggcggcugcggcucccgggcggcgggcggaggaggcgccuauagggccgcgcgggcgcaugugacccggagcccccgaugagucaggagcugccg

SEQ ID NO: 20564 - RNA, 847 nt, Homo sapiens
cggcagcuccugacucaucgggggcuccgggucacaugcgcccgcgcggcccuauaggcgccuccuccgcccgccgcccgggagccgcagccgccgccgccacugccacucccgcucucucagcgccgccgucgccaccgccaccgccaccgccacuaccaccgucugagucugcagucccgaggugaagcccccgccaggcccagagccccuguggcccccucccuucgccgcggcgccccugccuccuuuacccggugccgcugcgcaccucuccgcaucucuggcccggugcagcugcgcaccugcuccgccgcccgcgcccagggcgccuucccucccuggccuuccccgcccgcugccuucgcuuucuggcccucugcgcgccuaucucuaacugcgccucuccacccuugccugccucucucccggugcucgcccucaucuacgguucuauuuguuucuaaguugggagccucuccgggcggugcauuuuuauccuagagcgucccuuuugguuugcauuuggggaaaugucuucucucaccguuccucaccucccccagacuucccuuggacuccccucucuccugcucuuccccacggcgccccucuccguucgcgcuuccuccccucugcugcacgggggagagauggaagaaguggggaucugucgaggcgcagaggggaggacaggcccagcucgccuccacuccccaccggcucuuauccucuucacuucccgcugcaacccccagggacugcagggccuuucucaggacccucuuccccgacaccuguauugcaugcgccuuucgcgggaagaggagggauacacguuugggag

SEQ ID NO: 20565 - RNA, 3393 nt, Homo sapiens
gugaaucagaauagcccaucagugcuuugguauucccagggauccuauaaaagggggugaacuacagcuccaaaacggggagucggagaagugcgcagcagccgcggcagcuccgcgacgcucccuuuggcuacuccuucgcgcacucuaacucacucacucuuuuuuggauuucgucaucuuuucaaaaaaucaauaaaaauauucuggaggcuccggggguccacuucuuggucucauccggauccccagauccuccucuaucauucccgacaauuggaaaaaaugucugggggggucccugcggcccaggggccgcuuuugggggggcgggugaggagagguggggaagagagggggagggaggagaggaggaagagcgccgcagccucggcagcuggagucggagcagggggggaugguuucaaaaaauaauuaaaaaucgaggaaauauccuagaaaagcccuuuuggcgugaaaaccccaaagaagagccaggcuucccgaaacagagguuucgggugccagaaaggucuguauuccgaccccuggggcuuuggaucccgggaggaaacuugaaggggugagcgccgcggcgggaguguccggcugcggcccacaaggacagaaacuagggaacgcggugacgagcgaggggaaagacgggagcagagagcccuggaaagaggcacggggggcucccaccucuccuucaggggugacccgguauccccccuacacacacccccucccccccuuccuaccccacccaaaucuccgcaccgaggaagcuggaaaaccaaacuguaaguaaucuucgugagguggggggugggggagagggcacgauuagaagugggguggccgggauaauggggugcgaggguaagcgggcgacguuucccagccuuuccaaagggaguuugcaaagcaacauggcgaaaccacggcagguccagagcugugcauacgugggcacacggcucgcugggcaaagacuuggagugaggggcaagaagcgguucuuuuggguuccccugaaacacgcguuucuucaaugggacuuccggggcucccgaauuccccguuucucuccuucucccuccucccuccaccuccccggugaagugccagcgcggagucgcgaccacaggcggggaccugaggccaagacgaauuugcucuggccuuuugggggggguugccuuucuacucggggucccgauuucaggccccgacucucuuccuggccgcagcgcaagcagccgcggcggcuucgcaaaagacaggucgcgaggggggugggaagaagaggcagccacaugcaggaacacgcgcgcgggaugcuccccuacccccgcccaggacagccucgcuucucccagauuuuccuccccccucugccuccccaguuuaucuggagaggaacagaaauaaagccacgcgucucgccagaaggcgcgcgguaaacucccgcacaggagccgggaggccggcgcggggauugcccucucccagguuuagggcuccggccggggacccgagcauccggagggguccuggcuccuggcgagcgccaccccccgaccuaccuccagcauccagguggccaccauucugcgcauguaggguuggauguccuucugcacgcacuugaaguaggagcacugcggaagguagcgcuccucgauggugagcagguucugcaggacgcggucgucucggagcagguugcggucccgcacggcccugcggaccggguccaccucguggcacagcagcuccauggccagcccggcggccccucucccuccugcuuuccccggccuggaaaaagguuuuucuguuuuuguuuuuuggaaggggaggggagagcguuccccugaccuccuuccuuuggcuaaauaggggguuuucgggggagaggugagggcagagagagaagguggagcagaagggaggcgaggauuggguggugggcgagcagagccucggggcugccucacucgcaccgguccuccccuuaaaacuggucucgcucuccccugcucgcucuucuccgcucugaagcggugacgcaagcuggcugggcaguuagcucuccucccucuccccgcgcuccccgcucugguuccuccuccccuuuccuccccucccgguccuccccuccuccuuucaaucucucccucccucccuccuuuuccccucucguuauuaaggagaacagcagcuggcccgacccaacuucaaacgcggucccccgccaccccccaccccucucccuccauccagcccugcaugccaggggccccggacagggcaacccacaaaaaacuaccgacuccuauuucugcccucuaauuucacucauucuguagguguagcacgccaaaauacgacccuccaacuuuggcuucuucaaaacggauccuaauccuccugcccuuguauuuaagauccaggaauguaggguagauuaucugaagauggggugaccucagacaauuuagaaauaggucccuuaagugaaaaauaagggagggggugauuuuagaaaauagcaaccucgcauacccagagauaaaggucaugucccugaagucuguguuccugauaacuucgaagcuguuucgaaagccccgauuaaagggaccagaacaacgucccuucugccccccccugcagagugugugcagaggaagaagagggagggagagguggguauuaggaaggaaggggggugcuucucuggagggauagaaugugauccucgagcagaaaccaucguguuucugggggcucuucgggcgccguggggcgacgcggugcagcgucuagggccgccgcaggccgggggcagggcucccagcgguucccccgcggccagcggccacgcaggaaaaacccgcuuccucgccccugcaucugcugacaagccgcccgaggugucugcgcugagcguggccacaccgaugcagcuuucuaggaaauggcccgggagggggagggggcgagugagggauuagguccggcucccccucgcucccccugcgcaaacaccaccaccccuuccuuuccccggaggcaugaggccuccacgcucgguccuucgcccgcauccucgccgaccccuccgguuucgcgccucacucgccaggcuuucucccugggagccgacugcggugaagucgccgccagcacggucggcccugacacgugcucuaacgcaugcuugagucaaggcugucuuuacaggagauacgaucugguggcguuucuucaccuccuuccucccgucaccccccacccccaccgcgcccuuugguguauuucacuccaggaggaaggggagagaccagcgcccugaugugcuggccaagcuggcacgugcag

SEQ ID NO: 20566 - RNA, 3393 nt, Homo sapiens
cugcacgugccagcuuggccagcacaucagggcgcuggucucuccccuuccuccuggagugaaauacaccaaagggcgcgguggggguggggggugacgggaggaaggaggugaagaaacgccaccagaucguaucuccuguaaagacagccuugacucaagcaugcguuagagcacgugucagggccgaccgugcuggcggcgacuucaccgcagucggcucccagggagaaagccuggcgagugaggcgcgaaaccggaggggucggcgaggaugcgggcgaaggaccgagcguggaggccucaugccuccggggaaaggaagggguggugguguuugcgcagggggagcgagggggagccggaccuaaucccucacucgcccccucccccucccgggccauuuccuagaaagcugcaucgguguggccacgcucagcgcagacaccucgggcggcuugucagcagaugcaggggcgaggaagcggguuuuuccugcguggccgcuggccgcgggggaaccgcugggagcccugcccccggccugcggcggcccuagacgcugcaccgcgucgccccacggcgcccgaagagcccccagaaacacgaugguuucugcucgaggaucacauucuaucccuccagagaagcaccccccuuccuuccuaauacccaccucucccucccucuucuuccucugcacacacucugcaggggggggcagaagggacguuguucuggucccuuuaaucggggcuuucgaaacagcuucgaaguuaucaggaacacagacuucagggacaugaccuuuaucucuggguaugcgagguugcuauuuucuaaaaucacccccucccuuauuuuucacuuaagggaccuauuucuaaauugucugaggucaccccaucuucagauaaucuacccuacauuccuggaucuuaaauacaagggcaggaggauuaggauccguuuugaagaagccaaaguuggagggucguauuuuggcgugcuacaccuacagaaugagugaaauuagagggcagaaauaggagucgguaguuuuuuguggguugcccuguccggggccccuggcaugcagggcuggauggagggagaggggugggggguggcgggggaccgcguuugaaguugggucgggccagcugcuguucuccuuaauaacgagaggggaaaaggagggagggagggagagauugaaaggaggaggggaggaccgggaggggaggaaaggggaggaggaaccagagcggggagcgcggggagagggaggagagcuaacugcccagccagcuugcgucaccgcuucagagcggagaagagcgagcaggggagagcgagaccaguuuuaaggggaggaccggugcgagugaggcagccccgaggcucugcucgcccaccacccaauccucgccucccuucugcuccaccuucucucucugcccucaccucucccccgaaaacccccuauuuagccaaaggaaggaggucaggggaacgcucuccccuccccuuccaaaaaacaaaaacagaaaaaccuuuuuccaggccggggaaagcaggagggagaggggccgccgggcuggccauggagcugcugugccacgagguggacccgguccgcagggccgugcgggaccgcaaccugcuccgagacgaccgcguccugcagaaccugcucaccaucgaggagcgcuaccuuccgcagugcuccuacuucaagugcgugcagaaggacauccaacccuacaugcgcagaaugguggccaccuggaugcuggagguaggucgggggguggcgcucgccaggagccaggaccccuccggaugcucggguccccggccggagcccuaaaccugggagagggcaauccccgcgccggccucccggcuccugugcgggaguuuaccgcgcgccuucuggcgagacgcguggcuuuauuucuguuccucuccagauaaacuggggaggcagaggggggaggaaaaucugggagaagcgaggcuguccugggcggggguaggggagcaucccgcgcgcguguuccugcauguggcugccucuucuucccaccccccucgcgaccugucuuuugcgaagccgccgcggcugcuugcgcugcggccaggaagagagucggggccugaaaucgggaccccgaguagaaaggcaaccccccccaaaaggccagagcaaauucgucuuggccucagguccccgccuguggucgcgacuccgcgcuggcacuucaccggggagguggagggaggagggagaaggagagaaacggggaauucgggagccccggaagucccauugaagaaacgcguguuucaggggaacccaaaagaaccgcuucuugccccucacuccaagucuuugcccagcgagccgugugcccacguaugcacagcucuggaccugccgugguuucgccauguugcuuugcaaacucccuuuggaaaggcugggaaacgucgcccgcuuacccucgcaccccauuaucccggccaccccacuucuaaucgugcccucucccccaccccccaccucacgaagauuacuuacaguuugguuuuccagcuuccucggugcggagauuugggugggguaggaagggggggaggggguguguguaggggggauaccgggucaccccugaaggagaggugggagccccccgugccucuuuccagggcucucugcucccgucuuuccccucgcucgucaccgcguucccuaguuucuguccuugugggccgcagccggacacucccgccgcggcgcucaccccuucaaguuuccucccgggauccaaagccccaggggucggaauacagaccuuucuggcacccgaaaccucuguuucgggaagccuggcucuucuuugggguuuucacgccaaaagggcuuuucuaggauauuuccucgauuuuuaauuauuuuuugaaaccaucccccccugcuccgacuccagcugccgaggcugcggcgcucuuccuccucuccucccucccccucucuuccccaccucuccucacccgcccccccaaaagcggccccugggccgcagggacccccccagacauuuuuuccaauugucgggaaugauagaggaggaucuggggauccggaugagaccaagaaguggacccccggagccuccagaauauuuuuauugauuuuuugaaaagaugacgaaauccaaaaaagagugagugaguuagagugcgcgaaggaguagccaaagggagcgucgcggagcugccgcggcugcugcgcacuucuccgacuccccguuuuggagcuguaguucacccccuuuuauaggaucccugggaauaccaaagcacugaugggcuauucugauucac

SEQ ID NO: 20567 - RNA, 607 nt, Homo sapiens
cauugggcaauuuuugaaauccugaaguaggaagagaccccggaggauauaagucggggguggggguggagcagagaaucugugaaagauauucaaagagagaaaaggggaauccugaucguuucugcccgugcuuguuuucaacuugagcgugcuagccuuuaacuugaagaagucucauuggagcaucuagcauucuccaggaguuauucgaaagcugaaacuuucaguggauugugggccuggggagaagaaggauuccgaggguggaauugggaagagcgugcgugcgugugugugugugugugugugcgcgcgcgcgcgugggucggggcgggggcgucggggggccacugggaauucagugaagagggcacccuauaccauggcagugcccggcgacgcugcacgagucagggacaagcccguccacaguggggugagucaagcccccacggcgggccgggacugccaccaucgugcggaccccgcaucgccgcgggacucgggcugccguggcugcuggggagaccuggugcugcagccgcuccggagcucucggaaacuuuccuccgcgcugugcgcgggcucccuguccuuucugcug

SEQ ID NO: 20568 - RNA, 607 nt, Homo sapiens
cagcagaaaggacagggagcccgcgcacagcgcggaggaaaguuuccgagagcuccggagcggcugcagcaccaggucuccccagcagccacggcagcccgagucccgcggcgaugcgggguccgcacgaugguggcagucccggcccgccgugggggcuugacucaccccacuguggacgggcuugucccugacucgugcagcgucgccgggcacugccaugguauagggugcccucuucacugaauucccaguggccccccgacgcccccgccccgacccacgcgcgcgcgcgcacacacacacacacacacacgcacgcacgcucuucccaauuccacccucggaauccuucuucuccccaggcccacaauccacugaaaguuucagcuuucgaauaacuccuggagaaugcuagaugcuccaaugagacuucuucaaguuaaaggcuagcacgcucaaguugaaaacaagcacgggcagaaacgaucaggauuccccuuuucucucuuugaauaucuuucacagauucucugcuccacccccacccccgacuuauauccuccggggucucuuccuacuucaggauuucaaaaauugcccaaug

SEQ ID NO: 20569 - RNA, 1762 nt, Homo sapiens
cgcaguaggcgaggggcuccagcuucugccccgcgcgcuccaggcagggggcggccgcggacccggcggccgagggagcgccggugccuuugcucagagggaccuguugagucaacagcugcggggugggcaagaacuggguggccacggcgugcaagugguugaucagcuggacacaccgcggcucccuggguguccagcucucaaaccgggagagguauugcaagacuucuuuggcgcauguuugaaaucccgaguggaacgcauccaagucggacugaaugggcgauuucagagaucgcuccccuaggaugaggaagggaugggggugggggacggaggaguggaggcaagaagaaacauacccacguuaaaacaucugcuuaucacgugggcccugcaucgacuaaagugaucucgguuuuuccccaguauucaagugauauaauccaccaguugacgagagaagcgggguggcggaggugcggagcggggagagggcgcucuccucccagcugaaaaccaaaguggagcgggugcaaccgccacuuuaaauccugauuccuccgaguucugcugaaagccucuaggaugcuucgggaaaugggcucguuccaaugaagggaaaguauaagcaauuuaacaaaugagagggaacccaugagcccacggaaagagauggggugcgggugagggaguccugacacugcuccccugugggcugccccgcuucaucaggguaggcuggccucccugaacugacuuaccauucuguaaagcaauuaucuucugaugcuguugcucgguuaaggcgguuaaagcuuuuaaguguuucaaaguuaauuccaagacuacagcuuucuccagaugucccagagucugcaguggugcaaaaaagaaacgggcacuugguuacuuaaaaacacacauuuggcuuaauuggcuguccauucagcacagcaauuuaagcaaacacuuugaaagaaguacuguucuuuuacuucuugagcuuuccacaagacagguuauaaaugauuucuugccuucagcugggagcaccuacuccaguuugcgggaaacucuguacgguauagcacaaguuuuaagucaggaacuuauauuuacauuuauucuuauauuuucugggagucgcaccagacuauuaacacgcccuuggagagcagcaaagaaugaaaaugugcaucuuacugucaauuucagauguucaggcaguaaaucuuucagcugagcaaugcauucauuaauucggucucuucuuuucuuuucuauuaaucugugcgguaauuuguagguauccuuaauauaugagagucauggaaaagagaaaacaguaagcgaaacauucacuuauuggauauuacccucgucugccccccccgcccccccaccauaaaacauacuaugugauaaacuacacccaagaaaccucuuuccucuggacuguucugcaaugcaauuuaaauucagguaugauguuuaauaucccccugagaguacccagcaagccacuuaaaauucacaguuggggaagcucaggggcuggaauauauuugcgggcagagcuucacugugaaaucaauggcucuaauuaacuacccaugcagguuaugaggaauaucgggaacuuacacuuaccuuggugucgucucguuucaugcuccuuuuggguuuacacauauacaaagaggaauaguccagucugcaaaacagaaaucagcaucaggcacccauucggggaggg

SEQ ID NO: 20570 - RNA, 1762 nt, Homo sapiens
cccuccccgaaugggugccugaugcugauuucuguuuugcagacuggacuauuccucuuuguauauguguaaacccaaaaggagcaugaaacgagacgacaccaagguaaguguaaguucccgauauuccucauaaccugcauggguaguuaauuagagccauugauuucacagugaagcucugcccgcaaauauauuccagccccugagcuuccccaacugugaauuuuaaguggcuugcuggguacucucagggggauauuaaacaucauaccugaauuuaaauugcauugcagaacaguccagaggaaagagguuucuuggguguaguuuaucacauaguauguuuuauggugggggggcggggggggcagacgaggguaauauccaauaagugaauguuucgcuuacuguuuucucuuuuccaugacucucauauauuaaggauaccuacaaauuaccgcacagauuaauagaaaagaaaagaagagaccgaauuaaugaaugcauugcucagcugaaagauuuacugccugaacaucugaaauugacaguaagaugcacauuuucauucuuugcugcucuccaagggcguguuaauagucuggugcgacucccagaaaauauaagaauaaauguaaauauaaguuccugacuuaaaacuugugcuauaccguacagaguuucccgcaaacuggaguaggugcucccagcugaaggcaagaaaucauuuauaaccugucuuguggaaagcucaagaaguaaaagaacaguacuucuuucaaaguguuugcuuaaauugcugugcugaauggacagccaauuaagccaaauguguguuuuuaaguaaccaagugcccguuucuuuuuugcaccacugcagacucugggacaucuggagaaagcuguagucuuggaauuaacuuugaaacacuuaaaagcuuuaaccgccuuaaccgagcaacagcaucagaagauaauugcuuuacagaaugguaagucaguucagggaggccagccuacccugaugaagcggggcagcccacaggggagcagugucaggacucccucacccgcaccccaucucuuuccgugggcucauggguucccucucauuuguuaaauugcuuauacuuucccuucauuggaacgagcccauuucccgaagcauccuagaggcuuucagcagaacucggaggaaucaggauuuaaaguggcgguugcacccgcuccacuuugguuuucagcugggaggagagcgcccucuccccgcuccgcaccuccgccaccccgcuucucucgucaacugguggauuauaucacuugaauacuggggaaaaaccgagaucacuuuagucgaugcagggcccacgugauaagcagauguuuuaacguggguauguuucuucuugccuccacuccuccgucccccacccccaucccuuccucauccuaggggagcgaucucugaaaucgcccauucaguccgacuuggaugcguuccacucgggauuucaaacaugcgccaaagaagucuugcaauaccucucccgguuugagagcuggacacccagggagccgcgguguguccagcugaucaaccacuugcacgccguggccacccaguucuugcccaccccgcagcuguugacucaacaggucccucugagcaaaggcaccggcgcucccucggccgccggguccgcggccgcccccugccuggagcgcgcggggcagaagcuggagccccucgccuacugcg

SEQ ID NO: 20571 - RNA, 1469 nt, Homo sapiens
cgcccgccuggcgcugccagccaucuacgccuucugcguccucuucugcgcgcugccccugcugggccugggccaacaccagcaguacugccccggcagcuggugcuuccuccgcaugcgcugggcccagccgggcggcgccgccuucucgcuggccuacgccggccugguggcccugcugguggcugccaucuuccucugcaacggcucggucacccucagccucugccgcauguaccgccagcagaagcgccaccagggcucucuggguccacggccgcgcaccggagaggacgagguggaccaccugauccugcuggcccucaugacaguggucauggccgugugcucccugccucucacggugaguccccuccggagcugggaggaguggggagaggaggagggcagcucuguggguugugcccaugucacagauggggagacugaggcucaaaagaggugagacaucgugggcaugguggcucacgccuguaaucccagcauguagaaaggccgaggcaggaccggaugcgguggcucacaccuguaaucccagcacuuugggaggccgaggccggcggaucauuugaggucaggaguucgagaccagucuggccaacaugaugaaacccugucucuacuaaaaauacaacaaauaaauaaauaaaaaguagccggacguaguggcacaugccugaagucccagcuacuugggaggcugagccaggagaaucgcuugaaccccggaggcggagguugcagugagcugagaucgugccacugcacuauagccugggugacagagugagaccccgucccaaaaaaaaaaaaaaaaaaauaagaaaaaaaagaaaaagaaaggcgaggcaggacgaucacuugagcccagagguuugagaccagccugggcaacauggugaaaccccaucucuaugaaacauuuaaaaauuagccuggcaugauggccugugccuguggucucagcuacuugugaggcugaggugggaggauugcuccggccugggagguugaggcugcagugagcugugauuauaccacugcaucccagccuagcugacagagcaagaccuugucucaaaacaaaaacaaagaaaacaaaaacaaaucagacagaggcuugguccucagucagacagcuccuggcuuucuggaggggucuuucugcaucugacuucuucugauaccuugucucccagcuuaggcauccugagccccccaugaugaaaugcaucccccauccuuccccaccccuguaaugacaagaccaccacucauugagcacuucucuaugcccgccccgugcuuaguggcuuacagauacuuccuaagauaauuuucaaaaugaucauagccacccauuccacaguauuuggcaggaaaccaagagaacguucucucccauccccguuuuuacagaugaggggcagugucuuucgcccagucac

SEQ ID NO: 20572 - RNA, 1469 nt, Homo sapiens
gugacugggcgaaagacacugccccucaucuguaaaaacggggaugggagagaacguucucuugguuuccugccaaauacuguggaauggguggcuaugaucauuuugaaaauuaucuuaggaaguaucuguaagccacuaagcacggggcgggcauagagaagugcucaaugagugguggucuugucauuacagggguggggaaggaugggggaugcauuucaucauggggggcucaggaugccuaagcugggagacaagguaucagaagaagucagaugcagaaagaccccuccagaaagccaggagcugucugacugaggaccaagccucugucugauuuguuuuuguuuucuuuguuuuuguuuugagacaaggucuugcucugucagcuaggcugggaugcagugguauaaucacagcucacugcagccucaaccucccaggccggagcaauccucccaccucagccucacaaguagcugagaccacaggcacaggccaucaugccaggcuaauuuuuaaauguuucauagagaugggguuucaccauguugcccaggcuggucucaaaccucugggcucaagugaucguccugccucgccuuucuuuuucuuuuuuuucuuauuuuuuuuuuuuuuuuuuugggacggggucucacucugucacccaggcuauagugcaguggcacgaucucagcucacugcaaccuccgccuccgggguucaagcgauucuccuggcucagccucccaaguagcugggacuucaggcaugugccacuacguccggcuacuuuuuauuuauuuauuuguuguauuuuuaguagagacaggguuucaucauguuggccagacuggucucgaacuccugaccucaaaugauccgccggccucggccucccaaagugcugggauuacaggugugagccaccgcauccgguccugccucggccuuucuacaugcugggauuacaggcgugagccaccaugcccacgaugucucaccucuuuugagccucagucuccccaucugugacaugggcacaacccacagagcugcccuccuccucuccccacuccucccagcuccggaggggacucaccgugagaggcagggagcacacggccaugaccacugucaugagggccagcaggaucaggugguccaccucguccucuccggugcgcggccguggacccagagagcccugguggcgcuucugcuggcgguacaugcggcagaggcugagggugaccgagccguugcagaggaagauggcagccaccagcagggccaccaggccggcguaggccagcgagaaggcggcgccgcccggcugggcccagcgcaugcggaggaagcaccagcugccggggcaguacugcugguguuggcccaggcccagcaggggcagcgcgcagaagaggacgcagaaggcguagauggcuggcagcgccaggcgggcg

SEQ ID NO: 20573 - RNA, 532 nt, Homo sapiens
uccguugccgcugggagccggaggcgcggggaccucuuggcgcgacgcugccccgcgaggaggcaggacuuggggaccccagaccgccucccuuugccgccggggacgcuugcucccucccugcccccuacacggcgucccucaggcgcccccauuccggaccagcccucgggagucgccgacccggccucccgcaaagacuuuuccccagaccucgggcgcacccccugcacgccgccuucauccccggccugucuccugagcccccgcgcauccuagacccuuucuccuccaggagacggaucucucuccgaccugccacagauccccuauucaagaccacccaccuucugguaccagaucgcgcccaucuagguuauuuccgugggauacugagacacccccgguccaagccuccccuccaccacugcgcccuucucccugaggaccucagcuuucccucgaggcccuccuaccuuuugccgggagacccccagccccugcaggggcggggccuccccaccacaccagc

SEQ ID NO: 20574 - RNA, 532 nt, Homo sapiens
gcuggugugguggggaggccccgccccugcaggggcugggggucucccggcaaaagguaggagggccucgagggaaagcugagguccucagggagaagggcgcagugguggaggggaggcuuggaccgggggugucucaguaucccacggaaauaaccuagaugggcgcgaucugguaccagaagguggguggucuugaauaggggaucuguggcaggucggagagagauccgucuccuggaggagaaagggucuaggaugcgcgggggcucaggagacaggccggggaugaaggcggcgugcagggggugcgcccgaggucuggggaaaagucuuugcgggaggccgggucggcgacucccgagggcugguccggaaugggggcgccugagggacgccguguagggggcagggagggagcaagcguccccggcggcaaagggaggcggucugggguccccaaguccugccuccucgcggggcagcgucgcgccaagagguccccgcgccuccggcucccagcggcaacgga

SEQ ID NO: 20575 - RNA, 611 nt, Homo sapiens
gaggacaccccggggcaaagggaacgugugauggugggagggggguguccgaaagaggauggcacugagcccccuaccacccaggugucuggucuuggagaggaggagauagcgaaguggaccgcuucuagagugcgacagaaacaugcggggucgugggggcaguccccuagagggagacaagcaauagggggaggguagaaggcucccucuuccaggacgcguugaaugggggggggggucguggggugccaggugcagagaagggagccuggugugggagaagcgaagaccccagcauuugggaaaggagaggcgcuggagaaaguugacccagagcuuggggguccugagguggaaagauucaagaaggacagaaaagcuagaugaaggcaaccccagagggugccaggaaagugagagcggacccacuuccagaggcugccaggaacacgcgggaugcgggggugggggagagucguagaaagagaaacagaggugcgugugauaaauguggggagaaagggacgggagguuauuggaaggaggaggcaagcgggagaggagcggagacucgggagggcgcccgggaugcagagguguccucggug

SEQ ID NO: 20576 - RNA, 611 nt, Homo sapiens
caccgaggacaccucugcaucccgggcgcccucccgagucuccgcuccucucccgcuugccuccuccuuccaauaaccucccgucccuuucuccccacauuuaucacacgcaccucuguuucucuuucuacgacucucccccacccccgcaucccgcguguuccuggcagccucuggaaguggguccgcucucacuuuccuggcacccucugggguugccuucaucuagcuuuucuguccuucuugaaucuuuccaccucaggacccccaagcucugggucaacuuucuccagcgccucuccuuucccaaaugcuggggucuucgcuucucccacaccaggcucccuucucugcaccuggcaccccacgacccccccccccauucaacgcguccuggaagagggagccuucuacccucccccuauugcuugucucccucuaggggacugcccccacgaccccgcauguuucugucgcacucuagaagcgguccacuucgcuaucuccuccucuccaagaccagacaccugggugguagggggcucagugccauccucuuucggacaccccccucccaccaucacacguucccuuugccccgggguguccuc

SEQ ID NO: 20577 - RNA, 1280 nt, Homo sapiens
gaccucccaggccaugcgccugacucgugggcugggugucugguucccuggcagcgccacacccccgggacucaugguaccccgggagccccaggccucacccucgacccugccccucaccuuagaacggcccucuccagugaugcccccuccugaagaggcggccgcggucucugcaccacccccggcccccgcggggacucugcugcccggcccgucuaaauggcaaaagcccgcgggcacuccaguuccccggauccgccgccugcuggaggcgagccaucgcggccagggcgacccuccgagccuccgcccgcugaagccgccgccgccgccccggcaacuauccgugaaggacacugucccgagggccccaucccaauuuccgccgccccuggagacuuggaagccgccaccaccauuaccuucugaacggcagccggcggaccgcagaaucacuccugcucuggccacacccgccucacccccgacagaaagccaggcugggccccgcaaccagggccagacggccggcagggcucgcggaggggcgccuccccaugcgggcgaaggcgaaauggcccagccugcggauuccgaguccggucugagccugcuguguaaaaucaccuucaagucgaggcccucuuuggccccuccggcagccucgaguuccuuagcagccaaagcuucgcuggggggcggcggaggcggcggccucuuugcugccucaggugccaucucuuacgccgagguccugaagcaagggccccugccuccuggagccgcucgccccuugggagagguuucucgaggggcacaggaagccgagggaggugauggagacggcgaagggugcucugguccucccucggcgccugcgucccaagcccgggcccuaccgccgccacccuacaccaccuucccaggcucgaagcccaaauucgacuggguuagcgcucccgacggcccugaacgccacuuccgcuucaacggggcuggcggaggcaucggggcgccgcgacggcgugcggccgcacucucugggccuuggggcuccccuccgccaccaccagagcagauacacucagcucccgggccccggaggcccgcaccugcccugcuggcgccgccuacguucaucuucccagcacccaccaauggcgagcccaugcgcccggggccuccaggccugcaggaguuaccaccgcugccaccgcccacaccgccgcccacacugcagccaccagcgcuccagccaacgccgcugccgguggcuc

SEQ ID NO: 20578 - RNA, 1280 nt, Homo sapiens
gagccaccggcagcggcguuggcuggagcgcugguggcugcagugugggcggcggugugggcgguggcagcggugguaacuccugcaggccuggaggccccgggcgcaugggcucgccauuggugggugcugggaagaugaacguaggcggcgccagcagggcaggugcgggccuccggggcccgggagcugaguguaucugcucuggugguggcggaggggagccccaaggcccagagagugcggccgcacgccgucgcggcgccccgaugccuccgccagccccguugaagcggaaguggcguucagggccgucgggagcgcuaacccagucgaauuugggcuucgagccugggaaggugguguaggguggcggcgguagggcccgggcuugggacgcaggcgccgagggaggaccagagcacccuucgccgucuccaucaccucccucggcuuccugugccccucgagaaaccucucccaaggggcgagcggcuccaggaggcaggggcccuugcuucaggaccucggcguaagagauggcaccugaggcagcaaagaggccgccgccuccgccgccccccagcgaagcuuuggcugcuaaggaacucgaggcugccggaggggccaaagagggccucgacuugaaggugauuuuacacagcaggcucagaccggacucggaauccgcaggcugggccauuucgccuucgcccgcauggggaggcgccccuccgcgagcccugccggccgucuggcccugguugcggggcccagccuggcuuucugucgggggugaggcggguguggccagagcaggagugauucugcgguccgccggcugccguucagaagguaauggugguggcggcuuccaagucuccaggggcggcggaaauugggauggggcccucgggacaguguccuucacggauaguugccggggcggcggcggcggcuucagcgggcggaggcucggagggucgcccuggccgcgauggcucgccuccagcaggcggcggauccggggaacuggagugcccgcgggcuuuugccauuuagacgggccgggcagcagaguccccgcgggggccggggguggugcagagaccgcggccgccucuucaggagggggcaucacuggagagggccguucuaaggugaggggcagggucgagggugaggccuggggcucccgggguaccaugagucccggggguguggcgcugccagggaaccagacacccagcccacgagucaggcgcauggccugggagguc

SEQ ID NO: 20579 - RNA, 994 nt, Homo sapiens
auggagcugcggaaaguucccuccucuucaucggguuccccaguccugggaagacagaggcagagggauuucgggauggaaagggggagaggcugcccuucuaggaaccccccaguacaagccuccuuucccagauugguguaacuaggcccagauauggacgaagagcaggcucgggguccgccagaaaugaggagcacccaggagcagcuuaugugcuggcagggggcuucuaagcugguuaacagugaguaccuccgcggauuugggggcagggaugugaaguuggugggggagggauagucauggggacuuggcagacugccaugagauggccuggguuggaaacccagaaccccccaucuuccacuugagugaucuugaacaaagugacuuuaccucccugugccuuaguuuccucaucugucaaaugggguuaauaacagcaccucccucccagaggaagugaaaccguaucuaacacgugguacacacccaguaaauauuagcuacuacuuaugauaauaucuauaauuguucuaacauauucauacauuguccaugcuuuaacauuuuauucgaagaggaaucaaagagcuaggaacaagacucuaagcuaaacugggccgcgugugagaugaucucauuucaccgccguuucuucuuuccugcacuuuguguuaucacgcuuugugauuuuucuaucuguggggcuguuggaacccacggccaccgccuccacuaggcugggagcucggccaggaagggcgggagguuuuuuccucgcuuggucccagggccaggcuugggccauggcacauaguaggugcuuaauacauagucgcugacggggaucgggcugcgggucagggguacuccccgccucacccgcggcgcccuccagagcaggagcgggcgaaggagggcggggaggggcgucuuaccucugcugcugguugaacuugcaccggcaucuucugccugugggcgugga

SEQ ID NO: 20580 - RNA, 994 nt, Homo sapiens
uccacgcccacaggcagaagaugccggugcaaguucaaccagcagcagagguaagacgccccuccccgcccuccuucgcccgcuccugcucuggagggcgccgcgggugaggcggggaguaccccugacccgcagcccgauccccgucagcgacuauguauuaagcaccuacuaugugccauggcccaagccuggcccugggaccaagcgaggaaaaaaccucccgcccuuccuggccgagcucccagccuaguggaggcgguggccguggguuccaacagccccacagauagaaaaaucacaaagcgugauaacacaaagugcaggaaagaagaaacggcggugaaaugagaucaucucacacgcggcccaguuuagcuuagagucuuguuccuagcucuuugauuccucuucgaauaaaauguuaaagcauggacaauguaugaauauguuagaacaauuauagauauuaucauaaguaguagcuaauauuuacuggguguguaccacguguuagauacgguuucacuuccucugggagggaggugcuguuauuaaccccauuugacagaugaggaaacuaaggcacagggagguaaagucacuuuguucaagaucacucaaguggaagaugggggguucuggguuuccaacccaggccaucucauggcagucugccaaguccccaugacuaucccucccccaccaacuucacaucccugcccccaaauccgcggagguacucacuguuaaccagcuuagaagcccccugccagcacauaagcugcuccugggugcuccucauuucuggcggaccccgagccugcucuucguccauaucugggccuaguuacaccaaucugggaaaggaggcuuguacugggggguuccuagaagggcagccucucccccuuuccaucccgaaaucccucugccucugucuucccaggacuggggaacccgaugaagaggagggaacuuuccgcagcuccau

SEQ ID NO: 20581 - RNA, 637 nt, Homo sapiens
cggcuccgcacucagggcgcuggcccggggcgaaaguccugggggccugcacaauugucccagggguggccccggagaggcaggcgggccaccuggugcgcgccagccuccccacccccccccucccgccuccgccgcggagccagccggccggugugaacuuaggggcgacgggagagggcuugggccaaggcuggaggcgccgcggggcgggguggccgcggcacccgaagcgcggggcugggcugggagggguugccgcggaggcggggcggggacaaaguuaaaucaagaggcagacacuuggagaccacagaugggaagcucgccuaauuaaggacguaaaagcgcuuuuguucucaaaguuuauuguugccgggauuaaaaaaaaauuaauugaaacuaaugcuguuauucacucgugcaguuaaauuccuucaugcacauuugagauacggagcgaaaacuugaagcuuaucuuucugcagucgcgggugggggccgccggaagacagaaaggcgcugcagaggcggggguccgcccccggguguguuugcgagugugugccgggugcgcgcguccaggucagggggugcgggcgggcagcggggaaccggaucugcaggcggcgauccc

SEQ ID NO: 20582 - RNA, 637 nt, Homo sapiens
gggaucgccgccugcagauccgguuccccgcugcccgcccgcacccccugaccuggacgcgcgcacccggcacacacucgcaaacacacccgggggcggacccccgccucugcagcgccuuucugucuuccggcggcccccacccgcgacugcagaaagauaagcuucaaguuuucgcuccguaucucaaaugugcaugaaggaauuuaacugcacgagugaauaacagcauuaguuucaauuaauuuuuuuuuaaucccggcaacaauaaacuuugagaacaaaagcgcuuuuacguccuuaauuaggcgagcuucccaucuguggucuccaagugucugccucuugauuuaacuuuguccccgccccgccuccgcggcaaccccucccagcccagccccgcgcuucgggugccgcggccaccccgccccgcggcgccuccagccuuggcccaagcccucucccgucgccccuaaguucacaccggccggcuggcuccgcggcggaggcgggaggggggggguggggaggcuggcgcgcaccagguggcccgccugccucuccggggccaccccugggacaauugugcaggcccccaggacuuucgccccgggccagcgcccugagugcggagccg

SEQ ID NO: 20583 - RNA, 965 nt, Homo sapiens
cgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggcgcgcggcugugggaccgcccugggccagccuccggcggggacccagggagugguuuggggucgccggaucucgaggcuugcccgagccgugcgagccaggacuaggagauuccggugccuccugaaagccuggccugcuccgcguguccccucccuuccucugcgccggacuuggugcgucuaagaugagggggccaggcgguggcuucucccugcgaggaggggagaauucuuggggcugagcugggagcccggcaacucuaguauuuaggauaaccuugugccuuggaaaugcaaacucaccgcuccaaugccuacugaguagggggagcaaaucgugccuugucauuuuauuuggagguuuccugccuccuucccgaggcuacagcagacccccaugagagaaggaggggagcaggcccguggcaggaggagggcucagggagcugagaucccgacaagcccgccagccccagccgcuccuccacgccuguccuuagaaagggguggaaacauagggacuuggggcuuggaaccuaagguuguuccccuaguucuacaugaagguggagggucucuaguuccacgccucucccaccucccuccgcacacaccccaccccagccugcuauaggcugggcuuccccuuggggcggaacu

SEQ ID NO: 20584 - RNA, 965 nt, Homo sapiens
aguuccgccccaaggggaagcccagccuauagcaggcugggguggggugugugcggagggaggugggagaggcguggaacuagagacccuccaccuucauguagaacuaggggaacaaccuuagguuccaagccccaagucccuauguuuccaccccuuucuaaggacaggcguggaggagcggcuggggcuggcgggcuugucgggaucucagcucccugagcccuccuccugccacgggccugcuccccuccuucucucaugggggucugcuguagccucgggaaggaggcaggaaaccuccaaauaaaaugacaaggcacgauuugcucccccuacucaguaggcauuggagcggugaguuugcauuuccaaggcacaagguuauccuaaauacuagaguugccgggcucccagcucagccccaagaauucuccccuccucgcagggagaagccaccgccuggcccccucaucuuagacgcaccaaguccggcgcagaggaagggaggggacacgcggagcaggccaggcuuucaggaggcaccggaaucuccuaguccuggcucgcacggcucgggcaagccucgagauccggcgaccccaaaccacucccuggguccccgccggaggcuggcccagggcggucccacagccgcgcgccucacgcgcaguugcccauggccuugaccaaggagcucucuggcagcuggcggaagaugccccgcagcguguccaguucgcggcucagcuguuccacccgcuugcgcaggcggucauugucacuggucagcuccagcaccuucugcugcgucuccacguugcgcugcuuggccuugucgcggcucuugcgcaccgcgauguuguugcgcucgcgccgcacccgguacucguugcuguucuuguccaccgacuucuuggccuugcccgcgccgcugccgccacucgcgcggaggucggggugcg

SEQ ID NO: 20585 - RNA, 655 nt, Homo sapiens
cccuaggcuggcagccuggacucaagguucccuagggaugccugggacgggcugcuggauucccaggguccuggacaucuccccacccccuagcaaacguggcugagaagcaucuguucuuuugacaccuuugcugaagcaucuccuuagcaccuuuugcuuccucgaauagacucuuauccgggagaggcggcuggagagucuuugggccucggagugggggcacaggcucuugaaucccaaaggguugucuggggucuaagucuccugaguugaaggauuugacagagcugggagagggggacugaagaccgucaaugugaagaaggagggggcugggggccugaauucccggucugagggagauggaggauuucuggaucaggggggcgaagggagccagggaccuggacucuuggugaaggaggaggugcgggcuuagaauucuggauguugaaaagcagguuuugcccuggauccuggucuugggggugagggggcugggggccuggacuuccgagucucuggcucuugcugucccgcagccuucuggagaagcggcaggaaggcgcggagacgcuggagcugagugcggaugggcgcccggugaccacgcagacccgggacccgccggugguggacugcaccugcuucg

SEQ ID NO: 20586 - RNA, 655 nt, Homo sapiens
cgaagcaggugcaguccaccaccggcgggucccgggucugcguggucaccgggcgcccauccgcacucagcuccagcgucuccgcgccuuccugccgcuucuccagaaggcugcgggacagcaagagccagagacucggaaguccaggcccccagcccccucacccccaagaccaggauccagggcaaaaccugcuuuucaacauccagaauucuaagcccgcaccuccuccuucaccaagaguccaggucccuggcucccuucgccccccugauccagaaauccuccaucucccucagaccgggaauucaggcccccagcccccuccuucuucacauugacggucuucagucccccucucccagcucugucaaauccuucaacucaggagacuuagaccccagacaacccuuugggauucaagagccugugcccccacuccgaggcccaaagacucuccagccgccucucccggauaagagucuauucgaggaagcaaaaggugcuaaggagaugcuucagcaaaggugucaaaagaacagaugcuucucagccacguuugcuaggggguggggagauguccaggacccugggaauccagcagcccgucccaggcaucccuagggaaccuugaguccaggcugccagccuaggg

SEQ ID NO: 20587 - RNA, 1791 nt, Homo sapiens
ggugucucucucugucuuuggaucgcucuuucucucuuuuugucucuccccaccccaucugcugcuuggucucugaguuucugucuaucucuaagugugugucucuaugucuccaugucugucucgcugcgucucuguaucuccuuuucugccucuaucuguaucucucucauucauuccuuccucucucccucccccuccuccucucccuccucccccuccucucccucccccuccucucccuccucccccuccuccuucaccuccucccccuccuccucacuccugccuggcgguuuguucuugccucucuaaccuucugucccuccgcccuuccucuccguauccaucucaggcucccuuccccuccccagccuacgcagauguggguccucaccucccgcucuccgccucugcccucccggcuccuccuccccgccccucucucccucgccaggucucugccucccccuccaggcgagcagcccucacugcacuucaggcuccuaggggaucccccggccccguuaaggcagccccaggcagagacccaguggagcccuggggcggggaaggggggcugcgggcgcuggggcggcuccaaccugggucccagcgagcagggggacccugcauccgccaaggccggcggcccccagcauggagacuuccgaagccacucccagcuccaccuuaagcgcccccccuuccccuugcugcggaggauggaaacagccugcucccggccccaggugucccggccacccccgcccgcguggccccagcgcggcugggagccgaggaccagcccccuaccuccuuccgaauccugcccuuucgcacaucccaccccaagccaacccgaggaguguuugccgcuaugagaucaccugcucccccagcccaacaacaaaauuaaauaacaccacgggagaggagagagggagggggaggagggaggaagggacaagagagaagagagacugaaacagggagaagaggcaggagaggaggagguggggagagcacgaagcuggaggccgacacugagggagggcgggaggaggugaagaaggagagaggggagaagaggcaggagcuggaaaggagagagggaggaggaggaggagaugcgggauggagaccuggaguuagguggcuugggagagcuuaaugaaaagagaacggagaggagguguggguuaggaaccaagagguagcccugggggcagcagaaggcugagaggaguaggaagaucaggagcuagagggagacuggaggguuccgggaaaagagcagaggaaagaggaaagacacagagagacgggagagagaagaagaguggguuugaagggcggaucucagucccuggcugcuuuggcauuuggggaacugggacucccuguggggaggagaggaaagcuggaaguccuggagggacagggucccagaaggaggggacagaggagcugagagaggggggcagggcguugggcaggggucccucggaggccuccuggggaugggggcugcagcucgucugagcgccccucgagcgcugguacucugggcugcacugggggcagcagguaagaccugggguucccgggaggagcccccgagggaggguggagguggggaugccaaggagagggauucaggcugcucucuucccagcucacaucggaccagcaccugaccccgaggacugguggagcuacaaggauaaucuccagggaaacuucgugccaggugccgccaaggcggggacccaggaguccggcccuccc

SEQ ID NO: 20588 - RNA, 1791 nt, Homo sapiens
gggagggccggacuccuggguccccgccuuggcggcaccuggcacgaaguuucccuggagauuauccuuguagcuccaccaguccucggggucaggugcugguccgaugugagcugggaagagagcagccugaaucccucuccuuggcauccccaccuccacccucccucgggggcuccucccgggaaccccaggucuuaccugcugcccccagugcagcccagaguaccagcgcucgaggggcgcucagacgagcugcagcccccauccccaggaggccuccgagggaccccugcccaacgcccugccccccucucucagcuccucuguccccuccuucugggacccugucccuccaggacuuccagcuuuccucuccuccccacagggagucccaguuccccaaaugccaaagcagccagggacugagauccgcccuucaaacccacucuucuucucucucccgucucucugugucuuuccucuuuccucugcucuuuucccggaacccuccagucucccucuagcuccugaucuuccuacuccucucagccuucugcugcccccagggcuaccucuugguuccuaacccacaccuccucuccguucucuuuucauuaagcucucccaagccaccuaacuccaggucuccaucccgcaucuccuccuccuccucccucucuccuuuccagcuccugccucuucuccccucucuccuucuucaccuccucccgcccucccucagugucggccuccagcuucgugcucuccccaccuccuccucuccugccucuucucccuguuucagucucucuucucucuugucccuuccucccuccucccccucccucucuccucucccgugguguuauuuaauuuuguuguugggcugggggagcaggugaucucauagcggcaaacacuccucggguuggcuuggggugggaugugcgaaagggcaggauucggaaggagguagggggcugguccucggcucccagccgcgcuggggccacgcgggcggggguggccgggacaccuggggccgggagcaggcuguuuccauccuccgcagcaaggggaagggggggcgcuuaagguggagcugggaguggcuucggaagucuccaugcugggggccgccggccuuggcggaugcagggucccccugcucgcugggacccagguuggagccgccccagcgcccgcagccccccuuccccgccccagggcuccacugggucucugccuggggcugccuuaacggggccgggggauccccuaggagccugaagugcagugagggcugcucgccuggagggggaggcagagaccuggcgagggagagaggggcggggaggaggagccgggagggcagaggcggagagcgggaggugaggacccacaucugcguaggcuggggaggggaagggagccugagauggauacggagaggaagggcggagggacagaagguuagagaggcaagaacaaaccgccaggcaggagugaggaggagggggaggaggugaaggaggagggggaggagggagaggagggggagggagaggagggggaggagggagaggaggagggggagggagagaggaaggaaugaaugagagagauacagauagaggcagaaaaggagauacagagacgcagcgagacagacauggagacauagagacacacacuuagagauagacagaaacucagagaccaagcagcagaugggguggggagagacaaaaagagagaaagagcgauccaaagacagagagagacacc

SEQ ID NO: 20589 - RNA, 5266 nt, Homo sapiens
uuauaauacagggugggaaaggaguaugagaagggguuuggaaaucaggcuggaaauagguugggauugggggaggaucuaaucccccucccccugggcgacccuaggcaucccacacaagagggcaccccauguggucuugugaaaagcccgaagcccugaaugagucuuaaagagaaauuagccccggcugguaggugucucucggcggcguggagggacuagggccggucuguguguggcugcccggaggagcugaccaauuggucauggugcugaaaccuuuguggggaaucguggccaagugcacugacucugugggaaaacggcggcgugaagggaugccaacagcuccucgccgggaagggaaccgccucaaauugggaccaugacaauuccugcuaauuuguagagcagggaauuggugcaaagugucaagcagucacugcuugugcucaauagggcaucaaauuggcgcgacggauucaugaauguuauacgccucgcaaccucugaaccagagcauaaccccgagggguggacggagaaauacggcuucggagcagggagcgaugggccggggcuggggcgccgcccugccucgcgcaaagaagggggacgagaccuaccugggaaauaagaagaucugaugaaaggcugaaaagacccuucgaaguagggaaaggcgaaggucuugggagggacgcucuggagcaaggcuggggauguuucuggugggcgauggaggggggacagaaggagagagggagacagaaagaaucugauuacguacuugccuauuguauagcacacugaacacacgauauaauuagcccuucaucugguuucaaagacaucuuucuuauacguugacaggguaaaauaaaucuucccaacauugucuuaucuguaaaacucuuuucuuucuccccaacguaauucucugcgccgucccacucuaccccaaucuccauccuaggcacuaacgagauaggacugaguggggaggaaagaaauugcagauuuauaauauuugcuaauccaauaaauauaucauauugaguuuaaaaaaaaaaacugucuccuagaagcucgaaggcagaaacgcagacguccaggagcgugcgcucagcguuacugcaccagaugacugcgcacagucuccgacugcgugugcucaaguucacuccgaggauggggcgagccuggaggcuuuucuuccccggaauugacuggacuauucucacauugccugacguagggucucagaguucgugcguauugugugugcaccgaugugugugugggggcccgcucgcuagaggaaacugaggccaggaugacuccgcgcaugccuaguaccugaaugggcccuuaggguucugaccucgcuuaccuguucugggccccgaggagaggauggcguucacuccaaacuucagaaacgucgucucgcuggcaggggagaaggcagucggcggagagccgccccgucggcugccgggacccggggagcccagguccgaggcccccgugucggugagggccgugggggcccccugccugggcggcgacaugcuggcggugggcacgcugcggggcagguaggcggggggucggcugaugcggaucagauccuccaccaggaagcuggaguggccggaaaaugccgacugcaaggacuggggcagcgucaaggugggcgugggccgcaggaggcuaggguacccggcggggggcgcgaggaggccggggaacaucaugguaggcgcgggcgggcgaaauaacccuucuuucaguggccggaggguaaacgccucgcuucccgccccucccgcccccacaguguccucucucuugggcuuagcaaacgucuccaaguaacaaucccacuugggcgucugcgaguccuccgugguccucucgucgaggugaugguuuuauaguggcccgcccgcuaaagcacuuugaaaagugacagcucugacaaugaaguucaacaaaguucuccacucgagcuucauucgccggaggcucuggacucucugauuggcgcaggggugcaauuuaugauuggauuagucuucauaagcauggcccgcacaaugggccggcaacaaaggcccgcgcgcaucaauuuugcauaucgaccgccucuuugcaauacagugcgcccccaaagcucucgccaaagguuuuuguuccgaagcaacacccgggcuaauuaaaugccuauuuagaaguuucagaugacaucuugccucauagaaaaggaauuauuuaaagaacccacuaaauuuauuugcagcuccccugcuaagccuggaaaauaaaucaauaaauauucauagaaauacaucuucaggcuaucagcaaaguugcccucccucuuguggggguagggcaaugaaaaguuucaagucaguggacaugaaaauauacucccuuuccggucucuagcccuauccguuacuccagcugaagcauaaagcaaauguaggggugagugaaaucaguguuagaagucccauucugacgacucagggaaacuuggaaacggaugcuuuggggccacuggauguguguccguaagaguggggagaggucuggaguuauuucauuucgggagacugguugaguuugagcguugguggauaccugaaaaguaaaacgagucuccuucaaauucccagcaacuuggaaaacgauuuucucuaggaguuucugcaaggggcuguccgcaccucaccuugcgggaggagcggaggagagcggcgcugggcugccgagcggcaggauuccgcuugcaaagagcuuaggcugaccggaaacugccucgggcaaggguauccaaaggcugugagugcuaugcuggccguucuccaaacacagggagcucucggcaguuuaaguugaaacucacagcccugacauuuuaagccauagcagcgaagguccagacgucgucuggagagaacccuaccacuugcggggcccuuaacuuggcccaagguuuggcagcuucuuaauuaacuacaacgcacaaacgcgugaaaaccagagggaagggaugcgguucccaagaauguugguccacuccgggaaagccuccccugaauguggggcuucaaaggagaaucuuccuggagacagucccuucgcuuuccucugguuggggcugaggugguacuaagacucgauuccccccauuucucuguucggcgagauaacagauguguuaaaugucccauucaucucuuuaguguggcugaaccuccccaaagagaagugugcagccccgccaggccgcccugauccuauuaaccaugaacuaacugucaccuucagcugguuuuccuuuuugcuuuuuaacacaaagcuuucucaaaaaucuuauuaaccagcuuuauuucucucgaugguuuuguucgggguguuuuguguugaugaucuccaugucgcugcuuuaaccauucaauaaaagugcaucugcgauuuauaucacauuaaaccagaaacggagccggcuaaaacucucccuugauucaaauuaaaaaguuauuuagggcccagcuccagaggcgaauuaaugcuagaagaugacguaagugcggaguuucugagcccaagaccgcucaugcucaugggcagcgggagaaaaccaaucaggaaagaaacaacuuuuaaauaaggggcuauuuaaauaugggaagcgccuugcuggaguuaauuggaguccccuggaaacggaagaaggagaucugucgaagaacgucaaaaguuccuuuuugaaguuugcaauaaaauaggugagaaaagcauaagcuaucugaacaccugcacuuuaaccuugccaugagacaguuucccauugcaauaagacuggcucucucccuuccucucccuuacuuuuuuccucaggcccaccucccuccuucucccacucccuuucccucugccccccaccccuuuuucuccccgagucuuaaggacuugggcaauugccaguucccagaaggacgcgccgggggcuucaggauguuugauucccuaccggugaagcgcuuguccaagucuuccggaugaucagaauagagucuauauuugccaaaaucaacuuggauuuuguuuuuuuuuggaggggggaacgguaagaacuugaagccagcgugagcccuucccagcuccuccuucccuguuggggcauuugccgggguguaguuuucaccguuuccuguccgucgacaggcuucaugccaccccuagcccccaccccaagccccagccauucugccucacuauagacuaacugcuacuaacuucucggcuuuuaaaagucuacccugccauuuuuuggaggguggaucaaccccuugcugcgauccacguggacccugcuuccuggggucggucuccacagccuccuaaagaauuccuaaagcgccaaagaggaaaagugagggcgggggcgagggggcgagggcuggccgcccgugaaaggaaaaauaaauccuaaggaagcaagaaaucggacgaaaggaucuuacuuuaagugaucuccuugaacgcgucuuuucaaacuccgcgauagcccaaggagcugcgcggcgcggcggcugcggcuaagaccugugacuaaugccauuugaccugagcccaugggguuuugugcguccugccauucacuguuaugucguuaucuucaaguuuauuucggagaaaucacucgcguucuuugucucaaggcugagcuuucugucuauuucucuuucaagagaaaagaagacgggaggggaaaagagagaaucggagucccugguuugggguuuaagguccuugccuacgcugcgggggaggccgcagcagauccggcuggggcuccccgggccuagguggccaaagcugccgaaaccugccuuggauaguagaaagagcgugucggaacgcacucuggggguuucguuccccccgcgcaggggagagcgagcauguuccugccccgggcgccgugcggucgcagcagcagcgcggcccucuccagugcgagccgugccuggaaugucucggguaagcgaagggccagcaagcgaggcgaaacggacacuauaaagcagagaguggugugagcuuccccgcccucugaaaagauggcaagucuccguuucgggaaggcugcaacgcuaaggucacccuuugcaggcuucggacccccaguccuccaugcucccugccggagcagccaacagagugagagcgcauuuuggaa

SEQ ID NO: 20590 - RNA, 5266 nt, Homo sapiens
uuccaaaaugcgcucucacucuguuggcugcuccggcagggagcauggaggacuggggguccgaagccugcaaagggugaccuuagcguugcagccuucccgaaacggagacuugccaucuuuucagagggcggggaagcucacaccacucucugcuuuauaguguccguuucgccucgcuugcuggcccuucgcuuacccgagacauuccaggcacggcucgcacuggagagggccgcgcugcugcugcgaccgcacggcgcccggggcaggaacaugcucgcucuccccugcgcggggggaacgaaacccccagagugcguuccgacacgcucuuucuacuauccaaggcagguuucggcagcuuuggccaccuaggcccggggagccccagccggaucugcugcggccucccccgcagcguaggcaaggaccuuaaaccccaaaccagggacuccgauucucucuuuuccccucccgucuucuuuucucuugaaagagaaauagacagaaagcucagccuugagacaaagaacgcgagugauuucuccgaaauaaacuugaagauaacgacauaacagugaauggcaggacgcacaaaaccccaugggcucaggucaaauggcauuagucacaggucuuagccgcagccgccgcgccgcgcagcuccuugggcuaucgcggaguuugaaaagacgcguucaaggagaucacuuaaaguaagauccuuucguccgauuucuugcuuccuuaggauuuauuuuuccuuucacgggcggccagcccucgcccccucgcccccgcccucacuuuuccucuuuggcgcuuuaggaauucuuuaggaggcuguggagaccgaccccaggaagcaggguccacguggaucgcagcaagggguugauccacccuccaaaaaauggcaggguagacuuuuaaaagccgagaaguuaguagcaguuagucuauagugaggcagaauggcuggggcuuggggugggggcuagggguggcaugaagccugucgacggacaggaaacggugaaaacuacaccccggcaaaugccccaacagggaaggaggagcugggaagggcucacgcuggcuucaaguucuuaccguuccccccuccaaaaaaaaacaaaauccaaguugauuuuggcaaauauagacucuauucugaucauccggaagacuuggacaagcgcuucaccgguagggaaucaaacauccugaagcccccggcgcguccuucugggaacuggcaauugcccaaguccuuaagacucggggagaaaaagggguggggggcagagggaaagggagugggagaaggagggaggugggccugaggaaaaaaguaagggagaggaagggagagagccagucuuauugcaaugggaaacugucucauggcaagguuaaagugcagguguucagauagcuuaugcuuuucucaccuauuuuauugcaaacuucaaaaaggaacuuuugacguucuucgacagaucuccuucuuccguuuccaggggacuccaauuaacuccagcaaggcgcuucccauauuuaaauagccccuuauuuaaaaguuguuucuuuccugauugguuuucucccgcugcccaugagcaugagcggucuugggcucagaaacuccgcacuuacgucaucuucuagcauuaauucgccucuggagcugggcccuaaauaacuuuuuaauuugaaucaagggagaguuuuagccggcuccguuucugguuuaaugugauauaaaucgcagaugcacuuuuauugaaugguuaaagcagcgacauggagaucaucaacacaaaacaccccgaacaaaaccaucgagagaaauaaagcugguuaauaagauuuuugagaaagcuuuguguuaaaaagcaaaaaggaaaaccagcugaaggugacaguuaguucaugguuaauaggaucagggcggccuggcggggcugcacacuucucuuuggggagguucagccacacuaaagagaugaaugggacauuuaacacaucuguuaucucgccgaacagagaaauggggggaaucgagucuuaguaccaccucagccccaaccagaggaaagcgaagggacugucuccaggaagauucuccuuugaagccccacauucaggggaggcuuucccggaguggaccaacauucuugggaaccgcaucccuucccucugguuuucacgcguuugugcguuguaguuaauuaagaagcugccaaaccuugggccaaguuaagggccccgcaagugguaggguucucuccagacgacgucuggaccuucgcugcuauggcuuaaaaugucagggcugugaguuucaacuuaaacugccgagagcucccuguguuuggagaacggccagcauagcacucacagccuuuggauacccuugcccgaggcaguuuccggucagccuaagcucuuugcaagcggaauccugccgcucggcagcccagcgccgcucuccuccgcuccucccgcaaggugaggugcggacagccccuugcagaaacuccuagagaaaaucguuuuccaaguugcugggaauuugaaggagacucguuuuacuuuucagguauccaccaacgcucaaacucaaccagucucccgaaaugaaauaacuccagaccucuccccacucuuacggacacacauccaguggccccaaagcauccguuuccaaguuucccugagucgucagaaugggacuucuaacacugauuucacucaccccuacauuugcuuuaugcuucagcuggaguaacggauagggcuagagaccggaaagggaguauauuuucauguccacugacuugaaacuuuucauugcccuacccccacaagagggagggcaacuuugcugauagccugaagauguauuucuaugaauauuuauugauuuauuuuccaggcuuagcaggggagcugcaaauaaauuuaguggguucuuuaaauaauuccuuuucuaugaggcaagaugucaucugaaacuucuaaauaggcauuuaauuagcccggguguugcuucggaacaaaaaccuuuggcgagagcuuugggggcgcacuguauugcaaagaggcggucgauaugcaaaauugaugcgcgcgggccuuuguugccggcccauugugcgggccaugcuuaugaagacuaauccaaucauaaauugcaccccugcgccaaucagagaguccagagccuccggcgaaugaagcucgaguggagaacuuuguugaacuucauugucagagcugucacuuuucaaagugcuuuagcgggcgggccacuauaaaaccaucaccucgacgagaggaccacggaggacucgcagacgcccaagugggauuguuacuuggagacguuugcuaagcccaagagagaggacacugugggggcgggaggggcgggaagcgaggcguuuacccuccggccacugaaagaaggguuauuucgcccgcccgcgccuaccaugauguuccccggccuccucgcgccccccgccggguacccuagccuccugcggcccacgcccaccuugacgcugccccaguccuugcagucggcauuuuccggccacuccagcuuccugguggaggaucugauccgcaucagccgaccccccgccuaccugccccgcagcgugcccaccgccagcaugucgccgcccaggcagggggcccccacggcccucaccgacacgggggccucggaccugggcuccccgggucccggcagccgacggggcggcucuccgccgacugccuucuccccugccagcgagacgacguuucugaaguuuggagugaacgccauccucuccucggggcccagaacagguaagcgaggucagaacccuaagggcccauucagguacuaggcaugcgcggagucauccuggccucaguuuccucuagcgagcgggcccccacacacacaucggugcacacacaauacgcacgaacucugagacccuacgucaggcaaugugagaauaguccagucaauuccggggaagaaaagccuccaggcucgccccauccucggagugaacuugagcacacgcagucggagacugugcgcagucaucuggugcaguaacgcugagcgcacgcuccuggacgucugcguuucugccuucgagcuucuaggagacaguuuuuuuuuuuaaacucaauaugauauauuuauuggauuagcaaauauuauaaaucugcaauuucuuuccuccccacucaguccuaucucguuagugccuaggauggagauugggguagagugggacggcgcagagaauuacguuggggagaaagaaaagaguuuuacagauaagacaauguugggaagauuuauuuuacccugucaacguauaagaaagaugucuuugaaaccagaugaagggcuaauuauaucguguguucagugugcuauacaauaggcaaguacguaaucagauucuuucugucucccucucuccuucuguccccccuccaucgcccaccagaaacauccccagccuugcuccagagcgucccucccaagaccuucgccuuucccuacuucgaagggucuuuucagccuuucaucagaucuucuuauuucccagguaggucucgucccccuucuuugcgcgaggcagggcggcgccccagccccggcccaucgcucccugcuccgaagccguauuucuccguccaccccucgggguuaugcucugguucagagguugcgaggcguauaacauucaugaauccgucgcgccaauuugaugcccuauugagcacaagcagugacugcuugacacuuugcaccaauucccugcucuacaaauuagcaggaauugucauggucccaauuugaggcgguucccuucccggcgaggagcuguuggcaucccuucacgccgccguuuucccacagagucagugcacuuggccacgauuccccacaaagguuucagcaccaugaccaauuggucagcuccuccgggcagccacacacagaccggcccuagucccuccacgccgccgagagacaccuaccagccggggcuaauuucucuuuaagacucauucagggcuucgggcuuuucacaagaccacauggggugcccucuugugugggaugccuagggucgcccagggggagggggauuagauccucccccaaucccaaccuauuuccagccugauuuccaaaccccuucucauacuccuuucccacccuguauuauaa

SEQ ID NO: 20591 - RNA, 1426 nt, Homo sapiens
gcgaaagcgacaaaguagguaccugacagugcugagucauuacaagcuguuuccucugaaauguuacgcacccaugggcccucugagcauuaacauccccuuucuggaggcaaauaaaauacauauucauuguggaaaauggugcaaccuucuguaggcgacagaccacgauggggaauuuagcacuaagaguggauagcaggaacuacacaaacucgcagcugcucucuagguaccguaacuuuaucccagacgcucaaagagggcuauagggauaccggguggcaauauucccccugcagccccggcucaggccagggccacacuagggcgcauuucacucuaagcuguuauaucccccuguaauuggcggauguagaaagcgcccggagaaaaugaugcauaauagauuuguucucgaggaggaugcaauggagaguagaggacgcaggaugcuaacugguuuuucuucccaugugcaggucaccugaaaaccccgacgcuuuuucguuccucuccaaggagaacccugaacucaccgucucgcuccgcucuuauggggggagaggaauaguuucacgcccaccugcccgccgccucuccucccccggcacccccugccccagccggacgcgcgcgagcugcuaccggcaucaacggucccgcccgcuacccgcucgcuggcagccccggccggcagcucccccggcggccgccucugcaccacucgccaaccuccacgccgggccgaggucaugcccgccugcccccagcgccgggcggcccccucgucgggccaggcggccgcucgagagccgggcuggggaaggggcccgcggcggaguuggcucggggacucaccagguaggcgcccaccgugcccugcgccagcaucagggcgcacucggacaccaggaagaucuugauguuggaaaagcaggacaccuucuuuuucuuuuucuuguuccucugcgccucgucccccugcagcucgccgcuccggccgccgcccgacgaaccgcccggcuucuuccccugcauccuucccccgccgccgccgccgccgccgccgcugccgcuuucccgcucgccccgggugucggggccgcugccgggcgggggugcgcgccucgaggcugcgugcuguccccgccccggguucgcggcggccgcccccguccugccggggcuggagagguggaaggcacagcuccucgccgccgccgccgccgccgcgaucgccccuuccuccuccuccucccccgccuccgcccuccccuggccuccuccuccggcuccggcugugccaaucacaggggcucgucgcgccgcccgccgccgccgcugccucgccucccgcggccgcccgccgcugccaucgcccgguuccccuugcccgccggccgcgccugcucucacccccuca

SEQ ID NO: 20592 - RNA, 1426 nt, Homo sapiens
ugagggggugagagcaggcgcggccggcgggcaaggggaaccgggcgauggcagcggcgggcggccgcgggaggcgaggcagcggcggcggcgggcggcgcgacgagccccugugauuggcacagccggagccggaggaggaggccaggggagggcggaggcgggggaggaggaggaggaaggggcgaucgcggcggcggcggcggcggcgaggagcugugccuuccaccucuccagccccggcaggacgggggcggccgccgcgaacccggggcggggacagcacgcagccucgaggcgcgcacccccgcccggcagcggccccgacacccggggcgagcgggaaagcggcagcggcggcggcggcggcggcggcgggggaaggaugcaggggaagaagccgggcgguucgucgggcggcggccggagcggcgagcugcagggggacgaggcgcagaggaacaagaaaaagaaaaagaagguguccugcuuuuccaacaucaagaucuuccugguguccgagugcgcccugaugcuggcgcagggcacggugggcgccuaccuggugaguccccgagccaacuccgccgcgggccccuuccccagcccggcucucgagcggccgccuggcccgacgagggggccgcccggcgcugggggcaggcgggcaugaccucggcccggcguggagguuggcgaguggugcagaggcggccgccgggggagcugccggccggggcugccagcgagcggguagcgggcgggaccguugaugccgguagcagcucgcgcgcguccggcuggggcagggggugccgggggaggagaggcggcgggcaggugggcgugaaacuauuccucuccccccauaagagcggagcgagacggugaguucaggguucuccuuggagaggaacgaaaaagcgucgggguuuucaggugaccugcacaugggaagaaaaaccaguuagcauccugcguccucuacucuccauugcauccuccucgagaacaaaucuauuaugcaucauuuucuccgggcgcuuucuacauccgccaauuacagggggauauaacagcuuagagugaaaugcgcccuaguguggcccuggccugagccggggcugcagggggaauauugccacccgguaucccuauagcccucuuugagcgucugggauaaaguuacgguaccuagagagcagcugcgaguuuguguaguuccugcuauccacucuuagugcuaaauuccccaucguggucugucgccuacagaagguugcaccauuuuccacaaugaauauguauuuuauuugccuccagaaaggggauguuaaugcucagagggcccaugggugcguaacauuucagaggaaacagcuuguaaugacucagcacugucagguaccuacuuugucgcuuucgc

SEQ ID NO: 20593 - RNA, 448 nt, Homo sapiens
ggucggggggcuaaagauugcaagaaccccucccaccucucccaugcucuucuuuggagggagagagggagcucuguguccacggguaggaagaagaaauugccaacugacaccaguacaguuuauucacaaauaaauaaauucacauuaggcagagccuccugcuugccucaaagugucuagcccuaugggucccuccauggagggaggggcugagaagggccgccgcgguggggacggcucucacccgcaggaaugcccccgucgggaucgcccgugcccucuuccaggaaaggcagucugccaaggaaccacuucgaaggugcugaggccaaaaagccucggugcucacagagacggcgucaguugucccuugucacuugggcuccucaggcagccacuccagaggcgagaggggcauccaggucuccaacagagccagcacguc

SEQ ID NO: 20594 - RNA, 448 nt, Homo sapiens
gacgugcuggcucuguuggagaccuggaugccccucucgccucuggaguggcugccugaggagcccaagugacaagggacaacugacgccgucucugugagcaccgaggcuuuuuggccucagcaccuucgaagugguuccuuggcagacugccuuuccuggaagagggcacgggcgaucccgacgggggcauuccugcgggugagagccguccccaccgcggcggcccuucucagccccucccuccauggagggacccauagggcuagacacuuugaggcaagcaggaggcucugccuaaugugaauuuauuuauuugugaauaaacuguacuggugucaguuggcaauuucuucuuccuacccguggacacagagcucccucucucccuccaaagaagagcaugggagaggugggagggguucuugcaaucuuuagccccccgacc

SEQ ID NO: 20595 - RNA, 961 nt, Homo sapiens
gcgcgccgcgccuaccuacggagggggcgcgggggucccggagggugccuggccgcgcggggcucgccacggggcugucggcuggggugcugccccaugagucuggggacgagacgagggagcggccgcaguccuugucggagggcggcggccgccgaguugggccccaggccgcagagagcauccaggacucggagagcggcgggcacaggggcugggccauggcagcggcggcgcgucugggggccggcggccggcggccgcuuuaugccgagcccgaggugugaaguggccccuuccaggccgcaucagcacaucaaagugggcucggggcuuggagggggcggagccugacccuuugaauccacggcggggggccaaggugccagccccuugacugcgccuguuucgccccaccugggcccucgcuugggcgcccgacccagccucucggccuucccgccugcgcccaguguugggugaagcccggggcguugggccagcccugcagguuaaaggaagcggggucagaaaaacgaaaucuagauccuagguuuggggccugccuucaccuguuggggaccuuaugcaaauucuuaguucuuuugcaccuuagcuuccaauuuguauaaugagagccucagggcaugcgccaauuggacaguggaguagaguaaggaccaggagcagggacccucauucccucuaaagguggagaaaacaguaaaccacuucuccuuugaggcaggauggcccuggguagacccuucccugguaagaacauguggacagugcaaggaagcuugcaccccggcaaauucaauaagcugccgagucuggucaggaugcuggaccuucugagcagagggaggggguuaagccugcuccaaccccaggccaccucuagccuggcaaggucuggagcuuggccuguugccacagcugucaccacuggccuuua

SEQ ID NO: 20596 - RNA, 961 nt, Homo sapiens
uaaaggccaguggugacagcuguggcaacaggccaagcuccagaccuugccaggcuagagguggccugggguuggagcaggcuuaacccccucccucugcucagaagguccagcauccugaccagacucggcagcuuauugaauuugccggggugcaagcuuccuugcacuguccacauguucuuaccagggaagggucuacccagggccauccugccucaaaggagaagugguuuacuguuuucuccaccuuuagagggaaugagggucccugcuccugguccuuacucuacuccacuguccaauuggcgcaugcccugaggcucucauuauacaaauuggaagcuaaggugcaaaagaacuaagaauuugcauaagguccccaacaggugaaggcaggccccaaaccuaggaucuagauuucguuuuucugaccccgcuuccuuuaaccugcagggcuggcccaacgccccgggcuucacccaacacugggcgcaggcgggaaggccgagaggcugggucgggcgcccaagcgagggcccagguggggcgaaacaggcgcagucaaggggcuggcaccuuggccccccgccguggauucaaagggucaggcuccgcccccuccaagccccgagcccacuuugaugugcugaugcggccuggaaggggccacuucacaccucgggcucggcauaaagcggccgccggccgccggcccccagacgcgccgccgcugccauggcccagccccugugcccgccgcucuccgaguccuggaugcucucugcggccuggggcccaacucggcggccgccgcccuccgacaaggacugcggccgcucccucgucucguccccagacucauggggcagcaccccagccgacagccccguggcgagccccgcgcggccaggcacccuccgggacccccgcgcccccuccguagguaggcgcggcgcgc

SEQ ID NO: 20597 - RNA, 452 nt, Homo sapiens
auguagaaagugcuagugccugccacauacuaugugcucaauaaaacucaguguuuuauaugccuaucuccaauaaauggcagaaaagacuaaccugucucagagugccuggcucauagcaaguaccauguucauguuucaaaaaacagaugaaagacaacaagaaagucacauucuaaagcuuuucaagaaauaaagaaguacaaacaaaguuucuucaucauucuauuuauuacauguaugaauauuaacaucucaugguguccaucuaagucaaaaccaacaaaagaaaaaaguuaaccauaucucaagcaaacauucuuacagauucccguuacuuaaaauagaaauauguucaucugcauuaaaucauuugacaauuugaaaaagucuuuaaaaaaaaaaucaccuuuaguacuuaaauauauuuguuaauuguuugauggcaucag

SEQ ID NO: 20598 - RNA, 452 nt, Homo sapiens
cugaugccaucaaacaauuaacaaauauauuuaaguacuaaaggugauuuuuuuuuuaaagacuuuuucaaauugucaaaugauuuaaugcagaugaacauauuucuauuuuaaguaacgggaaucuguaagaauguuugcuugagauaugguuaacuuuuuucuuuuguugguuuugacuuagauggacaccaugagauguuaauauucauacauguaauaaauagaaugaugaagaaacuuuguuuguacuucuuuauuucuugaaaagcuuuagaaugugacuuucuuguugucuuucaucuguuuuuugaaacaugaacaugguacuugcuaugagccaggcacucugagacagguuagucuuuucugccauuuauuggagauaggcauauaaaacacugaguuuuauugagcacauaguauguggcaggcacuagcacuuucuacau

SEQ ID NO: 20599 - RNA, 634 nt, Homo sapiens
gcaauagugucacggucacugcggccacugcaacacaguacgguaaaugcggcucuaggcucagacuaaagcauccgcgccucagcaggugacgcacgcagaccuggucuccaacgccaccuccacguucccugauacaccagagaaagaugcuggauccguggcagccgucucuacccaaccccuccuacccucccuuccccgaaaccucccccuacgcugccaauacucuugucuucaaucucucucucucucucucucucucucucucucucucucucucucucucauuccugggaaucgggggugggggcgggugauaaagagaggugggcaggagagaaaucucuaagaggagacgggacacaucuagggagggggcgagccuggaggacagucgcacagggaggggcagaacucccgagccagggagggggugcacagucaccuggcgggacagaggcuggcggagggacgggaacccaggcggggcgagccgcgggagaguggagggcaggcgccugggcugggggcggggaccaggcggggcagggggcagggagaggagggcggcgggagccugagccggaaucgcagcgugagcagguggagccgcguugggagcccgccgggu

SEQ ID NO: 20600 - RNA, 634 nt, Homo sapiens
acccggcgggcucccaacgcggcuccaccugcucacgcugcgauuccggcucaggcucccgccgcccuccucucccugcccccugccccgccugguccccgcccccagcccaggcgccugcccuccacucucccgcggcucgccccgccuggguucccgucccuccgccagccucugucccgccaggugacugugcacccccucccuggcucgggaguucugccccucccugugcgacuguccuccaggcucgcccccucccuagaugugucccgucuccucuuagagauuucucuccugcccaccucucuuuaucacccgcccccacccccgauucccaggaaugagagagagagagagagagagagagagagagagagagagagagagagauugaagacaagaguauuggcagcguagggggagguuucggggaagggaggguaggagggguuggguagagacggcugccacggauccagcaucuuucucugguguaucagggaacguggagguggcguuggagaccaggucugcgugcgucaccugcugaggcgcggaugcuuuagucugagccuagagccgcauuuaccguacuguguugcaguggccgcagugaccgugacacuauugc

SEQ ID NO: 20601 - RNA, 1541 nt, Homo sapiens
ggagggagauaagcgucugagccagggaaagcgcgggcuaaacccgccucgccggggccccugcccgcccuccgugccccgcccgggcggugcagcuggcccgggugcucacgcucgacucucuuucuucuuuuccagggucugcgcuucgcagccgggaugaagcugguuuccgucgcccugauguaccuggguucgcucgccuuccuaggcgcugacaccgcucgguuggaugucgcgucggaguuucgaaagaagugaguccgggcagcgccuucccccuugcugguaccuggcaggcaaggggaacugaccguuggucccgaaggucuagaagugaaugggagcagggacaggccugggcgucaccugaacgcacgcgaaucgggucugcuuguguuuuccagguggaauaagugggcucugagucgugggaagagggaacugcggauguccagcagcuaccccaccgggcucgcugacgugaaggccgggccugcccagacccuuauucggccccaggacaugaagggugccucucgaagccccgaagacagguaacuacgcccugugcuguccagggacgggagggaaggaaggugugcgggaggaguucucugucuccacuccccuggcccgggggaucgucggggcuggaccgcagcucagauggcgcgagcaguuuccagcucccucuggcucuagaauggcucccguucccgguguuggggccaaagcucugcuugauggggucucaaguugccuuucuucccccuccccccgcccgcagcaguccggaugccgcccgcauccgagucaagcgcuaccgccagagcaugaacaacuuccagggccuccggagcuuuggcugccgcuucgggacgugcacggugcagaagcuggcacaccagaucuaccaguucacagauaaggacaaggacaacgucgcccccaggagcaagaucagcccccagggcuacggccgccggcgccggcgcucccugcccgaggccggcccgggucggacucuggugucuucuaagccacaagcacacggggcuccagcccccccgaguggaagugcuccccacuuucuuuaggauuuaggcgcccaugguacaaggaauagucgcgcaagcaucccgcuggugccucccgggacgaaggacuucccgagcgguguggggaccgggcucugacagcccugcggagacccugaguccgggaggcaccguccggcggcgagcucuggcuuugcaagggccccuccuucugggggcuucgcuuccuuagccuugcucaggugcaagugccccagggggcggggugcagaagaauccgaguguuugccaggcuuaaggagaggagaaacugagaaaugaaugcugagacccccggagcaggggucugagccacagccgugcucgcccacaaacugauuucucacggcgugucaccccaccagggcgcaagccucacuauuacuugaacuuuccaaaaccuaaagaggaaaagugcaaugcguguuguacauacagagg

SEQ ID NO: 20602 - RNA, 1541 nt, Homo sapiens
ccucuguauguacaacacgcauugcacuuuuccucuuuagguuuuggaaaguucaaguaauagugaggcuugcgcccugguggggugacacgccgugagaaaucaguuugugggcgagcacggcuguggcucagaccccugcuccgggggucucagcauucauuucucaguuucuccucuccuuaagccuggcaaacacucggauucuucugcaccccgcccccuggggcacuugcaccugagcaaggcuaaggaagcgaagcccccagaaggaggggcccuugcaaagccagagcucgccgccggacggugccucccggacucagggucuccgcagggcugucagagcccgguccccacaccgcucgggaaguccuucgucccgggaggcaccagcgggaugcuugcgcgacuauuccuuguaccaugggcgccuaaauccuaaagaaaguggggagcacuuccacucgggggggcuggagccccgugugcuuguggcuuagaagacaccagaguccgacccgggccggccucgggcagggagcgccggcgccggcggccguagcccugggggcugaucuugcuccugggggcgacguuguccuuguccuuaucugugaacugguagaucuggugugccagcuucugcaccgugcacgucccgaagcggcagccaaagcuccggaggcccuggaaguuguucaugcucuggcgguagcgcuugacucggaugcgggcggcauccggacugcugcgggcggggggagggggaagaaaggcaacuugagaccccaucaagcagagcuuuggccccaacaccgggaacgggagccauucuagagccagagggagcuggaaacugcucgcgccaucugagcugcgguccagccccgacgaucccccgggccaggggaguggagacagagaacuccucccgcacaccuuccuucccucccgucccuggacagcacagggcguaguuaccugucuucggggcuucgagaggcacccuucauguccuggggccgaauaagggucugggcaggcccggccuucacgucagcgagcccggugggguagcugcuggacauccgcaguucccucuucccacgacucagagcccacuuauuccaccuggaaaacacaagcagacccgauucgcgugcguucaggugacgcccaggccugucccugcucccauucacuucuagaccuucgggaccaacggucaguuccccuugccugccagguaccagcaagggggaaggcgcugcccggacucacuucuuucgaaacuccgacgcgacauccaaccgagcggugucagcgccuaggaaggcgagcgaacccagguacaucagggcgacggaaaccagcuucaucccggcugcgaagcgcagacccuggaaaagaagaaagagagucgagcgugagcacccgggccagcugcaccgcccgggcggggcacggagggcgggcaggggccccggcgaggcggguuuagcccgcgcuuucccuggcucagacgcuuaucucccucc

SEQ ID NO: 20603 - RNA, 819 nt, Homo sapiens
auccacagagauuaucucugcaauuggaaucugagaaauaaaagaaucaauuuuagugcucagccuaagcuccgccugcuggcaccucaguccccugcaggaaccaaguuuuacucuuaaauugggacccaagacuuucucucuuugcucccagagccugugacuggggcuugcaguuuagggcugcuugucccucagucgucgugccuauuugccacccauccgcucuguuccagguucugaaccaauuucccugggacugcugggcuccagacgccgucccugaucgcaccgucugcggaaaguuucucuugccucaggcucugugcgcggucccuggggagccugagugucccgagacuggccuaagccugugugcagugcgagagaguaagacuggaguccgcagccgagcaggaagagcgagccgggggauugagacuguccgauccaaccuagggcacgagccugguauaaaucgcggacuaacagagacuaucugaugaagagacuaacggagagagagggagaggaggaaagggagugagaaaaugacgaauggagggagagggagggagagacauauaccugagccaggaucucggggcucaccuggcgggagguggcuuggaucagaggcgguggcagcggcggcggcggcguccagccagagcccuguggaagcggcggcgacacuugggcugggcagugucucugaugccucccagcgccagcgacugcucuuauucccgccgcugugggucgggaaaguuccgccagugcacagcaaccaaugggcggagggguccuuugccccug

SEQ ID NO: 20604 - RNA, 819 nt, Homo sapiens
caggggcaaaggaccccuccgcccauugguugcugugcacuggcggaacuuucccgacccacagcggcgggaauaagagcagucgcuggcgcugggaggcaucagagacacugcccagcccaagugucgccgccgcuuccacagggcucuggcuggacgccgccgccgccgcugccaccgccucugauccaagccaccucccgccaggugagccccgagauccuggcucagguauaugucucucccucccucucccuccauucgucauuuucucacucccuuuccuccucucccucucucuccguuagucucuucaucagauagucucuguuaguccgcgauuuauaccaggcucgugcccuagguuggaucggacagucucaaucccccggcucgcucuuccugcucggcugcggacuccagucuuacucucucgcacugcacacaggcuuaggccagucucgggacacucaggcuccccagggaccgcgcacagagccugaggcaagagaaacuuuccgcagacggugcgaucagggacggcgucuggagcccagcagucccagggaaauugguucagaaccuggaacagagcggauggguggcaaauaggcacgacgacugagggacaagcagcccuaaacugcaagccccagucacaggcucugggagcaaagagagaaagucuugggucccaauuuaagaguaaaacuugguuccugcaggggacugaggugccagcaggcggagcuuaggcugagcacuaaaauugauucuuuuauuucucagauuccaauugcagagauaaucucuguggau

SEQ ID NO: 20605 - RNA, 1060 nt, Homo sapiens
caauuugcauucuauuuacaugucauuugcaugcaguuuaacucaaagccuggauccuccgcaagcccgaguccccaccgaagaaacuucugaauuaagaagguuccuuggcugaagugccgggguuuuugugccagaucccucccccacuucucuugucuuugcggggucccccagggcuuucugggcucuguucaggugccccccggccuggugcaguugggcggccaauguggcgcgugggcuggggccccaggcggggacgccgcugcccgccacacuccaggggccuuuguccgcgcuccaaggagccgcccccuuagcgaacgggggacggaaagggaggacuggcuaggccugggugugacagagcaaggacggaggagugaacccgcugcacgggggagauuucuggggcaaggucguuggccccuucccaggcuguucaaccggcugcccggggccaaggcgggugcgggcuccucccgcgcgcucccuuuucggccuaagcgcuagggaccccgggaugugugggguccuuguggggcuggaagccugugucccccaaggagaggggaccgagaacaggucuaguccuuaucuccagccuagccgccucuuccagagguccaagugcccccugucuggaagggaaacgccacugccccccccgccauuguaugcagccgcccccuccuccccaccccuccccgucauucguccccagcccaggucucagcucugccaucucccaccgccgugucccccccuccccuugcugaguaaugcgcacucaagccggcugcgggcuugacccccagcccccgcgacaggugcggcuguucacccccaaaguccagcccuugugcccccggcugcgucugcccuguccacagucagcccccaacgcggccccaggaccagcccgcagcuccucacacaugacgagucacuaggacacggcugggcuccuuuacccucccagcugcccuucaccuguggucgcccccacacccuccugggagacuuggaucucuaccugguccgggcacagucuccc

SEQ ID NO: 20606 - RNA, 1060 nt, Homo sapiens
gggagacugugcccggaccagguagagauccaagucucccaggagggugugggggcgaccacaggugaagggcagcugggaggguaaaggagcccagccguguccuagugacucgucaugugugaggagcugcgggcugguccuggggccgcguugggggcugacuguggacagggcagacgcagccgggggcacaagggcuggacuuugggggugaacagccgcaccugucgcgggggcugggggucaagcccgcagccggcuugagugcgcauuacucagcaaggggagggggggacacggcggugggagauggcagagcugagaccugggcuggggacgaaugacggggagggguggggaggagggggcggcugcauacaauggcggggggggcaguggcguuucccuuccagacagggggcacuuggaccucuggaagaggcggcuaggcuggagauaaggacuagaccuguucucgguccccucuccuugggggacacaggcuuccagccccacaaggaccccacacaucccggggucccuagcgcuuaggccgaaaagggagcgcgcgggaggagcccgcacccgccuuggccccgggcagccgguugaacagccugggaaggggccaacgaccuugccccagaaaucucccccgugcagcggguucacuccuccguccuugcucugucacacccaggccuagccaguccucccuuuccgucccccguucgcuaagggggcggcuccuuggagcgcggacaaaggccccuggaguguggcgggcagcggcguccccgccuggggccccagcccacgcgccacauuggccgcccaacugcaccaggccggggggcaccugaacagagcccagaaagcccugggggaccccgcaaagacaagagaagugggggagggaucuggcacaaaaaccccggcacuucagccaaggaaccuucuuaauucagaaguuucuucgguggggacucgggcuugcggaggauccaggcuuugaguuaaacugcaugcaaaugacauguaaauagaaugcaaauug

SEQ ID NO: 20607 - RNA, 1037 nt, Homo sapiens
gccgccagccgccgcuccgagaggcugcaccggccgccggucaucguccugcagcgcggagccugcggccaagguacuccgccgcgcuccugggcagcuccccacucucuccaucccagcucggaccugcuucugcgggacuggugggcagguugaggggcagcgaagcguugugggguggccagggcaacucucggggacaggcaggugggccccgggguggcggauuuccgcgggcugccucggaaccgagcuucgcgcccagcccggggccgguucugcgcccagacgaugccaguacgcccggccugcacucuggggcucgagacgccgggcgaccggccauggagugcccugagggcaaccacacagcgcggggaccccaggacaaauaagaggaaugggggcauaaaggaaggagagaaguucaggacugggaauuggcgccucgcagagcggcuucaggaccacaagaagucauuucgguugcuuuuucuucuauuuacguccuccguccccuuuaaaauucacugcuuugaucacgggaccgcucagugaaaacuguauguaacucuuuuggaaaggaacaguguuugccggcccgccccggaguuucuccaaaaagucuaccccgagcagggaacgguuuggcaccgcucucguuucggcggcguugcugccugucuugcuuuccucguuuugagccagcccuacaaaaaugaaaguggcuccuuuugaauaagcugaaucgggcuuuggaucacgaaaucugcagaggcggagaagggaccggguuagugaugaggaagaagucuaccccucuguuccuacagccgcacacaggaccuguucuggcaggggagacgguggugaugggggaaggaguggaauggagcaaugucuaacucucucgcgggaccuuccggagagaugcuccucaucuucaggcagaggccauguggaaaaauaauaucgaguucagcagcggccagccccgcguuguaggaaccagacagcggggcuuggcagugcgcuug

SEQ ID NO: 20608 - RNA, 1037 nt, Homo sapiens
caagcgcacugccaagccccgcugucugguuccuacaacgcggggcuggccgcugcugaacucgauauuauuuuuccacauggccucugccugaagaugaggagcaucucuccggaaggucccgcgagagaguuagacauugcuccauuccacuccuucccccaucaccaccgucuccccugccagaacagguccugugugcggcuguaggaacagagggguagacuucuuccucaucacuaacccggucccuucuccgccucugcagauuucgugauccaaagcccgauucagcuuauucaaaaggagccacuuucauuuuuguagggcuggcucaaaacgaggaaagcaagacaggcagcaacgccgccgaaacgagagcggugccaaaccguucccugcucgggguagacuuuuuggagaaacuccggggcgggccggcaaacacuguuccuuuccaaaagaguuacauacaguuuucacugagcggucccgugaucaaagcagugaauuuuaaaggggacggaggacguaaauagaagaaaaagcaaccgaaaugacuucuugugguccugaagccgcucugcgaggcgccaauucccaguccugaacuucucuccuuccuuuaugcccccauuccucuuauuuguccugggguccccgcgcugugugguugcccucagggcacuccauggccggucgcccggcgucucgagccccagagugcaggccgggcguacuggcaucgucugggcgcagaaccggccccgggcugggcgcgaagcucgguuccgaggcagcccgcggaaauccgccaccccggggcccaccugccuguccccgagaguugcccuggccaccccacaacgcuucgcugccccucaaccugcccaccagucccgcagaagcagguccgagcugggauggagagaguggggagcugcccaggagcgcggcggaguaccuuggccgcaggcuccgcgcugcaggacgaugaccggcggccggugcagccucucggagcggcggcuggcggc

SEQ ID NO: 20609 - RNA, 4270 nt, Homo sapiens
ggcuuggggcugagucgggggguccuugcugguuguugcggcugagggggccccugggcucgggcggggcgcgcagccgccaccugccccagcaggaggagccggccacgcggcgcuuggagccucagccagaucccgagcgccccccggugccgcgccggagccccggagcccccgccaggugcgggacgcgcggaaggccggcugcgccgggccgaaucugggccaggcuuggagccuacggaggcuccggccgccagaggagagaggaucagggcgggaaacacagcucaaauccuaccugcauggccgagcucaccggggugcgucuaaguagcucgccuuugcggcccacccaaaauaucuggauaaugguuaccccguccucagugcguuggacuugcauagacgcgaguucggucucgggggccaccacgauaauuugggggucuggggaaaccaucuccuggagaguuugaacgauguaagaaagcacugugauuuuuaccaagucaaaaaccacgcacaaaaucccgcaccccgccagccccccgccgccuaagccuagccaaggggaaggggccgccggcggaaucucgcgccccccuggccccccucgccccccucgcuccgccaucaaucacuucgcccgcgcuccgcgcgcgccucccggcggaguccuaggcccgcgggcuagaggcacuuuaccgcccggcgggagcgccucuccuccgcgucccucgccccagcccccugcccgccccacuuugggacccuccagccgcuuuccccacaaaugagaucuuugcaaugagcaaacgaaaguggcgcggauuucggggcgcccagcaggagcgagcgcagccgccagccgcaaguccgcagccgugucccgcgccccacgccggccuccccggcggcagccggagacgagcgccagcaccggcgggacagcagcagaugcgggccgagagccggucaggggcgcagaggcggaggggaucggcgcggcggggagcucaccgcgaagcuggaggcugcguccgcgggcgcaccaggagcucaggcagcgagcgaucgaacgcucuguggcaggcgguggacgcugcugaaggugagcgagaccccggggccaguccucaguguccgggagcaacgcccaguccguuggaagacccggggacaaugcccaaauuugggggagacugggggcaaugcccggucgcuuuccuggacacggggaagcccucccuguccacguccugagggcgcgcggccgacccaaguguguuugggcaacgcuagagagaaauuucccaaauccgaguugcucuggggacuucguaggagacagagaggcccgaaaccagugcccgcugugcgcgggguuggggaagcugcaguggguggccggcgagccgggaacaaugcccaaauuuuggggaacgcaaggcagaguucuuucugccuugcgggcuuagcgaauggguguccuggaggaggggaccccggggacuccguuaaugugggaaccgugauuaaugacuaaacucgagacuccagaaaaauagauuacagguuugggggaugagagaaguugcuccaugcaauugggaacauagagaaagaggucucaaauaggggccagcuagcuugggggaccaauuugugaggagggguaguuaaagaaaauucuccauaugaaauugggaauuuugccguagagccauauuacguaaaauuggcagaugaaagcaaggaacacauuuuggggauccaaacacauucuugguguguuagggggaagcugagauuaauuuucacaucuuaagaauauaaguuaguggccuggacgcuggcagcagccggggaaaaaauaaccuucauaauuacuguggcuucagggaaagguuuuaacacccuucagagauggaagaaagcacugucuagauuuugggggagccuggagugugaucaguacauuuggggaaagcaaaauaaaaaauaaaaaaauaaaaaaucaguauuauuuuucuaugcuaauuuuuaaaugauuuccauuagcuuauuuuugguaaauaagaaaaagacuauauauuuuccuggaugucgucugcauuugggggagccccagugaaacacauuucaaguuuuugggacacauggaaauuacccaauggagauuugauaucuaaauuucuggaaaccuaguuaguagcuaggaaacuuauaggucgcagguuuuuccaugccugggauuucuugggacccagggacauuuuuuagugugcuuuggggguccauggaacauuuucuaaauguagggggacccagggcagggaccauaaagucaggagacucauaaaucaguauuaaaaaaaaaaaaaccucaauuguuuugugaagggaaaaaaaucucaauuugcuuuggaaggcugggagacaauaccgcaauuugggggcuccaggaaaaucguuuuugaaucuaaagaucuagggaaguugcucagaguccuuggaggacuuggggguccauauguacauuuuaaagaaaggggauucagaauuccuaggucuuaggacuuaggaauuuucagauuuugugauagggagugugcagugugcuugaaggaaauauugcuuaacuuugagaugacucaguggguuguuuggagcccaagaaaucagugcuguccugugauccgagggcaaugcugaauguuccuagagggccuggagggcagcguccagaacauccaaguaugggggaccaggaaaaggguccagugugauccuggccguugggguuucagaccaaugccugaauuuuagaaaagcaagauucuuguuaugaagcuccugggacccagagaauuguuuaauagucaauauguugugaugcagagaaagugcucggaauguuugggaacuggggccguuagcaacaccuggcauaacagaaauaaaaguaggcucugcccaagggguccuuuugugcuugguguagcccagagggacccgggagacccugugugauuuggggggaccuggagaauccugggucacacuugagcaccuccugguaacugcucagugugcuccagggaccuggguggcacugucuacaucuuaagggaccugauucguggccaggcagcauauagagccauagacguuaaugccccaaagcuuugugacucacacacccacaacauucucaauagcuuuggggaaucacuggggaaaucccuccauuuuaugaaacucaggcaaucagagggcaggucguuuaugauucagaaaaggauucaacaugcucuggguguaaugaccgaauuugggggaagguaugggaagcaauuuucauacucugaggguuccaaccuuccagcccugcugagugucaugagggacuugggauucaacguguaaaguuuagggaacccagguuagugugaauagauuugcgggacccaacagcaaaugucccaugcugaggugaacgggaaggggcgcggggguggggugggggggcgcggaauggggcggacgugugccggaaacaguaagcuuaggagacccuggaguuaauauucaaaauuaugcgggaaaguuccacuuguuuuggaaacaaugccuaaauguggaaaaggcacuguccacauccuggggagccaggcaaauuggucagcgcgaccaccacggaccaagggcuucgucuuuaaaauuagggaagccggguuaguggccuguaaaucugugggaccuggaggggguguauaaaacuguccagagccugggagaaagcacaucuggggccccaggccacauaguguaagucuggaaaagcccgccgggacugauguguuuugacguccccggaaauuaacguccaagaaaauuauugugacccgucgaaauggugaguauauuuagaagacuugggaagcaaugcuuaaauuuagaggaucccagaaaaaguaaaauguccgaguucggggaaagcagggaaguuguuccguggauuggaaucccccgaggaucaagggcuaauuguugagcucaagcuucccgggcagcggaaggaaggcgcugccggggauucaccuuggcuggggcgcgcgcggagcacuggcgcccuccccgggaacccgagcgcgggcggcgcgggcagguagcgcggagcgcccuggcgcgcacggccggcugaaauucugcuuuucguucuuugggguuuuucuuccuuuugcuuuuauuuuuuuuuuucuuu

SEQ ID NO: 20610 - RNA, 4270 nt, Homo sapiens
aaagaaaaaaaaaaauaaaagcaaaaggaagaaaaaccccaaagaacgaaaagcagaauuucagccggccgugcgcgccagggcgcuccgcgcuaccugcccgcgccgcccgcgcucggguucccggggagggcgccagugcuccgcgcgcgccccagccaaggugaauccccggcagcgccuuccuuccgcugcccgggaagcuugagcucaacaauuagcccuugauccucgggggauuccaauccacggaacaacuucccugcuuuccccgaacucggacauuuuacuuuuucugggauccucuaaauuuaagcauugcuucccaagucuucuaaauauacucaccauuucgacgggucacaauaauuuucuuggacguuaauuuccggggacgucaaaacacaucagucccggcgggcuuuuccagacuuacacuauguggccuggggccccagaugugcuuucucccaggcucuggacaguuuuauacacccccuccaggucccacagauuuacaggccacuaacccggcuucccuaauuuuaaagacgaagcccuugguccgugguggucgcgcugaccaauuugccuggcuccccaggauguggacagugccuuuuccacauuuaggcauuguuuccaaaacaaguggaacuuucccgcauaauuuugaauauuaacuccagggucuccuaagcuuacuguuuccggcacacguccgccccauuccgcgcccccccaccccacccccgcgccccuucccguucaccucagcaugggacauuugcuguugggucccgcaaaucuauucacacuaaccuggguucccuaaacuuuacacguugaaucccaagucccucaugacacucagcagggcuggaagguuggaacccucagaguaugaaaauugcuucccauaccuucccccaaauucggucauuacacccagagcauguugaauccuuuucugaaucauaaacgaccugcccucugauugccugaguuucauaaaauggagggauuuccccagugauuccccaaagcuauugagaauguugugggugugugagucacaaagcuuuggggcauuaacgucuauggcucuauaugcugccuggccacgaaucaggucccuuaagauguagacagugccacccaggucccuggagcacacugagcaguuaccaggaggugcucaagugugacccaggauucuccagguccccccaaaucacacagggucucccgggucccucugggcuacaccaagcacaaaaggaccccuugggcagagccuacuuuuauuucuguuaugccagguguugcuaacggccccaguucccaaacauuccgagcacuuucucugcaucacaacauauugacuauuaaacaauucucugggucccaggagcuucauaacaagaaucuugcuuuucuaaaauucaggcauuggucugaaaccccaacggccaggaucacacuggacccuuuuccuggucccccauacuuggauguucuggacgcugcccuccaggcccucuaggaacauucagcauugcccucggaucacaggacagcacugauuucuugggcuccaaacaacccacugagucaucucaaaguuaagcaauauuuccuucaagcacacugcacacucccuaucacaaaaucugaaaauuccuaaguccuaagaccuaggaauucugaauccccuuucuuuaaaauguacauauggacccccaaguccuccaaggacucugagcaacuucccuagaucuuuagauucaaaaacgauuuuccuggagcccccaaauugcgguauugucucccagccuuccaaagcaaauugagauuuuuuucccuucacaaaacaauugagguuuuuuuuuuuuuaauacugauuuaugagucuccugacuuuauggucccugcccugggucccccuacauuuagaaaauguuccauggacccccaaagcacacuaaaaaaugucccugggucccaagaaaucccaggcauggaaaaaccugcgaccuauaaguuuccuagcuacuaacuagguuuccagaaauuuagauaucaaaucuccauuggguaauuuccaugugucccaaaaacuugaaauguguuucacuggggcucccccaaaugcagacgacauccaggaaaauauauagucuuuuucuuauuuaccaaaaauaagcuaauggaaaucauuuaaaaauuagcauagaaaaauaauacugauuuuuuauuuuuuuauuuuuuauuuugcuuuccccaaauguacugaucacacuccaggcucccccaaaaucuagacagugcuuucuuccaucucugaaggguguuaaaaccuuucccugaagccacaguaauuaugaagguuauuuuuuccccggcugcugccagcguccaggccacuaacuuauauucuuaagaugugaaaauuaaucucagcuucccccuaacacaccaagaauguguuuggauccccaaaauguguuccuugcuuucaucugccaauuuuacguaauauggcucuacggcaaaauucccaauuucauauggagaauuuucuuuaacuaccccuccucacaaauuggucccccaagcuagcuggccccuauuugagaccucuuucucuauguucccaauugcauggagcaacuucucucaucccccaaaccuguaaucuauuuuucuggagucucgaguuuagucauuaaucacgguucccacauuaacggaguccccgggguccccuccuccaggacacccauucgcuaagcccgcaaggcagaaagaacucugccuugcguuccccaaaauuugggcauuguucccggcucgccggccacccacugcagcuuccccaaccccgcgcacagcgggcacugguuucgggccucucugucuccuacgaaguccccagagcaacucggauuugggaaauuucucucuagcguugcccaaacacacuugggucggccgcgcgcccucaggacguggacagggagggcuuccccguguccaggaaagcgaccgggcauugcccccagucucccccaaauuugggcauuguccccgggucuuccaacggacugggcguugcucccggacacugaggacuggccccggggucucgcucaccuucagcagcguccaccgccugccacagagcguucgaucgcucgcugccugagcuccuggugcgcccgcggacgcagccuccagcuucgcggugagcuccccgccgcgccgauccccuccgccucugcgccccugaccggcucucggcccgcaucugcugcugucccgccggugcuggcgcucgucuccggcugccgccggggaggccggcguggggcgcgggacacggcugcggacuugcggcuggcggcugcgcucgcuccugcugggcgccccgaaauccgcgccacuuucguuugcucauugcaaagaucucauuuguggggaaagcggcuggagggucccaaaguggggcgggcagggggcuggggcgagggacgcggaggagaggcgcucccgccgggcgguaaagugccucuagcccgcgggccuaggacuccgccgggaggcgcgcgcggagcgcgggcgaagugauugauggcggagcgaggggggcgaggggggccaggggggcgcgagauuccgccggcggccccuuccccuuggcuaggcuuaggcggcggggggcuggcggggugcgggauuuugugcgugguuuuugacuugguaaaaaucacagugcuuucuuacaucguucaaacucuccaggagaugguuuccccagacccccaaauuaucgugguggcccccgagaccgaacucgcgucuaugcaaguccaacgcacugaggacgggguaaccauuauccagauauuuugggugggccgcaaaggcgagcuacuuagacgcaccccggugagcucggccaugcagguaggauuugagcuguguuucccgcccugauccucucuccucuggcggccggagccuccguaggcuccaagccuggcccagauucggcccggcgcagccggccuuccgcgcgucccgcaccuggcgggggcuccggggcuccggcgcggcaccggggggcgcucgggaucuggcugaggcuccaagcgccgcguggccggcuccuccugcuggggcagguggcggcugcgcgccccgcccgagcccaggggcccccucagccgcaacaaccagcaaggaccccccgacucagccccaagcc

SEQ ID NO: 20611 - RNA, 632 nt, Homo sapiens
cugaucucuugcgcuuggcgaagaaaucugcgggcgacagcgcgcgcggccggucagggcggggccggcccggagacccgagagggggccgggagagggcgcggggcgcgggccggccggggugggggcgccguccccgcccgcgccgagguccgcggcgggucagcuuuguuuacgucgccgcgcaaugugcuguguaagcauuuccccuugucccgcggccaagccccccggggccgccgccgcgcuuaacccccuccacgccgugcucacggcgcccggccgcgcccggggaggggcucccgcggccgggggcgaaaacugcgcucccggggggucgcggccgggauucagccucccaccccgcccgcgcgaagccgcuggagggcacaacaacggggcggggagggggguaagggcgcagccgcgcccugagcgcugcgggcccuuuaaugccacgggaggaggcgggaacccagcgaggcccccgagggcuggggggaccggccggccggacaaagcggggccgggccgggccggggcggggccgugcggggcucaccggagaucagaggcccggacagcuucuugaucgccgcgccguuggcgcuggcggccgcggugccggccgc

SEQ ID NO: 20612 - RNA, 632 nt, Homo sapiens
gcggccggcaccgcggccgccagcgccaacggcgcggcgaucaagaagcuguccgggccucugaucuccggugagccccgcacggccccgccccggcccggcccggccccgcuuuguccggccggccgguccccccagcccucgggggccucgcuggguucccgccuccucccguggcauuaaagggcccgcagcgcucagggcgcggcugcgcccuuaccccccuccccgccccguuguugugcccuccagcggcuucgcgcgggcggggugggaggcugaaucccggccgcgaccccccgggagcgcaguuuucgcccccggccgcgggagccccuccccgggcgcggccgggcgccgugagcacggcguggaggggguuaagcgcggcggcggccccggggggcuuggccgcgggacaaggggaaaugcuuacacagcacauugcgcggcgacguaaacaaagcugacccgccgcggaccucggcgcgggcggggacggcgcccccaccccggccggcccgcgccccgcgcccucucccggcccccucucgggucuccgggccggccccgcccugaccggccgcgcgcgcugucgcccgcagauuucuucgccaagcgcaagagaucag

SEQ ID NO: 20613 - RNA, 875 nt, Homo sapiens
gccccggcgccgcaagcucuacugcgccacgaaguaccaccuccagcugcacccgagcggccgcgucaacggcagccuggagaacagcgccuacagugagugccggacgcugcggggccccgggggaagcggcgccgggaggggucgggcccgggagaaggcgcgcugcggggccccgcgggggaggcggcgccggggaggggucuggcccgggagaaggcauggugcgcccgggguguccgggaaaagaccgucugccucccgcugccagaaggggaaugccagggugcccuccucaaccuacacguccgggagaagagcgcgcgcugggguucgagcagaacucgggggcaugggcguucacguccgaagagggcgccggcggcugucagaguccguccccgguccggcccgcuggucugaggggacgcgagcuaggcgaccccggggcuccaggcucugcugcuuugggcagcucugacaaguuuaagcccuuugaaugugucggagaaaaggagccggacaaggcauuuaucauccucuuuauuauuuugacgacuucuccuccuccugccgaccccuggacgccccgccguccccuccgcccuccccgcucgcggcugcccagguggccgcccccgcugcugccucugcgcggaggacucuugcccugcggagcucgguucccuggccgcggccgccaccgacaguuauuccccgcgcuggaaucugcaccucccccgccuccgcccuggccgcacagcgacaggaggguggaggcccucgccgucgggacgugcggaucacgagcgcggaacgguguccgcccgggccugggggugcagacacacacacuccggcccccgcacgcagga

SEQ ID NO: 20614 - RNA, 875 nt, Homo sapiens
uccugcgugcgggggccggagugugugugucugcacccccaggcccgggcggacaccguuccgcgcucgugauccgcacgucccgacggcgagggccuccacccuccugucgcugugcggccagggcggaggcgggggaggugcagauuccagcgcggggaauaacugucgguggcggccgcggccagggaaccgagcuccgcagggcaagaguccuccgcgcagaggcagcagcgggggcggccaccugggcagccgcgagcggggagggcggaggggacggcggggcguccaggggucggcaggaggaggagaagucgucaaaauaauaaagaggaugauaaaugccuuguccggcuccuuuucuccgacacauucaaagggcuuaaacuugucagagcugcccaaagcagcagagccuggagccccggggucgccuagcucgcguccccucagaccagcgggccggaccggggacggacucugacagccgccggcgcccucuucggacgugaacgcccaugcccccgaguucugcucgaaccccagcgcgcgcucuucucccggacguguagguugaggagggcacccuggcauuccccuucuggcagcgggaggcagacggucuuuucccggacaccccgggcgcaccaugccuucucccgggccagaccccuccccggcgccgccucccccgcggggccccgcagcgcgccuucucccgggcccgaccccucccggcgccgcuucccccggggccccgcagcguccggcacucacuguaggcgcuguucuccaggcugccguugacgcggccgcucgggugcagcuggaggugguacuucguggcgcaguagagcuugcggcgccggggc

SEQ ID NO: 20615 - RNA, 926 nt, Homo sapiens
gaccaucccaacccggcacucacagccccgcagcgcaucccggucgccgcccagccucccgcacccccaucgccggagcugcgccgagagccccagggaggugccaugcggagcggguguguggugguccacguauggauccuggccggccucuggcuggccguggccgggcgcccccucgccuucucggacgcggggccccacgugcacuacggcuggggcgaccccauccgccugcggcaccuguacaccuccggcccccacgggcucuccagcugcuuccugcgcauccgugccgacggcgucguggacugcgcgcggggccagagcgcgcacagugagugcccgccagcacccccgcccgccccgccgcgcgcaccccaccccgcugcgcgcgccccaccccagcgcccuuccuuccuuugccacccuuaggcuccugcggaccccucaacuccugggaaccccagguuuuggcaccuggacguuaggaucccuccguuaguccccaaacagcgcgggacgcuagggagaagcacaggcuuguggaccgaccgcacccacguggugcgggcccagcgguccuugcugcagcuucucgcuuccccugcgccuagguuugcuggagaucaaggcagucgcucugcggaccguggccaucaagggcgugcacagcgugcgguaccucugcaugggcgccgacggcaagaugcaggggcugguaaguguccccacggggcggaugcgccggggcgggggaccggcgccuguccccgggcggaggccugaaggagagaaaggcgcugguucgaauccaggguuuccucgccuccuccgcccagacccgcgugcaacuucgagggaaagauugcaaagaccgauuaagugcauguccgacgauuuccuacggaaauuuagggucucag

SEQ ID NO: 20616 - RNA, 926 nt, Homo sapiens
cugagacccuaaauuuccguaggaaaucgucggacaugcacuuaaucggucuuugcaaucuuucccucgaaguugcacgcgggucugggcggaggaggcgaggaaacccuggauucgaaccagcgccuuucucuccuucaggccuccgcccggggacaggcgccggucccccgccccggcgcauccgccccguggggacacuuaccagccccugcaucuugccgucggcgcccaugcagagguaccgcacgcugugcacgcccuugauggccacgguccgcagagcgacugccuugaucuccagcaaaccuaggcgcaggggaagcgagaagcugcagcaaggaccgcugggcccgcaccacgugggugcggucgguccacaagccugugcuucucccuagcgucccgcgcuguuuggggacuaacggagggauccuaacguccaggugccaaaaccugggguucccaggaguugagggguccgcaggagccuaaggguggcaaaggaaggaagggcgcugggguggggcgcgcgcagcgggguggggugcgcgcggcggggcgggcgggggugcuggcgggcacucacugugcgcgcucuggccccgcgcgcaguccacgacgccgucggcacggaugcgcaggaagcagcuggagagcccgugggggccggagguguacaggugccgcaggcggauggggucgccccagccguagugcacguggggccccgcguccgagaaggcgagggggcgcccggccacggccagccagaggccggccaggauccauacguggaccaccacacacccgcuccgcauggcaccucccuggggcucucggcgcagcuccggcgaugggggugcgggaggcugggcggcgaccgggaugcgcugcggggcugugagugccggguugggaugguc

SEQ ID NO: 20617 - RNA, 527 nt, Homo sapiens
ggaauaguggccccgccgaugccccccgcucgcucugccagaggcuuucgccccacugcucccgcagcucccagaacucggagggcugcgggaguuacugggggagggggucgaggagagccugggggccugggggucagaaguccaggagcgcgagcagccggcguccgcgcggcggccccugccuucgccuugucucucuuguuguccaucuugcaccugaagagacaaaccgguccgcaucccagguucuggacagcuacgccgccuccagagaccuggacccugcuaccucacugcccuuucgcagcaucgccacccauggacacucaaaccucggccucggcuuccauccgcucggcucccacgcaccuacacccacucgccagccccacugcuccucgcuguccccaagucccaccccccaccgcuuuucccuaaagcgaagaggcccugcccgccccagcccaccgccucccccgccucggcuccaauucaggaccgaucuccacgccccugccccuugc

SEQ ID NO: 20618 - RNA, 527 nt, Homo sapiens
gcaaggggcaggggcguggagaucgguccugaauuggagccgaggcgggggaggcggugggcuggggcgggcagggccucuucgcuuuagggaaaagcgguggggggugggacuuggggacagcgaggagcaguggggcuggcgaguggguguaggugcgugggagccgagcggauggaagccgaggccgagguuugaguguccauggguggcgaugcugcgaaagggcagugagguagcaggguccaggucucuggaggcggcguagcuguccagaaccugggaugcggaccgguuugucucuucaggugcaagauggacaacaagagagacaaggcgaaggcaggggccgccgcgcggacgccggcugcucgcgcuccuggacuucugacccccaggcccccaggcucuccucgacccccucccccaguaacucccgcagcccuccgaguucugggagcugcgggagcaguggggcgaaagccucuggcagagcgagcggggggcaucggcggggccacuauucc

SEQ ID NO: 20619 - RNA, 2635 nt, Homo sapiens
ccuuucaauacccaguggagaagcugccuccagggagauaagcucucaauuaggagacguguguguauaucaccaguucucucuggcauguaacaguuaacaauuucuauacaguuaaguggauuuagugaguaucauucuuccaggagagaaguaaaauuuuuuuuuaaagaggaaaacaaagaacaagauuaagaacaguaaaagaauaaguauggaaaaucugguaaguagcaaaaaucauuuuuaagcauuugagggagaaacugcaaaaucuguucagaagccacaccuuccggccugugggacugcauggcugugacacugagcaacagcugaagucuuuauucucucggaggggaaggaaaaaaggaaacaacagucaguccaggcuuguccacggcuggaagccucgacuccugcaaaccuccugcaaaccgaucucccagauccuuucugggcaagcacauaaccaaaggaaaugaaaacuagaaaaacaauuugugcauggaacaaugacauggaguuucacuuugguuucaugcucaaauaugaaugugguuauaauuuuuuaaaauauauauuaauagaaggcaacgaguugaggaugguggcuucuucaagccgggcguccagaagagccccacuucugccuuggagcgcgccuuaggcagcagucgugggaaagcucagauacagcuguuuccaggcaaagggcccagagcuuuucagccucagccaccagggucuccagacaaggagaaauacgcccaaagcugcucccaggggcuaggagcucggagcucccagugugggucucugagcagcgcggggugggcgcucccggcccuccagcccccaacucccucgcgcacccgggacgggugaaggcgcccagcugccgagcauacccgcgacgcggguucaaaucccgccggcucccaggcacccucaccccgccacagcgcgggcuguuucuccucccuuccccggaggaauuccuuaacucuccaguacccauaccauaacaaaggaggcucgguccaccaaugcgcgaucguagccuacagggacccccaacgaaccccggcccagagaaugcaccuggccgugccacgcgcgacccccgaggggcaggcggacggguccaggcgcggacaaaggggccucucggggcgcccaagcucggggcgggacgccgggagcggagcuggccgggaacucaccuucgcagcggcccggcugugcuccucguggagcagaagggcggcgggcagcagcagcagccagacgcugagccggggccccaugguggcgcgcccgaggcggcgagggacggcugcccggcgugcgggggccgcggcggacagcuagcucucggaaggccggacuuccagcgcuacgcaccgucccgggugcggcggcuccaagcggagaccugagcgcggcgggccgagcuccccaauuuguuggcgcugcccccucccccccggcggugcgcgggcggcgccucaaaggggaggacccugcggcgcggguaagaggcggcgggagcgcgcggcccgggaguguggcugcagugcgccgggacaccagggcuccgcgcuccgcacucaagaggcucccgcgucccaaccccucgcgcccgcgcguucgcggauccaggccgaggaccgaaaggggccgcccgagcccccggggccggcgcccagagagcccagcaaggccggccgcccugccggugugccgccggcgggugcuucuggaagggccaaugcguucgggcagcagccccugaagccgagcccgaggugagagcgacccccgagcggcgcccagacccuggcccgagagcaccgacuuggagcgccuugugcaggcuagggcugcacgcucuccugcuugggaguagaaagggggagggugggagagcgaagaccgagcuccucggccaaggagcacccacaggggccuaacgggaggcucuccuucuuuccgggucgugggggggacggcccuccggucaccccugcaugcgggccgcgcaccgcgcuguccccgcgucucgcggaccgagaccggcggugaggaugggcugccucccucauccugcgcuaaacucgcuuugucugucgccucuaggcuaagugggacugaccggggcccagaguggacgaaccgccagcauggggagagaccagcgcgcgguggccggcccugcccuacggcgguaagcgacuuucugccugguccccgugggucacgcgcgcauggacccuucgguguaacucucggggacugacaagccgggcccgcacguucacgucucucuuccucccuuucccaugcagguggcugcugcuggggacagugaccgugggguuccucgcccagagcgucuuggcgguaaguccuggcucccgcgcuuggacuugcgcgcccgagagugguugggacguuugaguggccuuggagaaggcagcucguccgugcgcucccgagugugugugugcguguggauguucgccaggcugcccaccaagguucugagaaagcuugcucuucccucaucaugcuuuccaccuuuccuuccccuuggguucccagcgucaauccuguguuuugcaagcgucgg

SEQ ID NO: 20620 - RNA, 2635 nt, Homo sapiens
ccgacgcuugcaaaacacaggauugacgcugggaacccaaggggaaggaaagguggaaagcaugaugagggaagagcaagcuuucucagaaccuuggugggcagccuggcgaacauccacacgcacacacacacucgggagcgcacggacgagcugccuucuccaaggccacucaaacgucccaaccacucucgggcgcgcaaguccaagcgcgggagccaggacuuaccgccaagacgcucugggcgaggaaccccacggucacuguccccagcagcagccaccugcaugggaaagggaggaagagagacgugaacgugcgggcccggcuugucaguccccgagaguuacaccgaaggguccaugcgcgcgugacccacggggaccaggcagaaagucgcuuaccgccguagggcagggccggccaccgcgcgcuggucucuccccaugcuggcgguucguccacucugggccccggucagucccacuuagccuagaggcgacagacaaagcgaguuuagcgcaggaugagggaggcagcccauccucaccgccggucucgguccgcgagacgcggggacagcgcggugcgcggcccgcaugcaggggugaccggagggccgucccccccacgacccggaaagaaggagagccucccguuaggccccugugggugcuccuuggccgaggagcucggucuucgcucucccacccucccccuuucuacucccaagcaggagagcgugcagcccuagccugcacaaggcgcuccaagucggugcucucgggccagggucugggcgccgcucgggggucgcucucaccucgggcucggcuucaggggcugcugcccgaacgcauuggcccuuccagaagcacccgccggcggcacaccggcagggcggccggccuugcugggcucucugggcgccggccccgggggcucgggcggccccuuucgguccucggccuggauccgcgaacgcgcgggcgcgagggguugggacgcgggagccucuugagugcggagcgcggagcccuggugucccggcgcacugcagccacacucccgggccgcgcgcucccgccgccucuuacccgcgccgcaggguccuccccuuugaggcgccgcccgcgcaccgccgggggggagggggcagcgccaacaaauuggggagcucggcccgccgcgcucaggucuccgcuuggagccgccgcacccgggacggugcguagcgcuggaaguccggccuuccgagagcuagcuguccgccgcggcccccgcacgccgggcagccgucccucgccgccucgggcgcgccaccauggggccccggcucagcgucuggcugcugcugcugcccgccgcccuucugcuccacgaggagcacagccgggccgcugcgaaggugaguucccggccagcuccgcucccggcgucccgccccgagcuugggcgccccgagaggccccuuuguccgcgccuggacccguccgccugccccucgggggucgcgcguggcacggccaggugcauucucugggccgggguucguugggggucccuguaggcuacgaucgcgcauugguggaccgagccuccuuuguuaugguauggguacuggagaguuaaggaauuccuccggggaagggaggagaaacagcccgcgcuguggcggggugagggugccugggagccggcgggauuugaacccgcgucgcggguaugcucggcagcugggcgccuucacccgucccgggugcgcgagggaguugggggcuggagggccgggagcgcccaccccgcgcugcucagagacccacacugggagcuccgagcuccuagccccugggagcagcuuugggcguauuucuccuugucuggagacccugguggcugaggcugaaaagcucugggcccuuugccuggaaacagcuguaucugagcuuucccacgacugcugccuaaggcgcgcuccaaggcagaaguggggcucuucuggacgcccggcuugaagaagccaccauccucaacucguugccuucuauuaauauauauuuuaaaaaauuauaaccacauucauauuugagcaugaaaccaaagugaaacuccaugucauuguuccaugcacaaauuguuuuucuaguuuucauuuccuuugguuaugugcuugcccagaaaggaucugggagaucgguuugcaggagguuugcaggagucgaggcuuccagccguggacaagccuggacugacuguuguuuccuuuuuuccuuccccuccgagagaauaaagacuucagcuguugcucagugucacagccaugcagucccacaggccggaagguguggcuucugaacagauuuugcaguuucucccucaaaugcuuaaaaaugauuuuugcuacuuaccagauuuuccauacuuauucuuuuacuguucuuaaucuuguucuuuguuuuccucuuuaaaaaaaaauuuuacuucucuccuggaagaaugauacucacuaaauccacuuaacuguauagaaauuguuaacuguuacaugccagagagaacuggugauauacacacacgucuccuaauugagagcuuaucucccuggaggcagcuucuccacuggguauugaaagg

SEQ ID NO: 20621 - RNA, 1326 nt, Homo sapiens
ucacguccuuggugcugaagaagcaagaggccaguggaaacgaaacugcugcuucauucccuccgaugcaggggccguuccagcacugcagggcagcucuuguuccagaaacacaccguguguuaagagucugccuccaacgguggccacuacagggguuucgguuagggucccccaauaacacuccugcauuaaccuugcuacuuguaaaccaagggcagcaguaaaucccagccaaccagcaaaagcagcagaggggcaaagcuuuguacaaaaccaaauuggguucaauuugacuuuguacagaagcaaauuggguucgugaauuggguucgauuugacuucuagagcguguguuccaucguuaccaaaugcucagugugagggagucagcucaguaaaccucauccugcagccugaggcagaagacagaguuggagcaaagaucagggaaaugcaccucuuuaccugggggacauuguuuucacaagaugauugccaauaaauuagucacgauguuaacugggauaauaauaaaaaagcaucaaagaaggcaaaagggagggggagaacuggaaguaccucugugagcuucguuaauucaguuuuaaagagagaauucauuaucaucuuguuuauucagcauacugauacacccaagauggcaauuuaagaauucuggacggggccuuuggguauaugacuuuuuaagaugcuaacauaaaagaagucagaacuuucagaguuucaggcuucuaaaaacucacacucauugaaaaugugucacacuauuuccaguuucuucauucacuuacaauaucuuauucuuuuguaaggagaaggaaauauauuccauugcaaugcuacaaucaccaguguuauuuuccaaaguuaaacagaaagccugaauugagauccucuaaguuguacuuuugaaaagucacaaauacuacacaauaaaaauaacucauuaccuaucuuaaaaaugcuuccaccggaagucacuccaacccaaacccauaugacguaucugagccaagaucaagcagaagauuaacuguaaaaggcagauaugcuccgggcuaagagguccggaggcuccaguuuuauuuccucucuccugacuaaacccaacaggggggaacacucugugccucauuuuacuuuuucuuagaaaggggcuaauaacaccagcucugcucaccccucaagugaaucucaaaggauaucauguuccuacggguacgugaaaacugaaaauaccuaacaaagcagccacagaggagcgucucugguucccagggcggcagagcaggaacgcggggc

SEQ ID NO: 20622 - RNA, 1326 nt, Homo sapiens
gccccgcguuccugcucugccgcccugggaaccagagacgcuccucuguggcugcuuuguuagguauuuucaguuuucacguacccguaggaacaugauauccuuugagauucacuugaggggugagcagagcugguguuauuagccccuuucuaagaaaaaguaaaaugaggcacagaguguuccccccuguuggguuuagucaggagagaggaaauaaaacuggagccuccggaccucuuagcccggagcauaucugccuuuuacaguuaaucuucugcuugaucuuggcucagauacgucauauggguuuggguuggagugacuuccgguggaagcauuuuuaagauagguaaugaguuauuuuuauuguguaguauuugugacuuuucaaaaguacaacuuagaggaucucaauucaggcuuucuguuuaacuuuggaaaauaacacuggugauuguagcauugcaauggaauauauuuccuucuccuuacaaaagaauaagauauuguaagugaaugaagaaacuggaaauagugugacacauuuucaaugagugugaguuuuuagaagccugaaacucugaaaguucugacuucuuuuauguuagcaucuuaaaaagucauauacccaaaggccccguccagaauucuuaaauugccaucuuggguguaucaguaugcugaauaaacaagaugauaaugaauucucucuuuaaaacugaauuaacgaagcucacagagguacuuccaguucucccccucccuuuugccuucuuugaugcuuuuuuauuauuaucccaguuaacaucgugacuaauuuauuggcaaucaucuugugaaaacaaugucccccagguaaagaggugcauuucccugaucuuugcuccaacucugucuucugccucaggcugcaggaugagguuuacugagcugacucccucacacugagcauuugguaacgauggaacacacgcucuagaagucaaaucgaacccaauucacgaacccaauuugcuucuguacaaagucaaauugaacccaauuugguuuuguacaaagcuuugccccucugcugcuuuugcugguuggcugggauuuacugcugcccuugguuuacaaguagcaagguuaaugcaggaguguuauugggggacccuaaccgaaaccccuguaguggccaccguuggaggcagacucuuaacacacgguguguuucuggaacaagagcugcccugcagugcuggaacggccccugcaucggagggaaugaagcagcaguuucguuuccacuggccucuugcuucuucagcaccaaggacguga

SEQ ID NO: 20623 - RNA, 600 nt, Homo sapiens
uugcauggcaaggaguuauacagcaggaaaaagaaaaaaaacccaauaauuauauugaugcaagauucaucaguauuuuagaauauugucguuucaacauguuaaauuguuucugagcacugcugauuucagcacugucccugguccacgugacgcaaaugccacccuuuccauauauucuucagcaaaaauauaugaaaagcccgucacucccuaagaggacccugaucccucuggagaggaaaacuaaacucuuuaagaagaaaaccaaacccaaccugaacuaaucguccaaggaguccuguuuggucccacgaaaggcagauuuccauccacaccagugaggggcaaguguccggguuccaacucgaagccaggcgggccugugcgggggugaguccuuugccacccggcgccccccaggcucuacaagcgucuagaggucggagucgcagggcagcgagcugucgcaggggugggugcugcacgagggagcguccugggacucccaccccuccccgucgaggacguccaccgaguugguguaggccuugggccgcggccgcggcauggggaagccgaccuugggcuugggcuugg

SEQ ID NO: 20624 - RNA, 600 nt, Homo sapiens
ccaagcccaagcccaaggucggcuuccccaugccgcggccgcggcccaaggccuacaccaacucgguggacguccucgacggggaggggugggagucccaggacgcucccucgugcagcacccaccccugcgacagcucgcugcccugcgacuccgaccucuagacgcuuguagagccuggggggcgccggguggcaaaggacucacccccgcacaggcccgccuggcuucgaguuggaacccggacacuugccccucacugguguggauggaaaucugccuuucgugggaccaaacaggacuccuuggacgauuaguucagguuggguuugguuuucuucuuaaagaguuuaguuuuccucuccagagggaucaggguccucuuagggagugacgggcuuuucauauauuuuugcugaagaauauauggaaaggguggcauuugcgucacguggaccagggacagugcugaaaucagcagugcucagaaacaauuuaacauguugaaacgacaauauucuaaaauacugaugaaucuugcaucaauauaauuauuggguuuuuuuucuuuuuccugcuguauaacuccuugccaugcaa

SEQ ID NO: 20625 - RNA, 771 nt, Homo sapiens
gcuuucgaucuggacuguucucaggcaagccggggaguaacuuuuaguuuugcuccugcgauuauucaacugacgggcuuucauuuccauuucacauacccuagcaacacuuauaccuugcggaauuguauugguagcgugaaaaaagcacacugagagguaacauuuuucaaauaauaguugugacuguguguguuucucucgagggcauguuucuggggacuguggggggccguguguguaugcguguccugaugccuugacacgauguuuugcagacggaaaaugccgggguucauaaauauuaauacugauuuuuggaggaacagucggcgcaauuauggaucaucugauuuuaggggaagcagguucugcugcuguugcugcugcuacuggggcugcugaggcugcgaggaggaggaggaggaggagguagagagggaggaggaggaggagguugguggagguuuaauuucacuuuuggauuugcagaugcggagagguggcuccauggacacagaccugcugugugugcuucugcgccccagguguugugugugggggugcaggucagcuggagucgggccucauuuaaaacaaaauuguguguaugugcguguuugugugugcgcgcgugugugugugugcagccaccgccgccaccggauccgaaggaggggagcggguccuucucggugcccgcggcggcgccucuccaggcugccuccagcguaaauaagcaggcaccgcuccccggccgggaggagcgcc

SEQ ID NO: 20626 - RNA, 771 nt, Homo sapiens
ggcgcuccucccggccggggagcggugccugcuuauuuacgcuggaggcagccuggagaggcgccgccgcgggcaccgagaaggacccgcuccccuccuucggauccgguggcggcgguggcugcacacacacacacgcgcgcacacacaaacacgcacauacacacaauuuuguuuuaaaugaggcccgacuccagcugaccugcacccccacacacaacaccuggggcgcagaagcacacacagcaggucuguguccauggagccaccucuccgcaucugcaaauccaaaagugaaauuaaaccuccaccaaccuccuccuccuccucccucucuaccuccuccuccuccuccuccucgcagccucagcagccccaguagcagcagcaacagcagcagaaccugcuuccccuaaaaucagaugauccauaauugcgccgacuguuccuccaaaaaucaguauuaauauuuaugaaccccggcauuuuccgucugcaaaacaucgugucaaggcaucaggacacgcauacacacacggccccccacaguccccagaaacaugcccucgagagaaacacacacagucacaacuauuauuugaaaaauguuaccucucagugugcuuuuuucacgcuaccaauacaauuccgcaagguauaaguguugcuaggguaugugaaauggaaaugaaagcccgucaguugaauaaucgcaggagcaaaacuaaaaguuacuccccggcuugccugagaacaguccagaucgaaagc

SEQ ID NO: 20627 - RNA, 313 nt, Homo sapiens
auauaaacagacccggacgcgaggcagcggcggagggcgagcgugacgcuggaggaggagugggagcucccagccugcgcggguccucucuuuaccugccagggcuuuuccggguaaucugggaccgacagggaugccagcaccccgucaucucacccaaagggcgccaggccagagauuccuggggaaaagucgccggcugcaggcgguugucccaggaauuccuccauggugccggcgggagcgcggcgagccggggcgcggcggcugcgggagguggaggcgacccgggacagggccggucccagggaga

SEQ ID NO: 20628 - RNA, 313 nt, Homo sapiens
ucucccugggaccggcccugucccgggucgccuccaccucccgcagccgccgcgccccggcucgccgcgcucccgccggcaccauggaggaauuccugggacaaccgccugcagccggcgacuuuuccccaggaaucucuggccuggcgcccuuugggugagaugacggggugcuggcaucccugucggucccagauuacccggaaaagcccuggcagguaaagagaggacccgcgcaggcugggagcucccacuccuccuccagcgucacgcucgcccuccgccgcugccucgcguccgggucuguuuauau

SEQ ID NO: 20629 - RNA, 1603 nt, Homo sapiens
augccggcggaauauuucauucuuuucuguuucugccucugguugcagaaccagacgcgcaccacguuuuucuucagguccagcuucuccgcgauggcggcgaucuuuucagaggagggccgaggcugaauggcaaaguaggcuucgagcgagcgcuucucuggcgcagcgauggacgugcgcuugcgcuucuucuccgcgccauugaagaguucaggcuuggugagcuucucgcggugggacuucucggccuccucgagccaugccugcaggauggguuugagcgcgaucauauuauugugggacagugugagggacucgaaccugcagauggugcucuggcuaagcgagcccacgccggggaucuugagguuggccagcgcggagcccacaucugccugggucacccccagcuugaugcgucgcugcuugaagcgcucggcgaaugccuccaggucccgcgggucggcguccacgucgcucaugcagcccaugugcgacggcagcccgugcgcgugggccaugcugagcgcugcuuggugcaugggguucaugguggccaugugcggcgcgugagccggcguggacaccacagcgccgucggggcccgccauagcgcccagggccagcccgggacucaggugcuccagcagcucgcccuccagcgccuggugcgguugguggugguggugguggugauggugguggugguggugcgugcccgccaacgcggaagggugcgagaugggcaccgaugaagaagaggcggccgacgugcacgggaugguauucauagugugguagguggcguccgguuugaaggggcuguggugggguggaugguggugguggcucuugcucugggagacgauguccacggcugccagagccucggcgcgggccagcagacucucauccagcccgccgaauauauugcucugcaauuguaaguagaaggcacacauuacgcucagcagggaauuguacgcccucucuccggaagccccggcccagggcucgacaccgucgccgcgccuacaacauucccagaucguuaaaauaauaauaauaauaauccugaaaacagaggugaagagaaaaagagggaagccacagaaagaagccgagagugcaggaggaggaggaaagugagccuguagacacaacgaaacacaacacaacacgcgcacaggcaacaucccaggucauaaaaauuaauaugaaaggcaagaccugcugaauacuuaagagagagagaggggaaaauugguuggagguguggggugauuugcugugcagacaugaaaaaaacaucaagcagauaaagggggcugucaaaaugugccuuuaagcggugauuaugcagaaauacgcaccggugggguuggaagacaggcucuccgcauagccuccgagcccccgccgccgcugcugccacugcugcuggagcugcugcuucggccuccgccgccgccgccgccgccgccgccgccgccgccaccaccagcguugcucgagcugcugggggagcuggccgagggcgcgaugggagccgaggagcccggcgaggugcugugcagugccgaguacuugggcuccacgu

SEQ ID NO: 20630 - RNA, 1603 nt, Homo sapiens
acguggagcccaaguacucggcacugcacagcaccucgccgggcuccucggcucccaucgcgcccucggccagcucccccagcagcucgagcaacgcuggugguggcggcggcggcggcggcggcggcggcggcggcggaggccgaagcagcagcuccagcagcaguggcagcagcggcggcgggggcucggaggcuaugcggagagccugucuuccaaccccaccggugcguauuucugcauaaucaccgcuuaaaggcacauuuugacagcccccuuuaucugcuugauguuuuuuucaugucugcacagcaaaucaccccacaccuccaaccaauuuuccccucucucucucuuaaguauucagcaggucuugccuuucauauuaauuuuuaugaccugggauguugccugugcgcguguuguguuguguuucguugugucuacaggcucacuuuccuccuccuccugcacucucggcuucuuucuguggcuucccucuuuuucucuucaccucuguuuucaggauuauuauuauuauuauuuuaacgaucugggaauguuguaggcgcggcgacggugucgagcccugggccggggcuuccggagagagggcguacaauucccugcugagcguaaugugugccuucuacuuacaauugcagagcaauauauucggcgggcuggaugagagucugcuggcccgcgccgaggcucuggcagccguggacaucgucucccagagcaagagccaccaccaccauccaccccaccacagccccuucaaaccggacgccaccuaccacacuaugaauaccaucccgugcacgucggccgccucuucuucaucggugcccaucucgcacccuuccgcguuggcgggcacgcaccaccaccaccaccaucaccaccaccaccaccaccaaccgcaccaggcgcuggagggcgagcugcuggagcaccugagucccgggcuggcccugggcgcuauggcgggccccgacggcgcugugguguccacgccggcucacgcgccgcacauggccaccaugaaccccaugcaccaagcagcgcucagcauggcccacgcgcacgggcugccgucgcacaugggcugcaugagcgacguggacgccgacccgcgggaccuggaggcauucgccgagcgcuucaagcagcgacgcaucaagcugggggugacccaggcagaugugggcuccgcgcuggccaaccucaagauccccggcgugggcucgcuuagccagagcaccaucugcagguucgagucccucacacugucccacaauaauaugaucgcgcucaaacccauccugcaggcauggcucgaggaggccgagaagucccaccgcgagaagcucaccaagccugaacucuucaauggcgcggagaagaagcgcaagcgcacguccaucgcugcgccagagaagcgcucgcucgaagccuacuuugccauucagccucggcccuccucugaaaagaucgccgccaucgcggagaagcuggaccugaagaaaaacguggugcgcgucugguucugcaaccagaggcagaaacagaaaagaaugaaauauuccgccggcau

SEQ ID NO: 20631 - RNA, 293 nt, Homo sapiens
cccaccgccagagauaaggcuccccgcccaccagcgagccacuuucccgcgcggacaccucuaacuccggcagcucaggcugggaacucggagauccagaguggccuccccucccccccgcgcauacgucagcgcuagcgucguggaagcgccguaaugucccgaagaagcgcgucuccaaacuugcaccccgcugccgcagcuucaacggagaaaucccuugccccaagcacacgucagcccugcccgcggagucauggcacagcaaaagagaggcucuccauggagauaug

SEQ ID NO: 20632 - RNA, 293 nt, Homo sapiens
cauaucuccauggagagccucucuuuugcugugccaugacuccgcgggcagggcugacgugugcuuggggcaagggauuucuccguugaagcugcggcagcggggugcaaguuuggagacgcgcuucuucgggacauuacggcgcuuccacgacgcuagcgcugacguaugcgcgggggggaggggaggccacucuggaucuccgaguucccagccugagcugccggaguuagagguguccgcgcgggaaaguggcucgcuggugggcggggagccuuaucucuggcgguggg

SEQ ID NO: 20633 - RNA, 311 nt, Homo sapiens
aacucuuugaaagcaguacuuccucagccugacaugauuaccaguuuuuugacuaaaugaagcuaaaccuuuagguagagugacuugccacaaaauuaauuuugaaaaguuauacugcuuauuaaacaaguguuuaaggguacuaauauauagaacuuaagguuuuuaugauuuguguauguguuuuuccuuucacaggcuuauuuaauuaaacuuucugguuugaacaaggagacauaucagagcugucuuaaaucuuuugaguguuuacugggccugaauucaaauauuggaauaagagaccuagcugu

SEQ ID NO: 20634 - RNA, 311 nt, Homo sapiens
acagcuaggucucuuauuccaauauuugaauucaggcccaguaaacacucaaaagauuuaagacagcucugauaugucuccuuguucaaaccagaaaguuuaauuaaauaagccugugaaaggaaaaacacauacacaaaucauaaaaaccuuaaguucuauauauuaguacccuuaaacacuuguuuaauaagcaguauaacuuuucaaaauuaauuuuguggcaagucacucuaccuaaagguuuagcuucauuuagucaaaaaacugguaaucaugucaggcugaggaaguacugcuuucaaagaguu

SEQ ID NO: 20635 - RNA, 3018 nt, Homo sapiens
ggcaucuauaaagagggaaggggggcaaccggguuggaaggaggauggaaucugggcuugcacagccucuuauagguaacagugagaaagccucaacugugucgaucaaagaauggggacgaagggagugaugagaacacgaccccgccacccgcgcaggcuaaccccguuguguccagacccuucucuaaaucucuuggcaaggucaccagagaaggauccaagcccccgcgguugcucccguagacaagcgggucgggcccagauucccggcucucagcaaagaagcuugccggggucucccaccugucuccugcucccguuuucucggccgccccagguacuuuuccagccaccucuccugcugcggcgcccccagccccgccacuucugcgccuccucagcuauugcuguccuuugacuacucggucccgauucgucucucguccuuucccgcgaauucuucaaacaaccgaggggagaaaaaacccaaaaaacaaaaaaccaccaaacagauccgucgagggggcagacaggcggguuauagucaaaguggcagcagcucauuuauuuagccaaaaauagauacuuucucguacaauuugguucacacauauguacauuucucuguauauauacacacacacaaaggcagacacguuuauucucacugaaacuccaccccccaaaaucaaccggacaaacaaaccucacagcgaaugcggggugccacagaagcgacuuggggagggcugaggaggacugguuuuauuucuuuuucuuacuuucuuuguuuaguuuugcuuuuagguauuuauacacggacaugcuuacaaguuguaacuauacagagcgauuuuuuuuauacaauuauuacaacgauuaaaaaaaguuuuuuuuguuuuuuuguuuuuuuuaaagaacuaggaugaggagagagccgauaagaccagggcggcguccagaugguucuggggccuggaagagagagacaguaguagcaaaagaggugagauucaggagcgcagaggcugccuagggcggggagauccuacuuggauuggggccgaucgucaggaaggugucgcaauguaaaauuauguccaguuguagauguguguguugggguuuaacuguagggugggcacgaggcgucaggacccgaggucuggggcuggaaagaggugggcgucagagaaccgccacccgccccaggggccugugggcccagccacgcaaggcuuccccuagaagguacaagcgcuguacccuccggccgcgccuggggugccugggcuggaccuggagagcugucgcagggccgacaggggcgacugaaaaagugacuuucguccccuuuuacaaaaugcgucccagcaggguuccccccuaccccggggcaaaaggccgugcguggugcucggcguccucuccuuuccccgccagccagucccccuggccccucaaccucgggguuucuuaccgccugggcacgggcuggaaagcugucuugaguaacuuuuucuccacuuccaaggcacuacagcgaucuaagggaagcgggggaagaaaaaggagggccuuuagagcgcucggugccggcgcccagggccgcagaaagcaggaguggagagggacgcgcgcccugcgccccccgggcccugccccucccggccagcuccggcacuacccgcagagcccgcccccgcuccgcgcccagcgcucagcagucaccuguuccgccuucgggcuccgcuggccgagcgaaggcggcggcggcagccggguggcccgcggcuccgggaagucccagcaggugcggaggggcagagcccagcagggagagcgggugcaggcgggggccgggcggugggccuggaaacggccgguugguccaagccgggaacuugcccagcggcgcugagaccagucugugagcggcggcggcggcggcggccggagagagcugcagggcggaaggcgcgaccgcugcccccgguggagacccccccgcgccgggaggcgagcggcgcggguuguccgggcuuguggcagucuccgcgagggaccagaucuugggcuucugcagggcggaggcgggggcuggugcgggagcgcagggguccaggcucacggggggcgacggcagagacggcgaggccacggccacuggugguggcgcuggagccagacucaggaccgguaguggccgguccucuaagcccucagagcuaucuuccgagucgcuauuuuuggaguccgaaaugggucccaggccuaggucgccaucccugcgcgccgccccagccagggacagcucaggcucgguggccgcgccgucuaaguucuccaaaucgaucuccucguccucgucgucgucagccaggcccucgccccccguguccuccuccucccccccgagcuccuccuccuccagcucuagcucgcguuugccguccuccucguccuccucuucgucuuccuccucgcgcucgcucccauaagcguuucccuccucgucagugcggcugcgaggcgcccaagucaucuuauucuccuucuugaggcgccggcgcgcguuggcgaaccagguggacaccugggugagggucaucuuggugaugauggccagcaugaucuucucgcccuuggugggguagggguucuugcggugcucguugagccaggccuucagcgugcuggugcucucccugguggcguucuugggacgggacggguccccgaacugguacuggccauacggguagaaggcggggugcgggugcggaaacgcggcagccgcggccggaugcugcaccccggggcuguccuucagcucauacugcgcgcccuguacgcacauggagaaggaagggacacgcgcggagggagcgcgagugagccccagccaucgcugccuccccccuccuggccugcaccccucuaguccggcccccgcgcgcucagcucgcccugcgccccagcgccaaccccuccuucccuggcuccgcgggcucu

SEQ ID NO: 20636 - RNA, 3018 nt, Homo sapiens
agagcccgcggagccagggaaggagggguuggcgcuggggcgcagggcgagcugagcgcgcgggggccggacuagaggggugcaggccaggaggggggaggcagcgauggcuggggcucacucgcgcucccuccgcgcgugucccuuccuucuccaugugcguacagggcgcgcaguaugagcugaaggacagccccggggugcagcauccggccgcggcugccgcguuuccgcacccgcaccccgccuucuacccguauggccaguaccaguucggggacccgucccgucccaagaacgccaccagggagagcaccagcacgcugaaggccuggcucaacgagcaccgcaagaaccccuaccccaccaagggcgagaagaucaugcuggccaucaucaccaagaugacccucacccagguguccaccugguucgccaacgcgcgccggcgccucaagaaggagaauaagaugacuugggcgccucgcagccgcacugacgaggagggaaacgcuuaugggagcgagcgcgaggaggaagacgaagaggaggacgaggaggacggcaaacgcgagcuagagcuggaggaggaggagcucgggggggaggaggaggacacggggggcgagggccuggcugacgacgacgaggacgaggagaucgauuuggagaacuuagacggcgcggccaccgagccugagcugucccuggcuggggcggcgcgcagggauggcgaccuaggccugggacccauuucggacuccaaaaauagcgacucggaagauagcucugagggcuuagaggaccggccacuaccgguccugagucuggcuccagcgccaccaccaguggccguggccucgccgucucugccgucgccccccgugagccuggaccccugcgcucccgcaccagcccccgccuccgcccugcagaagcccaagaucuggucccucgcggagacugccacaagcccggacaacccgcgccgcucgccucccggcgcgggggggucuccaccgggggcagcggucgcgccuuccgcccugcagcucucuccggccgccgccgccgccgccgcucacagacuggucucagcgccgcugggcaaguucccggcuuggaccaaccggccguuuccaggcccaccgcccggcccccgccugcacccgcucucccugcugggcucugccccuccgcaccugcugggacuucccggagccgcgggccacccggcugccgccgccgccuucgcucggccagcggagcccgaaggcggaacaggugacugcugagcgcugggcgcggagcgggggcgggcucugcggguagugccggagcuggccgggaggggcagggcccggggggcgcagggcgcgcgucccucuccacuccugcuuucugcggcccugggcgccggcaccgagcgcucuaaaggcccuccuuuuucuucccccgcuucccuuagaucgcuguagugccuuggaaguggagaaaaaguuacucaagacagcuuuccagcccgugcccaggcgguaagaaaccccgagguugaggggccagggggacuggcuggcggggaaaggagaggacgccgagcaccacgcacggccuuuugccccgggguaggggggaacccugcugggacgcauuuuguaaaaggggacgaaagucacuuuuucagucgccccugucggcccugcgacagcucuccagguccagcccaggcaccccaggcgcggccggaggguacagcgcuuguaccuucuaggggaagccuugcguggcugggcccacaggccccuggggcggguggcgguucucugacgcccaccucuuuccagccccagaccucggguccugacgccucgugcccacccuacaguuaaaccccaacacacacaucuacaacuggacauaauuuuacauugcgacaccuuccugacgaucggccccaauccaaguaggaucuccccgcccuaggcagccucugcgcuccugaaucucaccucuuuugcuacuacugucucucucuuccaggccccagaaccaucuggacgccgcccuggucuuaucggcucucuccucauccuaguucuuuaaaaaaaacaaaaaaacaaaaaaaacuuuuuuuaaucguuguaauaauuguauaaaaaaaaucgcucuguauaguuacaacuuguaagcauguccguguauaaauaccuaaaagcaaaacuaaacaaagaaaguaagaaaaagaaauaaaaccaguccuccucagcccuccccaagucgcuucuguggcaccccgcauucgcugugagguuuguuuguccgguugauuuugggggguggaguuucagugagaauaaacgugucugccuuuguguguguguauauauacagagaaauguacauaugugugaaccaaauuguacgagaaaguaucuauuuuuggcuaaauaaaugagcugcugccacuuugacuauaacccgccugucugcccccucgacggaucuguuuggugguuuuuuguuuuuuggguuuuuucuccccucgguuguuugaagaauucgcgggaaaggacgagagacgaaucgggaccgaguagucaaaggacagcaauagcugaggaggcgcagaaguggcggggcugggggcgccgcagcaggagagguggcuggaaaaguaccuggggcggccgagaaaacgggagcaggagacaggugggagaccccggcaagcuucuuugcugagagccgggaaucugggcccgacccgcuugucuacgggagcaaccgcgggggcuuggauccuucucuggugaccuugccaagagauuuagagaagggucuggacacaacgggguuagccugcgcggguggcggggucguguucucaucacucccuucguccccauucuuugaucgacacaguugaggcuuucucacuguuaccuauaagaggcugugcaagcccagauuccauccuccuuccaacccgguugccccccuucccucuuuauagaugcc

SEQ ID NO: 20637 - RNA, 5595 nt, Homo sapiens
cgagaaguuucuguauuggcguuuuugucuguggagaaccuuccuugcgcgaccccuaccccuucucccggucccggcgcuaaccucuuuucucucugcaaggauccucccaccgccuccgguggggauggaaagcaagaguuuugguuuaaugaugggauauuuccuaaaucaaacuugaaaucucaggaucgggcgcccaccuucacggauuagggcgugcagucgauagcggcauugaaauucccagcauugccgcggcugggggcucagagcuuuaggccgcggcggcgacccacaagccggccaggccugcagugggcacgccccggagacaaaacggggguggugacucugccguggaguggccagccccagcucggaggcggaaaccgucaccuugcauggauggauccaggaaucgaauucgaauuccaccagaguggcgggaucagaggagaucagagggucuuggccccggcugucucugaucacagcucuggggagcccagcucuggaaugaaaaauucuuccaccuccacggcagacacccaguuuugaucccacccccaccgcccaccucccacuucccaccucccaccucuuuccgugggucuuggcacaagcccacggcccuaguaggugugaacgccaaaaaccuugcgcgggcgggaugggggcggggaggaaacaagggaaaguuuggggaggaccagguuuugggggcaaugagggaaagcgggguauucccagacugcaucugaguaguuucccuaucaccuucucuuccgccucugccuggugcuggggagccuggugccuucucaggagccucgccggaggaggcgucaucaggggccgcccuggcuuugaaauaucucuucgacgccugauuucguuucccguuaaaccucacagagaguggcauagggaauguugggcucacuuucacgcgaagaaacuugggguuacaaaauugagaguaacguuauuuuccgggauguuuccuaggugucagaccucgagccucgacggcccugaagucauaguguuuguacaaagugguggcaccagaccaggaggagcugagagcgagauuccgagguggggggaauggggcugcgcuguaagugaccgagugagacucccgauauuuaauuuagcuuuuuucagaaggaaaagaaaaaacaauaaugagccucggagaugcuccuucugcauuaaccagcuaucgaccugucugcgucggacugcgggcggcgagaaagaggacagggaagggccaggcggcucuuagggacucagucacgccggcggguggggggggggggcgcccacagcccaggggaugaaccuccagaccgagacgugcacccaagaaccucgcauauuagaucccuccaggcuccccaggccucgagcagaagcggccuccuggcuacccuacuuuccaauugagaacagcccuggucuguccgggccaucugcgcgccacgucgagacucagcgucccaggcagccgcgucccaacguggcgcuggucccccaacucgacagguccaguggagcccggcugugggcugaacucgaggguccgagggcagcugaaccuuuuccagggauuuuuaauccaacagauuaaaugggucagagugacacacucgcacagggaagaaaagcaggugcacagaaguagauuugggaaagucgcgcgcacgaacgcgcuucacgcagaagcuucuccaucaucuugccuucuuucaacauucccagcgcacaaagcgcuuuggagacugacugcaggcccucucaaugcagcccagggagcggggaguguucggagagggugucuguccaucgcacacgcuuggcgcgcgugcgccggaugcgcaccgggaacggcugcccgacgugugcccagggcccgcggcccgccagguucugggggcugcgccucgcacuucacaagaggggagucaccaggcccgcuuccugcccccuccucgcccagccucacggugcucacacguccccgucgaggggagccgcggcagcccucggacucccagccccggcucaucuucuauccuucccucccaggcccuaaguccccgggcugcggugcgggccggcgaucucugagcuuccugcaggcgcugcggcgcgcgcucccaccguucccucccccucgcgcucggguuacagguuaaugaaaugcucguuuuccucagucauuuguuuuguuuuccugcaaaguucugauaaguagcuaaccaacgaagcuuguaauuacaaucuuacagaaaccgggccgaucuguauauaaaucucaccauccaauuacaagauguaauaauuuugcacucaagcugguaaugaggucuaauacucgugcaugcgauaauccccucuggaugcuggcuugaucagauguuggcuuuguaauuagacgggcagaaaaucauuauuucauguucaaauagaaaaugagguuggugggaaguuaauuucucuccgcucugugaagcguagacaagaauuuaaugauuuaauuacaguuguaagcccuuuccaugagacuuaaauugagcugagaauauuuuuuuuccuucucucucccucucucccacuuucgcguucucuuucuccgcuauuagcagccgcggacuccugagagcguggccuggcguccgcacaggguggaauucguauuuggccaggaauccggacuccgaucaucccaggagacgcggaccgggggccuccagagcucuccggagcgugcugccgcuccccaccagccaccagggacucggaggcccuuccuggguccggagaagcgacggggacacuuaggggaaaacuuugccaacuucgcucuuggcgcggaagaggccgcuggccggaauggugcagcagcggcggcgggccgcgacgcgcagggugggccccgggccagugcugggcacccuggagcgcgucgggaugcccaaaguggggcgugaggccggugggcucuuugcuccuccgcuucgccccugcgccucccgcgacccgucucacuucccugcgucucugagcggcccgagaggcgcagcgcucagaguggccuugauggaagaaccuggcccucggcgggaacgauuuucuuuugcuuuaccucuucuggaucagccguuuuccaccugacuugagcagcccccucccccaugccuuuuuuuucucguucccuccgucuguccucacaauuuccucuaucuucgauuucuagaucauucgcuuuucuucucuuuccuccgcuuccucauugugcuguuuuuaugccuuugcccuggaccacuuuucaguucacuuuucucccuucugcucccucccucacccccuucuuaaugucucuuuuuuccucgcccugagucugugacugugucccuuucccccaucugcaguugccguuuuugauuuucuuucuuuccuccccacuuccauccggauccucuccuauuuccuccuuggauuucugucucucagguucugucucucagguucuccucuccguaaauauucucuccucucccucuccgggauccguccccucccccacguggaucugccuccccggcgcccccuccucauucauccugggagaugaauuugucgccuuauuggacgccgaggccagagccgugugagggggcucggccagcgcugugcauuuucuucaugcauauugaggagaugguaaugagcgcguuugcauuguugcuuggaaauguuguguuuccugccgcaguucgcaguucggagugggcgaggguggugugggcccaggacagccccucaguaggcacccggccuggcggccgccgcugacccucuccggauucccgggcucugggggccgggggaggaagcgaccuugccgagcuccugacccggccgccgccuccuccuccgguuuguccacaaaggccgucgcgcuccccucauuaaagccucguuacaggaacccccggcuggcucgcgacggcuccuccgagccccccugcccaccggccucugagccccuccccugauuugagaggccugugauggagcgccaccagaaaauuagugccugacaacgucgucuauuggcaauaaauugagauuccaagugacacgucgcgggaucaaacacagccacauuguuguguacccugcuccgcucgcuccucguuaaucuuggagggcgccuuggcaucgcuuggccaggggagguuguaggcaggccuuucggcugucaggacucggauccugccucugcccuggcugagcccacuucagucauucaggagggacugacugccccucccugauaagguccaaggcgcucaggaggcgugacccaggaacgccuuucaauaagcugaagguuuauuaaagucaggagcuucgaggggcaaacucugaguuaagcuuguggggaaucgacgugagccuugcugggaauucagaacaucaaggucuggccuugucuggaauugucuggugucgaguuucccaaacuucaagcuucccgcuacuaccuuuauuauuuacuuaacauuuuuccuuaaauugacucauuuuuaaaaucaaaguacauauuuuuggaaagaaaaucugauacuaccacuguaaauugaaaaguagcuguuacucaccagaaaaggaagugguaaaagauaaacacagcuaaaaccaagcaauguuaauacauguuagccguuuugcuggcuuggaaagacuccuagaggcucaggugugugugugucauuagcaaguguuggaaguguuaaauacugaaucuuucucggaagaaaugagacaauugaaaagagaauguuucucacuauucaauguucauuuaauucaguguuaauuuaauucucugauccaagacugcacacuaccuaaaauaauguugacaaccucaagagcuaggacuguugaggagcguauaaaaaaauuaagauuaggcugggcgcgcggugucucacaccuguaaucccagcacuuugggaggccgaggugggcggaucaccugaggucaggaguucgagaccagccuggccaacauagugaaaccccaucucuacuaaaaauacaaaaauuagcugggcaugguagcaggugccuguaaucccagcuucucaggaggcugaggcaggagaauugcuugagcccaggaaguggagguugcagugagcugagaucgcgccauugcacuccagccugggggacaagagcgagacuuugucucaaaaaaacaaagaaaaaagaaaaaaaagauuaaaaacauaauguugauuuauuauuauuuaccaaauaauuguguuaagcauuuucaaacuguaucauauuuaauucucacuauaagucuacaagcuagaggcuauccaggguggccaugugugguaguacaggauguucauugaacaagggcaccgacgggcuaaaagggugugaagucuagcccugcuguguucaccaauauguguaccuuggcuuggggccacacuggaggaacaguaccuuucucucauguacacaaauuuuauacaaaauuggcacaaa

SEQ ID NO: 20638 - RNA, 5595 nt, Homo sapiens
uuugugccaauuuuguauaaaauuuguguacaugagagaaagguacuguuccuccaguguggccccaagccaagguacacauauuggugaacacagcagggcuagacuucacacccuuuuagcccgucggugcccuuguucaaugaacauccuguacuaccacacauggccacccuggauagccucuagcuuguagacuuauagugagaauuaaauaugauacaguuugaaaaugcuuaacacaauuauuugguaaauaauaauaaaucaacauuauguuuuuaaucuuuuuuuucuuuuuucuuuguuuuuuugagacaaagucucgcucuugucccccaggcuggagugcaauggcgcgaucucagcucacugcaaccuccacuuccugggcucaagcaauucuccugccucagccuccugagaagcugggauuacaggcaccugcuaccaugcccagcuaauuuuuguauuuuuaguagagaugggguuucacuauguuggccaggcuggucucgaacuccugaccucaggugauccgcccaccucggccucccaaagugcugggauuacaggugugagacaccgcgcgcccagccuaaucuuaauuuuuuuauacgcuccucaacaguccuagcucuugagguugucaacauuauuuuagguagugugcagucuuggaucagagaauuaaauuaacacugaauuaaaugaacauugaauagugagaaacauucucuuuucaauugucucauuucuuccgagaaagauucaguauuuaacacuuccaacacuugcuaaugacacacacacaccugagccucuaggagucuuuccaagccagcaaaacggcuaacauguauuaacauugcuugguuuuagcuguguuuaucuuuuaccacuuccuuuucuggugaguaacagcuacuuuucaauuuacagugguaguaucagauuuucuuuccaaaaauauguacuuugauuuuaaaaaugagucaauuuaaggaaaaauguuaaguaaauaauaaagguaguagcgggaagcuugaaguuugggaaacucgacaccagacaauuccagacaaggccagaccuugauguucugaauucccagcaaggcucacgucgauuccccacaagcuuaacucagaguuugccccucgaagcuccugacuuuaauaaaccuucagcuuauugaaaggcguuccugggucacgccuccugagcgccuuggaccuuaucagggaggggcagucagucccuccugaaugacugaagugggcucagccagggcagaggcaggauccgaguccugacagccgaaaggccugccuacaaccuccccuggccaagcgaugccaaggcgcccuccaagauuaacgaggagcgagcggagcaggguacacaacaauguggcuguguuugaucccgcgacgugucacuuggaaucucaauuuauugccaauagacgacguugucaggcacuaauuuucugguggcgcuccaucacaggccucucaaaucaggggaggggcucagaggccggugggcaggggggcucggaggagccgucgcgagccagccggggguuccuguaacgaggcuuuaaugaggggagcgcgacggccuuuguggacaaaccggaggaggaggcggcggccgggucaggagcucggcaaggucgcuuccucccccggcccccagagcccgggaauccggagagggucagcggcggccgccaggccgggugccuacugaggggcuguccugggcccacaccacccucgcccacuccgaacugcgaacugcggcaggaaacacaacauuuccaagcaacaaugcaaacgcgcucauuaccaucuccucaauaugcaugaagaaaaugcacagcgcuggccgagcccccucacacggcucuggccucggcguccaauaaggcgacaaauucaucucccaggaugaaugaggagggggcgccggggaggcagauccacgugggggaggggacggaucccggagagggagaggagagaauauuuacggagaggagaaccugagagacagaaccugagagacagaaauccaaggaggaaauaggagaggauccggauggaaguggggaggaaagaaagaaaaucaaaaacggcaacugcagaugggggaaagggacacagucacagacucagggcgaggaaaaaagagacauuaagaagggggugagggagggagcagaagggagaaaagugaacugaaaagugguccagggcaaaggcauaaaaacagcacaaugaggaagcggaggaaagagaagaaaagcgaaugaucuagaaaucgaagauagaggaaauugugaggacagacggagggaacgagaaaaaaaaggcaugggggagggggcugcucaagucagguggaaaacggcugauccagaagagguaaagcaaaagaaaaucguucccgccgagggccagguucuuccaucaaggccacucugagcgcugcgccucucgggccgcucagagacgcagggaagugagacgggucgcgggaggcgcaggggcgaagcggaggagcaaagagcccaccggccucacgccccacuuugggcaucccgacgcgcuccagggugcccagcacuggcccggggcccacccugcgcgucgcggcccgccgccgcugcugcaccauuccggccagcggccucuuccgcgccaagagcgaaguuggcaaaguuuuccccuaaguguccccgucgcuucuccggacccaggaagggccuccgagucccugguggcugguggggagcggcagcacgcuccggagagcucuggaggcccccgguccgcgucuccugggaugaucggaguccggauuccuggccaaauacgaauuccacccugugcggacgccaggccacgcucucaggaguccgcggcugcuaauagcggagaaagagaacgcgaaagugggagagagggagagagaaggaaaaaaaauauucucagcucaauuuaagucucauggaaagggcuuacaacuguaauuaaaucauuaaauucuugucuacgcuucacagagcggagagaaauuaacuucccaccaaccucauuuucuauuugaacaugaaauaaugauuuucugcccgucuaauuacaaagccaacaucugaucaagccagcauccagaggggauuaucgcaugcacgaguauuagaccucauuaccagcuugagugcaaaauuauuacaucuuguaauuggauggugagauuuauauacagaucggcccgguuucuguaagauuguaauuacaagcuucguugguuagcuacuuaucagaacuuugcaggaaaacaaaacaaaugacugaggaaaacgagcauuucauuaaccuguaacccgagcgcgagggggagggaacggugggagcgcgcgccgcagcgccugcaggaagcucagagaucgccggcccgcaccgcagcccggggacuuagggccugggagggaaggauagaagaugagccggggcugggaguccgagggcugccgcggcuccccucgacggggacgugugagcaccgugaggcugggcgaggagggggcaggaagcgggccuggugacuccccucuugugaagugcgaggcgcagcccccagaaccuggcgggccgcgggcccugggcacacgucgggcagccguucccggugcgcauccggcgcacgcgcgccaagcgugugcgauggacagacacccucuccgaacacuccccgcucccugggcugcauugagagggccugcagucagucuccaaagcgcuuugugcgcugggaauguugaaagaaggcaagaugauggagaagcuucugcgugaagcgcguucgugcgcgcgacuuucccaaaucuacuucugugcaccugcuuuucuucccugugcgagugugucacucugacccauuuaaucuguuggauuaaaaaucccuggaaaagguucagcugcccucggacccucgaguucagcccacagccgggcuccacuggaccugucgaguugggggaccagcgccacguugggacgcggcugccugggacgcugagucucgacguggcgcgcagauggcccggacagaccagggcuguucucaauuggaaaguaggguagccaggaggccgcuucugcucgaggccuggggagccuggagggaucuaauaugcgagguucuugggugcacgucucggucuggagguucauccccugggcugugggcgccccccccccccacccgccggcgugacugagucccuaagagccgccuggcccuucccuguccucuuucucgccgcccgcaguccgacgcagacaggucgauagcugguuaaugcagaaggagcaucuccgaggcucauuauuguuuuuucuuuuccuucugaaaaaagcuaaauuaaauaucgggagucucacucggucacuuacagcgcagccccauuccccccaccucggaaucucgcucucagcuccuccuggucuggugccaccacuuuguacaaacacuaugacuucagggccgucgaggcucgaggucugacaccuaggaaacaucccggaaaauaacguuacucucaauuuuguaaccccaaguuucuucgcgugaaagugagcccaacauucccuaugccacucucugugagguuuaacgggaaacgaaaucaggcgucgaagagauauuucaaagccagggcggccccugaugacgccuccuccggcgaggcuccugagaaggcaccaggcuccccagcaccaggcagaggcggaagagaaggugauagggaaacuacucagaugcagucugggaauaccccgcuuucccucauugcccccaaaaccugguccuccccaaacuuucccuuguuuccuccccgcccccaucccgcccgcgcaagguuuuuggcguucacaccuacuagggccgugggcuugugccaagacccacggaaagaggugggaggugggaagugggaggugggcggugggggugggaucaaaacugggugucugccguggagguggaagaauuuuucauuccagagcugggcuccccagagcugugaucagagacagccggggccaagacccucugaucuccucugaucccgccacucugguggaauucgaauucgauuccuggauccauccaugcaaggugacgguuuccgccuccgagcuggggcuggccacuccacggcagagucaccacccccguuuugucuccggggcgugcccacugcaggccuggccggcuugugggucgccgccgcggccuaaagcucugagcccccagccgcggcaaugcugggaauuucaaugccgcuaucgacugcacgcccuaauccgugaaggugggcgcccgauccugagauuucaaguuugauuuaggaaauaucccaucauuaaaccaaaacucuugcuuuccauccccaccggaggcggugggaggauccuugcagagagaaaagagguuagcgccgggaccgggagaagggguaggggucgcgcaaggaagguucuccacagacaaaaacgccaauacagaaacuucucg

SEQ ID NO: 20639 - RNA, 1067 nt, Homo sapiens
cgcggccccuucaaacuugggcgauugucuccgccagcuucgcccaggccuuggacucaagaguugcucgcaaaagagagccgcgucuugcucggaucgcugagcuggcgggaagggguucuguggggagagguagcugcaauuaaagagcagcauuugguguaaacguaagcuccgggcugcccugcaaauuuuauauuuuugguuuugccauuuuggaaaaguaguucaaaagaaauagacucgaaauuugagcagaagcgugcuaagucuauguaaauguguuuggccuagccuuuaauuaguccuccaaaauguugcaaauccguaauccuaucuucgcaauccgauuugggaguauuaaauuucugaaaagucggucgagcugcggugcauccgggauuuuucggccggguuguaacuucggucugggguaguauuuuuggagggugggagugcgugggcauggcucagcuuuuuguuugcauuucuuagcuguugaaaaaagaaaaaaagagccuugacuucccuuguuuuccccccuugcgcccaacgugcguccgcucccccgccgagcgcggagucgccucaguugcccaggccucuaucugcauggagggccgggccgccguggccagaucugcgcacgggguacggacgugcccgggcagaugggggccuacggggugacaccgaggccgggacagcuucaggggccccagaaggaccugacccagaaauugagguccccgcugccuucugaggagggggaggaguugcuccuaggucugaaccccgccagccuugccccguaggaagcuggagugcgggccucguccacccacagaccccggggagcgcagggaaaagggugcuucggucguuccgauggcaguggagaccacgguccacacucaccucucugcgucuccaccgcagggcucucccuacgaccacacacccggcauggcgggcuccuugggguaccauccuuacgcggcgccccugggaucguacccuuacggggacccagcguaccggaagaacgccacaagggacgccacggc

SEQ ID NO: 20640 - RNA, 1067 nt, Homo sapiens
gccguggcgucccuuguggcguucuuccgguacgcuggguccccguaaggguacgaucccaggggcgccgcguaaggaugguaccccaaggagcccgccaugccggguguguggucguagggagagcccugcgguggagacgcagagaggugaguguggaccguggucuccacugccaucggaacgaccgaagcacccuuuucccugcgcuccccggggucuguggguggacgaggcccgcacuccagcuuccuacggggcaaggcuggcgggguucagaccuaggagcaacuccucccccuccucagaaggcagcggggaccucaauuucugggucagguccuucuggggccccugaagcugucccggccucggugucaccccguaggcccccaucugcccgggcacguccguaccccgugcgcagaucuggccacggcggcccggcccuccaugcagauagaggccugggcaacugaggcgacuccgcgcucggcgggggagcggacgcacguugggcgcaaggggggaaaacaagggaagucaaggcucuuuuuuucuuuuuucaacagcuaagaaaugcaaacaaaaagcugagccaugcccacgcacucccacccuccaaaaauacuaccccagaccgaaguuacaacccggccgaaaaaucccggaugcaccgcagcucgaccgacuuuucagaaauuuaauacucccaaaucggauugcgaagauaggauuacggauuugcaacauuuuggaggacuaauuaaaggcuaggccaaacacauuuacauagacuuagcacgcuucugcucaaauuucgagucuauuucuuuugaacuacuuuuccaaaauggcaaaaccaaaaauauaaaauuugcagggcagcccggagcuuacguuuacaccaaaugcugcucuuuaauugcagcuaccucuccccacagaaccccuucccgccagcucagcgauccgagcaagacgcggcucucuuuugcgagcaacucuugaguccaaggccugggcgaagcuggcggagacaaucgcccaaguuugaaggggccgcg

SEQ ID NO: 20641 - RNA, 1010 nt, Homo sapiens
uacacucaagagucagacauagaaugagcgccguagugaagauaaggaaaagaaaacagcaauggaaaccaccucccacuucagcuagggcaggaggcaccccaggccuuugcacucagcaggcagauagucccccaggccaggccgggacagcgcccacgccuggccagccggccgggacaggccuagacgagcaguuuacaccuggcggcgucuaccucuagggccgacaccgcccuacgccuccgcuccagcagcucccaagcaggccgaagacgcgggccgcaaggacaggugaccuauaugggccccucgaccccuuucgcuuccggcugcggcucagggagaccugacccagcaggucucccaaaggcgucucggccucgcuccccgggcgggaacuggggauggaucccaaagccugcgucccgaucccuucgguaggaguagguuccugcaaugguugaaaaguaaggagcccaggggaauggcuggcacgcgcggaugaaaggggcacgcacacgcgagagucgcucaaaguuucaaacaagagcccaguccugccgccuggaccgguugguugcggcacgccaggccuagccuccggccgccaaucccgcccagaaauguccucacguccaggccaugccgccacccaccccggcgcucaccugcugcagcaccuuguccagcggcucugcccgcgccaggcugucggcgcucaggccgcucgccucgcggcacugcguacucagugcggccgccucggcacgaaccagcgauuugugcagcguccccaccugugagcggcgggggaaaccgaucagccgcgccccucgaccccggaagcucccuggggaccucaccgccucuuuuccacccuaccuggcggcuccgcggcucaaccacuugccaaacuaggaggauuaagucggucucguccgagcccaggucccgucccagcgcacccgccguagccccgaagaggacgaccagugauccgggccagg

SEQ ID NO: 20642 - RNA, 1010 nt, Homo sapiens
ccuggcccggaucacuggucguccucuucggggcuacggcgggugcgcugggacgggaccugggcucggacgagaccgacuuaauccuccuaguuuggcaagugguugagccgcggagccgccagguaggguggaaaagaggcggugagguccccagggagcuuccggggucgaggggcgcggcugaucgguuucccccgccgcucacagguggggacgcugcacaaaucgcugguucgugccgaggcggccgcacugaguacgcagugccgcgaggcgagcggccugagcgccgacagccuggcgcgggcagagccgcuggacaaggugcugcagcaggugagcgccgggguggguggcggcauggccuggacgugaggacauuucugggcgggauuggcggccggaggcuaggccuggcgugccgcaaccaaccgguccaggcggcaggacugggcucuuguuugaaacuuugagcgacucucgcgugugcgugccccuuucauccgcgcgugccagccauuccccugggcuccuuacuuuucaaccauugcaggaaccuacuccuaccgaagggaucgggacgcaggcuuugggauccauccccaguucccgcccggggagcgaggccgagacgccuuugggagaccugcugggucaggucucccugagccgcagccggaagcgaaaggggucgaggggcccauauaggucaccuguccuugcggcccgcgucuucggccugcuugggagcugcuggagcggaggcguagggcggugucggcccuagagguagacgccgccagguguaaacugcucgucuaggccugucccggccggcuggccaggcgugggcgcugucccggccuggccugggggacuaucugccugcugagugcaaaggccuggggugccuccugcccuagcugaagugggaggugguuuccauugcuguuuucuuuuccuuaucuucacuacggcgcucauucuaugucugacucuugagugua

SEQ ID NO: 20643 - RNA, 1364 nt, Homo sapiens
ucugcucacaguucaccguguggggcacauuaucuggguauucaauggauggaaaaaacaccaggucccuaggaggcgguguggggaccagguccccucuugucuucccuuccccccccacccuccccuagcucacagagucuuccaguacacccugaaccuuucuccuuacaaggggccuaugggaauucugugcaaggcagagauggcaaaguuuuuucauuaggagggugcggucucaagcagccgugggauucgaaugacgcugccuagagagaccucacuggcaaaagggaaaacaaaccuguacccuucagugggagaauuuuacguagacuuuguucuuugguuaaaaauguagcgucucccaucugacuuuuuuuuuuuuuuuugagacggagucucgcuuugucgcccaggcuggagugcaguggugcgaucucggcucacugcaaccuccgccucccggguucaagcgauucucccuccucagccucccaaguagcugggauuacaggcaucugccaucacgccuggcuaaguuuuuguauuuuuaguaaagacgggguuucaccauguuggccaggcuggucucgaacuccuggccucaggugauccgcccgccucggccucccaaaguguugggauuacaggcaugagccaccgcgccggcccaccuguuucugaaggcaccuauuccugggagggguaacacauuaaacuauuaacucuucaucgggcuucccaagugggcggcccggccacaaggaaggggacuuuggagucgggaagggcuggcucuggaacacgggacaagggucugaaccccaaggcgcaguccugugaccaugcgggccgggccggggaggagccuggggugaaccccacccgccuggucuccucccaccccucccucucgggucccggggccucucuuucucuucuccagguccuccagcccagccacugcucacaggggugguuuuugcuuuguuaguuggguucaggccacgagaagggggaacccuaaaguuuuccuucccugccaggucgccucugagagcgcagaagggagaaacggcauuuguucauuuaaacgggcuccuaggacgagaacccggggacgccagggccucgcgggccggccugggccacagguguccccggcgcggaggucgcagcgccccggccccucucaccuuucgggucugcggcgcccggggucucccuuccucugcggcugcggcggcuccggggcuucccagggcgcgggcccaggaggcgcggcugcgucccaggucaguccccgggcuccgucccgcguccggcuuuggcgcgguuuuucccaaacuccguguucaccu

SEQ ID NO: 20644 - RNA, 1364 nt, Homo sapiens
aggugaacacggaguuugggaaaaaccgcgccaaagccggacgcgggacggagcccggggacugaccugggacgcagccgcgccuccugggcccgcgcccugggaagccccggagccgccgcagccgcagaggaagggagaccccgggcgccgcagacccgaaaggugagaggggccggggcgcugcgaccuccgcgccggggacaccuguggcccaggccggcccgcgaggcccuggcguccccggguucucguccuaggagcccguuuaaaugaacaaaugccguuucucccuucugcgcucucagaggcgaccuggcagggaaggaaaacuuuaggguucccccuucucguggccugaacccaacuaacaaagcaaaaaccaccccugugagcaguggcugggcuggaggaccuggagaagagaaagagaggccccgggacccgagagggaggggugggaggagaccaggcgggugggguucaccccaggcuccuccccggcccggcccgcauggucacaggacugcgccuugggguucagacccuugucccguguuccagagccagcccuucccgacuccaaaguccccuuccuuguggccgggccgcccacuugggaagcccgaugaagaguuaauaguuuaauguguuaccccucccaggaauaggugccuucagaaacaggugggccggcgcgguggcucaugccuguaaucccaacacuuugggaggccgaggcgggcggaucaccugaggccaggaguucgagaccagccuggccaacauggugaaaccccgucuuuacuaaaaauacaaaaacuuagccaggcgugauggcagaugccuguaaucccagcuacuugggaggcugaggagggagaaucgcuugaacccgggaggcggagguugcagugagccgagaucgcaccacugcacuccagccugggcgacaaagcgagacuccgucucaaaaaaaaaaaaaaaagucagaugggagacgcuacauuuuuaaccaaagaacaaagucuacguaaaauucucccacugaaggguacagguuuguuuucccuuuugccagugaggucucucuaggcagcgucauucgaaucccacggcugcuugagaccgcacccuccuaaugaaaaaacuuugccaucucugccuugcacagaauucccauaggccccuuguaaggagaaagguucaggguguacuggaagacucugugagcuaggggaggguggggggggaagggaagacaagaggggaccugguccccacaccgccuccuagggaccugguguuuuuuccauccauugaauacccagauaaugugccccacacggugaacugugagcaga

SEQ ID NO: 20645 - RNA, 2010 nt, Homo sapiens
ggcgcccggagaagccgcccuauuccuacaucgcgcucaucgucauggccauccagaguucacccaccaagcgccugacgcugagcgagaucuaccaguuccugcagagccgcuuccccuucuuccggggcuccuaccagggcuggaagaacuccgugcgccacaaccucucgcucaacgagugcuucaucaagcuacccaagggccuugggcggcccggcaagggccacuacuggaccaucgacccggccagcgaguucauguucgaggagggcuccuuucggcggcggccgcgcggcuuccgaaggaaaugccaggcgcucaagcccauguacagcaugaugaacgggcucggcuucaaccaccucccggacaccuacggcuuccagggcucggccggcggccucucgugcccgcccaacagccuggcgcuggagggcggccugggcaugaugaacggccacuugccgggcaacguggacggcauggcccugcccagccacucggugccccaccugccuuccaacggcggccacucguacaugggcggcugcggcggcgcggcggccggcgaguacccgcaccacgacagcucggugcccgccuccccgcugcugcccaccggcgccgguggggucauggagccgcacgccgucuacucgggcucggcggcggccuggccgcccucggcguccgcggcgcucaacagcggcgccucuuauaucaagcagcagccccugucccccuguaaccccgcggccaacccccuguccggcagccucuccacgcacucccuggagcagccguaucugcaccagaacagccacaacgccccagccgagcugcaaggugaguggggaggccgagggcgcccugguccccgggaagucgagucugaguggcagcgggacccagcuggggcgagccccuccacuucuguggucggaaccccaaggcugaggggaggcaccagcuccccaaggugucucuuggccccaccucucccccuucgaagagugacuaccgcucuugacccuaguuugggccaaucuguuucucuuucuguucgaacuccagcugccagcugcuccaggccugaccagguaggcugguccugagccagaugucccagaccccagugcccuaaguccuuuugugucccuuaaguccccucacagcuuggaaagauccugggauggacccaaggcucccagcgcuggccagauggcugucccucccuggugguggcccucaggcugccuggagggcugccucugccuggggcugggcggaacggaagguguuaggcccaaagccgcugggccagcgcucagaggcucagccccggccuuucaggggaccagaccuggcagacccacagcugaguccaggggcauuuuguggugacugaggcaggagggugccguggccaggccccggagggucagagcugcagaccgggccaugggggcuccuuguuuuuuaggauccaaguuuucagguccccacacccccaacaccccugauaccccaauaccccgaacaugcagaagcaucugccaagggagaugcagcagccucgccuccugauucugccccaggccccccgcagccugcaggcccagcucuggaaaaagcuggagugagcuugccagggccaguccagggucagcugucagcagccccaggaggcaggagccaggccuggaggccuuaggcagccucucugcgggggacuccccggcuccggggccuguucucuggagaagcuucuucucaccccugcugcuggcccggcgcuggcccugcacuggccucuccuucaaccccgccggcagucguagccucugagguuggggguggugguggcugcccuggcggugacggccaugggcguuaggggcccuccacuuggucucccucaccacuuccccuauggcucuggaagcccugggccccugcacgguguccgaggcuggacaggcacgcagcaggcaggcaggcaggcag

SEQ ID NO: 20646 - RNA, 2010 nt, Homo sapiens
cugccugccugccugccugcugcgugccuguccagccucggacaccgugcaggggcccagggcuuccagagccauaggggaaguggugagggagaccaaguggagggccccuaacgcccauggccgucaccgccagggcagccaccaccacccccaaccucagaggcuacgacugccggcgggguugaaggagaggccagugcagggccagcgccgggccagcagcaggggugagaagaagcuucuccagagaacaggccccggagccggggagucccccgcagagaggcugccuaaggccuccaggccuggcuccugccuccuggggcugcugacagcugacccuggacuggcccuggcaagcucacuccagcuuuuuccagagcugggccugcaggcugcggggggccuggggcagaaucaggaggcgaggcugcugcaucucccuuggcagaugcuucugcauguucgggguauugggguaucagggguguuggggguguggggaccugaaaacuuggauccuaaaaaacaaggagcccccauggcccggucugcagcucugacccuccggggccuggccacggcacccuccugccucagucaccacaaaaugccccuggacucagcugugggucugccaggucugguccccugaaaggccggggcugagccucugagcgcuggcccagcggcuuugggccuaacaccuuccguuccgcccagccccaggcagaggcagcccuccaggcagccugagggccaccaccagggagggacagccaucuggccagcgcugggagccuuggguccaucccaggaucuuuccaagcugugaggggacuuaagggacacaaaaggacuuagggcacuggggucugggacaucuggcucaggaccagccuaccuggucaggccuggagcagcuggcagcuggaguucgaacagaaagagaaacagauuggcccaaacuagggucaagagcgguagucacucuucgaagggggagagguggggccaagagacaccuuggggagcuggugccuccccucagccuugggguuccgaccacagaaguggaggggcucgccccagcugggucccgcugccacucagacucgacuucccggggaccagggcgcccucggccuccccacucaccuugcagcucggcuggggcguuguggcuguucuggugcagauacggcugcuccagggagugcguggagaggcugccggacaggggguuggccgcgggguuacagggggacaggggcugcugcuugauauaagaggcgccgcuguugagcgccgcggacgccgagggcggccaggccgccgccgagcccgaguagacggcgugcggcuccaugaccccaccggcgccggugggcagcagcggggaggcgggcaccgagcugucguggugcggguacucgccggccgccgcgccgccgcagccgcccauguacgaguggccgccguuggaaggcagguggggcaccgaguggcugggcagggccaugccguccacguugcccggcaaguggccguucaucaugcccaggccgcccuccagcgccaggcuguugggcgggcacgagaggccgccggccgagcccuggaagccguagguguccgggaggugguugaagccgagcccguucaucaugcuguacaugggcuugagcgccuggcauuuccuucggaagccgcgcggccgccgccgaaaggagcccuccucgaacaugaacucgcuggccgggucgaugguccaguaguggcccuugccgggccgcccaaggcccuuggguagcuugaugaagcacucguugagcgagagguuguggcgcacggaguucuuccagcccugguaggagccccggaagaaggggaagcggcucugcaggaacugguagaucucgcucagcgucaggcgcuuggugggugaacucuggauggccaugacgaugagcgcgauguaggaauagggcggcuucuccgggcgcc

SEQ ID NO: 20647 - RNA, 1357 nt, Homo sapiens
cucccccgcaucugcgagauggugcggcgauagggcggccccgaucugggcucagauaaaguuuaaaauauuacauucugcaagucccguccugauaagaucguucugucgggacgggcugaaauugugaucuuaucucgcgcgguugacucucccaggcuuuguaucuagaagcgaagagagagaccugggaggcagaggggacacccggggccgcggagaugccuggccaaguggcaggcaccggcccgcgcccacccccaccggugccgucgcagagccgcaggacaggggaggggguagcgcgcagcugccgcagccuaggcacuuggcuccagccccccagacacccccaccccgugcccuagcgcugaaguccugaacccaggccccgccagccuggugacaccuccuggacccugcaagugucccagccaaggcggcaugggcaacaaauggugcccucggaugcccgcgggcacccccuggcaucccaaugggcugcucugagucagagaagggccucccaggacgcagccccgggccggggucgccccugcacgccacuaaguuucucgcugguccggcucccugcccggucagaggcugcugccccgccgccacauugccagugcccccgcgaugagaacuaagcugucggggccacugucuggccugggccucugggcugugccaggagggagcaagagcacaggaagcuacccuccccacccuaugccaauaauaacuuugcgccucacaguuagggcccagacgcaggucuuccuccccggggcgccuccccggagccugacgggcaggucgucugagcccugccaggaggccacgacggaaacccgcccgcugcccagccguaggcgcccgggcacuaccuccuuuguccacacgaccacugccaccaggaccccuugugcggggccugugggagcuucccuacucaggaggucucccgaggcgggggucacaggcaugaaccgguucccguaacccaacucccucagcgcaaacgggaccuguuuuccgaaagucgccuucuaucgugucaacucaaguauuaaaagccacccacaggucccgauccgcgcuugugcucugguuucuuuuuccuuccuucccugagcgccuauguucgguucuggggugugugugugugugugugugugugugugugugugugugugguguuucacugugaugagaaaugcagauagcucggacagggagaucgcagguuggaaaccgaucuccagcgcugauaaggccgccagcgccagcgagagcccguagcccagcccagcggggcgggcagagcgcgcgcacuuugggaacugggacc

SEQ ID NO: 20648 - RNA, 1357 nt, Homo sapiens
ggucccaguucccaaagugcgcgcgcucugcccgccccgcugggcugggcuacgggcucucgcuggcgcuggcggccuuaucagcgcuggagaucgguuuccaaccugcgaucucccuguccgagcuaucugcauuucucaucacagugaaacaccacacacacacacacacacacacacacacacacacacacaccccagaaccgaacauaggcgcucagggaaggaaggaaaaagaaaccagagcacaagcgcggaucgggaccuguggguggcuuuuaauacuugaguugacacgauagaaggcgacuuucggaaaacaggucccguuugcgcugagggaguuggguuacgggaaccgguucaugccugugacccccgccucgggagaccuccugaguagggaagcucccacaggccccgcacaagggguccugguggcaguggucguguggacaaaggagguagugcccgggcgccuacggcugggcagcgggcggguuuccgucguggccuccuggcagggcucagacgaccugcccgucaggcuccggggaggcgccccggggaggaagaccugcgucugggcccuaacugugaggcgcaaaguuauuauuggcauaggguggggaggguagcuuccugugcucuugcucccuccuggcacagcccagaggcccaggccagacaguggccccgacagcuuaguucucaucgcgggggcacuggcaauguggcggcggggcagcagccucugaccgggcagggagccggaccagcgagaaacuuaguggcgugcaggggcgaccccggcccggggcugcguccugggaggcccuucucugacucagagcagcccauugggaugccagggggugcccgcgggcauccgagggcaccauuuguugcccaugccgccuuggcugggacacuugcaggguccaggaggugucaccaggcuggcggggccuggguucaggacuucagcgcuagggcacggggugggggugucuggggggcuggagccaagugccuaggcugcggcagcugcgcgcuacccccuccccuguccugcggcucugcgacggcaccggugggggugggcgcgggccggugccugccacuuggccaggcaucuccgcggccccggguguccccucugccucccaggucucucucuucgcuucuagauacaaagccugggagagucaaccgcgcgagauaagaucacaauuucagcccgucccgacagaacgaucuuaucaggacgggacuugcagaauguaauauuuuaaacuuuaucugagcccagaucggggccgcccuaucgccgcaccaucucgcagaugcgggggag

SEQ ID NO: 20649 - RNA, 571 nt, Homo sapiens
ggccgggagagcagggcgucgggcugugugcuggagcaugccggcaggggacguuuguaguguuuuacuggcuccucggcuuugaaagcagcguuaucuuuuccgaauuccuguaacccucguuacugugacauuuagugucaccgcaaacccagaaaauucugaguuaauggagauggacuacgggugguuggguuggaacaagagagugguauccugaaacaagccagagggaacuaacuagaugaacagacuucaguucugaagucagaccccuaaauguccacgccgggguuuggcugcuucagagguuuuuucuuugcuucauucauucauucauagccgaagauguuagguggaaugggugccuuaugugguuucugguaaauuacguggauuuguuuuaucuagaagggcagaaauaaagcccucuuuccacgugcugaaucggccuagcuucugagcugacauuguacucuuagcguuguuuuuguaaaaaaugguauagguaguauauguacgcgaagacuugguuuauucuugaacagcaaagagcaugcaggcagcaaaa

SEQ ID NO: 20650 - RNA, 571 nt, Homo sapiens
uuuugcugccugcaugcucuuugcuguucaagaauaaaccaagucuucgcguacauauacuaccuauaccauuuuuuacaaaaacaacgcuaagaguacaaugucagcucagaagcuaggccgauucagcacguggaaagagggcuuuauuucugcccuucuagauaaaacaaauccacguaauuuaccagaaaccacauaaggcacccauuccaccuaacaucuucggcuaugaaugaaugaaugaagcaaagaaaaaaccucugaagcagccaaaccccggcguggacauuuaggggucugacuucagaacugaagucuguucaucuaguuaguucccucuggcuuguuucaggauaccacucucuuguuccaacccaaccacccguaguccaucuccauuaacucagaauuuucuggguuugcggugacacuaaaugucacaguaacgaggguuacaggaauucggaaaagauaacgcugcuuucaaagccgaggagccaguaaaacacuacaaacguccccugccggcaugcuccagcacacagcccgacgcccugcucucccggcc

SEQ ID NO: 20651 - RNA, 1483 nt, Homo sapiens
ucugauagaaucuauucauuuuuccaauuagauagggcauaauucuuaauuugcaaaacaaaacguaauaugcuuaugagguuccaucccaaagaaccugcuauugagaguagcauucagaauaacggguggaaaugccaacuccagaguuucagauccuaccgguaauugggguagggaggggcuuugggcggggccucccuagaggaggaggcguuguuagaaagcugucuggccaguccacagcugucacuaaucgggguaagccuuguuguauuugugcguguggguggcauucucaaugagaacuagcuucacuugucauuugagugaaaucuacaacccgaggcggcuagugcucccgcacuacugggaucugagaucuucggagaugacugucgcccgcaguacggagccagcagaaguccgacccuuccugggaaugggcuguaccgagagguccgacuagccccaggguuuuagugagggggcaguggaacucagcgagggacugagagcuucacagcaugcacgaguuugaugccagagaaaaagucgggagauaaaggagccgcgugucacuaaauugccgucgcagccgcagccacucaagugccggacuugugaguacucugcgucuccaguccucggacagaaguuggagaacucucuuggagaacuccccgaguuaggagacgagaucuccuaacaauuacuacuuuuucuugcgcuccccacuugccgcucgcugggacaaacgacagccacaguuccccugacgacaggauggaggccaagggcaggagcugaccagcgccgcccucccccgcccccgacccaggagguggagaucccuccgguccagccacauucaacacccacuuucuccucccucugccccuauauucccgaaacccccuccuccuucccuuuucccuccuccuggagacgggggaggagaaaaggggaguccagucgucaugacugagcugaaggcaaaggguccccgggcuccccacguggcgggcggcccgcccucccccgaggucggauccccacugcugugucgcccagccgcagguccguucccggggagccagaccucggacaccuugccugaaguuucggccauaccuaucucccuggacgggcuacucuucccucggcccugccagggacaggaccccuccgacgaaaagacgcaggaccagcagucgcugucggacguggagggcgcauauuccagagcugaagcuacaaggggugcuggaggcagcaguucuagucccccagaaaaggacagcggacugcuggacagugucuuggacacucuguuggcgcccucaggucccgggcagagccaacccagcccucccgccugcgaggucaccagcucuuggugccuguuuggccccgaacuucccgaagauccaccggcugcccccgccacccagcggguguuguccccgcucaugagccgguc

SEQ ID NO: 20652 - RNA, 1483 nt, Homo sapiens
gaccggcucaugagcggggacaacacccgcuggguggcgggggcagccgguggaucuucgggaaguucggggccaaacaggcaccaagagcuggugaccucgcaggcgggagggcuggguuggcucugcccgggaccugagggcgccaacagaguguccaagacacuguccagcaguccgcuguccuuuucugggggacuagaacugcugccuccagcaccccuuguagcuucagcucuggaauaugcgcccuccacguccgacagcgacugcugguccugcgucuuuucgucggagggguccugucccuggcagggccgagggaagaguagcccguccagggagauagguauggccgaaacuucaggcaagguguccgaggucuggcuccccgggaacggaccugcggcugggcgacacagcaguggggauccgaccucgggggagggcgggccgcccgccacguggggagcccggggacccuuugccuucagcucagucaugacgacuggacuccccuuuucuccucccccgucuccaggaggagggaaaagggaaggaggaggggguuucgggaauauaggggcagagggaggagaaaguggguguugaauguggcuggaccggagggaucuccaccuccugggucgggggcgggggagggcggcgcuggucagcuccugcccuuggccuccauccugucgucaggggaacuguggcugucguuugucccagcgagcggcaaguggggagcgcaagaaaaaguaguaauuguuaggagaucucgucuccuaacucggggaguucuccaagagaguucuccaacuucuguccgaggacuggagacgcagaguacucacaaguccggcacuugaguggcugcggcugcgacggcaauuuagugacacgcggcuccuuuaucucccgacuuuuucucuggcaucaaacucgugcaugcugugaagcucucagucccucgcugaguuccacugcccccucacuaaaacccuggggcuagucggaccucucgguacagcccauucccaggaagggucggacuucugcuggcuccguacugcgggcgacagucaucuccgaagaucucagaucccaguagugcgggagcacuagccgccucggguuguagauuucacucaaaugacaagugaagcuaguucucauugagaaugccacccacacgcacaaauacaacaaggcuuaccccgauuagugacagcuguggacuggccagacagcuuucuaacaacgccuccuccucuagggaggccccgcccaaagccccucccuaccccaauuaccgguaggaucugaaacucuggaguuggcauuuccacccguuauucugaaugcuacucucaauagcagguucuuugggauggaaccucauaagcauauuacguuuuguuuugcaaauuaagaauuaugcccuaucuaauuggaaaaaugaauagauucuaucaga

SEQ ID NO: 20653 - RNA, 951 nt, Homo sapiens
cugggaggccucgcagaccccucagugcccuguacaggggugagaagccaggcccauaggaggaaagaggcuugcuugcucuagaucacacagggagaacccacagugagagcccacagcgagaacacuucgccuaggacuuucccacuagagcacaggggaaugacuccaagaagggaguccagucguuaguaggaguucuggaggaggguuagcaccuggggggcucugggagcgcuggaggagggagugagaaagggaagcagagggguucuuuggagagaaugaaggggugggcccuggggagugggcaaagagguguagagaagagcccggcgugaccuugggccagcugcgucucccuccugggcccgucuuuccgucugcaggcaagagagcgccugggaucccggggggcucaggcuugaaggugccaccccggcgagugagggcgccucaccuucuugaagucggcggugaaggagacgagggugccgucgggcuugcgcagcucgaggcugaugcuguccgcgucgcuguccgccugcaggcucuccucggucaccuggccguccggcagccgcacgcggacccgcagcucggccggcgcacccguucccagcagcggcgcgagcagcggcagcagcagcagcagcgcagggcgcgccagggguaccccgggaaggcgcauccccgggggccgcugccguccgcggccccggcgcgccgcgugggggcggggagaggcgcaggcaaacuucgcccaaaguugggggcuaguucggggcgcccgggagccgcuccgccgggggccuuggccgcggggucgcccgcgagguggcgcggacgcacguggguagcgcucagcagggcgcccccggcggccccgaggcggagacggcgcugccccggcccggcuccgcggccccgggcuccagcgcugcgagccug

SEQ ID NO: 20654 - RNA, 951 nt, Homo sapiens
caggcucgcagcgcuggagcccggggccgcggagccgggccggggcagcgccgucuccgccucggggccgccgggggcgcccugcugagcgcuacccacgugcguccgcgccaccucgcgggcgaccccgcggccaaggcccccggcggagcggcucccgggcgccccgaacuagcccccaacuuugggcgaaguuugccugcgccucuccccgcccccacgcggcgcgccggggccgcggacggcagcggcccccggggaugcgccuucccgggguaccccuggcgcgcccugcgcugcugcugcugcugccgcugcucgcgccgcugcugggaacgggugcgccggccgagcugcggguccgcgugcggcugccggacggccaggugaccgaggagagccugcaggcggacagcgacgcggacagcaucagccucgagcugcgcaagcccgacggcacccucgucuccuucaccgccgacuucaagaaggugaggcgcccucacucgccgggguggcaccuucaagccugagccccccgggaucccaggcgcucucuugccugcagacggaaagacgggcccaggagggagacgcagcuggcccaaggucacgccgggcucuucucuacaccucuuugcccacuccccagggcccaccccuucauucucuccaaagaaccccucugcuucccuuucucacucccuccuccagcgcucccagagccccccaggugcuaacccuccuccagaacuccuacuaacgacuggacucccuucuuggagucauuccccugugcucuagugggaaaguccuaggcgaaguguucucgcugugggcucucacuguggguucucccugugugaucuagagcaagcaagccucuuuccuccuaugggccuggcuucucaccccuguacagggcacugaggggucugcgaggccucccag

SEQ ID NO: 20655 - RNA, 5314 nt, Homo sapiens
gggugacccucuccaauccccaccucccuagugaaguuucaaaggacagguuuuucuggacgggaaggaagaguuucucugggcaggagacgguuaaaagcugggacuacgauuccagccuggggcugcccccuccuggccagcugucugaaccccugaauuauagaugugcuugcuccuggccuggcgagcaagagcuaguaggugcugggagccaggccuaguccagggucaccuaaggguagggccauugggccagacgcaccuccucacuccacaugcagacacacacaccgaguccccucccaguucugacugugcacccacauucacagauauaaccuguacacaaagucuaugcacagaccacacaucuccaaaccccaucuacacagcagacacacacacagcaagcacacaucgaaaucacaaagaaaucaucagaugacacauacugagacauacuuagaccuccccuccccauccagacacacgcaggcagggugggcagaggcucccaacauaaagauacagccacagucauaacugucauaauuaacacauauggagcacuuacucugugcuagguauugcucuaagcccuuuccagagaacaguuuauuuaauuauuauguaauagagauagcuacaauuauuauacccccauuuuacagaugaggaaacugagggaaggagaauuaaaauaagaugccugaggucacacagguguccuggcacagccucaggcacagauacccacccccucgcucuugucccccauuuacauaaacacauucauucaaacgcagcaucccccaaccccugaccugcccgcacacacucagggugagcgcucuuugggggacuguugacuaaagacgcaagaaauggccuauuggccaacgggugguaaacuguaacaagagccgguccgguggcccggcgcgguggcucacgccuguaaucccagcacugugggaagccgaggugggcggaucacgaggucaggaguucgagaccagccugacaaacauggugaaacccgguuucuacuaaaaauacaaaaauuagcggggcgugguggcgcucgccugcaaucucagcuacucaggaggcugaggcaggagaaucgcuugaacccgggaggcggagguugcagugagccgagaucgcaccauuacacuccagccugggcggcacagcaagagucuaucucaaaaaaaaaaaaaaaaaaaaaaaaaaaaaagccggaccggugagaagacuagaccuccuaaagguggaggcggagcucaaaagccggacgcuacuggacgaggcuuaaagcgcucgccccagcgcggggccggugaggaacguucaccguggaccauggucgaauaauguuagcgugcacucggggccucgcccuagccuucugcaaagccucggccugcgcccucggcugcauccguuucgacgccaaccaaccucaugcucuuaguagaacggcaguagcgaccgcgcccucaggcccacaagcccgaaggucugggcagggucuggaauggcgguggagacacuuuauccgcaggcguuucaccucgcgccccacccaggcgcacaccaaguucuugguacuccuuuuaaugggaaaacaagaacagacaccaugguuggauaaauguuauuuauaauucaugggccggucuuugaacccuuucaaacaaaacccacagcgauuucuuugaaagaaugccuggacugugcucagagcucucagauuuucucaggaccaacgagccgccgccucgcagauaccacuguaaauuacccagcgccuuacguucguuucugauuauuugcauugcaguggguuuguuaaugaaggacaagaguuuagaaaaaucuuuuauuuuggaaguuggacacgcaaucgaccccagcaguguuccuaaaaggagcuaugccauuuggaugggggaaaaaugagggggcggggaaguccauguuacauuuaaaacaacaacagcaacaaauuaaaagcaaaacaaaacaacaaaaaaaaggaaguggagcaggaggaggagguggugguggaggagagggaggaggggcagcagcagcggcagcagcagcaaggauggagucaggacccgucccagucccgggugagcgcuuuuggaucuggguucuggcucaacccacguaaugccccaaucuaaaguuuucuacguguguguggauaggaaagucuaaauagaguuuaucagaacccagguggucauucucuacacucucucuagcuuggacccgaagaacaaaggcacaugagaggagaaaggugaccagcuggacgaugacggucacguccaaacggaucccccuuguccucggcucucucguccugagaguggguuuaauuuuuuuuuuuuuaauuuauauaagaagggagcucuuaaaggagagccaucuccacccucagguauccaucacccagcuccagcgcgccugggaaaaccgccccgaaaguccaagaggaagcucagaguuguaacggccgcggagccagcucggcggugacgcaagguccaguccagauugccaggcccggggcaugagagaggauccuuguagguuucggaggugggggggcugcacuccauuguucacuccgggccaaucaggguuggcccacuuccucccagccaaucucccuucacccccagccuccaacccaacccaccccgcccaucagccccuggauccccaucaccucccccgcauccccggcaguucuggggaagcuucgugacgccacaggucccgcccccagcuccggcccggggcuagugcguguugacgucaugcugcgugcgggccggugcggaaucgcuccuucaacuccgcggggcaguaggaguuaguuagcaaagagccgaggccgggcgcgcgacccucguccuucugccccuggccgcacacuuugcgcacaucucuuuuucugcaugguggauauuauuuuucauuauccuuuucugggugcuaugggugaucauuccaagaguaaguauuucuguguguguguggggugggguguguguguaugcuuaauaugcaaaauuucuaaugcagaaaaauguuuaguggauucuacaaguggcuucuauuugucagaauaguuuaggagaggaaaaacgaaugcaugucuccugcaggacugcuuaucuuugggaauccuguuguuuuauuuuauaaguaaacacuauuucucaagccggcuaggaugacuucgggcugcgaaaucugcuucuguuuugcgcaaaggcaauuagguuugauuuagggauguggguuuuuuuuuuuuugguuguuguuuguuugccuuucgguuuuucaaagcuaggaagcuuucuuucgcuugcucugggauauuuaaacuaagaaaugucugagaggaugagcggggacugccgaaagacgaugugucuguguugggauaggaggcagccgcugugagugggagugugugagcggaaaugccaggacagcaccguuagguguugauauccaggcguccgcagugccuguguauuuacucucuucuuaguuucguguuugcguuuaguuucaagacacgucgacaaaacgacugucauuaaugaauguaauaacgaaauauuuggggugggggacagaagaaaccuucagcaauccacaagauacugguuuuucguuuccaaugcccuggaccuuuagagagcucaucaucuuuccuuauggucgcaagucuugaaagaaagagcaagagagcgagcggguuggguuggggcuggaguagccgaggccggccuggguccgggcagucaggccugacgcggccccgcgcccuuccccggcagagaagcccgggacggccaugugcgugggcugcgggagucagauccacgaccaguuuauccugcgggugucgcccgaccucgaguggcacgcggccugccucaagugugccgagugcagccaguaccuggacgagacgugcacgugcuucgugagagacgggaagaccuacugcaagcgggacuaugucaggugaggccggcgggaacgcgggcugggccaccgcgcgcaggggccggggccgggacuggggauggcggccugcccgcgcgccccggcccugcccagggagaaggccauccgcaucccgcacgggugccgcagcgcucccccgggcccgggaaugcccgcaggcgggucaccgcagucuccugguggccacaaaguguccugggcgcgcgccggagccguagcagccagggagaugagggcggccgcaggcccagcgcugacaccgccgcaccuugggcccgcaggcuguucggcaucaagugcgccaagugccaggugggcuucagcagcagcgaccuggugaugagggcgcgggacagcguguaccacaucgagugcuuccgcugcuccgugugcagccgccagcugcugccuggggacgaguucucgcugcgggagcacgagcugcucugccgcgccgaccacggccuccugcucgagcgcgccgcggccggcagcccgcgcagccccggcccgcuucccggcgcccgcggccugcaucugcccgguaagcgcgccggggccugugccggggugagcgggguguaugugcgugcguguguguagggguacgcuugugucccuaacgagaaguugucaguugugugugguuccgucugccgggauaguguuuuucuguaucagugcggaacugugugcugggaacaaggcuguguguauucucgugugcucgggagaaacugcguguguaugagugugugagcacggagaauugugcagaaucguguucuccaugaccaggaacaugcagggcacagugcuaggagcagaagaguggaugacaacagggaaucuuaagugguguccgucuuggggcuuguauuaggaauuucuuggaggaauauguguuauugucagaggguaagguuugcccagggguauguguguaaguaacacagcuccaaacugggagcugggcaggagcuuggucagccaggagccaagaacccaacaaagagggguuuuugccaucuuguuuugaggcccaguuugaugaacaauuuagccagguucuucugggggagggggaguaucaaugcauaguggacugucacuggaauauucuggguccuaaucagcagcugcccagagauggggucugaguguauaaugggcagguacggcugaacagaaacagaggugccuccaccccaggcaaggcaguuucccccagguagccaua

SEQ ID NO: 20656 - RNA, 5314 nt, Homo sapiens
uauggcuaccugggggaaacugccuugccugggguggaggcaccucuguuucuguucagccguaccugcccauuauacacucagaccccaucucugggcagcugcugauuaggacccagaauauuccagugacaguccacuaugcauugauacucccccucccccagaagaaccuggcuaaauuguucaucaaacugggccucaaaacaagauggcaaaaaccccucuuuguuggguucuuggcuccuggcugaccaagcuccugcccagcucccaguuuggagcuguguuacuuacacacauaccccugggcaaaccuuacccucugacaauaacacauauuccuccaagaaauuccuaauacaagccccaagacggacaccacuuaagauucccuguugucauccacucuucugcuccuagcacugugcccugcauguuccuggucauggagaacacgauucugcacaauucuccgugcucacacacucauacacacgcaguuucucccgagcacacgagaauacacacagccuuguucccagcacacaguuccgcacugauacagaaaaacacuaucccggcagacggaaccacacacaacugacaacuucucguuagggacacaagcguaccccuacacacacgcacgcacauacaccccgcucaccccggcacaggccccggcgcgcuuaccgggcagaugcaggccgcgggcgccgggaagcgggccggggcugcgcgggcugccggccgcggcgcgcucgagcaggaggccguggucggcgcggcagagcagcucgugcucccgcagcgagaacucguccccaggcagcagcuggcggcugcacacggagcagcggaagcacucgaugugguacacgcugucccgcgcccucaucaccaggucgcugcugcugaagcccaccuggcacuuggcgcacuugaugccgaacagccugcgggcccaaggugcggcggugucagcgcugggccugcggccgcccucaucucccuggcugcuacggcuccggcgcgcgcccaggacacuuuguggccaccaggagacugcggugacccgccugcgggcauucccgggcccgggggagcgcugcggcacccgugcgggaugcggauggccuucucccugggcagggccggggcgcgcgggcaggccgccauccccagucccggccccggccccugcgcgcgguggcccagcccgcguucccgccggccucaccugacauagucccgcuugcaguaggucuucccgucucucacgaagcacgugcacgucucguccagguacuggcugcacucggcacacuugaggcaggccgcgugccacucgaggucgggcgacacccgcaggauaaacuggucguggaucugacucccgcagcccacgcacauggccgucccgggcuucucugccggggaagggcgcggggccgcgucaggccugacugcccggacccaggccggccucggcuacuccagccccaacccaacccgcucgcucucuugcucuuucuuucaagacuugcgaccauaaggaaagaugaugagcucucuaaagguccagggcauuggaaacgaaaaaccaguaucuuguggauugcugaagguuucuucugucccccaccccaaauauuucguuauuacauucauuaaugacagucguuuugucgacgugucuugaaacuaaacgcaaacacgaaacuaagaagagaguaaauacacaggcacugcggacgccuggauaucaacaccuaacggugcuguccuggcauuuccgcucacacacucccacucacagcggcugccuccuaucccaacacagacacaucgucuuucggcaguccccgcucauccucucagacauuucuuaguuuaaauaucccagagcaagcgaaagaaagcuuccuagcuuugaaaaaccgaaaggcaaacaaacaacaaccaaaaaaaaaaaaacccacaucccuaaaucaaaccuaauugccuuugcgcaaaacagaagcagauuucgcagcccgaagucauccuagccggcuugagaaauaguguuuacuuauaaaauaaaacaacaggauucccaaagauaagcaguccugcaggagacaugcauucguuuuuccucuccuaaacuauucugacaaauagaagccacuuguagaauccacuaaacauuuuucugcauuagaaauuuugcauauuaagcauacacacacaccccaccccacacacacacagaaauacuuacucuuggaaugaucacccauagcacccagaaaaggauaaugaaaaauaauauccaccaugcagaaaaagagaugugcgcaaagugugcggccaggggcagaaggacgagggucgcgcgcccggccucggcucuuugcuaacuaacuccuacugccccgcggaguugaaggagcgauuccgcaccggcccgcacgcagcaugacgucaacacgcacuagccccgggccggagcugggggcgggaccuguggcgucacgaagcuuccccagaacugccggggaugcgggggaggugauggggauccaggggcugaugggcgggguggguuggguuggaggcugggggugaagggagauuggcugggaggaagugggccaacccugauuggcccggagugaacaauggagugcagcccccccaccuccgaaaccuacaaggauccucucucaugccccgggccuggcaaucuggacuggaccuugcgucaccgccgagcuggcuccgcggccguuacaacucugagcuuccucuuggacuuucggggcgguuuucccaggcgcgcuggagcugggugauggauaccugaggguggagauggcucuccuuuaagagcucccuucuuauauaaauuaaaaaaaaaaaaauuaaacccacucucaggacgagagagccgaggacaagggggauccguuuggacgugaccgucaucguccagcuggucaccuuucuccucucaugugccuuuguucuucggguccaagcuagagagaguguagagaaugaccaccuggguucugauaaacucuauuuagacuuuccuauccacacacacguagaaaacuuuagauuggggcauuacguggguugagccagaacccagauccaaaagcgcucacccgggacugggacggguccugacuccauccuugcugcugcugccgcugcugcugccccuccucccucuccuccaccaccaccuccuccuccugcuccacuuccuuuuuuuuguuguuuuguuuugcuuuuaauuuguugcuguuguuguuuuaaauguaacauggacuuccccgcccccucauuuuucccccauccaaauggcauagcuccuuuuaggaacacugcuggggucgauugcguguccaacuuccaaaauaaaagauuuuucuaaacucuuguccuucauuaacaaacccacugcaaugcaaauaaucagaaacgaacguaaggcgcuggguaauuuacagugguaucugcgaggcggcggcucguugguccugagaaaaucugagagcucugagcacaguccaggcauucuuucaaagaaaucgcuguggguuuuguuugaaaggguucaaagaccggcccaugaauuauaaauaacauuuauccaaccauggugucuguucuuguuuucccauuaaaaggaguaccaagaacuuggugugcgccuggguggggcgcgaggugaaacgccugcggauaaagugucuccaccgccauuccagacccugcccagaccuucgggcuugugggccugagggcgcggucgcuacugccguucuacuaagagcaugagguugguuggcgucgaaacggaugcagccgagggcgcaggccgaggcuuugcagaaggcuagggcgaggccccgagugcacgcuaacauuauucgaccaugguccacggugaacguuccucaccggccccgcgcuggggcgagcgcuuuaagccucguccaguagcguccggcuuuugagcuccgccuccaccuuuaggaggucuagucuucucaccgguccggcuuuuuuuuuuuuuuuuuuuuuuuuuuuuuugagauagacucuugcugugccgcccaggcuggaguguaauggugcgaucucggcucacugcaaccuccgccucccggguucaagcgauucuccugccucagccuccugaguagcugagauugcaggcgagcgccaccacgccccgcuaauuuuuguauuuuuaguagaaaccggguuucaccauguuugucaggcuggucucgaacuccugaccucgugauccgcccaccucggcuucccacagugcugggauuacaggcgugagccaccgcgccgggccaccggaccggcucuuguuacaguuuaccacccguuggccaauaggccauuucuugcgucuuuagucaacagucccccaaagagcgcucacccugagugugugcgggcaggucagggguugggggaugcugcguuugaaugaauguguuuauguaaaugggggacaagagcgaggggguggguaucugugccugaggcugugccaggacaccugugugaccucaggcaucuuauuuuaauucuccuucccucaguuuccucaucuguaaaauggggguauaauaauuguagcuaucucuauuacauaauaauuaaauaaacuguucucuggaaagggcuuagagcaauaccuagcacagaguaagugcuccauauguguuaauuaugacaguuaugacuguggcuguaucuuuauguugggagccucugcccacccugccugcgugugucuggauggggaggggaggucuaaguaugucucaguaugugucaucugaugauuucuuugugauuucgaugugugcuugcugugugugugucugcuguguagaugggguuuggagauguguggucugugcauagacuuuguguacagguuauaucugugaaugugggugcacagucagaacugggaggggacucggugugugugucugcauguggagugaggaggugcgucuggcccaauggcccuacccuuaggugacccuggacuaggccuggcucccagcaccuacuagcucuugcucgccaggccaggagcaagcacaucuauaauucagggguucagacagcuggccaggagggggcagccccaggcuggaaucguagucccagcuuuuaaccgucuccugcccagagaaacucuuccuucccguccagaaaaaccuguccuuugaaacuucacuagggagguggggauuggagagggucaccc

SEQ ID NO: 20657 - RNA, 4917 nt, Homo sapiens
ugcugcuggccagaacaugggaaacgucggguacacaguggcggcggcggccgcugcagccacugccgcugcguccuuggcugccccggaggguugaugcccccagaacauggcgccgccgcccgggcccgccccugcccccgggggcaaguggcuggcucccgggccccccgcacccccgccuguccccgcgccgccgccgccgcucccagugccaggaccgcccuuuggcucgcccgcgccuaaaaccgggucguccuuuuuggggcauaggccgaaggccguagggaagccguaaggaugggggaaaaguggugggggcagcuuuugcaggagcccaaagccuuugcugggcaccgggaucaccggguagcuucguacgccggcgccgccaccgggcccuccugggcccgccgggccacuagcuccagucgccaggccaaguccgcgcugcgggugggguggagguggccccggaggcccggcagccucaucuucgccacagcgcaggcuuuuguggggcggcgggccuggggccaucucugcaccgcacccugggccaccgccgccaccgccgccagcaccacccuuccccugcccacccgacccgccauuggcaccgccuccgccgccuccuuguagggagaagguccgcuugcgcgugccgccauuaaacauggccuugacguccucccaagcauggcucaguucgucuguggccgacuugucacugaguuugaggugacgacgccaggaguugaaguuggcggcaucgggcugcguguacuuggcgucggguguucggugcgaguggaagaugaacuuguugggcgagaaguacaugcugcaguagccgcacuugaugcacuuggcacgagagcuguuguaacgcgcagggaugaagcuaccacgcgagccccacgcgcacucgugcaccacaucgaaggcgaaguucucgggcagcuugggugguuugugcucgcccaggaacgacuugcacaggcguucggccucucgcuuagugaucaugccgcagcggcgcgacgagaugggcauggccccggcccgacgcagaaucuccagcuguaccggcgugcacugcacgcacgugaugcccagggccacgcggcgguuguggaucucauuauagcuguaguucuugaggaggguguuggagaucugcgccaggcauaggcgcuccuggccgucgaugaccagcgacacaaugggcaccccguacagcgacgucucgcccaccugguuggguuugagagcgcuggagcccgaguacggcugcagcuccugcuuggaguugggcgaggaacugcccucgcgccccggccccagcugaguggugagagccuccaugccgccgcuccugcgaaauagagaaagcagagagcagaugagccauuuucagcgccgccgccgaggcucgggcccgcccagcagggcgcuccgaguugggcgcgcgggggauacuuggcaguggggaguccaaacucauucacccccuggacaggcgucuuuuguuacucagacccauguuggcgccguuaacaacagcccccggggcuugggggaggagaagggguaaaggagaccucaggaaugcccgggcugcaaggaacccaaucccguuuucggauugggaaggaagugaaacccagauacgcagagugacuugcccaaggccacacagcaaagccauugccaaauccuggcuuuuucagcgcccagauccgugcgccuucggcaacccucgcagccggugcugccggcccggguccugaagcccggacuucggggaucggccgccccucugcucagucgcgcaugcacgcgggcgggcgggggcagugcaaggagggguggggaggggggaggggcggucacugcccaucuccagacagcaggggguagaggggggugaagagaaggaggggggugaggagaaggaggagggaaccgugucugccagggaaggagagaggcggaggcuaccgcuguucgcggugcugaaccugacccucuccaaagcgcucggugcgcacccggaccuagcgcggcccccaccgcacccagcuuggugcccgagccggcuucaggggacaacauugccaguuuccacaaacccgagcuucuccucucacggcuggcgcccgcguucguugagcagaaagauuucggcuggauauauaaaccguuuucuuuccagcuauuagugagaccaggauccugcaguucuaaccacauuuucugcauuuuuagcuguauuccagaccaaagcugguuuccaccgaggucaacgugugggacagagagguucucaaggaacuuuguugggauccacuucuuagcuuccagucgcccacuccuugagcuuuccuccuucagauauacguuucccacucgggccaacugcaggauucggggcucugggcuuccucuuugaggggcaucaccucucugaguauccuucaugccucgcugucccggcucauaugggcuagaaggaaucucagccaucuucguagccauugcaaggcuccaggcacacaaguugcugcugguccuugcacuuugcuuucuggcugaggcagggagggagcugugcaggcagaccucagcagcggggguacuuggggacugauguuuggggcccucuaggucgccugacccagccacauguccucagacaagccaggcucccauccggcccaaggcugcaggcgcuccugcggccagggcagcccaacccugagggcuccuccccugcagucggcccugaauguaacuccguuuucagaggggcagcuccagacaggggaucccaguucaaaagccuucagcaaggagacuggaaucuucuguuuaucugucucucucccuucuucucuauuugucuaggagacccucauuugucgaucuuaucugucccugagcugucucugccggcucguuccucuuucucucaucuguuuuguaccuucuucaaguaucaagcuauuuauguauuaucugucuguuucaucuuuaucuccgaggaucgaacuaaaauaaguugacccuuauuucgcguugaaguccuuuauaucauuguaggaggcaaaaacacuguccuaacuccccggcugacaagccucgcgcccuccuggagguggcuggagggcgcgcagcgcugggaaaugacagcuucucgguuucucgaaaucggcaacuaugccuggcccgcauacagugaagacagcgcccgagccgagagcguaccccaguugaggguccugggucccugcgcgguuuucccugagugagaggagggggguccgggcccggagucagaagaagggggucccuaggaaaggaacggaauuucgggggccaaagcggaaagcacaggcgaagagccauaugcagcgacaaggagcagcagccagagcagcuugaggaacccccgucggcucccggagcuagauggacgagcuuggggagggcagcgaagcgggagacuggcaguggugggagcgaggcgguggugucuuuagguauaaucauaaaaacaacagccacaggagcccaaaucagaacuaaacgaaaaaaaagcugcaggagcagagcgcgggggcggcgggcuaccggacguggguacucacagugcggcggcggcuggagccgggcgagcggugagcggaggugcgcggcgggaggagcggcgggcgggaguccgggauccgccgggcucuccgggugacggcgcggccccuccccgcgcgcgcgcacagccgugcucccugguucuccgcgcucccacccgcggccccucccgcucucagcgggcacggggcgccgggaccccgggcgcggagaugcgaacccugagccguugaccccgaggccggggacuggccggaagaagaggccgaagccuggagcgcauggcgcggcggcggggacggcgcggucacagcccgaguggcggggcaggcgcgccugacagcugagagccggggcgccacacccaccgcccgcgcagucgcuagcgcccuccccggguccgcccgcccgcgggccacgcgcggcgcccgccgccuccccgcagcccaaggccugcacgccccagguaagcggccgcacaccugcguccagcacccugcaccugcgucccgcucuagcuggagaggccaggagggaggaaaggcccuggggccauaaaguuuguccccaagaacgaaguggggagggcccagugcucccggccaaggagccaguuuuggucugggccaaaaccgggugauggggcuaagggggacucaagaggaacgggcgcagggaggaguacuucacuuuccggccgcaggcgagggccagggugguggagccuagaguggcccucgggaaccaguagggucaccagagaccgggacagggaccugggugcagggcagcgaggauggcacccgggaaggagcagaucugccucucccaugcuccugacuucggugggagguaucaagagagagcucuaaccugaggaggggcguucuccuguuuccgucccugggcaggggacuugggaacuagguuuggggagcccucggccuugaaugccucccuucgccaucaccaacaggcccagggcaggagccaagucaucguugggagugaucugagguuaacuacgcucucaacgcugcuaagccaguuuccccaagggggagguccaguccucugaugcuacagacgccccuggguaccuccucucucuccucaaagcuccguuucucuccaucccuuuccugucucagucggucucuccgucuucaccauucuuuccccuaacgccccacuggguccccuucucuuccucucucaaucugucucuacuucuucguuugaguuacuagucgcaccccgccc

SEQ ID NO: 20658 - RNA, 4917 nt, Homo sapiens
gggcggggugcgacuaguaacucaaacgaagaaguagagacagauugagagaggaagagaaggggacccaguggggcguuaggggaaagaauggugaagacggagagaccgacugagacaggaaagggauggagagaaacggagcuuugaggagagagaggagguacccaggggcgucuguagcaucagaggacuggaccucccccuuggggaaacuggcuuagcagcguugagagcguaguuaaccucagaucacucccaacgaugacuuggcuccugcccugggccuguuggugauggcgaagggaggcauucaaggccgagggcuccccaaaccuaguucccaaguccccugcccagggacggaaacaggagaacgccccuccucagguuagagcucucucuugauaccucccaccgaagucaggagcaugggagaggcagaucugcuccuucccgggugccauccucgcugcccugcacccaggucccugucccggucucuggugacccuacugguucccgagggccacucuaggcuccaccacccuggcccucgccugcggccggaaagugaaguacuccucccugcgcccguuccucuugagucccccuuagccccaucacccgguuuuggcccagaccaaaacuggcuccuuggccgggagcacugggcccuccccacuucguucuuggggacaaacuuuauggccccagggccuuuccucccuccuggccucuccagcuagagcgggacgcaggugcagggugcuggacgcaggugugcggccgcuuaccuggggcgugcaggccuugggcugcggggaggcggcgggcgccgcgcguggcccgcgggcgggcggacccggggagggcgcuagcgacugcgcgggcgguggguguggcgccccggcucucagcugucaggcgcgccugccccgccacucgggcugugaccgcgccguccccgccgccgcgccaugcgcuccaggcuucggccucuucuuccggccaguccccggccucggggucaacggcucaggguucgcaucuccgcgcccggggucccggcgccccgugcccgcugagagcgggaggggccgcgggugggagcgcggagaaccagggagcacggcugugcgcgcgcgcggggaggggccgcgccgucacccggagagcccggcggaucccggacucccgcccgccgcuccucccgccgcgcaccuccgcucaccgcucgcccggcuccagccgccgccgcacugugaguacccacguccgguagcccgccgcccccgcgcucugcuccugcagcuuuuuuuucguuuaguucugauuugggcuccuguggcuguuguuuuuaugauuauaccuaaagacaccaccgccucgcucccaccacugccagucucccgcuucgcugcccuccccaagcucguccaucuagcuccgggagccgacggggguuccucaagcugcucuggcugcugcuccuugucgcugcauauggcucuucgccugugcuuuccgcuuuggcccccgaaauuccguuccuuuccuagggacccccuucuucugacuccgggcccggaccccccuccucucacucagggaaaaccgcgcagggacccaggacccucaacugggguacgcucucggcucgggcgcugucuucacuguaugcgggccaggcauaguugccgauuucgagaaaccgagaagcugucauuucccagcgcugcgcgcccuccagccaccuccaggagggcgcgaggcuugucagccggggaguuaggacaguguuuuugccuccuacaaugauauaaaggacuucaacgcgaaauaagggucaacuuauuuuaguucgauccucggagauaaagaugaaacagacagauaauacauaaauagcuugauacuugaagaagguacaaaacagaugagagaaagaggaacgagccggcagagacagcucagggacagauaagaucgacaaaugagggucuccuagacaaauagagaagaagggagagagacagauaaacagaagauuccagucuccuugcugaaggcuuuugaacugggauccccugucuggagcugccccucugaaaacggaguuacauucagggccgacugcaggggaggagcccucaggguugggcugcccuggccgcaggagcgccugcagccuugggccggaugggagccuggcuugucugaggacauguggcugggucaggcgaccuagagggccccaaacaucaguccccaaguacccccgcugcugaggucugccugcacagcucccucccugccucagccagaaagcaaagugcaaggaccagcagcaacuugugugccuggagccuugcaauggcuacgaagauggcugagauuccuucuagcccauaugagccgggacagcgaggcaugaaggauacucagagaggugaugccccucaaagaggaagcccagagccccgaauccugcaguuggcccgagugggaaacguauaucugaaggaggaaagcucaaggagugggcgacuggaagcuaagaaguggaucccaacaaaguuccuugagaaccucucugucccacacguugaccucgguggaaaccagcuuuggucuggaauacagcuaaaaaugcagaaaaugugguuagaacugcaggauccuggucucacuaauagcuggaaagaaaacgguuuauauauccagccgaaaucuuucugcucaacgaacgcgggcgccagccgugagaggagaagcucggguuuguggaaacuggcaauguuguccccugaagccggcucgggcaccaagcugggugcggugggggccgcgcuagguccgggugcgcaccgagcgcuuuggagagggucagguucagcaccgcgaacagcgguagccuccgccucucuccuucccuggcagacacgguucccuccuccuucuccucaccccccuccuucucuucaccccccucuacccccugcugucuggagaugggcagugaccgccccuccccccuccccaccccuccuugcacugcccccgcccgcccgcgugcaugcgcgacugagcagaggggcggccgauccccgaaguccgggcuucaggacccgggccggcagcaccggcugcgaggguugccgaaggcgcacggaucugggcgcugaaaaagccaggauuuggcaauggcuuugcuguguggccuugggcaagucacucugcguaucuggguuucacuuccuucccaauccgaaaacgggauuggguuccuugcagcccgggcauuccugaggucuccuuuaccccuucuccucccccaagccccgggggcuguuguuaacggcgccaacaugggucugaguaacaaaagacgccuguccagggggugaaugaguuuggacuccccacugccaaguaucccccgcgcgcccaacucggagcgcccugcugggcgggcccgagccucggcggcggcgcugaaaauggcucaucugcucucugcuuucucuauuucgcaggagcggcggcauggaggcucucaccacucagcuggggccggggcgcgagggcaguuccucgcccaacuccaagcaggagcugcagccguacucgggcuccagcgcucucaaacccaaccaggugggcgagacgucgcuguacggggugcccauugugucgcuggucaucgacggccaggagcgccuaugccuggcgcagaucuccaacacccuccucaagaacuacagcuauaaugagauccacaaccgccgcguggcccugggcaucacgugcgugcagugcacgccgguacagcuggagauucugcgucgggccggggccaugcccaucucgucgcgccgcugcggcaugaucacuaagcgagaggccgaacgccugugcaagucguuccugggcgagcacaaaccacccaagcugcccgagaacuucgccuucgauguggugcacgagugcgcguggggcucgcgugguagcuucaucccugcgcguuacaacagcucucgugccaagugcaucaagugcggcuacugcagcauguacuucucgcccaacaaguucaucuuccacucgcaccgaacacccgacgccaaguacacgcagcccgaugccgccaacuucaacuccuggcgucgucaccucaaacucagugacaagucggccacagacgaacugagccaugcuugggaggacgucaaggccauguuuaauggcggcacgcgcaagcggaccuucucccuacaaggaggcggcggaggcggugccaauggcgggucgggugggcaggggaaggguggugcuggcggcgguggcggcgguggcccagggugcggugcagagauggccccaggcccgccgccccacaaaagccugcgcuguggcgaagaugaggcugccgggccuccggggccaccuccaccccacccgcagcgcggacuuggccuggcgacuggagcuaguggcccggcgggcccaggagggcccgguggcggcgccggcguacgaagcuacccggugaucccggugcccagcaaaggcuuugggcuccugcaaaagcugcccccaccacuuuucccccauccuuacggcuucccuacggccuucggccuaugccccaaaaaggacgacccgguuuuaggcgcgggcgagccaaagggcgguccuggcacugggagcggcggcggcggcgcggggacaggcgggggugcggggggcccgggagccagccacuugcccccgggggcaggggcgggcccgggcggcggcgccauguucugggggcaucaacccuccggggcagccaaggacgcagcggcaguggcugcagcggccgccgccgccacuguguacccgacguuucccauguucuggccagcagca

SEQ ID NO: 20659 - RNA, 485 nt, Homo sapiens
guaggcuggauugggucucuuagaguagaaguucggucccugggugacccaacuugaagaguuucguuaaacuuucagguggaguagauguacaguguaguuaguggauugucaaaacagugcccccuccccccugcacaugaaagucaaauuugcuaaaagcaugucauuucuuguuucggguuuugaagacaacgauuuuuauuuccgguguguucuaggaccagcugcaucauuuuauucuugcuuaaagugcuuuauuuuagguaagcuuuuugacuugccccagaguaaacuuaaaaaccucaaggugugccuaaaagcaacgauugaaaaaauuugaggaaugcuuuggaugagugucuguagccuuugauaauuuagaaaauaucuauuucauguaauguauuguuucuguuuuuuucuuugccacuuugacuuaugacugcaggaccaaguguauuucuguccuguauucuaccgag

SEQ ID NO: 20660 - RNA, 485 nt, Homo sapiens
cucgguagaauacaggacagaaauacacuugguccugcagucauaagucaaaguggcaaagaaaaaaacagaaacaauacauuacaugaaauagauauuuucuaaauuaucaaaggcuacagacacucauccaaagcauuccucaaauuuuuucaaucguugcuuuuaggcacaccuugagguuuuuaaguuuacucuggggcaagucaaaaagcuuaccuaaaauaaagcacuuuaagcaagaauaaaaugaugcagcugguccuagaacacaccggaaauaaaaaucguugucuucaaaacccgaaacaagaaaugacaugcuuuuagcaaauuugacuuucaugugcaggggggagggggcacuguuuugacaauccacuaacuacacuguacaucuacuccaccugaaaguuuaacgaaacucuucaaguugggucacccagggaccgaacuucuacucuaagagacccaauccagccuac

SEQ ID NO: 20661 - RNA, 3161 nt, Homo sapiens
uuuagccaaaacauucauuugaaugcuuagcaacacuucauugagcauucucagacauaaauaucugaaagcggccgccccuacguggcagcgaggacucccucacuucacccucaugaauaaaaaugaguccacuggggugggagugggggcuaaguggacucguccccuucugccaacucgcccccucccaauucccugcuggaagaacccaauuccuuaacucccgcguccaguuaaaaagaaaaucacacacacacacacacaccgcgugcgcgucgccuaccuccucucccacccaccacgaccuuggcauuagccaaaggagagcuuagcguuuauuuccuuuccugcccuauccuuccccagcauucacuagaagacuacagaguccggaucgagagucucccuggcccagagucccagggagcccugaacuggucacugaagggcucccgaggucgcccgcuuggggguaccuguuccgcucgcugaacgaguccggcgacccacgcuuucugauccccacaagucuaggaucugagugggaaaccgccgcggagaucucacagaccccgaauagggccuccaccaaugcaccgggagggagucggagaggggacuuucucccggagcugggaaaaguccgccaagaaugaguacccuagugcugccuaacccaccaucucggaugcucugaaagguaggggaggaaggagccagaacacuccacuaggaaucuguuacgagaugccacacacacccgugcagccucgacgagcugcagagcacucagcgggcccuccaaagaauuccgcaccgugcgucaccaaaauaccuucccagcgcccccgccgcacgccugcccuccccgacaaagccacagccgcgagauaaccagggcccugcugccccagaacccggcgcgcccuccauugaaaucgacagcaucuacagaugaaacuccucuagaaacggaaacacugaacgggaugcuuugcgugcacaaaaccuugcucagcucuuaagaaaagcaacauuccccucucccucaaaaaccccaaagaaucaccaaaucccaguauacaaggcaacgcucuagcccaccuacacuauuacaaguccaaacuguccucgcccaggauucuucaccgcuccgggcaaggugcaagcuagacgccguuucccgaguugucucugggaaugauggggguaggggaaaggggacagaaaccaggcugaccugaggcggcggcaacagggagagguagcggcggcgacagcggcuucccggcgucggagaagcuggugcucgguguggcccccacacgccccggcgauaggcgcugcacuccaggagcaccuggcggccgccgaggcgugggcagcugcggggaaguccaggaggaggaggagaaucccaggaggagaggcgggcgcggcaggaagacuggagauggccugagccugcagcugccggcgcgcggacgcgucuggggcgguucgccuuagccaaguggaaagagacuccgcgccgcgggcuacuuaauagagggcuguucccagcucucaguuuacucgguuacgaaacgccugagaagguggacggcugccacggggugauguaugcuccuccggcggugaaggaggucuacuuuugggaacgugugcauacuucgagcauuccuucggcgugagguggcgaucgccguaguagcagugccccgcuggggggcggggagaagggagggagcguagagggggacagccgcagccggguucccugccaagggaagccgcguacuccgccacuuggggcggacugggauuucuuuaaugaagcucggguuucccuaucccugagauuucuuuaaugaauuuuucuacauuaagaacaauggggaggggaccgacucccauuuucggaaaugcaaggaugcguaacccauucacccccgcuccugcggaucuccauccuucaucugauaucaccaccuccaucuuccucccccucuguccugggugcacuuaaaaccgauuuacaggauuuccauuaacuaacugucuguacacgcggcgcgccuucugucuuuuucaaucuccaagcgcgauuggaaacccggacagccgcccgcgcggggcucagugaugggauggcuuucccaguccuuucucacuccccuggugcuucaggacggaacugggaggcuuaaguugagccaaaagagagggagaggaaaccuaugaaacccaggaguucucagaauaggaagccgcucaguaacaaguugcauccacugcagaaacuucucacccggaccagagcaaaaccuggccccgagcggaggcuucggacugaaagcucugcccuuaaaaccucgcggagccaaaggggcgaagaggaguaaguuugaaaccccaaagcaccccuccacacacaguacuggagaagccaaauagggggcugauauucuaccaacaacgucgccucuucuuacagcccccuccauccuggcauccuaccccuuguuccugggcagggagucugguacucaggguugccagauuguacaaggcgcacgggaggaagcuucgagcgcucacaccaagaaaucagaaaaaugcuacuggagagauucugauuauaacgucugaccucaguauaggcccugcaccguuuuggccucuugaagcccaaagguuacuccuguaacgcugggggagcguugaacaacaaaggaccgggguggggcgcaagggaacagaggagcugcuucucuggaacuaaccgcccgccauaguagaaucggagggcauguucccaauguaaaucucucuuccccauuggcucugacgucugcaaauuuggccuucccucuccacuaggcgugauagccuccaaacuugccuuucgacugacaagaacuuguagggcgcuccccuuucugcacaucuccccacacacaggcugccuccagcagaagccggcgaaagcaagagagaagacaagagggagacaaugaagacaaauaggaaucgccgccucugcacauuccccaaccacacagcccacucgaaguccagcugggcagcucgcacaaagagccuacacaguacacaagauuuucccccuucaaauccucacaaccagagugucugac

SEQ ID NO: 20662 - RNA, 3161 nt, Homo sapiens
gucagacacucugguugugaggauuugaagggggaaaaucuuguguacuguguaggcucuuugugcgagcugcccagcuggacuucgagugggcugugugguuggggaaugugcagaggcggcgauuccuauuugucuucauugucucccucuugucuucucucuugcuuucgccggcuucugcuggaggcagccuguguguggggagaugugcagaaaggggagcgcccuacaaguucuugucagucgaaaggcaaguuuggaggcuaucacgccuaguggagagggaaggccaaauuugcagacgucagagccaauggggaagagagauuuacauugggaacaugcccuccgauucuacuauggcgggcgguuaguuccagagaagcagcuccucuguucccuugcgccccaccccgguccuuuguuguucaacgcucccccagcguuacaggaguaaccuuugggcuucaagaggccaaaacggugcagggccuauacugaggucagacguuauaaucagaaucucuccaguagcauuuuucugauuucuuggugugagcgcucgaagcuuccucccgugcgccuuguacaaucuggcaacccugaguaccagacucccugcccaggaacaagggguaggaugccaggauggagggggcuguaagaagaggcgacguuguugguagaauaucagcccccuauuuggcuucuccaguacuguguguggaggggugcuuugggguuucaaacuuacuccucuucgccccuuuggcuccgcgagguuuuaagggcagagcuuucaguccgaagccuccgcucggggccagguuuugcucugguccgggugagaaguuucugcaguggaugcaacuuguuacugagcggcuuccuauucugagaacuccuggguuucauagguuuccucucccucucuuuuggcucaacuuaagccucccaguuccguccugaagcaccaggggagugagaaaggacugggaaagccaucccaucacugagccccgcgcgggcggcuguccggguuuccaaucgcgcuuggagauugaaaaagacagaaggcgcgccgcguguacagacaguuaguuaauggaaauccuguaaaucgguuuuaagugcacccaggacagagggggaggaagauggagguggugauaucagaugaaggauggagauccgcaggagcgggggugaauggguuacgcauccuugcauuuccgaaaaugggagucgguccccuccccauuguucuuaauguagaaaaauucauuaaagaaaucucagggauagggaaacccgagcuucauuaaagaaaucccaguccgccccaaguggcggaguacgcggcuucccuuggcagggaacccggcugcggcugucccccucuacgcucccucccuucuccccgccccccagcggggcacugcuacuacggcgaucgccaccucacgccgaaggaaugcucgaaguaugcacacguucccaaaaguagaccuccuucaccgccggaggagcauacaucaccccguggcagccguccaccuucucaggcguuucguaaccgaguaaacugagagcugggaacagcccucuauuaaguagcccgcggcgcggagucucuuuccacuuggcuaaggcgaaccgccccagacgcguccgcgcgccggcagcugcaggcucaggccaucuccagucuuccugccgcgcccgccucuccuccugggauucuccuccuccuccuggacuuccccgcagcugcccacgccucggcggccgccaggugcuccuggagugcagcgccuaucgccggggcgugugggggccacaccgagcaccagcuucuccgacgccgggaagccgcugucgccgccgcuaccucucccuguugccgccgccucaggucagccugguuucuguccccuuuccccuacccccaucauucccagagacaacucgggaaacggcgucuagcuugcaccuugcccggagcggugaagaauccugggcgaggacaguuuggacuuguaauaguguaggugggcuagagcguugccuuguauacugggauuuggugauucuuugggguuuuugagggagaggggaauguugcuuuucuuaagagcugagcaagguuuugugcacgcaaagcaucccguucaguguuuccguuucuagaggaguuucaucuguagaugcugucgauuucaauggagggcgcgccggguucuggggcagcagggcccugguuaucucgcggcuguggcuuugucggggagggcaggcgugcggcgggggcgcugggaagguauuuuggugacgcacggugcggaauucuuuggagggcccgcugagugcucugcagcucgucgaggcugcacggguguguguggcaucucguaacagauuccuaguggaguguucuggcuccuuccuccccuaccuuucagagcauccgagaugguggguuaggcagcacuaggguacucauucuuggcggacuuuucccagcuccgggagaaaguccccucuccgacucccucccggugcauugguggaggcccuauucggggucugugagaucuccgcggcgguuucccacucagauccuagacuuguggggaucagaaagcgugggucgccggacucguucagcgagcggaacagguacccccaagcgggcgaccucgggagcccuucagugaccaguucagggcucccugggacucugggccagggagacucucgauccggacucuguagucuucuagugaaugcuggggaaggauagggcaggaaaggaaauaaacgcuaagcucuccuuuggcuaaugccaaggucguggugggugggagaggagguaggcgacgcgcacgcggugugugugugugugugugauuuucuuuuuaacuggacgcgggaguuaaggaauuggguucuuccagcagggaauugggagggggcgaguuggcagaaggggacgaguccacuuagcccccacucccaccccaguggacucauuuuuauucaugagggugaagugagggaguccucgcugccacguaggggcggccgcuuucagauauuuaugucugagaaugcucaaugaaguguugcuaagcauucaaaugaauguuuuggcuaaa

SEQ ID NO: 20663 - RNA, 2223 nt, Homo sapiens
agcuguaacacaaaguucuccccccaaaaacacagggcauuaagcgucuaguucaaguacugccaggcuguauguagaucugucucagacaggcuucagacaacaauuacaaguacacugcuucuagugggcauuauccacgauaccaaagcagggcagggauucccuuccauuaucaauuuuuaaaaguugcaacccccuuugggauuggcugccgcagggucagugcugagcccggggcuugaggggaggaagugagccuccuccugggcagggaagcucuacauuuaguuucaacacuucuccuuucagagcucucucucaggacuauucuggcuucucaggauccauugcccuugcccaggagagagagccucgcugggacccagaaaccgcgaaagaagauucgaccuaccuguggaaccagacacaacuugguccccaaaggucgcuuaggcgaccccacugcaaacggcaagucaacuugugcacuuaaaacguaucaguuuauggaaugcuuguuuaaaguccucauuggacaugguauagauuaugggguugaugagggaguugagauagcccagccaugugaagaagucaaagauggcuagguggaaccagcaggcaucuuugcagauaggcaucacuagggagaugaugaagaaggguagccaacacacaauaaaggcucccaaaaugaucccuagggucuugguggcuuugcgcucccuagcggccaugaguuucuucuuuuccagcagggcgucggagacucgcacuuugacuugguucacauacacaggagauccggauucgcugggcacgucgggaacccgcgaguuaauagaggugaccgaggacguggacccgggggagucgguuaucagcugggcucgggucaagcgcuugccgguccuguugggcgucuguuucaaaauccgggagcgggcuucuacguagaugcggccauagagggcgaugaggagcaggguggggaaguagaaagcacccaccguggaguagaccguguagaggauguggucgguguucaccacgcauuccgacaccuccucuucggccuuagccugacgccagaagaagggcggcagcgagauagagauggagaagacccacaccagcgcgaucaugaccgccgcccucuugggaguccuuuuagcugaguacuccacggcguccgugauggcccaguagcgguccagggcgaugacacagaggugcaggauggaggcagugcaacaagugauguccgacgacagccagaagucacagaccaccuggcccaguguccagcggccggugacaguguacauggugcugaugggcaucaccaggauggacacaagcaggucggugaccgccagagaggcgaucagguaguuagccggggugugcaguuuccggguccgguacacuguggcaaucacaaaggcauuggagagcgugguggccaaggugaugagcgccaauagcauaaccagcaguacuuuccaggguagggagauggaguccugguaaauguaguccuuggcgcugcaguuuugggagggagcagaggauaaguuggcuugaggaacccaggucucggagcccgcgggcggcgguggagcgcacugagcacccgguuccuccauggcucuccucgccccagcuccggagcgcagcucuugggcauggagcggacgaaggagagggcggaaggaccguggcgaucgcagguuuguccccaguugauaguuccgugaguuccucaauuauuccuccgcccagguucacagcugaaacuagaggucaugggugcggcagccaaggcaggcgggcgccuccccugcacuuccagagcgccuagcuaagccgccgcgucugugguuguuccucuccacaccgggucuuagaccuggguugcuaagagcuggcccaccgagcccugcuccgcuccagcucccuggaggcgucuagugcaggagggugaaguacugcuugaggagaaggcuuugaccaaaugggaucucuuaccccaguugcuugaggcugagcgucuccuaaccuggacgcuuuuggaucugcagacuuugcccacaggaguuuccuagguguagagaccaaagcuugcaggccagcgagaggucccgagaucuugcauucccaccccucgccccaagcuggggcacuuuuggggggcugcagcggccgccagagcugggu

SEQ ID NO: 20664 - RNA, 2223 nt, Homo sapiens
acccagcucuggcggccgcugcagccccccaaaagugccccagcuuggggcgaggggugggaaugcaagaucucgggaccucucgcuggccugcaagcuuuggucucuacaccuaggaaacuccugugggcaaagucugcagauccaaaagcguccagguuaggagacgcucagccucaagcaacugggguaagagaucccauuuggucaaagccuucuccucaagcaguacuucacccuccugcacuagacgccuccagggagcuggagcggagcagggcucggugggccagcucuuagcaacccaggucuaagacccgguguggagaggaacaaccacagacgcggcggcuuagcuaggcgcucuggaagugcaggggaggcgcccgccugccuuggcugccgcacccaugaccucuaguuucagcugugaaccugggcggaggaauaauugaggaacucacggaacuaucaacuggggacaaaccugcgaucgccacgguccuuccgcccucuccuucguccgcuccaugcccaagagcugcgcuccggagcuggggcgaggagagccauggaggaaccgggugcucagugcgcuccaccgccgcccgcgggcuccgagaccuggguuccucaagccaacuuauccucugcucccucccaaaacugcagcgccaaggacuacauuuaccaggacuccaucucccuacccuggaaaguacugcugguuaugcuauuggcgcucaucaccuuggccaccacgcucuccaaugccuuugugauugccacaguguaccggacccggaaacugcacaccccggcuaacuaccugaucgccucucuggcggucaccgaccugcuuguguccauccuggugaugcccaucagcaccauguacacugucaccggccgcuggacacugggccagguggucugugacuucuggcugucgucggacaucacuuguugcacugccuccauccugcaccucugugucaucgcccuggaccgcuacugggccaucacggacgccguggaguacucagcuaaaaggacucccaagagggcggcggucaugaucgcgcuggugugggucuucuccaucucuaucucgcugccgcccuucuucuggcgucaggcuaaggccgaagaggaggugucggaaugcguggugaacaccgaccacauccucuacacggucuacuccacggugggugcuuucuacuuccccacccugcuccucaucgcccucuauggccgcaucuacguagaagcccgcucccggauuuugaaacagacgcccaacaggaccggcaagcgcuugacccgagcccagcugauaaccgacucccccggguccacguccucggucaccucuauuaacucgcggguucccgacgugcccagcgaauccggaucuccuguguaugugaaccaagucaaagugcgagucuccgacgcccugcuggaaaagaagaaacucauggccgcuagggagcgcaaagccaccaagacccuagggaucauuuugggagccuuuauuguguguuggcuacccuucuucaucaucucccuagugaugccuaucugcaaagaugccugcugguuccaccuagccaucuuugacuucuucacauggcugggcuaucucaacucccucaucaaccccauaaucuauaccauguccaaugaggacuuuaaacaagcauuccauaaacugauacguuuuaagugcacaaguugacuugccguuugcaguggggucgccuaagcgaccuuuggggaccaaguugugucugguuccacagguaggucgaaucuucuuucgcgguuucugggucccagcgaggcucucucuccugggcaagggcaauggauccugagaagccagaauaguccugagagagagcucugaaaggagaaguguugaaacuaaauguagagcuucccugcccaggaggaggcucacuuccuccccucaagccccgggcucagcacugacccugcggcagccaaucccaaaggggguugcaacuuuuaaaaauugauaauggaagggaaucccugcccugcuuugguaucguggauaaugcccacuagaagcaguguacuuguaauuguugucugaagccugucugagacagaucuacauacagccuggcaguacuugaacuagacgcuuaaugcccuguguuuuuggggggagaacuuuguguuacagcu

SEQ ID NO: 20665 - RNA, 1201 nt, Homo sapiens
acacacacacucacacacacagguggaugaaagcgcuuaaguucccagguuauugagguuugaauuuuuuaauggcaaauuugaaacguuguugccaguuuccuuuacuuuuucucucucuugcguuauuuuucuguuuucugccuuuccguugucuccuucgacugcccccgcuaacccugucucuccucacuccuguucccuacuugggccccuuucauucagguaaaacuguaaauuucccaacgcgcuauuguucccuugggcugcccaaagcucccuagagauccccgaauacuuuuucgguauuuaaauccccaauagauaggaccaauguaaauuuugugacauucaaaccuuuucuaguucacaaaucagucacccuugucacaguuauugaaauuccgcaacucgccacaccaggacgguggaaaaagcgggcgcggucuuuguugccgaccaggcuuuugaucgccagagaaaauuuacuuaccuucagaugagugagcagaaaaagaaauaacacucccuuugauuuaguuaggaaaaugcagacauuuggauucagugcaaacauacaacacucgcuuguuuucgcgaugcggcccucgauuaaccugucuuugccuagcgcaaagucuauucaacaacugcgcguaguuucuuuuugucccuuccacaaagagccauugacuauauauuaaaaugauuguugaaagguaggggaguaugguacuuaaaagcaggaaaaaaaaaucccugugacucaaucaauuaagccgagcaacauuuaugcauuucaaaaaaugcacgcggaugcgggggguuguggggacgaagguugcauuucuccgcagcucuguuuaaaacccagcaguccuggccgaggcuuuagcugaagcgucugcauauucauuaggucuaauuauuuucuaguaaggaaaacacaaaaagccaagagucggaauccuucaauuuacccuuuguuucuaacuucauuuggcuucuuugcagcugaaucaaagcccuaaacucuuuuuccaaacaaagaaaccucaacucauccuuucauaggcggcccgguuaggaaacucaccgugccccagcgagaggaaaaugaaaaugaauauauuuuuugcccugacgccagcgcugacugcacgggcuggaggaaggcagggucagcguccgccgcuccucg

SEQ ID NO: 20666 - RNA, 1201 nt, Homo sapiens
cgaggagcggcggacgcugacccugccuuccuccagcccgugcagucagcgcuggcgucagggcaaaaaauauauucauuuucauuuuccucucgcuggggcacggugaguuuccuaaccgggccgccuaugaaaggaugaguugagguuucuuuguuuggaaaaagaguuuagggcuuugauucagcugcaaagaagccaaaugaaguuagaaacaaaggguaaauugaaggauuccgacucuuggcuuuuuguguuuuccuuacuagaaaauaauuagaccuaaugaauaugcagacgcuucagcuaaagccucggccaggacugcuggguuuuaaacagagcugcggagaaaugcaaccuucguccccacaaccccccgcauccgcgugcauuuuuugaaaugcauaaauguugcucggcuuaauugauugagucacagggauuuuuuuuuccugcuuuuaaguaccauacuccccuaccuuucaacaaucauuuuaauauauagucaauggcucuuuguggaagggacaaaaagaaacuacgcgcaguuguugaauagacuuugcgcuaggcaaagacagguuaaucgagggccgcaucgcgaaaacaagcgaguguuguauguuugcacugaauccaaaugucugcauuuuccuaacuaaaucaaagggaguguuauuucuuuuucugcucacucaucugaagguaaguaaauuuucucuggcgaucaaaagccuggucggcaacaaagaccgcgcccgcuuuuuccaccguccugguguggcgaguugcggaauuucaauaacugugacaagggugacugauuugugaacuagaaaagguuugaaugucacaaaauuuacauugguccuaucuauuggggauuuaaauaccgaaaaaguauucggggaucucuagggagcuuugggcagcccaagggaacaauagcgcguugggaaauuuacaguuuuaccugaaugaaaggggcccaaguagggaacaggagugaggagagacaggguuagcgggggcagucgaaggagacaacggaaaggcagaaaacagaaaaauaacgcaagagagagaaaaaguaaaggaaacuggcaacaacguuucaaauuugccauuaaaaaauucaaaccucaauaaccugggaacuuaagcgcuuucauccaccugugugugugagugugugugu

SEQ ID NO: 20667 - RNA, 783 nt, Homo sapiens
aacuccuccaccuguuugaucugcuggaaggugagggcgguccgccaggcauuggcggccugcguggcauugcgugcagauaccacgaaaggcuuggaggaggagcccgagccacuggucauguucagggcaaacugcuccauuucggggcucaccaacagucccacaaaaucguacacucuccguagugucuugacggggucucccaccagguccucguaccgcaccaccagguaguggcccugcagccagucagggggcugcagggcugucugcagcgucuuagccauacuauugcagaugaccuccauagcgcccagagcgugguagucugcggggccgcccacgcccuccuucuuggcgccaagcuuguggcccgcggccuccaagaagggcaugcggugagcucgcgggucucggcugcgcaccaccuguaggcucucacggaugaggccguggcgcgagcggauccgugaacucgccaccgcgcggggaucacgcaccaaguggaugaccuugagguccagggccgggucucgcagcaguggcgccaagaccgccacgucgaagacgcgcacacccuuuaugacuagugugcgguacuugcggcacuccuccucgaaacgcgccaggcgcuguggcgggcacuucuugcacacgcggucguccaccaaccccacgaccuccuugcgguaggcggggcagaguggugacgagcacaccaccuuguugguggcugcgccgaagaugcccagcguggugagguugcgccccccgcugccc

SEQ ID NO: 20668 - RNA, 783 nt, Homo sapiens
gggcagcggggggcgcaaccucaccacgcugggcaucuucggcgcagccaccaacaagguggugugcucgucaccacucugccccgccuaccgcaaggaggucgugggguugguggacgaccgcgugugcaagaagugcccgccacagcgccuggcgcguuucgaggaggagugccgcaaguaccgcacacuagucauaaagggugugcgcgucuucgacguggcggucuuggcgccacugcugcgagacccggcccuggaccucaaggucauccacuuggugcgugauccccgcgcgguggcgaguucacggauccgcucgcgccacggccucauccgugagagccuacagguggugcgcagccgagacccgcgagcucaccgcaugcccuucuuggaggccgcgggccacaagcuuggcgccaagaaggagggcgugggcggccccgcagacuaccacgcucugggcgcuauggaggucaucugcaauaguauggcuaagacgcugcagacagcccugcagcccccugacuggcugcagggccacuaccugguggugcgguacgaggaccuggugggagaccccgucaagacacuacggagaguguacgauuuugugggacuguuggugagccccgaaauggagcaguuugcccugaacaugaccaguggcucgggcuccuccuccaagccuuucgugguaucugcacgcaaugccacgcaggccgccaaugccuggcggaccgcccucaccuuccagcagaucaaacagguggaggaguu

SEQ ID NO: 20669 - RNA, 862 nt, Homo sapiens
gcgccgccgucugucgccgcggcuccuccccuccgccgcgcagcccucccccuucgccggccccgcccccgcccccaacgccgagccggcucccaccgucgcugcgccucgggggcuggagacgcgacccgcuuuaccgcgacgcgcgggggcugcaguccacggguccgaaggcuuagcucugcgcgcaaagcgccgggaugcgaacgcgggaucuggagcucgucggugccgagagcugccagagaguuggauucugcgugcagcugccggacucggccccauguuuuugcucucagaaagaguuggugaugaaguuugggcagaaauccccugucggccguccgcuccacgcuucccucggggccgacacugccaaccucuccgggcacugaggacaccucugcgcccuggagcggugggaggacgcggagcgccguucucuggcuuccgacacccugcccgcccucucuagugggucuguggcugcgcccucucgaaggaaguaauaaaucuuucugaccuugggggucagaggagacgcuucaguuuuccggaggggugugcgggcgggaccgucuuuccgcuuuacuggaccucuggccggggcugcucuuguuucauugugccccacaugcggagccccgaugcucuccgcauuuccgcucgcggugcugcguccacugugauugacguccucuggaauuggggugaugggggaggggaacgccccguucuaauuugcagaaaaauacuugucccgcuucuugguuuuguagaugagaucaaagaacuugaccccaaaggaaacaccguuguugaaagaaaaucauuuuucaguugcuuuagguuuaaguacuuu

SEQ ID NO: 20670 - RNA, 862 nt, Homo sapiens
aaaguacuuaaaccuaaagcaacugaaaaaugauuuucuuucaacaacgguguuuccuuuggggucaaguucuuugaucucaucuacaaaaccaagaagcgggacaaguauuuuucugcaaauuagaacggggcguuccccucccccaucaccccaauuccagaggacgucaaucacaguggacgcagcaccgcgagcggaaaugcggagagcaucggggcuccgcauguggggcacaaugaaacaagagcagccccggccagagguccaguaaagcggaaagacggucccgcccgcacaccccuccggaaaacugaagcgucuccucugacccccaaggucagaaagauuuauuacuuccuucgagagggcgcagccacagacccacuagagagggcgggcagggugucggaagccagagaacggcgcuccgcguccucccaccgcuccagggcgcagagguguccucagugcccggagagguuggcagugucggccccgagggaagcguggagcggacggccgacaggggauuucugcccaaacuucaucaccaacucuuucugagagcaaaaacauggggccgaguccggcagcugcacgcagaauccaacucucuggcagcucucggcaccgacgagcuccagaucccgcguucgcaucccggcgcuuugcgcgcagagcuaagccuucggacccguggacugcagcccccgcgcgucgcgguaaagcgggucgcgucuccagcccccgaggcgcagcgacggugggagccggcucggcguugggggcgggggcggggccggcgaagggggagggcugcgcggcggaggggaggagccgcggcgacagacggcggcgc

SEQ ID NO: 20671 - RNA, 850 nt, Homo sapiens
caugagcugcacggcgcacguguucagcugccugucgcugcgucugcgcgccgccuucuucuaccuggacuacgcguccaucagcuacuacggcuucggcagcacgguggccuacuacuacuaccuguugccaggccucagcuugcuggaugccagagucaugacuccauacuugcagcagcgccugggcuggcacguggacugcacgcgccuuaucgccgccuaccgcgcccuggugcugccuguggccuucgugcuggcgguggcuugcacuguggccugcugcaagagccguaccgacugguguaccuacccguucgcgcugcgcaccuucgucuucgucaugccgcucagcauggccugccccauuaugcucgagagcuggcucuucgaccugcguggggagaaccccacacucuucgugcacuucuaccgccgcuacuucuggcuggugguggccgccuucuucaacgugagcaagauccccgagcgcauccagccgggucuuuucgacauuaucggccacagccaccagcucuuccacaucuucaccuuccucagcaucuacgaccagguguacuacguagaagagggccugcgccaguuccuccaggcgccgccugccgcacccacuuucucggguacugugggcuacaugcugcugcugguggucugccuggggcugguaaucaggaaguuccuaaacagcuccgaauucugcaguaaaaagugagccuccgccuuggaggagacuacugguucgcccaucuguuuggaguuucuguuguugcuauuguugguuuguuuucaaauuucauuguguuuucuucuuugcucaaggaaggugcug

SEQ ID NO: 20672 - RNA, 850 nt, Homo sapiens
cagcaccuuccuugagcaaagaagaaaacacaaugaaauuugaaaacaaaccaacaauagcaacaacagaaacuccaaacagaugggcgaaccaguagucuccuccaaggcggaggcucacuuuuuacugcagaauucggagcuguuuaggaacuuccugauuaccagccccaggcagaccaccagcagcagcauguagcccacaguacccgagaaagugggugcggcaggcggcgccuggaggaacuggcgcaggcccucuucuacguaguacaccuggucguagaugcugaggaaggugaagauguggaagagcugguggcuguggccgauaaugucgaaaagacccggcuggaugcgcucggggaucuugcucacguugaagaaggcggccaccaccagccagaaguagcggcgguagaagugcacgaagagugugggguucuccccacgcaggucgaagagccagcucucgagcauaauggggcaggccaugcugagcggcaugacgaagacgaaggugcgcagcgcgaacggguagguacaccagucgguacggcucuugcagcaggccacagugcaagccaccgccagcacgaaggccacaggcagcaccagggcgcgguaggcggcgauaaggcgcgugcaguccacgugccagcccaggcgcugcugcaaguauggagucaugacucuggcauccagcaagcugaggccuggcaacagguaguaguaguaggccaccgugcugccgaagccguaguagcugauggacgcguaguccagguagaagaaggcggcgcgcagacgcagcgacaggcagcugaacacgugcgccgugcagcucaug

SEQ ID NO: 20673 - RNA, 821 nt, Homo sapiens
ccguauauucugguuccuaguauaggcuucagggugcacucacuaugaaaagucagaauauuuccuguagccaguuuuacuuacuuccuugccaggaguguuuagguucuuuuuuuuuuuuuuuucuuuuuugagauggagucucacucugucgcccggggcuggagugcaauggcgugaucucggcucacugcaaccuccgccucccggguucacgcgauacuucugccucagcuucccgaguacccgggauuacagacgcacaccgcaacaccuggcuaauuuuuuguauuuuuagucgaggcgggguuucaccaucuuggccagacugguuucgaacuccugaccucgugauccgcccgccucggccuccaaaagugcugggauuacaggcgugggccaucgcgcccacccguguuuagauucuuaacagcucauuauuagaaauaaagucucgauaagaacuacuuuaauacuuaauuuucuugcuuagaaaggugaaaacaauuuagaaggaacaacgugaggcaucaaaguuaagcuguaucucccauagcuggugauuauuaaaaaucucuaugaaucuagucuguuccugucauucuuuuauuaaucccugguuauugggaagcucuuaacaaaauaaauguuuaaaauuauauuucuguaauuaaguaaaagagaguauugauuccacaaggcuagaauuguucgucuaagaaaaacgaauucuccguaaauuuuaacccguuaauaccacagaaagaugcuguuggaaaggucuaagaacagagagaugcaagcagagaaacaccauuuuc

SEQ ID NO: 20674 - RNA, 821 nt, Homo sapiens
gaaaaugguguuucucugcuugcaucucucuguucuuagaccuuuccaacagcaucuuucugugguauuaacggguuaaaauuuacggagaauucguuuuucuuagacgaacaauucuagccuuguggaaucaauacucucuuuuacuuaauuacagaaauauaauuuuaaacauuuauuuuguuaagagcuucccaauaaccagggauuaauaaaagaaugacaggaacagacuagauucauagagauuuuuaauaaucaccagcuaugggagauacagcuuaacuuugaugccucacguuguuccuucuaaauuguuuucaccuuucuaagcaagaaaauuaaguauuaaaguaguucuuaucgagacuuuauuucuaauaaugagcuguuaagaaucuaaacacgggugggcgcgauggcccacgccuguaaucccagcacuuuuggaggccgaggcgggcggaucacgaggucaggaguucgaaaccagucuggccaagauggugaaaccccgccucgacuaaaaauacaaaaaauuagccagguguugcggugugcgucuguaaucccggguacucgggaagcugaggcagaaguaucgcgugaacccgggaggcggagguugcagugagccgagaucacgccauugcacuccagccccgggcgacagagugagacuccaucucaaaaaagaaaaaaaaaaaaaaaagaaccuaaacacuccuggcaaggaaguaaguaaaacuggcuacaggaaauauucugacuuuucauagugagugcacccugaagccuauacuaggaaccagaauauacgg

SEQ ID NO: 20675 - RNA, 2861 nt, Homo sapiens
ggugggaggauagagggcucagagucugagagaaaggaacuccuaucuucaucccccaaccccccaaggaggagaguggggcgcagaagaggaaaccaagcggggggagguuagagaacuugcccaaggucacaccgcgagcuggugguggagacagauucgaacccaagccugacuccagaacugagaacucuccaccuucucgcgacagcgguacagaaaagugcccuccucuccuuccugccggcagccgucugcgcuuggccaugggccggcgggagcagccacucccccgguucucccgccagucagaggucgggggcucggcguccccuucuggcuuggagccccuggcgcguacagagcgaccagggcggacacauuugccgcgcucaagucucugacccccucccuccuucccagagcccugcgccuaggguuuccugagcucccaacccccucccuucccgagcauagacaaguuuguauucaagcaaggccaggacuggucccugagucgcucucgggccaggcgaccagccucacugccccagagucaggaauaaacgguaacaacagccaccggugccuauugcgugacccgugcuuuacuuccaccucuccgaauaccccggacgaacagacccccaggaauuauuguccccauuacacggacgacggaacugcugcagcuucggaaaguuggauaacaagcuugggcucgcaaagcuaauaauaauacuagcuaacauaugauugaguguuuccugugugcccagcacaugucuaccuacgaacaccaucccauagaucuuuccaauaccccuauaaaaugugcacaauuaucauucccauccuacggaugaggaaacagguuuggcgcccuguccaaggucacucagccagugagugacggauccuggauccaaaccaaagcgggugaaucggauggcaguuuuuugugcguuguccgcuacgcagagaagcaaagggcuuagaacccaugauaccaaaggccgggccccaaacgccccagggcugcgcgcaaaucaaccaucucgaacugccacaaccugcagagaggaauucucagggacugggacgucaggagcgccagcugugucgagugcuggcccgcacaaaguccgugcagccggaucucggcucccggcccccgcgcgccccucaccaggagcuggagaguacuuaccauaaaagagagggcaagcgccuguucgggaagaauccccagcgcuggcagguccuggacucccuggagaggggucugcugccgccgccgcccacucaggggcgcccgagugacccgcaaaugccggcucucuccgcacggccaggggcgcguccucacggcugaugcccggcagcagcgcccccucugcgcugcaggauggccuggaguuaggagcguucuuggcgaaguuggcgcucaggcgccgggggucgggccuggaguggggaagcgccuuacugaagcgauccugggggcgcuccaaggcccgcgcucuagccgcuuggaagcuuggcgccugacccggagggcgacgagucccgcgcucagggcgcacgggccgcgccucggccgcuggcccccggcgcgccgggcgucuuccccagcgcccugagcgcacgcagcgguagcagcagcuggggcccgggcccgggaugugguguguucaucgcccuccccuggggcugggugcuuuugugcgcggggcgcgccggccgccacggccagcucuggaugcugcagccgccgccgccucccccuccuccgccgccgccgcccgcuccccgccuucccggccggcccggaggcugcagcugaaagccgaucuggcugagcucaucccugaaggccacuaauccaauagccgcggaaggcgcggucgccgggaacgccccuucccccaccaucccgcgccccggccgucccagcucgggccgcugccggcgccgccaccuucucgaggccaccagcuggcgggagagggaaguggagcccgcgcccgcgccccugugccaaggcggcggcgcggucgccauucacucacccgcccacucgcccgcucacucccuagcucucgcauucauuccugcgcgcggguccucccggauucauucaagcgcuccuggagcgccagggugggugccccugacggggaggagacacccagucacuaggcagcuuuggugccuuuacucaacgcacgugggaaauagcagccaggaggaaaaaagggugguuuauuaucccccuuccucagacacacacguccacacuuuauuuuugagaucaggcuccaacucaucucuuaaaguccaauuucauaccgcaccugcucaaggagcguuccccgcccacccgaggcgcaggaagucggucucuuugcucuaccagcgcugauggugggccgccucauugggagccugaacugagcgaugggguaaagggcguggccaaaacagaagccucgagggugcuucugguaucugcgcuuccuuggggaaauugaaaguucuugguuugguggcccucgucugugcucccagaauugacuuuagguccauuacgcagucauuugcuaacccaaucccucucugugccagguaccaggcagagucuagaugcagacagagucuagaugcagacagagucuagaugcagagugcgcauuucaucaaggacauggaaaacaaguaaagacaauccaacucuaugaaggaaacguuuugagagagguucuggggcgaauuugucagacuggaaagggcaacugggaauguuuccuaguaaaugugucuacaugaauuagcuccuggaggcagggguacaacauggu

SEQ ID NO: 20676 - RNA, 2861 nt, Homo sapiens
accauguuguaccccugccuccaggagcuaauucauguagacacauuuacuaggaaacauucccaguugcccuuuccagucugacaaauucgccccagaaccucucucaaaacguuuccuucauagaguuggauugucuuuacuuguuuuccauguccuugaugaaaugcgcacucugcaucuagacucugucugcaucuagacucugucugcaucuagacucugccugguaccuggcacagagagggauuggguuagcaaaugacugcguaauggaccuaaagucaauucugggagcacagacgagggccaccaaaccaagaacuuucaauuuccccaaggaagcgcagauaccagaagcacccucgaggcuucuguuuuggccacgcccuuuaccccaucgcucaguucaggcucccaaugaggcggcccaccaucagcgcugguagagcaaagagaccgacuuccugcgccucgggugggcggggaacgcuccuugagcaggugcgguaugaaauuggacuuuaagagaugaguuggagccugaucucaaaaauaaaguguggacgugugugucugaggaagggggauaauaaaccacccuuuuuuccuccuggcugcuauuucccacgugcguugaguaaaggcaccaaagcugccuagugacugggugucuccuccccgucaggggcacccacccuggcgcuccaggagcgcuugaaugaauccgggaggacccgcgcgcaggaaugaaugcgagagcuagggagugagcgggcgagugggcgggugagugaauggcgaccgcgccgccgccuuggcacaggggcgcgggcgcgggcuccacuucccucucccgccagcugguggccucgagaagguggcggcgccggcagcggcccgagcugggacggccggggcgcgggauggugggggaaggggcguucccggcgaccgcgccuuccgcggcuauuggauuaguggccuucagggaugagcucagccagaucggcuuucagcugcagccuccgggccggccgggaaggcggggagcgggcggcggcggcggaggagggggaggcggcggcggcugcagcauccagagcuggccguggcggccggcgcgccccgcgcacaaaagcacccagccccaggggagggcgaugaacacaccacaucccgggcccgggccccagcugcugcuaccgcugcgugcgcucagggcgcuggggaagacgcccggcgcgccgggggccagcggccgaggcgcggcccgugcgcccugagcgcgggacucgucgcccuccgggucaggcgccaagcuuccaagcggcuagagcgcgggccuuggagcgcccccaggaucgcuucaguaaggcgcuuccccacuccaggcccgacccccggcgccugagcgccaacuucgccaagaacgcuccuaacuccaggccauccugcagcgcagagggggcgcugcugccgggcaucagccgugaggacgcgccccuggccgugcggagagagccggcauuugcgggucacucgggcgccccugagugggcggcggcggcagcagaccccucuccagggaguccaggaccugccagcgcuggggauucuucccgaacaggcgcuugcccucucuuuuaugguaaguacucuccagcuccuggugaggggcgcgcgggggccgggagccgagauccggcugcacggacuuugugcgggccagcacucgacacagcuggcgcuccugacgucccagucccugagaauuccucucugcagguuguggcaguucgagaugguugauuugcgcgcagcccuggggcguuuggggcccggccuuugguaucauggguucuaagcccuuugcuucucugcguagcggacaacgcacaaaaaacugccauccgauucacccgcuuugguuuggauccaggauccgucacucacuggcugagugaccuuggacagggcgccaaaccuguuuccucauccguaggaugggaaugauaauugugcacauuuuauagggguauuggaaagaucuaugggaugguguucguagguagacaugugcugggcacacaggaaacacucaaucauauguuagcuaguauuauuauuagcuuugcgagcccaagcuuguuauccaacuuuccgaagcugcagcaguuccgucguccguguaauggggacaauaauuccugggggucuguucguccgggguauucggagagguggaaguaaagcacgggucacgcaauaggcaccgguggcuguuguuaccguuuauuccugacucuggggcagugaggcuggucgccuggcccgagagcgacucagggaccaguccuggccuugcuugaauacaaacuugucuaugcucgggaagggaggggguugggagcucaggaaacccuaggcgcagggcucugggaaggagggagggggucagagacuugagcgcggcaaauguguccgcccuggucgcucuguacgcgccaggggcuccaagccagaaggggacgccgagcccccgaccucugacuggcgggagaaccgggggaguggcugcucccgccggcccauggccaagcgcagacggcugccggcaggaaggagaggagggcacuuuucuguaccgcugucgcgagaagguggagaguucucaguucuggagucaggcuuggguucgaaucugucuccaccaccagcucgcggugugaccuugggcaaguucucuaaccuccccccgcuugguuuccucuucugcgccccacucuccuccuugggggguugggggaugaagauaggaguuccuuucucucagacucugagcccucuauccucccacc

SEQ ID NO: 20677 - RNA, 4825 nt, Homo sapiens
ccgugagaugcgaaagugagcagcgugugaaaagccuuagggucugcacauuggcuugacauguuuuccaccaacaugugcaaaaucugaauuaguacguguagcuggugagugugagagaaguaggaggggagggagaacuagaggggauuuggaguugacagagggagaaggagagagaaguggauggaguaacgugaccugaguggagggacaccgagucccugaggugugggugcaaagggcccugugaggggccgggagggagugagugcugacaguuguugaggcguggaguguauggggauguacuaauagacacagugaagcuucccuuugcuagccaagcaccgcagaggccaucccuccaagcagaggguugcagcaagcucuauucucucccgcucaggagcgggaagccgccggguguuucggggucccgcuaggaaaggggacagcggaaccugguucaggcagccggcggcggcgcgggacgagcugagugguucuagcgaagcgcugccugccucagagcagccgcgacgcuucccuaguagagcugggccgccggaagcccgaggcgcgggcggcuucugccgcuguugcaggauucccggcccuggggagaaaagcgucuguaucagagccguguagauugcucgcgccggcugucgggaccuccgaggcgcggggccaggcugcgaggaggcgcgggagcugagacugcgcucaaucggcgguucacuggaaccguauccgcaggcggcgcuacggugggaccacggucaggaggcgccgguggcugcugaauugcagcugcgggacccuggaaaacuggggcaaagaggcagugaguucugcccagcccaccacccuggccuuuggaggugagcgccgccccaaggucacuaagccgggggcccugcgucgccccaaugccgcggggagaaaaggaaccggcccuggcguccacaaaaccuaggcacaguaugcccuguucagagaggaucccgaccucgccagcaaccagccuaccuccgaagguugagaaguaaaucagggcgccccgcaccguuuccuggagcgcccgguucacccaccucuggcugggccggcaaggagaggauucuguucucucccuagauuccucuaucuccagcccgaagccccuggcuuuuccgcagaagccuggaggggaccugaaaguaaucauucugccagcuuucccgcccgcauuuucuugccuguuuucugagccuucgaaugccggacagccaugugaaggcacaucuuggggagaccgauuccagcccuucccagggugcacgcaucaggcauccucuucuucaccagggcuggggauucuguuccucuacgggacagucagaaaucaguauuuucagagcagaacuccuuucuauucugaaaauccuucagaggaacuccuucauuugcccccaaccccuacacacacacacacacacacacacacgcacaugcauacacacacaggcucuuuaaaggcugaaaagggagccgaguguggaauucagggaagugaugacacacacaacaaugcuguuacaccuggcugcugcagggcugagcagcggaaaugccugugagaagaagaaagaaagacagagagacgcagagagccagccuggguggucaagaaaaaaaaaaaggagagaaaaggagagaggagcccccaccaggauggggccagacccagcuguuuuucccccugcccaggcccuggcugggggaggauaggcacugaggccaaucugcagcagccccaaaccggacucaccacucccacccaaagcuugggcaaggauggggguaaggaagaagaaaaacaucugcacuccugcucagaaagcagcagcagggauucugcggaagugcugcuucccccaugucuguugggugcagugggagaccgcccauaaaaaaaaccaagcuacuuuggggauagccuugcucccucucauccuugugaccaggcaagggcugcccugcugaccucucuggugucaucuucaagaugcugaauuccaaagagcccuaccacccuuguccucccucccuuucaucucagaaugcagaucagaggccugagugagcagcagacaacacuuguagauggccuguggaugcuggaaccacaggccgcugaaggcuccuugggcuucaggagaacccucagagucuaaacagccugggaggaagaggcagugacaggcauugagucagccacuccagacaugccaaucacuaaugcacagcuauaugacauccauucaguccaccuuccuccauaagguggccuugccccccuccucagcaccaaggaguuuggggcuugaggauucaaaacacuggccaucucucucauacuuuaugacugcagacuuuuuguuuaggccaaguuaaaaggcacuguuaaggagcacacuguuaaaaggcacaccugauuuucccugaaacaaucucuguacaugcugaaauaauuggauucccaucagaauucugcuuaagguaggugacaacuaacuccugauucuuuggagaaagaucagaacaaaugucucaucaggagagagauuugaacaagucccucccucagccugauguuugucuucccagucuguggcaaaauacauacacugggagggaaagaggcaucgaagaauugugaaagaaaggaagaaaggggggaaggaaagaaguaagaaaggagaaaaagagaagaugcuauauccaccagcuacauuuacucuaauacuugaugaacauauuacauaacuaucaguauaaguguguuuuaccucguaaauacaaaucucacaccuuguacaugugcauaccuguguuucugagcagcacacaugcaccugguaucucacccaucucaaggacagcuccucuccaugacuuccauaugugaccccugugcacacacauacacagucccgcaaagucccgggcaacagccccgccuguguuagugcaauagcugaggggcaucuacuuggugcuguuaaagcacacauccaaccuucacuccaaccccguaggauuaguacacggauuccugguuccuagauccacugguaacgcagggagaggcagaggugauucaggcggcgccccugacgacuauuuccagagauccucuccccugccccauuccagcccagucacucugagagcgcgagggacaggccaggccgaggcuucuucguacagucacacccguuucugggcugacuuucccaaagccucagagcagcucuccccacccuaccccguccagcccccucgccgucucgccccuccccagccccgagcuagaaguucagccucaagacggcagcaaacggcagagcaaaggagucguuuucuuucaccugaaagccgcgaggaggcuuggagcgccuuuccucgcuggggcccgagcuuccugggcuuuggccgggugcgggcagaccccaccgggguccucgucaucucccagcccagcccgcagagcgaguaccggcagauuucaagggcgcgugagccuggcugucggcugggccccugaggcucgcugggcgggggcaggccgguccaggcugugcggggcguuuacaaaaagugacuuggagaugaacucgcccgugcgcggcuggccgccccgcuauaggggcgaaggcgccugacgcaagcggaacucgguggagcccauacgaaucagaacagagcgaggcuccuggcgcacuagggacuccaggaggcagcuccgccagagacgcgggucgugcuucgggaaaccggggggcggggggaggggaagagcgcagaaaagaaaacccaccaaggcggggacuggccugagcggggaggggcggcgaggccggagccccucucuguugggcggacuccccauggccagaggcugagcuccacucccgccggccgcucccuaggggaaggggaaggagaggggagagcagcgacaggccuccagcaagcaagcgcgggcggcauccgcagucuccagaaguuugagacuuggccguaagcggacucgugcgccccaacucuuugccgcgccagcgccuggagcggagagcagaggcggcccggccgcggcgcgccggcuuugucaugauggccagcuaccccgagcccgaggacgcggcgggggcccugcuggccccagagaccggucgcacagucaaggagccagaagggccgccgccgagcccaggcaagggcgguggggguggcggcgggacagccccggagaagccggacccggcgcagaagcccccguacucguacguggcgcucaucgccauggcgauccgcgagagcgcggagaagaggcucacgcuguccggcaucuaccaguacaucaucgcgaaguucccguucuacgagaagaauaagaagggcuggcaaaauagcauccgccacaaccucagccucaacgagugcuucaucaaggugccgcgcgagggcggcggcgagcgcaagggcaacuacuggacgcuggacccggccugcgaagacauguucgagaagggcaacuaccggcgccgccgccgcaugaagaggcccuuccggccgccgcccgcgcacuuccagcccggcaaggggcucuucggggccggaggcgccgcaggcgggugcggcguggcgggcgccggggccgacggcuacggcuaccuggcgccccccaaguaccugcagucuggcuuccucaacaacucguggccgcuaccgcagccucccucacccaugcccuaugccuccugccagauggcgg

SEQ ID NO: 20678 - RNA, 4825 nt, Homo sapiens
ccgccaucuggcaggaggcauagggcaugggugagggaggcugcgguagcggccacgaguuguugaggaagccagacugcagguacuuggggggcgccagguagccguagccgucggccccggcgcccgccacgccgcacccgccugcggcgccuccggccccgaagagccccuugccgggcuggaagugcgcgggcggcggccggaagggccucuucaugcggcggcggcgccgguaguugcccuucucgaacaugucuucgcaggccggguccagcguccaguaguugcccuugcgcucgccgccgcccucgcgcggcaccuugaugaagcacucguugaggcugagguuguggcggaugcuauuuugccagcccuucuuauucuucucguagaacgggaacuucgcgaugauguacugguagaugccggacagcgugagccucuucuccgcgcucucgcggaucgccauggcgaugagcgccacguacgaguacgggggcuucugcgccggguccggcuucuccggggcugucccgccgccacccccaccgcccuugccugggcucggcggcggcccuucuggcuccuugacugugcgaccggucucuggggccagcagggcccccgccgcguccucgggcucgggguagcuggccaucaugacaaagccggcgcgccgcggccgggccgccucugcucuccgcuccaggcgcuggcgcggcaaagaguuggggcgcacgaguccgcuuacggccaagucucaaacuucuggagacugcggaugccgcccgcgcuugcuugcuggaggccugucgcugcucuccccucuccuuccccuuccccuagggagcggccggcgggaguggagcucagccucuggccauggggaguccgcccaacagagaggggcuccggccucgccgccccuccccgcucaggccaguccccgccuugguggguuuucuuuucugcgcucuuccccuccccccgccccccgguuucccgaagcacgacccgcgucucuggcggagcugccuccuggagucccuagugcgccaggagccucgcucuguucugauucguaugggcuccaccgaguuccgcuugcgucaggcgccuucgccccuauagcggggcggccagccgcgcacgggcgaguucaucuccaagucacuuuuuguaaacgccccgcacagccuggaccggccugcccccgcccagcgagccucaggggcccagccgacagccaggcucacgcgcccuugaaaucugccgguacucgcucugcgggcugggcugggagaugacgaggaccccgguggggucugcccgcacccggccaaagcccaggaagcucgggccccagcgaggaaaggcgcuccaagccuccucgcggcuuucaggugaaagaaaacgacuccuuugcucugccguuugcugccgucuugaggcugaacuucuagcucggggcuggggaggggcgagacggcgagggggcuggacgggguaggguggggagagcugcucugaggcuuugggaaagucagcccagaaacgggugugacuguacgaagaagccucggccuggccugucccucgcgcucucagagugacugggcuggaauggggcaggggagaggaucucuggaaauagucgucaggggcgccgccugaaucaccucugccucucccugcguuaccaguggaucuaggaaccaggaauccguguacuaauccuacgggguuggagugaagguuggaugugugcuuuaacagcaccaaguagaugccccucagcuauugcacuaacacaggcggggcuguugcccgggacuuugcgggacuguguaugugugugcacaggggucacauauggaagucauggagaggagcuguccuugagaugggugagauaccaggugcaugugugcugcucagaaacacagguaugcacauguacaaggugugagauuuguauuuacgagguaaaacacacuuauacugauaguuauguaauauguucaucaaguauuagaguaaauguagcugguggauauagcaucuucucuuuuucuccuuucuuacuucuuuccuuccccccuuucuuccuuucuuucacaauucuucgaugccucuuucccucccaguguauguauuuugccacagacugggaagacaaacaucaggcugagggagggacuuguucaaaucucucuccugaugagacauuuguucugaucuuucuccaaagaaucaggaguuaguugucaccuaccuuaagcagaauucugaugggaauccaauuauuucagcauguacagagauuguuucagggaaaaucaggugugccuuuuaacagugugcuccuuaacagugccuuuuaacuuggccuaaacaaaaagucugcagucauaaaguaugagagagauggccaguguuuugaauccucaagccccaaacuccuuggugcugaggaggggggcaaggccaccuuauggaggaagguggacugaauggaugucauauagcugugcauuagugauuggcaugucuggaguggcugacucaaugccugucacugccucuuccucccaggcuguuuagacucugaggguucuccugaagcccaaggagccuucagcggccugugguuccagcauccacaggccaucuacaaguguugucugcugcucacucaggccucugaucugcauucugagaugaaagggagggaggacaagggugguagggcucuuuggaauucagcaucuugaagaugacaccagagaggucagcagggcagcccuugccuggucacaaggaugagagggagcaaggcuauccccaaaguagcuugguuuuuuuuaugggcggucucccacugcacccaacagacaugggggaagcagcacuuccgcagaaucccugcugcugcuuucugagcaggagugcagauguuuuucuucuuccuuacccccauccuugcccaagcuuugggugggaguggugaguccgguuuggggcugcugcagauuggccucagugccuauccucccccagccagggccugggcagggggaaaaacagcugggucuggccccauccuggugggggcuccucucuccuuuucucuccuuuuuuuuuuucuugaccacccaggcuggcucucugcgucucucugucuuucuuucuucuucucacaggcauuuccgcugcucagcccugcagcagccagguguaacagcauuguugugugugucaucacuucccugaauuccacacucggcucccuuuucagccuuuaaagagccuguguguguaugcaugugcguguguguguguguguguguguguguagggguugggggcaaaugaaggaguuccucugaaggauuuucagaauagaaaggaguucugcucugaaaauacugauuucugacugucccguagaggaacagaauccccagcccuggugaagaagaggaugccugaugcgugcacccugggaagggcuggaaucggucuccccaagaugugccuucacauggcuguccggcauucgaaggcucagaaaacaggcaagaaaaugcgggcgggaaagcuggcagaaugauuacuuucagguccccuccaggcuucugcggaaaagccaggggcuucgggcuggagauagaggaaucuagggagagaacagaauccucuccuugccggcccagccagaggugggugaaccgggcgcuccaggaaacggugcggggcgcccugauuuacuucucaaccuucggagguaggcugguugcuggcgaggucgggauccucucugaacagggcauacugugccuagguuuuguggacgccagggccgguuccuuuucuccccgcggcauuggggcgacgcagggcccccggcuuagugaccuuggggcggcgcucaccuccaaaggccaggguggugggcugggcagaacucacugccucuuugccccaguuuuccagggucccgcagcugcaauucagcagccaccggcgccuccugaccguggucccaccguagcgccgccugcggauacgguuccagugaaccgccgauugagcgcagucucagcucccgcgccuccucgcagccuggccccgcgccucggaggucccgacagccggcgcgagcaaucuacacggcucugauacagacgcuuuucuccccagggccgggaauccugcaacagcggcagaagccgcccgcgccucgggcuuccggcggcccagcucuacuagggaagcgucgcggcugcucugaggcaggcagcgcuucgcuagaaccacucagcucgucccgcgccgccgccggcugccugaaccagguuccgcuguccccuuuccuagcgggaccccgaaacacccggcggcuucccgcuccugagcgggagagaauagagcuugcugcaacccucugcuuggagggauggccucugcggugcuuggcuagcaaagggaagcuucacugugucuauuaguacauccccauacacuccacgccucaacaacugucagcacucacucccucccggccccucacagggcccuuugcacccacaccucagggacucggugucccuccacucaggucacguuacuccauccacuucucucuccuucucccucugucaacuccaaauccccucuaguucucccuccccuccuacuucucucacacucaccagcuacacguacuaauucagauuuugcacauguugguggaaaacaugucaagccaaugugcagacccuaaggcuuuucacacgcugcucacuuucgcaucucacgg

SEQ ID NO: 20679 - RNA, 1207 nt, Homo sapiens
aacgaguaugcuguuuucuugugcaaugaggguguuuaagaaaacgugucuucacaacaggccaugaaaugugucaaauacagaacacccgacauuagugguaaagccugugaguucaucugguugucaucucuguugaagagcacaacaguugaaugaacacaaaccuagcuuuagcuuagaagccacauucuuaauuauuaaccccuucaugcuuccacccuuuccaaacuccacucccuuaagaggaggucacuucauuuagaauuaauaacuguuauucaagaugcucaugagagaucauuuuggcuucagucguuuugcugcaguuuauucuacauauuucucccuaaaucaaauguauacacgucccugagacuuguguaugaccuuagucccuggaccuugggaagucacgaugucguggaggagaggggagcugggagccugaagcugacagaucccgggaucccgcaggccccccgcagggcucccgcccuuccaccgaggcacccgucgagguugccccagaugcucauucugcgcccaucaaugggaguaacugagcuuagagaggaaaaacuacggcuucaacaaagcacaacgugugcagcucugauaaugcagggcggaauuauggagacaccgucggggcuggcuggaaagcggaaagcguuccaucucaggauuuucacggggaauuucaagaaccaagggggccucugagauccccagaaccucuccuuuccacgaggcagcuuccuuccuucccugcucguucuccacaaaaaucagggcugcccggaucccagcagugagcgcugcucucuuuggcugcuguauccccaaccgcugcugaggcgcagcuggagugagccccuccgagccccgcuuugcgcagcugcagcuggagcccagaggcgcccggagcucggagaaaagcacugugcuccgcgggacccaacccuccccacggccaccaagggggcccgcagauccccgggcaccggcagccgaacccagacaggggcgucccaaccgcugagcccgacgccagagggcaccgcgggggagagaaggcgccgcgccucgcuccuggcacuugguccccgggagucagggacaugcgcgccccggagcuggagcccgggaaaauuacugcgcgggcacagaggagcuagagagguccccgacccucccagccccg

SEQ ID NO: 20680 - RNA, 1207 nt, Homo sapiens
cggggcugggagggucggggaccucucuagcuccucugugcccgcgcaguaauuuucccgggcuccagcuccggggcgcgcaugucccugacucccggggaccaagugccaggagcgaggcgcggcgccuucucucccccgcggugcccucuggcgucgggcucagcgguugggacgccccugucuggguucggcugccggugcccggggaucugcgggcccccuugguggccguggggaggguugggucccgcggagcacagugcuuuucuccgagcuccgggcgccucugggcuccagcugcagcugcgcaaagcggggcucggaggggcucacuccagcugcgccucagcagcgguuggggauacagcagccaaagagagcagcgcucacugcugggauccgggcagcccugauuuuuguggagaacgagcagggaaggaaggaagcugccucguggaaaggagagguucuggggaucucagaggcccccuugguucuugaaauuccccgugaaaauccugagauggaacgcuuuccgcuuuccagccagccccgacggugucuccauaauuccgcccugcauuaucagagcugcacacguugugcuuuguugaagccguaguuuuuccucucuaagcucaguuacucccauugaugggcgcagaaugagcaucuggggcaaccucgacgggugccucgguggaagggcgggagcccugcggggggccugcgggaucccgggaucugucagcuucaggcucccagcuccccucuccuccacgacaucgugacuucccaagguccagggacuaaggucauacacaagucucagggacguguauacauuugauuuagggagaaauauguagaauaaacugcagcaaaacgacugaagccaaaaugaucucucaugagcaucuugaauaacaguuauuaauucuaaaugaagugaccuccucuuaagggaguggaguuuggaaaggguggaagcaugaagggguuaauaauuaagaauguggcuucuaagcuaaagcuagguuuguguucauucaacuguugugcucuucaacagagaugacaaccagaugaacucacaggcuuuaccacuaaugucggguguucuguauuugacacauuucauggccuguugugaagacacguuuucuuaaacacccucauugcacaagaaaacagcauacucguu

SEQ ID NO: 20681 - RNA, 3008 nt, Homo sapiens
cggcggagcuucgggcgcggaccgucccaccguuuugcgccagcgccaagguccaggaagccuggagugggaacaaucucucuggagcucucaggaaccuaacaaucucucucucugccuccuuggcuccuuuuccuucccauccucccaaguugcuuuucuugugacauuaacauuuuuuuuucgcaguuuuuggucuaggaaguuaaagaauugugcaaaacugaaauucuuuuagaaauccauguuuuaaaacgaaagagaggacacagaaaauaagagaccucuccgccacaauacugccaggagcaaagccaucaccgaacauggacaucccguugaaaccacaccagaagggcccaauaaacaaaauugacagaauggaaguguuuaggaaaagagaucuaaugaaaaaaaaauauugagacagagaaagucggcaugcagucuucccaccacccccagcccccgcuggcagcaccuucccuccgaccgcaccucugucccucaaaccuuuccacugagaccuauuuuugcccauauuucucuaaacuugggagcagccaggaaagaaaggagagcgaauguuucaauuccucucuccaaacucagaggaaccuccaccaaccgccuggccaccuucucuugccuuccuuccguuccugaugugugauuugguuagagaaauugggaaggggggugggguggaagaaaguuaaaaaaaaaaucaggaaggcguaagcuggagcggugagugugucaaucagaggguuuugugccugggggcuccuagcgguucggagcagaggugucccagggcggccccacaaugaauaugaauaggaauccuugcuaaaugggacagcaaagcgcaccgcccugaaugauggcacgucauccuaaccagcccaggauagauaggagggcuccuuuugucucuuuucuccgccgcagcucuauaaaagccccucuuuuucagcgugagguuaguucaagcacacaccaacuagcuguccaggaagcagccuaaccagagagaggggcgugggagggagagaggcggggaaaagcagcgucuccgcuuuucuucucacgucuugccgcggagaaguggguuccugggcagugcagauuuuuuuuuuuuaauucaagauuuucuuuaauuucccgccuaaagccuccccacgguagggccgcauccccuguaauaaaaugaauucugauucgagcucugucuccagcagagcuucaucuccggacauggaugagauguaccugagggaccaccaccaccgccaccaccaccaccaggagagccgucucaacucggucucguccacgcagggcgauaugaugcagaagaugcccggggaaagccucucgcgggcuggcgccaaggccgcgggagagagcagcaaguacaaaaucaagaagcagcugucggagcaggaccuacagcaguugaggcugaagaucaacggacgcgaacgcaagcggaugcacgaccugaaccuagccauggacgggcugcgcgaagucaugcccuacgcgcaugggccgucggugcgcaagcucuccaagaucgccacacuccugcucgccagaaacuacauccucaugcucaccagcucccuggaggagaugaagaggcugguuggcgagaucuaugggggccaccacucggccuuucacugcgggaccgugggccacucggccggccaccccgcgcacgcggccaacuccgugcacccggugcaccccaucuugggcggcgcgcucucaucuggcaacgccucgucaccgcuguccgccgccucacuucccgccaucggcaccauccggccuccccacucgcuacucaaggcgcccuccacgccgcccgcgcugcagcugggcagcggcuuccagcacugggcuggucugcccugccccugcaccaucugccagaugccgccgccgccgcaccuguccgcucucuccacagccaacauggcccggcugucggccgaguccaaggacuugcucaagugagcagcgggcgggcccggcugccaaggaggagggagagcggcgggaggggccgcggugccgggccgggagggaagagggaggcugcacgcucggcccacgggagggcaggcuccggggcccgcagccucccacgcugucugagagaucucagacuccacuugacccccggagggaaaggaccaaaaucaaaccgcaauuucuaggugguagcaaagggggacucgaaccagaugucguguguuuugcaugcaugcuucuuuuccccaugccgcgccaguauuuuucacugccauaugcucuugucaaaacugcauuuguuguauaaagaugggaucgguguaguuaaaaacuugcgaagggacuuuugaguuggcuuucucugacucuguguucucgcuuuggaaaaagacggccaucccuuuugugcaaaacaaauguaaauauuuucuugagauggaugcgauuaugauugucucuguccuugccacaguuuuucuagagacaauggagagagaaagagagagagagcgcgagagagaucaagacccaaguuuugaaucucaaccgagguccagggcaugacaccuccuauguggguuuuccuuucgacgcaguguaggucaaaagaaugcaugcacgcuucuaaaugaaucuugucugaauaugucgugcaggcuguggugccguuuuccuuguaacaaggauuuauuagugaauuaucccaaguacuccauauaucugucugugguuguaugaaaugaaaaaaggggcagagugcaaagacccacacucacgcacacgcgcuucuucucccacccccacccccuucaaacuuuauucggaaccuuccuuugcuguucuggggccgcuauuguaaaagccugggcucccucuaguagcuugcgccacccccccucgcucaguuauucugcaugcgggguuggcucucucuauuaucagcuuugaaaacuuauccu

SEQ ID NO: 20682 - RNA, 3008 nt, Homo sapiens
aggauaaguuuucaaagcugauaauagagagagccaaccccgcaugcagaauaacugagcgaggggggguggcgcaagcuacuagagggagcccaggcuuuuacaauagcggccccagaacagcaaaggaagguuccgaauaaaguuugaagggggugggggugggagaagaagcgcgugugcgugagugugggucuuugcacucugccccuuuuuucauuucauacaaccacagacagauauauggaguacuugggauaauucacuaauaaauccuuguuacaaggaaaacggcaccacagccugcacgacauauucagacaagauucauuuagaagcgugcaugcauucuuuugaccuacacugcgucgaaaggaaaacccacauaggaggugucaugcccuggaccucgguugagauucaaaacuugggucuugaucucucucgcgcucucucucucuuucucucuccauugucucuagaaaaacuguggcaaggacagagacaaucauaaucgcauccaucucaagaaaauauuuacauuuguuuugcacaaaagggauggccgucuuuuuccaaagcgagaacacagagucagagaaagccaacucaaaagucccuucgcaaguuuuuaacuacaccgaucccaucuuuauacaacaaaugcaguuuugacaagagcauauggcagugaaaaauacuggcgcggcauggggaaaagaagcaugcaugcaaaacacacgacaucugguucgagucccccuuugcuaccaccuagaaauugcgguuugauuuugguccuuucccuccgggggucaaguggagucugagaucucucagacagcgugggaggcugcgggccccggagccugcccucccgugggccgagcgugcagccucccucuucccucccggcccggcaccgcggccccucccgccgcucucccuccuccuuggcagccgggcccgcccgcugcucacuugagcaaguccuuggacucggccgacagccgggccauguuggcuguggagagagcggacaggugcggcggcggcggcaucuggcagauggugcaggggcagggcagaccagcccagugcuggaagccgcugcccagcugcagcgcgggcggcguggagggcgccuugaguagcgaguggggaggccggauggugccgauggcgggaagugaggcggcggacagcggugacgaggcguugccagaugagagcgcgccgcccaagauggggugcaccgggugcacggaguuggccgcgugcgcgggguggccggccgaguggcccacggucccgcagugaaaggccgagugguggcccccauagaucucgccaaccagccucuucaucuccuccagggagcuggugagcaugaggauguaguuucuggcgagcaggaguguggcgaucuuggagagcuugcgcaccgacggcccaugcgcguagggcaugacuucgcgcagcccguccauggcuagguucaggucgugcauccgcuugcguucgcguccguugaucuucagccucaacugcuguagguccugcuccgacagcugcuucuugauuuuguacuugcugcucucucccgcggccuuggcgccagcccgcgagaggcuuuccccgggcaucuucugcaucauaucgcccugcguggacgagaccgaguugagacggcucuccuggugguggugguggcgguggugguggucccucagguacaucucauccauguccggagaugaagcucugcuggagacagagcucgaaucagaauucauuuuauuacaggggaugcggcccuaccguggggaggcuuuaggcgggaaauuaaagaaaaucuugaauuaaaaaaaaaaaaucugcacugcccaggaacccacuucuccgcggcaagacgugagaagaaaagcggagacgcugcuuuuccccgccucucucccucccacgccccucucucugguuaggcugcuuccuggacagcuaguuggugugugcuugaacuaaccucacgcugaaaaagaggggcuuuuauagagcugcggcggagaaaagagacaaaaggagcccuccuaucuauccugggcugguuaggaugacgugccaucauucagggcggugcgcuuugcugucccauuuagcaaggauuccuauucauauucauuguggggccgcccugggacaccucugcuccgaaccgcuaggagcccccaggcacaaaacccucugauugacacacucaccgcuccagcuuacgccuuccugauuuuuuuuuuaacuuucuuccaccccaccccccuucccaauuucucuaaccaaaucacacaucaggaacggaaggaaggcaagagaagguggccaggcgguugguggagguuccucugaguuuggagagaggaauugaaacauucgcucuccuuucuuuccuggcugcucccaaguuuagagaaauaugggcaaaaauaggucucaguggaaagguuugagggacagaggugcggucggagggaaggugcugccagcgggggcuggggguggugggaagacugcaugccgacuuucucugucucaauauuuuuuuuucauuagaucucuuuuccuaaacacuuccauucugucaauuuuguuuauugggcccuucuggugugguuucaacgggauguccauguucggugauggcuuugcuccuggcaguauuguggcggagaggucucuuauuuucuguguccucucuuucguuuuaaaacauggauuucuaaaagaauuucaguuuugcacaauucuuuaacuuccuagaccaaaaacugcgaaaaaaaaauguuaaugucacaagaaaagcaacuugggaggaugggaaggaaaaggagccaaggaggcagagagagagauuguuagguuccugagagcuccagagagauuguucccacuccaggcuuccuggaccuuggcgcuggcgcaaaacggugggacgguccgcgcccgaagcuccgccg

SEQ ID NO: 20683 - RNA, 1002 nt, Homo sapiens
ccucgggggugcaacgcuggggucucggggaaaggaaaccacagcccggacgagcuuccccccacugagcugccagaauaguuucccccuccgggggccaccgcagagugcgcggaggcuggagaccccuuggagagguccccgcgccccgcccggccgguccuccacgcggcgcugccucggacugcaauggcaaugaagcuuuugccucucaaagaacuacuuagaaguaggacaucucggccuucagccccuucauuucuuuuuccccuugguccuucucucuuuaucucucucucacuuaugcccugcuucaaaguaacagcuuuacgcgugaccccgccugcacccuuaucuggguguccuggguuucgcccaaaagguugggcugagugggagcuucugggagcgcacggucccgcguagggucccgcucacccggaccccgaacgcccucgccacgccccggugggauccuccccuccccgccugguugcacuuucuccucccgacuucccagcuagcgccugcccuccauggagcggugcucgcucccucugcgcucacaaguccccucuuuggcccucuccugccacgccuggggccgaggucugauugagucugucccugucccuggguugaggcauugggggugacgacuggaugauguuucugugauacgcgcggcucugagcgcucccacacguugcagaggacacauugacguucccggcuucuccuucccgcgccucgacacuucauaauuaccugacacaaugcgauauggggguguccauuguuccacugcauguuacuguggaguguucguuaugacagugguggaacuuaaaauuacacaauuuuuuuaaguuccuaaaagaaugaauuccguguggggauaugaguaagcuuuccauuaaaucucaguuuggccugucaaacgaggcucauucuggguauuacaucgccuaauuugcauuuuagcauuguuuuguuucuuaa

SEQ ID NO: 20684 - RNA, 1002 nt, Homo sapiens
uuaagaaacaaaacaaugcuaaaaugcaaauuaggcgauguaauacccagaaugagccucguuugacaggccaaacugagauuuaauggaaagcuuacucauauccccacacggaauucauucuuuuaggaacuuaaaaaaauuguguaauuuuaaguuccaccacugucauaacgaacacuccacaguaacaugcaguggaacaauggacacccccauaucgcauugugucagguaauuaugaagugucgaggcgcgggaaggagaagccgggaacgucaauguguccucugcaacgugugggagcgcucagagccgcgcguaucacagaaacaucauccagucgucacccccaaugccucaacccagggacagggacagacucaaucagaccucggccccaggcguggcaggagagggccaaagaggggacuugugagcgcagagggagcgagcaccgcuccauggagggcaggcgcuagcugggaagucgggaggagaaagugcaaccaggcggggaggggaggaucccaccggggcguggcgagggcguucgggguccgggugagcgggacccuacgcgggaccgugcgcucccagaagcucccacucagcccaaccuuuugggcgaaacccaggacacccagauaagggugcaggcggggucacgcguaaagcuguuacuuugaagcagggcauaagugagagagagauaaagagagaaggaccaaggggaaaaagaaaugaaggggcugaaggccgagauguccuacuucuaaguaguucuuugagaggcaaaagcuucauugccauugcaguccgaggcagcgccgcguggaggaccggccgggcggggcgcggggaccucuccaaggggucuccagccuccgcgcacucugcgguggcccccggagggggaaacuauucuggcagcucaguggggggaagcucguccgggcugugguuuccuuuccccgagaccccagcguugcacccccgagg

SEQ ID NO: 20685 - RNA, 580 nt, Homo sapiens
ugaauucccagaagucacugauguacuacaguuuacuguaacuaaaguuauaacaaauuuagaagacuuggaggacaagcucugcuuccacuuguacauugaugaggauauucccccaaaauccucccucacacucagaaaaaaacuguuuuccaaaggcaaaaaaagguaaacaacuucuguaaggguuuucucauauagacauguuugauaaaaaugaggaauauggguaucauuuccauguaagaauguguguuuguucaaauguaaacauaacauucuguggaaguccuucaaggagguuuuuacauucuuccacuucucuaaauaggaugcucuuaaaaaaaaaaaaguuggaugcaaaguuguuuuucccucaguuaugauuuaagcaaaccugcuuauuuuuauuuaguuccaacauguagagucaugacgccaaacacauguuaaaaauaaaauaaaauagaaaacuucagccaacccggaauaguuugacgagugugagcuggaaccacuacugaaauuucaaugaauuggcaauuaugucuagaacugaaaggguuaaugauucauaagg

SEQ ID NO: 20686 - RNA, 580 nt, Homo sapiens
ccuuaugaaucauuaacccuuucaguucuagacauaauugccaauucauugaaauuucaguagugguuccagcucacacucgucaaacuauuccggguuggcugaaguuuucuauuuuauuuuauuuuuaacauguguuuggcgucaugacucuacauguuggaacuaaauaaaaauaagcagguuugcuuaaaucauaacugagggaaaaacaacuuugcauccaacuuuuuuuuuuuuaagagcauccuauuuagagaaguggaagaauguaaaaaccuccuugaaggacuuccacagaauguuauguuuacauuugaacaaacacacauucuuacauggaaaugauacccauauuccucauuuuuaucaaacaugucuauaugagaaaacccuuacagaaguuguuuaccuuuuuuugccuuuggaaaacaguuuuuuucugagugugagggaggauuuugggggaauauccucaucaauguacaaguggaagcagagcuuguccuccaagucuucuaaauuuguuauaacuuuaguuacaguaaacuguaguacaucagugacuucugggaauuca

SEQ ID NO: 20687 - RNA, 2836 nt, Homo sapiens
ucccagugccugcacgcugugguaguucaaaagacacgagggggaggggcacagcagcucugcuucccagcgccuugggagacugaagugaaaggaacgcuugagcccaggaguucgagaccauccugggcaacaaagcaagaccgccccucaccccauacaaaauaaaaauacaaauaaauuagccgggcacaguggcgcaugccuguagucucagcuacugggaaggcugaagugggaggauagcuugagcccaggagaucaaggcugcagugagcugugauugcaccacugcaguccagccugggcgacagaaggagaccguuuuuugguuuuguuuguucguuuaaaaaaaaaaagaagcaagagcucacugugaacuccugguuccuuccuccccuccucacacuucccagaacucuuccugucacgguuccuggccagaacgcugggauacuaucuacaagcuguaguaggcuuguaguaauggaauguccgcuugagggguccccgcacagccaaccccugccucuggagugggaucuaugggggugggguucuaagcgccucuggggagugugagguagcaucucaggguguggcagaggcucggacacccccaaaaggucugcgaauggaagggacauaggcaggaucucucucagugauguccccugucuuccaggaugaagagaggcagugaaacaccaggagagcagggcguccuuuagaauuccuggacccuucuccaggcugcuagucaggacaaugagcucgugguugucuuugccacuaucuuccugugcgauuucagacaagccaccucccucacuaagccuaaauuuccccauguguaacgugcaggcauuguacccuagaggcaucaaaguccccuccaggacagaugcuaaggaaagauaggcuaggagcaaagccgucugagguggccugaccagagccacacgaggcucuucucacugggcgaggcucuuugaggaaccgagaguugcugggacccagcccgcccucgagagagcaaacagagcggcgcuccccucccccgaccccggcccuuuguccggaauccagcugugcccugcgggggaggagcgggcucgcguggcgcggccccagggccccggcgcugauuggccgguggcgcgggcagcagccgggcaggcacgcuccuggcccgggcgaagcagauaaagcgugccaaggggcacacgacuugcugcucaggaaaucccugcggucucaccgccgcgccucgagagagagcgugacagaggccucggaccccauucucucuucuuuucuccuuuggggcuggggcaacucccaggcgggggcgccugcagcucagcugaacuuggcgaccagaagcccgcugagcuccccacggcccucgcugcucaucgcucucuauucuuuugcgccgguagaaagguaauauuuggaggccuccgagggacgggcaggggaaagagggauccucugacccagcgggggcugggaggauggcuguuuuuguuuuuucccaccuagccucggaaucgcggacugcgcccagugacggacucaaacuuacccuucccucugaccccgccguaggaugacgccucaacccucgggugcgcccacuguccaagugacccgugagacggagcgguccuuccccagagccucggaagacgaagugaccugccccacguccgccccgcccagccccacucgcacacgggggaacugcgcagaggcggaagagggaggcugccgaggggccccgaggaagcuccgggcacggcgcgggggacgcagccggccuaagagcgaguuggcacugagcaagcagcgacggagucggcgaaagaaggccaacgaccgcgagcgcaaucgaaugcacaaccucaacucggcacuggacgcccugcgcgguguccugcccaccuucccagacgacgcgaagcucaccaagaucgagacgcugcgcuucgcccacaacuacaucugggcgcugacucaaacgcugcgcauagcggaccacagcuuguacgcgcuggagccgccggcgccgcacugcggggagcugggcagcccaggcgguucccccggggacugggggucccucuacuccccagucucccaggcuggcagccugagucccgccgcgucgcuggaggagcgacccgggcugcugggggccaccuuuuccgccugcuugagcccaggcagucuggcuuucucagauuuucugugaaaggaccugucugucgcugggcugugggugcuaaggguaagggagagggagggagccgggagccguagaggguggccgacggcggcggcccucaaaagcacuuguuccuucugcuucucccuggcugaccccuggccggcccaggccuccacgggggcggcaggcuggguucauuccccggcccuccgagccgcgccaacgcacgcaacccuugcugcugcccgcgcgaagugggcauugcaaagugcgcucauuuuaggccuccucucugccaccaccccauaaucucauucaaagaauacuagaaugguagcacuacccggccggagccgcccaccgucuugggucgcccuacccucacucaagucugucugccucucagucucuuaccaccccuccuccaaugugauucaauccaauguuuggucucucagcgcuuacuccccuugccuugcuccaaagacgcugccgaucugcucuacucccaaucagguccgggauuucagggcgccucacucugccuuaaagccacgaaggcgacccucugccuucuccucgugcacuuuucggagccau

SEQ ID NO: 20688 - RNA, 2836 nt, Homo sapiens
auggcuccgaaaagugcacgaggagaaggcagagggucgccuucguggcuuuaaggcagagugaggcgcccugaaaucccggaccugauugggaguagagcagaucggcagcgucuuuggagcaaggcaaggggaguaagcgcugagagaccaaacauuggauugaaucacauuggaggaggggugguaagagacugagaggcagacagacuugagugaggguagggcgacccaagacggugggcggcuccggccggguagugcuaccauucuaguauucuuugaaugagauuauggggugguggcagagaggaggccuaaaaugagcgcacuuugcaaugcccacuucgcgcgggcagcagcaaggguugcgugcguuggcgcggcucggagggccggggaaugaacccagccugccgcccccguggaggccugggccggccaggggucagccagggagaagcagaaggaacaagugcuuuugagggccgccgccgucggccacccucuacggcucccggcucccucccucucccuuacccuuagcacccacagcccagcgacagacagguccuuucacagaaaaucugagaaagccagacugccugggcucaagcaggcggaaaagguggcccccagcagcccgggucgcuccuccagcgacgcggcgggacucaggcugccagccugggagacuggggaguagagggacccccaguccccgggggaaccgccugggcugcccagcuccccgcagugcggcgccggcggcuccagcgcguacaagcugugguccgcuaugcgcagcguuugagucagcgcccagauguaguugugggcgaagcgcagcgucucgaucuuggugagcuucgcgucgucugggaaggugggcaggacaccgcgcagggcguccagugccgaguugagguugugcauucgauugcgcucgcggucguuggccuucuuucgccgacuccgucgcugcuugcucagugccaacucgcucuuaggccggcugcgucccccgcgccgugcccggagcuuccucggggccccucggcagccucccucuuccgccucugcgcaguucccccgugugcgaguggggcugggcggggcggacguggggcaggucacuucgucuuccgaggcucuggggaaggaccgcuccgucucacgggucacuuggacagugggcgcacccgaggguugaggcgucauccuacggcggggucagagggaaggguaaguuugaguccgucacugggcgcaguccgcgauuccgaggcuaggugggaaaaaacaaaaacagccauccucccagcccccgcugggucagaggaucccucuuuccccugcccgucccucggaggccuccaaauauuaccuuucuaccggcgcaaaagaauagagagcgaugagcagcgagggccguggggagcucagcgggcuucuggucgccaaguucagcugagcugcaggcgcccccgccugggaguugccccagccccaaaggagaaaagaagagagaaugggguccgaggccucugucacgcucucucucgaggcgcggcggugagaccgcagggauuuccugagcagcaagucgugugccccuuggcacgcuuuaucugcuucgcccgggccaggagcgugccugcccggcugcugcccgcgccaccggccaaucagcgccggggcccuggggccgcgccacgcgagcccgcuccucccccgcagggcacagcuggauuccggacaaagggccggggucgggggaggggagcgccgcucuguuugcucucucgagggcgggcugggucccagcaacucucgguuccucaaagagccucgcccagugagaagagccucguguggcucuggucaggccaccucagacggcuuugcuccuagccuaucuuuccuuagcaucuguccuggaggggacuuugaugccucuaggguacaaugccugcacguuacacauggggaaauuuaggcuuagugagggagguggcuugucugaaaucgcacaggaagauaguggcaaagacaaccacgagcucauuguccugacuagcagccuggagaaggguccaggaauucuaaaggacgcccugcucuccugguguuucacugccucucuucauccuggaagacaggggacaucacugagagagauccugccuaugucccuuccauucgcagaccuuuuggggguguccgagccucugccacacccugagaugcuaccucacacuccccagaggcgcuuagaaccccacccccauagaucccacuccagaggcagggguuggcugugcggggaccccucaagcggacauuccauuacuacaagccuacuacagcuuguagauaguaucccagcguucuggccaggaaccgugacaggaagaguucugggaagugugaggaggggaggaaggaaccaggaguucacagugagcucuugcuucuuuuuuuuuuuaaacgaacaaacaaaaccaaaaaacggucuccuucugucgcccaggcuggacugcaguggugcaaucacagcucacugcagccuugaucuccugggcucaagcuauccucccacuucagccuucccaguagcugagacuacaggcaugcgccacugugcccggcuaauuuauuuguauuuuuauuuuguauggggugaggggcggucuugcuuuguugcccaggauggucucgaacuccugggcucaagcguuccuuucacuucagucucccaaggcgcugggaagcagagcugcugugccccucccccucgugucuuuugaacuaccacagcgugcaggcacuggga

SEQ ID NO: 20689 - RNA, 516 nt, Homo sapiens
caucuggacgcccccacgcagccgaccgcccagacgcgccgggaagggcgcccgcuccgcgcagcagcugaaggggggcggggagcgcgcgggcagaggaaggagggugucuccggcugaggauuucucucgaagcuccccacaguaauucugcuccuccuaggguuuacccucccagucccaaggugcccaaaauacuuaaacaaacaaacaacccaaaccuguuccguuuucgcuccuguauaaauagaacagacuuuccaaaaaagcaauacgcauucacucuuaucaccagccacuucuuuccaccaaguaauucagaaaaaagcagucagcuuccgugaaugcauguagcuuuuuuuuucuucgcugccuccuuuugcuugcgguuuugagcugccaagaaagugaguagggguuugacuguagugucucggcuccgcucgguuucuuuccgaaguuuaauuuuccggaauggcucccaaacaagggcuagggaggcggagccgccggcac

SEQ ID NO: 20690 - RNA, 516 nt, Homo sapiens
gugccggcggcuccgccucccuagcccuuguuugggagccauuccggaaaauuaaacuucggaaagaaaccgagcggagccgagacacuacagucaaaccccuacucacuuucuuggcagcucaaaaccgcaagcaaaaggaggcagcgaagaaaaaaaaagcuacaugcauucacggaagcugacugcuuuuuucugaauuacuugguggaaagaaguggcuggugauaagagugaaugcguauugcuuuuuuggaaagucuguucuauuuauacaggagcgaaaacggaacagguuuggguuguuuguuuguuuaaguauuuugggcaccuugggacugggaggguaaacccuaggaggagcagaauuacuguggggagcuucgagagaaauccucagccggagacacccuccuuccucugcccgcgcgcuccccgccccccuucagcugcugcgcggagcgggcgcccuucccggcgcgucugggcggucggcugcgugggggcguccagaug

SEQ ID NO: 20691 - RNA, 1913 nt, Homo sapiens
acaggagagagucaguggcaaauagacauuuuucuuauuucuuaaaaaacagcaacuuguuugcuacuuuuauuucuguugauuuuuuuuucuugguguguguggugguuguuuuuaaguguggagggcaaaaggagauaccaucccaggcucaguccaaccccucuccaaaacggcuuuucugacacuccagguagcgagggaguugggucuccagguugugcgaggagcaaaugaugaccgccaaggccguagacaaaaucccaguaacucucagugguuuugugcaccagcugucugacaacaucuacccgguggaggaccucgccgccacgucggugaccaucuuucccaaugccgaacugggaggccccuuugaccagaugaacggaguggccggagguaagccgcgugucuucgcaggcccggaccugcgcggcccggaggugguggauggggugcagugggugugcgggaaucgcaggagaggauuggggcuccagguggacggugcugacugcacuggcuuugaagacuggaagugggugcaggaggaaccugcgacagcugagaccagggcgcgcgggcagaugcgccaggucgccagcaaaccggcgugcgugcgccccggcgcgcccagccccgggcgagcgcagggauggggguggaagaggcguccccccggguuucgaggcuugcguaggcccucuggccggcagcacuucgaccuccccucucccggggcaggggcaaagugacgguaaaguucggggcucucggggagagcugcgcgccuggagagccgagcggcggagaagcgccaggggaaagcgucgguagcucccuccugggcagagccgaccccgggaaaaucucggagcgcucccuucuugcggccuggaggcgcgcccccaccugcccgccgcccgcgaaguugaggggguuaguaaggcgggggcuccggccggcggaggcagcgagugggugguggaggagggcgcgcaacggcgggaagcagcccccggacugccgagggaggcccgcgggggcaccggcgacgccgguuuccuuggcgaugcuguggaaagucgucucucgcggcccccgcgccuuccucgaggccgggccacuggccuugggcugaggcggggacgcgcggcugucgggaaaggcggagaagauugggagggcacggaaaccuacggacuccuuccucuacaucccccauucgcuccagcagcccucggcugaagcgcagcgggagagggagggagaaaaaggcacaaggcgccggggauggggagcagccgggaaaucacccacccccuucucgggcucuccucucgguuuggcaccaucacggcacugacugggauaggucgauucuugggugguguuugucuuggugccucagccguggaacccccaggcaaaaaagagggagaaaagcuccgggcggaugaggcuuuuuaaaauauuguuguugcuauuauuggguguuuuuuauuggggacuagagccacagauggcuggggguggaggggaguugggaaaagcucauucugcuuuuuuggagguaguucuugaguuccauacugucaauggguugccacaguugggcuggccucuucuuacagucugugggccucaauuuccccaccuuuuggacuuugccacagcucuacagugcugagacucucggccuuggaaauggaccuaugugagcgggggugagaagggaguccuggcuguauuuucauuguuccaccuccauucugccuuuccccuccccagauggcaugaucaacauugacaugacuggagagaagaggucguuggaucucccauaucccagcagcuuugcucccgucucugcaccuagaaaccagaccuucacuuacaugggcaaguuc

SEQ ID NO: 20692 - RNA, 1913 nt, Homo sapiens
gaacuugcccauguaagugaaggucugguuucuaggugcagagacgggagcaaagcugcugggauaugggagauccaacgaccucuucucuccagucaugucaauguugaucaugccaucuggggaggggaaaggcagaauggagguggaacaaugaaaauacagccaggacucccuucucacccccgcucacauagguccauuuccaaggccgagagucucagcacuguagagcuguggcaaaguccaaaagguggggaaauugaggcccacagacuguaagaagaggccagcccaacuguggcaacccauugacaguauggaacucaagaacuaccuccaaaaaagcagaaugagcuuuucccaacuccccuccacccccagccaucuguggcucuaguccccaauaaaaaacacccaauaauagcaacaacaauauuuuaaaaagccucauccgcccggagcuuuucucccucuuuuuugccuggggguuccacggcugaggcaccaagacaaacaccacccaagaaucgaccuaucccagucagugccgugauggugccaaaccgagaggagagcccgagaagggggugggugauuucccggcugcuccccauccccggcgccuugugccuuuuucucccucccucucccgcugcgcuucagccgagggcugcuggagcgaaugggggauguagaggaaggaguccguagguuuccgugcccucccaaucuucuccgccuuucccgacagccgcgcguccccgccucagcccaaggccaguggcccggccucgaggaaggcgcgggggccgcgagagacgacuuuccacagcaucgccaaggaaaccggcgucgccggugcccccgcgggccucccucggcaguccgggggcugcuucccgccguugcgcgcccuccuccaccacccacucgcugccuccgccggccggagcccccgccuuacuaacccccucaacuucgcgggcggcgggcaggugggggcgcgccuccaggccgcaagaagggagcgcuccgagauuuucccggggucggcucugcccaggagggagcuaccgacgcuuuccccuggcgcuucuccgccgcucggcucuccaggcgcgcagcucuccccgagagccccgaacuuuaccgucacuuugccccugccccgggagaggggaggucgaagugcugccggccagagggccuacgcaagccucgaaacccggggggacgccucuuccacccccaucccugcgcucgcccggggcugggcgcgccggggcgcacgcacgccgguuugcuggcgaccuggcgcaucugcccgcgcgcccuggucucagcugucgcagguuccuccugcacccacuuccagucuucaaagccagugcagucagcaccguccaccuggagccccaauccucuccugcgauucccgcacacccacugcaccccauccaccaccuccgggccgcgcagguccgggccugcgaagacacgcggcuuaccuccggccacuccguucaucuggucaaaggggccucccaguucggcauugggaaagauggucaccgacguggcggcgagguccuccaccggguagauguugucagacagcuggugcacaaaaccacugagaguuacugggauuuugucuacggccuuggcggucaucauuugcuccucgcacaaccuggagacccaacucccucgcuaccuggagugucagaaaagccguuuuggagagggguuggacugagccugggaugguaucuccuuuugcccuccacacuuaaaaacaaccaccacacacaccaagaaaaaaaaaucaacagaaauaaaaguagcaaacaaguugcuguuuuuuaagaaauaagaaaaaugucuauuugccacugacucucuccugu

SEQ ID NO: 20693 - RNA, 637 nt, Homo sapiens
ggcaccuuccacaccccugcccgggcugggggcuccgagagcggccgcgaagcgacuccgauccucccucugagccuugcucagcucugccccgcgccucccgggcuccgguccgcgcggcggggucccugcuccugcgccccgggcgcgcuucccggacaccccgguccccgcagccaggacaaagccaugaagccagcgcugcuggaagugaugaggaugaacagaaucugccggauggugcuggccacuugcuugggauccuuuauccuggucaucuucuauuuccaaaguauguugcacccagguagggggcgcguuagcgugguuuuguuggauauuuucuucucucucgcgcucuagcucgcuccgccugauuucugccucuuccaacccuaccucuccgccuucggccucuucggggcuccuggcugcccagagcuccuggcugcccagaucuacccgggucaccgcgucgggauggggaggagaagggaaggugugcuucgcccucuucuuccuaccggcuccgggcuggaggaugggaccaggaggggcgguaguuuuuuuuuuuuuuuuuuucuucuucuuuuuuucuuugugucccuugucugucugucugcgagguagcagggaa

SEQ ID NO: 20694 - RNA, 637 nt, Homo sapiens
uucccugcuaccucgcagacagacagacaagggacacaaagaaaaaaagaagaagaaaaaaaaaaaaaaaaaaacuaccgccccuccuggucccauccuccagcccggagccgguaggaagaagagggcgaagcacaccuucccuucuccuccccaucccgacgcggugacccggguagaucugggcagccaggagcucugggcagccaggagccccgaagaggccgaaggcggagagguaggguuggaagaggcagaaaucaggcggagcgagcuagagcgcgagagagaagaaaauauccaacaaaaccacgcuaacgcgcccccuaccugggugcaacauacuuuggaaauagaagaugaccaggauaaaggaucccaagcaaguggccagcaccauccggcagauucuguucauccucaucacuuccagcagcgcuggcuucauggcuuuguccuggcugcggggaccgggguguccgggaagcgcgcccggggcgcaggagcagggaccccgccgcgcggaccggagcccgggaggcgcggggcagagcugagcaaggcucagagggaggaucggagucgcuucgcggccgcucucggagcccccagcccgggcagggguguggaaggugcc

SEQ ID NO: 20695 - RNA, 2102 nt, Homo sapiens
cagagguaauagcauuacauguuaaaguaucaagauauacacauuuuaaaccauuuguacaaaacuucuauaaauuuuucucucucuuucucucuuauguacaaaaauaucuuaauauauccccgaacugguuaggauagauacaaauagauuuuuuauaauaaaaaauucacaaaagauuggaagcauucuauaaugaaaaugguagaaaagacagugugagggaagccaugggguuugggaaucgggcccuggaggagaagcagaguuucaaagggcugagaauagcauaguuucacuguaaaccaaugucuacagcuuauuggggugggggcuacugagacgaaagacaccaacucguuucuagagggcuaagaacugcacuuuaagaaagggcgaggaggugaagggacccgagcaagaacuuucagcugugcguguuagaggugaugggaguuacuauaacgcgugugcugcucccuucugccaggagcccacugcuuuugcacacaagcugcauuuugcgcauugacucaggucccaguugcucuucauaucuccgugaaugauuggagugcaaagauacuguucugagcgcuucccguuuucugaaagccaugucucucaggcaugccucgcuuaguuggcgaugggguugguugacuguuuucguuuuuuucuucuucucuuuucuucuucuucuucuuuuuuuuuucuuuuccuuuucucccccucccaacgccacugacaagaaagcacuaaagaugcagguugugcgaucacccuauaacauaaggaaaagaacaggagagguuaauuugaacguguaggcuagugguagagggagauggaggucuggggaaagagucugucagguagacaucucuuuuaacaugucccaguauucgguucaccaguaucucugcaccucacuacuacccuucacuccuuggagaccugggcaaggccauuuucagaggccagugcugaaacuaacaaacuaggacuugaaaucgaccaacuuucacaaauucuuuaaauaaaaauccccuuaucuccuuggagacauccccacuuccacagacacucagagggaggacgaaggcaagaauaccccccugcccaccccaaaaugcaaccuaccugcuuccaaaguccauucgcaccagggccugaccaggccgagccccucagaaccaguuggugaagucgagaagcuccugcuccucggggcugagcgggucguaagagcccucguccgacgaguaggaugagaccggcgagccggccauggaguucaagucguuggaguaguugggggagauggugggcgacaggacgccugccuggaaggcggcgcucaccgcgucaugcucguccagcagcugcugcagcgcgcggauguacucgaccgccgagcgcagugucuccaccuuacucaucuucuuguuggccgcgccguuggggacgugcucccgaaggguggcaaagcccagguugaccaacuugacgcgguugcgcucgcgcucguugcggcgcgccacggcggccggcugcugcugcggcaggcuguagccaaagccgcugaaguugagccggcguuugcagcgcaucaguucgggcgaagacgagcgcugucgcuugacuugcuugggcgcugacuugugaccgcccccugagggcuggccgucggccgccggucucagcugcggcgccugcugcugcugcugcugcugcugcugcugcugcugcgcgcucugcgcugccgcugcggcggcugcggccgccgcggcugcggccguggcaaagaaacaggcugcgggcggcaggaagggcugcuggggcugcggcuggggcugcuggccggcgccgccgcucuccaucuuggcagagcuuuccaugcgcagcggcggccaaggagucgcggaaucagagcgauccgggacgcgaggugcggggcccgcgagggggacacagagagaacuugggugcaggaacagagagggaaagaaaaggaaauaugaagcgggagcccugacggaaguuaaaaaauauauacaaaauccccgggagacuucuuagagugggagcaaaaaaaguga

SEQ ID NO: 20696 - RNA, 2102 nt, Homo sapiens
ucacuuuuuuugcucccacucuaagaagucucccggggauuuuguauauauuuuuuaacuuccgucagggcucccgcuucauauuuccuuuucuuucccucucuguuccugcacccaaguucucucugugucccccucgcgggccccgcaccucgcgucccggaucgcucugauuccgcgacuccuuggccgccgcugcgcauggaaagcucugccaagauggagagcggcggcgccggccagcagccccagccgcagccccagcagcccuuccugccgcccgcagccuguuucuuugccacggccgcagccgcggcggccgcagccgccgcagcggcagcgcagagcgcgcagcagcagcagcagcagcagcagcagcagcagcaggcgccgcagcugagaccggcggccgacggccagcccucagggggcggucacaagucagcgcccaagcaagucaagcgacagcgcucgucuucgcccgaacugaugcgcugcaaacgccggcucaacuucagcggcuuuggcuacagccugccgcagcagcagccggccgccguggcgcgccgcaacgagcgcgagcgcaaccgcgucaaguuggucaaccugggcuuugccacccuucgggagcacguccccaacggcgcggccaacaagaagaugaguaagguggagacacugcgcucggcggucgaguacauccgcgcgcugcagcagcugcuggacgagcaugacgcggugagcgccgccuuccaggcaggcguccugucgcccaccaucucccccaacuacuccaacgacuugaacuccauggccggcucgccggucucauccuacucgucggacgagggcucuuacgacccgcucagccccgaggagcaggagcuucucgacuucaccaacugguucugaggggcucggccuggucaggcccuggugcgaauggacuuuggaagcagguagguugcauuuuggggugggcagggggguauucuugccuucguccucccucugagugucuguggaaguggggaugucuccaaggagauaaggggauuuuuauuuaaagaauuugugaaaguuggucgauuucaaguccuaguuuguuaguuucagcacuggccucugaaaauggccuugcccaggucuccaaggagugaaggguaguagugaggugcagagauacuggugaaccgaauacugggacauguuaaaagagaugucuaccugacagacucuuuccccagaccuccaucucccucuaccacuagccuacacguucaaauuaaccucuccuguucuuuuccuuauguuauagggugaucgcacaaccugcaucuuuagugcuuucuugucaguggcguugggagggggagaaaaggaaaagaaaaaaaaaagaagaagaagaagaaaagagaagaagaaaaaaacgaaaacagucaaccaaccccaucgccaacuaagcgaggcaugccugagagacauggcuuucagaaaacgggaagcgcucagaacaguaucuuugcacuccaaucauucacggagauaugaagagcaacugggaccugagucaaugcgcaaaaugcagcuugugugcaaaagcagugggcuccuggcagaagggagcagcacacgcguuauaguaacucccaucaccucuaacacgcacagcugaaaguucuugcucgggucccuucaccuccucgcccuuucuuaaagugcaguucuuagcccucuagaaacgaguuggugucuuucgucucaguagcccccaccccaauaagcuguagacauugguuuacagugaaacuaugcuauucucagcccuuugaaacucugcuucuccuccagggcccgauucccaaaccccauggcuucccucacacugucuuuucuaccauuuucauuauagaaugcuuccaaucuuuugugaauuuuuuauuauaaaaaaucuauuuguaucuauccuaaccaguucggggauauauuaagauauuuuuguacauaagagagaaagagagagaaaaauuuauagaaguuuuguacaaaugguuuaaaauguguauaucuugauacuuuaacauguaaugcuauuaccucug

SEQ ID NO: 20697 - RNA, 594 nt, Homo sapiens
gcggcgggggggcggcgggggggagggaaggggggccgggggacggcguggggugauguuugccuuuccagagaaaaagcgccuccuuuaagugaaacgagacacgggagcgcgcggaaacaggcugggggccaggaggagaccuguccugcuuuuugcaucccuagggacucguuuuccuuuagguuucuaacucccaggguuagccuuaaacuccagaggggcuccaggaggggagacuggguggagaacuucucucccagauacuucucacgccuuuucuccaagcuuucuuuuggagggacgccccacacaccccggguggcccgggcgcggagggggagcggcgccgcgugguuaaguuucugaaagucaaacccaguccccggucuccggucuccgccccggggcuccagcugcacgcggggagcugcggcuguucuggcaaaggggccgcggcugcuuuaagagccgccucccccucuccuccuuugacaauggucugaaccgagcuuugcuucccaaagcaaaauuuguaauaugccauuuuuccgauggacgcuucuccuuuuggcugcugacggagccacggga

SEQ ID NO: 20698 - RNA, 594 nt, Homo sapiens
ucccguggcuccgucagcagccaaaaggagaagcguccaucggaaaaauggcauauuacaaauuuugcuuugggaagcaaagcucgguucagaccauugucaaaggaggagagggggaggcggcucuuaaagcagccgcggccccuuugccagaacagccgcagcuccccgcgugcagcuggagccccggggcggagaccggagaccggggacuggguuugacuuucagaaacuuaaccacgcggcgccgcucccccuccgcgcccgggccacccgggguguguggggcgucccuccaaaagaaagcuuggagaaaaggcgugagaaguaucugggagagaaguucuccacccagucuccccuccuggagccccucuggaguuuaaggcuaacccugggaguuagaaaccuaaaggaaaacgagucccuagggaugcaaaaagcaggacaggucuccuccuggcccccagccuguuuccgcgcgcucccgugucucguuucacuuaaaggaggcgcuuuuucucuggaaaggcaaacaucaccccacgccgucccccggccccccuucccucccccccgccgcccccccgccgc

SEQ ID NO: 20699 - RNA, 1510 nt, Homo sapiens
cuggggaaacugguuuugacagcgucagaaaggacugacuagugcagagcaaaugugggacagccagagagaacggaugcccaugaaauaaggaaaaggcgaguugaggcugggggcgguguggcuacacucgggcagagcccgucccgacucuuagcagagggcgcugcgaaagcgccuucucgcuguccugagguguggagauccugcagauaaaguacaagugcgcgggagggggaggccggagugggcaguacccuccgccugcuugcggcuuaaagcuacauggguuccuuuucauucacugaggacucguccugagauggacaguccagacauggaacuuuuagagauuucuccucgaccgagaugaucagagagguccugaaugucugccuugcacaaaguuccgguuuugcccaucacacucaaacuuucuagggaugggaaaugagagaggaggaguuugcaguaucaaaggcauacacuaguugggcacccgagaaagagcagaagcucccuauucccaagcccagucaacgcccuuggcgugggcacaggucaagcugaaaguccccgcccagguauccaaguguccgcuguguccgcucccccaggugcagggcgccgcgcacuucgggccgguguggcuagccagcuuugggacagugcgcaccguguacguggcugccccugcacucgucgaggagcugcugcgacaggagggaccccggcccgagcgcugcagcuucucgcccuggacggagcaccgccgcugccgccagcgggcuugcggacugcucacugcgugagucuucucugcccccagaagcccagacgcccugcagcggcccucuccugcugcgggucccgaaacuaucaaucugggggcauggugggaggucggcugucccacucuaccauugggcaucuugggguucccaucccagucugcuucacccacacucagguugagccccaaccucacuccccgccuaccuccuuauccuuugaggcccgaauccugggaacugggggaaccggaggaauugggcuaggguacaaggaucuggauggaaugaauguaagguucugugacucaaguuacccgggaaccccggccccugagggcaggaaaugaguaaagaggaagggggcuggaagacaggcgcaggccggugcagguuuccguaccccaagggggcagacgcaaucccucuccuggccaccgcagccgaacgcgcuccuucacugcagccagucccgucgagccguccccaccuucccgaugcgcacucucuccucaacccugcagggaaggcgaagaauggcaaaggcuccgcagucuccuggccccgcuccuccuccggccucaagcggccgcccgcuacgccggaacccugaacaacguagucugcgaccuugugcggcgucugaggcgccagcggggacguggcacggggccgcccgcccugguucgggacguggcgggggaauuuuacaaguucgg

SEQ ID NO: 20700 - RNA, 1510 nt, Homo sapiens
ccgaacuuguaaaauucccccgccacgucccgaaccagggcgggcggccccgugccacguccccgcuggcgccucagacgccgcacaaggucgcagacuacguuguucaggguuccggcguagcgggcggccgcuugaggccggaggaggagcggggccaggagacugcggagccuuugccauucuucgccuucccugcaggguugaggagagagugcgcaucgggaagguggggacggcucgacgggacuggcugcagugaaggagcgcguucggcugcgguggccaggagagggauugcgucugcccccuugggguacggaaaccugcaccggccugcgccugucuuccagcccccuuccucuuuacucauuuccugcccucaggggccgggguucccggguaacuugagucacagaaccuuacauucauuccauccagauccuuguacccuagcccaauuccuccgguucccccaguucccaggauucgggccucaaaggauaaggagguaggcggggagugagguuggggcucaaccugagugugggugaagcagacugggaugggaaccccaagaugcccaaugguagagugggacagccgaccucccaccaugcccccagauugauaguuucgggacccgcagcaggagagggccgcugcagggcgucugggcuucugggggcagagaagacucacgcagugagcaguccgcaagcccgcuggcggcagcggcggugcuccguccagggcgagaagcugcagcgcucgggccggggucccuccugucgcagcagcuccucgacgagugcaggggcagccacguacacggugcgcacugucccaaagcuggcuagccacaccggcccgaagugcgcggcgcccugcaccugggggagcggacacagcggacacuuggauaccugggcggggacuuucagcuugaccugugcccacgccaagggcguugacugggcuugggaauagggagcuucugcucuuucucgggugcccaacuaguguaugccuuugauacugcaaacuccuccucucucauuucccaucccuagaaaguuugagugugaugggcaaaaccggaacuuugugcaaggcagacauucaggaccucucugaucaucucggucgaggagaaaucucuaaaaguuccaugucuggacuguccaucucaggacgaguccucagugaaugaaaaggaacccauguagcuuuaagccgcaagcaggcggaggguacugcccacuccggccucccccucccgcgcacuuguacuuuaucugcaggaucuccacaccucaggacagcgagaaggcgcuuucgcagcgcccucugcuaagagucgggacgggcucugcccgaguguagccacaccgcccccagccucaacucgccuuuuccuuauuucaugggcauccguucucucuggcugucccacauuugcucugcacuagucaguccuuucugacgcugucaaaaccaguuuccccag

SEQ ID NO: 20701 - RNA, 882 nt, Homo sapiens
cgggcccugugcgcucugguccuucugcucgccugcgccucgcuggggcuccuguacgcgagcacccgggacgcgcccggccuccggcuaccucuugcgccgugggcgcccccgcaaagcccccgcaggcccgagcugccagaucuugcuccugagccccgcuacgcacacaucccggucaggaucaaggagcaaguaguggggugagugccgaccgcggcggcgcagcgcagcgcucgcuggggguggucugggggcuuuuguuuucuccacugcugggcucagaugccugcauucuccuaacgggcuguguggagugaagugggagguggaagugggaggcugcugaggcuugggcuggggaaaaucuguucucccugaaccuugccauggggauaaggauggggaugggcgugggagguugugcagucaagggagggcccugaaagacucccugagguccugauucagguaugagaagagacuccaggugggguccugguugguggguaggcagcuccugaaauccugguaauuggcccuauccuacaacucuaaaauccagauuuaggggauaggucauccgauccuuggucccccucccgaggacuauuugaagggcagcauuuaaggggacagagccuagacagacagaauugcagggccaagguguggggugcugugucaguguuuaugggaugaauggagcuguguagcugggcucugaugacccucacuaccuacccccuucaggcugcuggcuuggaacaacugcaguugugaguccaguggggggggccucccccuccccuuccagaaacaaguccgagcuauugaccucaccaaggccuuugacccugcagagcugagggcugccucugc

SEQ ID NO: 20702 - RNA, 882 nt, Homo sapiens
gcagaggcagcccucagcucugcagggucaaaggccuuggugaggucaauagcucggacuuguuucuggaaggggagggggaggccccccccacuggacucacaacugcaguuguuccaagccagcagccugaaggggguagguagugagggucaucagagcccagcuacacagcuccauucaucccauaaacacugacacagcaccccacaccuuggcccugcaauucugucugucuaggcucuguccccuuaaaugcugcccuucaaauaguccucgggagggggaccaaggaucggaugaccuauccccuaaaucuggauuuuagaguuguaggauagggccaauuaccaggauuucaggagcugccuacccaccaaccaggaccccaccuggagucucuucucauaccugaaucaggaccucagggagucuuucagggcccucccuugacugcacaaccucccacgcccauccccauccuuauccccauggcaagguucagggagaacagauuuuccccagcccaagccucagcagccucccacuuccaccucccacuucacuccacacagcccguuaggagaaugcaggcaucugagcccagcaguggagaaaacaaaagcccccagaccacccccagcgagcgcugcgcugcgccgccgcggucggcacucaccccacuacuugcuccuugauccugaccgggaugugugcguagcggggcucaggagcaagaucuggcagcucgggccugcgggggcuuugcgggggcgcccacggcgcaagagguagccggaggccgggcgcgucccgggugcucgcguacaggagccccagcgaggcgcaggcgagcagaaggaccagagcgcacagggcccg

SEQ ID NO: 20703 - RNA, 1442 nt, Homo sapiens
uguggguagguaaggaggccaggaagcaugggugccccccucuguuugcccacacccauguguacacacacagugucacuggggacaggaacagcagagccaagcugcugggcuagaaucuccaccgccugguccccguccccgccacgcugcgaucccggguuauuaaugcugccaccacccgcucgucauacauauuuaucgccccccucauucccccucccauccaucccuccucucagcccaggugagggggcgggggcagcaagaaugauugacucccacagacaggcuuaagccagcagcuaacaccuggagggugggccugagagaggguggagggaggggucccaggguacagugggagggagaagaggccccagaagugggcuuggagagggcagggccugaaucugagagagggcauugggggagggagguuagguuuccugggaaagcugaagggugggccauuugaacucuggucccuaaucucacccaaccgcuguucuuuccagaagcccagucauccagguccccccuauccccaugccaucagauguuaugaccccaaaugccuccaagccaucuccucccagcagaccagagcaccccuaugucuuguacccagucagaaccuggcuggggugauucaggccagugacuucuaccagacaggggcaggggguagaaguaaggggcagggggaggggaggagguucagcaggguaaggagagguuccagggugucacccccaucucugaucucagacaaagugccgucugugcuucucugauccuggcgaauccccuggcuuugggcagucccgcccccacccacuacuguagacagccaagauaaaaaggaagaguugggggggcacggcugaagcgaccuuguaggggaguucagacagggaggggugagagucugugaggaaacgagagccgagaaaugggaacauggaauaaaauaaaauaagauccucccucuggcucccuugauugcucgugcucucucucccucucuugugcuguuuuuccaucucucccuccccauucucucagucucuuuugucucucagucucuuuucucacugucucugucucaaauuuccuccucccaugauucugauuuucucccucugucugugguucucuccugcuguccuucagguugucugucuccagcaacauggggggaggugggggaguugggaaggcaggugguaaggagcuccucugcccagagcucuugucgcccaccuccauggcugagggugggagcaggauguuguccgaggaggggucccccuugcuccagagcuggcuuaauuaagcuaauugggcgcggugacauuugcggaggggagaggcuagcgcugcugucggcgcgggggcggggcggaggugcgcggcagcugggggguucagcaggcucc

SEQ ID NO: 20704 - RNA, 1442 nt, Homo sapiens
ggagccugcugaaccccccagcugccgcgcaccuccgccccgcccccgcgccgacagcagcgcuagccucuccccuccgcaaaugucaccgcgcccaauuagcuuaauuaagccagcucuggagcaagggggaccccuccucggacaacauccugcucccacccucagccauggaggugggcgacaagagcucugggcagaggagcuccuuaccaccugccuucccaacucccccaccuccccccauguugcuggagacagacaaccugaaggacagcaggagagaaccacagacagagggagaaaaucagaaucaugggaggaggaaauuugagacagagacagugagaaaagagacugagagacaaaagagacugagagaauggggagggagagauggaaaaacagcacaagagagggagagagagcacgagcaaucaagggagccagagggaggaucuuauuuuauuuuauuccauguucccauuucucggcucucguuuccucacagacucucaccccucccugucugaacuccccuacaaggucgcuucagccgugcccccccaacucuuccuuuuuaucuuggcugucuacaguagugggugggggcgggacugcccaaagccaggggauucgccaggaucagagaagcacagacggcacuuugucugagaucagagaugggggugacacccuggaaccucuccuuacccugcugaaccuccuccccucccccugccccuuacuucuacccccugccccugucugguagaagucacuggccugaaucaccccagccagguucugacuggguacaagacauaggggugcucuggucugcugggaggagauggcuuggaggcauuuggggucauaacaucugauggcauggggauaggggggaccuggaugacugggcuucuggaaagaacagcgguugggugagauuagggaccagaguucaaauggcccacccuucagcuuucccaggaaaccuaaccucccucccccaaugcccucucucagauucaggcccugcccucuccaagcccacuucuggggccucuucucccucccacuguacccugggaccccucccuccacccucucucaggcccacccuccagguguuagcugcuggcuuaagccugucugugggagucaaucauucuugcugcccccgcccccucaccugggcugagaggagggauggaugggagggggaaugaggggggcgauaaauauguaugacgagcgggugguggcagcauuaauaacccgggaucgcagcguggcggggacggggaccaggcgguggagauucuagcccagcagcuuggcucugcuguuccuguccccagugacacuguguguguacacaugggugugggcaaacagaggggggcacccaugcuuccuggccuccuuaccuacccaca

SEQ ID NO: 20705 - RNA, 594 nt, Homo sapiens
cgcucugugaauaaagggacagauaugggaaggaacgccuaaggccucccugccucccucgucacccccccuuucccccgcugaugcuccuuuaacucaaaggcaccgggggcccgcgcgcuccgugccaacgagggacugaggcaacugagcguccccccaccuuccgcacugaugccagcucgagcuccagggcauccccuggugcuuggaggcucccacauucuuugcagggggcucuuaggccagauggagcccacagaguaaaccaggaauggagauuuggguacuacucuuucauauccagcuucaucagaugcuugccugcucccagggcccccuaauucgaagacgcacccccuuuuccaucagucuccaccccccacccccguccugcuuccccacguccuccccucgaccuccgcccucuggaccccauucccaaguccagcuccacccaucuccacuccccgcugccucccuuugcccacuaacuugagucugggcugcaggguccggcgggcgcuguccccuccgcccggcggcugcucggcugugggggaaggcgcucugugcauggacggccggagauca

SEQ ID NO: 20706 - RNA, 594 nt, Homo sapiens
ugaucuccggccguccaugcacagagcgccuucccccacagccgagcagccgccgggcggaggggacagcgcccgccggacccugcagcccagacucaaguuagugggcaaagggaggcagcggggaguggagauggguggagcuggacuugggaaugggguccagagggcggaggucgaggggaggacguggggaagcaggacgggggugggggguggagacugauggaaaagggggugcgucuucgaauuagggggcccugggagcaggcaagcaucugaugaagcuggauaugaaagaguaguacccaaaucuccauuccugguuuacucugugggcuccaucuggccuaagagcccccugcaaagaaugugggagccuccaagcaccaggggaugcccuggagcucgagcuggcaucagugcggaagguggggggacgcucaguugccucagucccucguuggcacggagcgcgcgggcccccggugccuuugaguuaaaggagcaucagcgggggaaagggggggugacgagggaggcagggaggccuuaggcguuccuucccauaucugucccuuuauucacagagcg

SEQ ID NO: 20707 - RNA, 894 nt, Homo sapiens
gaccccagacccugucuccacagcucuccccgcuucugaggguuugcaggggcaguuggugaggagccugguggcucaugccuauggugcagugagcgaggcagaggcugccuucucucucuggaucuucccccgacccauucugacuccucuaagaucugcccucacccugggccuggguugagggaggaccucccuccauggcuuccccugggcucccaccauccucccugacugugcuggucuuggcugcacccucccaggcccuaaugagccuccagaucucagagaccccuggauccaagguaccccgagaggcccauccucugggugagcucagccccuugcaacagcagacaugcagaucccaggaggccgugacccccaucagcccagaucccccacuccacuccauaugggggcuccaggaggucuggggggaggggaaaccucagcaccucccccagcccagcagggaaggagcugggcgggccccaggggucucacugcuccucaggacacacugucccggaccccugccccugcccucugcucugaccucgcccagccagcggccugccaucccccugcgagucugagaggcagggggaacggggugggggcggguuuggguccuggccucucugccuuucccuuccaggcuuggcuaucgcgacuuagccgcccaguccggccacuuguugucgccaccgccucccgggccgccuucccggcgcgccgggcuggggguccccgcagggcugcagggaaggggcuacggccgcagguggggacgggggcggccccgcagcgggcaagagcagggcagucgcccucuccccuucugcugcugcccgagcagauugaauuuuuaaagcgacacgagcggaaugu

SEQ ID NO: 20708 - RNA, 894 nt, Homo sapiens
acauuccgcucgugucgcuuuaaaaauucaaucugcucgggcagcagcagaaggggagagggcgacugcccugcucuugcccgcugcggggccgcccccguccccaccugcggccguagccccuucccugcagcccugcggggacccccagcccggcgcgccgggaaggcggcccgggaggcgguggcgacaacaaguggccggacugggcggcuaagucgcgauagccaagccuggaagggaaaggcagagaggccaggacccaaacccgcccccaccccguucccccugccucucagacucgcagggggauggcaggccgcuggcugggcgaggucagagcagagggcaggggcagggguccgggacaguguguccugaggagcagugagaccccuggggcccgcccagcuccuucccugcugggcugggggaggugcugagguuuccccuccccccagaccuccuggagcccccauauggaguggagugggggaucugggcugaugggggucacggccuccugggaucugcaugucugcuguugcaaggggcugagcucacccagaggaugggccucucgggguaccuuggauccaggggucucugagaucuggaggcucauuagggccugggagggugcagccaagaccagcacagucagggaggauggugggagcccaggggaagccauggagggagguccucccucaacccaggcccagggugagggcagaucuuagaggagucagaaugggucgggggaagauccagagagagaaggcagccucugccucgcucacugcaccauaggcaugagccaccaggcuccucaccaacugccccugcaaacccucagaagcggggagagcuguggagacagggucugggguc

SEQ ID NO: 20709 - RNA, 2070 nt, Homo sapiens
cuuauggcaaacaccaggcaccaaggugcacaucccugauggauccugggaucaguugacacucaauccaccugccuucuggguccucugggcccucuggguccauguggcagcuggagguaugguagacacuuuuuaaaaaaugaguucugguaagaagaaggugauaaauggcuauuuguccacguugggacccggaggggagggauggcaugcccuuacaugggacuccuacccccagcggggcagcuggccacucugagggcaguuuugcaccugccuccuggcuggaaagugaguucccacugugcugucccucccuggggcccagcacggggcccggccccacaccgaccugaagagguugguaggaugacugaaugaauugacgcugggaugcagcagggcccaugggcagaggcuccagagccugggaaggaugggguggccuuucuguggcccuccgaauugagagaggucucagaggccugacaccacggcuuuccguccaggguuccuggucacccgcggagggcucagagccccgguggacucggggucccgccuuaaggggggugccuagggcagaaggaggagggaugucggcccccucagacccgcaccccaggcccuccccaccaccuuuccuucccucaggcccucugucuucccagucgccccgcccccugccccucuguccuaggcgcaagucuccgggcuugggacgcucgccgccagcgcccgcccgccugccccgccccuagccccccgccccccgccccccgcccccccgcagccccuccguccacucucggcuccuccuucucuuccuccuccuccuccccggggguggggagccggcuccggaagccccggcgcccccgccccgggccccgccagcgcuuuggagacggcuauccgcgcgggagugcgccacgcggggccggagcgccuauuagccgccaggaccucggagcgccccgaccaccccugagccccucuggcuucggagccccccagcaccccuucccggguccccucgcccacccuaauccacucucccucccuuucccggauucccucgcucaccccauccucucucccgccccuuccuggauucccucacccgucucgauccccucuccgcccuuucccagagacccagagccccugaccccccgcgcccuccccggagccccccgcgcgugccgcggccauggcggccgugcgcggggcgccccugcucagcugccuccuggcguugcuggcccugugcccuggagggcgcccgcagacggugcugaccgacgacgagaucgaggaguuccucgagggcuuccugucagagcuagaaccugagccccgggaggacgacguggaggccccgccgccucccgagcccaccccgcggguccgaaaagcccaggcggggggcaagccagggaagcggccagggacggccgcagaagguaagagcccagggcagggcggggguguggggggcuggcaucucaggugggaacagggggauucgguagggucuggccacuccccagucugcuaggggaggaauggcuggcuuacuaaugcgcacgcgagcccagaugccuggagggacccugugcuaggccgaggucagcgcuggcguggaggcacauccagcacccgggcggcagggccgcuuuugggggccgguggcucuaggguuggugcugugguuguacgggucgcuuauccccauuccuccaguacgcgacagguacuaggcuugagccacaggggacugugcugugucacccccugccauacuaaugggaccacucucccuguugguggcacagcuucacgucgucccucccuccugccuuugcccuccuacuccaggaggucucacguaggugagagaguuucaggugguggugagcacagggcuucaggugguggugagcaaugggugguccuacauuaguacaggaaauuagaugaggugaugcaucacugaagcauuuaacccacggccucuugcauaaucaguugucaguaaaucuuagcuguuuucaucguggcccu

SEQ ID NO: 20710 - RNA, 2070 nt, Homo sapiens
agggccacgaugaaaacagcuaagauuuacugacaacugauuaugcaagaggccguggguuaaaugcuucagugaugcaucaccucaucuaauuuccuguacuaauguaggaccacccauugcucaccaccaccugaagcccugugcucaccaccaccugaaacucucucaccuacgugagaccuccuggaguaggagggcaaaggcaggagggagggacgacgugaagcugugccaccaacagggagaguggucccauuaguauggcagggggugacacagcacaguccccuguggcucaagccuaguaccugucgcguacuggaggaauggggauaagcgacccguacaaccacagcaccaacccuagagccaccggcccccaaaagcggcccugccgcccgggugcuggaugugccuccacgccagcgcugaccucggccuagcacagggucccuccaggcaucugggcucgcgugcgcauuaguaagccagccauuccuccccuagcagacuggggaguggccagacccuaccgaaucccccuguucccaccugagaugccagccccccacacccccgcccugcccugggcucuuaccuucugcggccgucccuggccgcuucccuggcuugccccccgccugggcuuuucggacccgcggggugggcucgggaggcggcggggccuccacgucguccucccggggcucagguucuagcucugacaggaagcccucgaggaacuccucgaucucgucgucggucagcaccgucugcgggcgcccuccagggcacagggccagcaacgccaggaggcagcugagcaggggcgccccgcgcacggccgccauggccgcggcacgcgcggggggcuccggggagggcgcggggggucaggggcucugggucucugggaaagggcggagaggggaucgagacgggugagggaauccaggaaggggcgggagagaggauggggugagcgagggaauccgggaaagggagggagaguggauuagggugggcgaggggacccgggaaggggugcuggggggcuccgaagccagaggggcucagggguggucggggcgcuccgagguccuggcggcuaauaggcgcuccggccccgcguggcgcacucccgcgcggauagccgucuccaaagcgcuggcggggcccggggcgggggcgccggggcuuccggagccggcuccccacccccggggaggaggaggaggaagagaaggaggagccgagaguggacggaggggcugcgggggggcggggggcggggggcggggggcuaggggcggggcaggcgggcgggcgcuggcggcgagcgucccaagcccggagacuugcgccuaggacagaggggcagggggcggggcgacugggaagacagagggccugagggaaggaaaggugguggggagggccuggggugcgggucugagggggccgacaucccuccuccuucugcccuaggcaccccccuuaaggcgggaccccgaguccaccggggcucugagcccuccgcgggugaccaggaacccuggacggaaagccguggugucaggccucugagaccucucucaauucggagggccacagaaaggccaccccauccuucccaggcucuggagccucugcccaugggcccugcugcaucccagcgucaauucauucagucauccuaccaaccucuucaggucgguguggggccgggccccgugcugggccccagggagggacagcacagugggaacucacuuuccagccaggaggcaggugcaaaacugcccucagaguggccagcugccccgcuggggguaggagucccauguaagggcaugccaucccuccccuccgggucccaacguggacaaauagccauuuaucaccuucuucuuaccagaacucauuuuuuaaaaagugucuaccauaccuccagcugccacauggacccagagggcccagaggacccagaaggcagguggauugagugucaacugaucccaggauccaucagggaugugcaccuuggugccugguguuugccauaag

SEQ ID NO: 20711 - RNA, 1702 nt, Homo sapiens
guccauaggaguaaggagaaguuaaaagcagggccaggcuggggaggucagagccagaaccgcggaguguacaagcucccaaguccaggcaaaauucugaauccggcagaagccagcuucauguugcacaagcaaagguucacuuggugcccggacggcaggccgcccagagcaugaggcguuguuucauuuuguuucacguguuuuugaaaagguagagacuacaaagggccaauguggagggcuaauugcacuucuuguccacuuagacacuugguuccuuuaaaggucuccagggcugcgccccugccccagaucccgcaaucaccacuccagcugaccucucugugcccagccacugaaagaucgcugacgcgaaaucccaccgcaccucaaccgcaguaacgggcccaggcuucgcagagggccagaggacgccgaaggggccacuguagaggggggcgaccccaagaugcggccugaggucgggagcgccucagcugcggccagcguccuucguugccagcgcgcacccggccuucucucugcccagucugggcugcggaccgcagggucccagcagggggugaagggugacuggccuagcaccucaaagggucucggggauuugugaagccggagggcagcaagucgcgugcugccauccuuguagcugaacccgcggccccaggacacggucgagaacagagaacuaggccucagcggcguagcccacgcagacccgagcugggaggucgaagccucgcccccgccgcugccgggaacccggggugccacucucaggggucagggaggggcgcuggaaacugggccuggggcccuggggggccaucgcuacaccccgcuuagcgggaucgcugugaagcaagccagggacucgggcuaggacguucaaggagagaaguuagagcuaaagaagcuccccccagccccguucccgcccccgucuucugggacccaagaccugggcugagggaguccagcuuguaggaaggggaccggaagggaagcagccagggcucuagggccgaaggaaaaugggacucaaagcugcgacggcuuugcgaagcugcagcgugaguuuucaaagacuuucuccaaacuuagcacuucagcuugguuacuucggaggaggcgggggagggggcugcgggccgcgacagcgccccgggguccucggcucaccaagaggggagccaggccgcucccacagccccgaccaccugcuggggaccggggaagccgggauccauuugaggagggggagauaaggguaaccaacgcgcucccggaguccgggguggccccgcggcuuucuccuuaccugcccucagcugccggggccguucaccaucuaccuggaucucucacagagacccgccgggcagccaaccugcaaaacagagcagcacuggaauuacccuggcggcuggucuaggacccccagguuucuuucuuuucccaacuuccuucuucccaccucuaucuuuuuuuucaauggcuuugugcguguccuucuggguuucacuuuauugcacagacacuuuguuugcuaagccccacacguucucaggacauugccucgccugggaucgcgccgaggggccgcaagggggggaauucgaggggcagaguugggagguggcucggcguugccgcggcacucccggugcaacgugga

SEQ ID NO: 20712 - RNA, 1702 nt, Homo sapiens
uccacguugcaccgggagugccgcggcaacgccgagccaccucccaacucugccccucgaauucccccccuugcggccccucggcgcgaucccaggcgaggcaauguccugagaacguguggggcuuagcaaacaaagugucugugcaauaaagugaaacccagaaggacacgcacaaagccauugaaaaaaaagauagaggugggaagaaggaaguugggaaaagaaagaaaccuggggguccuagaccagccgccaggguaauuccagugcugcucuguuuugcagguuggcugcccggcgggucucugugagagauccagguagauggugaacggccccggcagcugagggcagguaaggagaaagccgcggggccaccccggacuccgggagcgcguugguuacccuuaucucccccuccucaaauggaucccggcuuccccgguccccagcagguggucggggcugugggagcggccuggcuccccucuuggugagccgaggaccccggggcgcugucgcggcccgcagcccccucccccgccuccuccgaaguaaccaagcugaagugcuaaguuuggagaaagucuuugaaaacucacgcugcagcuucgcaaagccgucgcagcuuugagucccauuuuccuucggcccuagagcccuggcugcuucccuuccgguccccuuccuacaagcuggacucccucagcccaggucuugggucccagaagacgggggcgggaacggggcuggggggagcuucuuuagcucuaacuucucuccuugaacguccuagcccgagucccuggcuugcuucacagcgaucccgcuaagcgggguguagcgauggccccccagggccccaggcccaguuuccagcgccccucccugaccccugagaguggcaccccggguucccggcagcggcgggggcgaggcuucgaccucccagcucgggucugcgugggcuacgccgcugaggccuaguucucuguucucgaccguguccuggggccgcggguucagcuacaaggauggcagcacgcgacuugcugcccuccggcuucacaaauccccgagacccuuugaggugcuaggccagucacccuucacccccugcugggacccugcgguccgcagcccagacugggcagagagaaggccgggugcgcgcuggcaacgaaggacgcuggccgcagcugaggcgcucccgaccucaggccgcaucuuggggucgccccccucuacaguggccccuucggcguccucuggcccucugcgaagccugggcccguuacugcgguugaggugcggugggauuucgcgucagcgaucuuucaguggcugggcacagagaggucagcuggaguggugauugcgggaucuggggcaggggcgcagcccuggagaccuuuaaaggaaccaagugucuaaguggacaagaagugcaauuagcccuccacauuggcccuuuguagucucuaccuuuucaaaaacacgugaaacaaaaugaaacaacgccucaugcucugggcggccugccguccgggcaccaagugaaccuuugcuugugcaacaugaagcuggcuucugccggauucagaauuuugccuggacuugggagcuuguacacuccgcgguucuggcucugaccuccccagccuggcccugcuuuuaacuucuccuuacuccuauggac

SEQ ID NO: 20713 - RNA, 3350 nt, Homo sapiens
gagcagcuccgggcgugcagaucucuccucggccccuccggacucucgcgccugggaagagcacccacugggagggcgccgccacuuaccugcuugcucgucggcaucucccgggguuccagguccccaccaaggguguuugcaagucuuaagcgcuucuacugaaacguuggagcccagcguccucuuccccucacacguacacccuacuucuuaauugaaacauuuugauaggaaaguuucuuuuucgcucuuucucucucuuucuuagacugccucuaacagggacuuuuugauggaaaauguggccacagaccccugcccucaacuuuuuuccacaugcugcguaaggauccuccuugaggcgauuuccccggauuguucguacgggcgaagcccauuucccacccgaaaaaacuucccaaacacgucuaccuggguggacuuuuaaaagugcaaaaaagaguuuucguuccaacucuaagcuaggcgaaucuuuuaaauggcaccuccuccugaaaauuaggcacuuuauucccuuucgaggaauuucuaccccuuguuucuaaucucccccacucccccaccccgacaggcgggguaaaaaguuugcacaggauuaagugugagggcaagucaaggagccuccaggcgcaucgcaguggggagcacucgcgcugcccgggcugcggggucgggcgccgagagcggaccgggcgcugggugaggaggaggagaacgaagggggagcccgcugagugaaaaggggccgcggccgccgcucaucaaagugcuucccccucccccaagcgacacuuuccuuuggaguccgaauaaaauacgguaacagaauaugauggagggcacacuguuuccuuaacugcuucucaaaggacccgggagaucuucuuaggaccuuuaauaaggcuuuggucgguucuuuuguugaucucucaaaaucaacuccuucuaauugaaguuggagcugaaagcgagcuaauguucaaagaaaguggccgccagaccaacgaaauuacauuuuuuuuuugacgaugagggaacaucuaaucaaagaggcaggggaggaggggugggagugggggcguacgaaggagaaaaggagguuuuacaagauccuucucugguucacaaaagucagcgacacgggcgcuucucuacagaacaaagacaccgcggcccauucacaaaagggagagaaagagagaaagcugaauaaaagaacgagagaaauggggaaaaaaugagagagagaaggagggagagagugagugagaaagaagcuuuaagaggaaaagaaacagugcagagcgcagcgcuaacccaggcggggacacaccuuaggcucgcgcaggccccuaccaggaguagcccgcgaggcccgcggucagccgcccgcggcucggagccacugugaucgugcugagguuuaaagaaagcaacgaaauauaccccuuccuuagguuccgaggaaaggcgccggcuggagcgcacuaguuuugggggaaagaauaugcggacgucccggggugcgcuucgccggcguccgcguccauagcccggcgcugcccuagucccggccaguccgcugugugccgggguuggcccuccagugccggggcgcgugaccuugccccauuccuccaccuuaacucauuccucccuccaccaggcccuguuucgccugcagccucagcaccugaccuggguccggcgcagcgaggugggacggcagugcgcucuggaaugugccagcgcgguccccgggguacgccucgcgggaggccggcgcucucgguuccagaugcugccaccauucucggggaaguugggagguaucaaguagcacggauuuuuuuuuuccuaauuagaguauuuaucuaaucccaaauugcaggcgaauuuucuuaacgcucagcccauaaaaccccaggauuaagaaaagaaagaggagagggggagagggaggagaguggagagggagagagacugggaugaaaguuucuugaaagcagcgcagaggauugaggcggccgucgcuaggcaaauguccaggugggagaugcugggccagaagccaugaccguuccagcaucggccgcggugcgggaaggggaaguggggacaccacuggaggaggugaagccguccagcucaaggcccucgagccgggaaggggcgagggagcuggguguggagacaaggauccagcauccaggugaccuccaggcccggccaggcucuggaggacacuugggacaaggggagggcuuuggaucugaggccgagggaucugaccaggggcggaaguucugcuccggcccgcagacugugcccaagcaagcccgcugccaacgccccugcuccucugcgacccucggaccgauagucucuuuucccgcagcgcgggcuuucgaguuccggguccuccggcgugcugggcucgugcccguucucgggagccagcgucugggcaccacgcagcgauguccggaugcagcgcccuugccgcgggccuuaccccgccaggcgccggaguccacgcuccaccgccgcugaggggcguucgggcgccaccgagcagcccaaauugaaaccccgagaggcucgggacuaaagcugaaggggcagguagaggggccgcccggcggucccagaccauccuagcaaaucuggggcgagggaaggguugucaguuggccgauugggagcggcuucgggagcgaaggagcugcuuuucggcgaggccccucgggagugaagguuccucgaaucaagcguaaacugggugggugcuguuggccgcccaggccccaggcugcuuggggcgggcgauuucugucugcugaguuuucccgggguuagaacgggauucugagagcguuccccagagagcagcagcucucucucugcucucgugcucgaauaaagagggcaaauaccgacuucauuuacuuaaaauaacuuuucaauaacuuaaaagaaaugcucaucaugaaggaauucuaccguagcaaguuuuuaucauuuugaaagacuggcaacuggagguggcugcauacuuggaacgaaauuuguuugugugcacauacauacgaucuacgcugaaguauaaaugcuaguggacuuuuuucucuaaguuucuggacuuguugaacaagcuuucuuuguuuggacaccccugugggggaaugaaggaaacuagcauagaaucgcuuuuuuuuuuuuucuguagccuagaacuucuuguuaaaaguucucuuucccucauuucauacacacauaccugcauacauucuccccgccccccaacaauaacccucuuccuuuca

SEQ ID NO: 20714 - RNA, 3350 nt, Homo sapiens
ugaaaggaagaggguuauuguuggggggcggggagaauguaugcagguauguguguaugaaaugagggaaagagaacuuuuaacaagaaguucuaggcuacagaaaaaaaaaaaaagcgauucuaugcuaguuuccuucauucccccacagggguguccaaacaaagaaagcuuguucaacaaguccagaaacuuagagaaaaaaguccacuagcauuuauacuucagcguagaucguauguaugugcacacaaacaaauuucguuccaaguaugcagccaccuccaguugccagucuuucaaaaugauaaaaacuugcuacgguagaauuccuucaugaugagcauuucuuuuaaguuauugaaaaguuauuuuaaguaaaugaagucgguauuugcccucuuuauucgagcacgagagcagagagagagcugcugcucucuggggaacgcucucagaaucccguucuaaccccgggaaaacucagcagacagaaaucgcccgccccaagcagccuggggccugggcggccaacagcacccacccaguuuacgcuugauucgaggaaccuucacucccgaggggccucgccgaaaagcagcuccuucgcucccgaagccgcucccaaucggccaacugacaacccuucccucgccccagauuugcuaggauggucugggaccgccgggcggccccucuaccugccccuucagcuuuagucccgagccucucgggguuucaauuugggcugcucgguggcgcccgaacgccccucagcggcgguggagcguggacuccggcgccuggcgggguaaggcccgcggcaagggcgcugcauccggacaucgcugcguggugcccagacgcuggcucccgagaacgggcacgagcccagcacgccggaggacccggaacucgaaagcccgcgcugcgggaaaagagacuaucgguccgagggucgcagaggagcaggggcguuggcagcgggcuugcuugggcacagucugcgggccggagcagaacuuccgccccuggucagaucccucggccucagauccaaagcccuccccuugucccaaguguccuccagagccuggccgggccuggaggucaccuggaugcuggauccuugucuccacacccagcucccucgccccuucccggcucgagggccuugagcuggacggcuucaccuccuccagugguguccccacuuccccuucccgcaccgcggccgaugcuggaacggucauggcuucuggcccagcaucucccaccuggacauuugccuagcgacggccgccucaauccucugcgcugcuuucaagaaacuuucaucccagucucucucccucuccacucuccucccucucccccucuccucuuucuuuucuuaauccugggguuuuaugggcugagcguuaagaaaauucgccugcaauuugggauuagauaaauacucuaauuaggaaaaaaaaaauccgugcuacuugauaccucccaacuuccccgagaaugguggcagcaucuggaaccgagagcgccggccucccgcgaggcguaccccggggaccgcgcuggcacauuccagagcgcacugccgucccaccucgcugcgccggacccaggucaggugcugaggcugcaggcgaaacagggccugguggagggaggaaugaguuaagguggaggaauggggcaaggucacgcgccccggcacuggagggccaaccccggcacacagcggacuggccgggacuagggcagcgccgggcuauggacgcggacgccggcgaagcgcaccccgggacguccgcauauucuuucccccaaaacuagugcgcuccagccggcgccuuuccucggaaccuaaggaagggguauauuucguugcuuucuuuaaaccucagcacgaucacaguggcuccgagccgcgggcggcugaccgcgggccucgcgggcuacuccugguaggggccugcgcgagccuaagguguguccccgccuggguuagcgcugcgcucugcacuguuucuuuuccucuuaaagcuucuuucucacucacucucucccuccuucucucucucauuuuuuccccauuucucucguucuuuuauucagcuuucucucuuucucucccuuuugugaaugggccgcggugucuuuguucuguagagaagcgcccgugucgcugacuuuugugaaccagagaaggaucuuguaaaaccuccuuuucuccuucguacgcccccacucccaccccuccuccccugccucuuugauuagauguucccucaucgucaaaaaaaaaauguaauuucguuggucuggcggccacuuucuuugaacauuagcucgcuuucagcuccaacuucaauuagaaggaguugauuuugagagaucaacaaaagaaccgaccaaagccuuauuaaagguccuaagaagaucucccggguccuuugagaagcaguuaaggaaacagugugcccuccaucauauucuguuaccguauuuuauucggacuccaaaggaaagugucgcuugggggagggggaagcacuuugaugagcggcggccgcggccccuuuucacucagcgggcucccccuucguucuccuccuccucacccagcgcccgguccgcucucggcgcccgaccccgcagcccgggcagcgcgagugcuccccacugcgaugcgccuggaggcuccuugacuugcccucacacuuaauccugugcaaacuuuuuaccccgccugucggggugggggagugggggagauuagaaacaagggguagaaauuccucgaaagggaauaaagugccuaauuuucaggaggaggugccauuuaaaagauucgccuagcuuagaguuggaacgaaaacucuuuuuugcacuuuuaaaaguccacccagguagacguguuugggaaguuuuuucgggugggaaaugggcuucgcccguacgaacaauccggggaaaucgccucaaggaggauccuuacgcagcauguggaaaaaaguugagggcaggggucuguggccacauuuuccaucaaaaagucccuguuagaggcagucuaagaaagagagagaaagagcgaaaaagaaacuuuccuaucaaaauguuucaauuaagaaguaggguguacgugugaggggaagaggacgcugggcuccaacguuucaguagaagcgcuuaagacuugcaaacacccuugguggggaccuggaaccccgggagaugccgacgagcaagcagguaaguggcggcgcccucccagugggugcucuucccaggcgcgagaguccggaggggccgaggagagaucugcacgcccggagcugcuc

SEQ ID NO: 20715 - RNA, 3601 nt, Homo sapiens
gggccuauguguaacugacuuggcccugcgggaaccggggucgcugggguccgcgggugagcaggcuggcucugcaccacccgcacgacgcccgggggcugggucagucucauccaguucgcccagggccugucuugaaccccuuuccagacgcgaucgcuucgccguuuacggguugaaucaaaacagagaucggauaaaaacgcggcuggaauggagacgcggagauggggggagaggaaaccggcguccacgaggauuguugaaaauccgagagggcgggcuggaagaaggaggagaaggagagugcgagaggcccgugugugugcgcgugugugugugugugugugugccuguguguuuggggcgggggugggugagaggaaaucaagugaacgcaggagaccguacaaaacacggggagagaguuggaggggcucacgaaagauggggauggggauggaggagaaaccaaggcgugggagaccacgauggagagagaagcacaggccagcgagaagggugaaaggaagagguacaaucugcgaaggcgggguggggguguguuugggggaggcagaggggggcggggguaguggauagccuuaaaauagggcuagugcgaggcugcggcucggggcgggacaggugaagggcagguguaaggugggccgggucaggccucucucaccgccacuugguccuccgguuuuggaaccaggucuugaccugcgcguccgucauuuugagggacuuggcgagcgccgcccucucggcagaggccagguacuucuggcgauggaagcgcuuuuccagcucgcagaucugcacccgggaaaaggacgugcgcggcuucuuacgcuugggcggcguccgguucugguagggguggccgaugcgccgggucacggugaagggcgugagugcggccgccgcugcggagacacaggagggccccugaagcccagcccggcuccgccaccguucaggccccaugcggaccccguggcgccccgugggacacggagagcuccgcuauuucgcuggucgcgcgcguuuccagagacaccaagccggucgggagacccccucgcccccugucccuucccccgggcacgggcuuauuuuccugcaacucuccgauuacccuccccaccacggcugcccggggcccuggggccgaggccuccgccgcgcuugggccucugaaaugguuuccgggaguggagcgcacagggcgcggcgccucuggccccgagagggcggaggccuggagccuggucgccagcucugcucaccugugaagcggucuuucacgaagcggcggcugcucuccauccaggggaaauugagaccgccaaggcuggagaccgugggcacggagggcauggcggguagcgcgcuuggcagaggcgguggcacggccccgggcagcggccugugcgccggcacccggaucacgccugcgggcgcuaggcucagguucacacuguaagaucccgcguccucgaagggcgcgccgaggcccgcaaaggaggcgggcagagacggguauguggcgcccggacggcccccggggggcccucccagguagcuggcgccgucggggccccgcggggcgggugcgcuguccugguccgggcuguuaaggaucuggucgaugccgaagcugaugggcucgugcgggugcggggucugcgcgcuggcgggcgccuccauccugggcgggcggaagggcugggcugggcugggcggggaggcggcuggguccccguuacggcgcggccauggagcgcccggcgccucucgucgcacugaaacuuugccaagagugcgcgggcccgacaggcucugugucaucuuucuugaaccgaaccuggaguuuccgcugcuaauuccucuccugccgcagccauuggcugcgaucaacaagccucucuccucucauuggcucccggcuuucaauaaaggccuaauucauggaaauaggagcuuagggacuguuccaaggugacaucauuuuaacaaacgaacaauaggucaaauuuauuagcagggauaaugggcggcggauauuagagcccgaaccacagccucccaaacccgaaaucuaacgaagcugcaauuagcagacgcuccccgcuccuccgggccgggccgcuucccagacaccgcgcuggguggguagagcgcuccgcuugugaaauugucuuuugcugaguggguuuucguuuucuuccaauuuuuuuuuuuuuucaucugagcaaaagccaaaccaaaugcauccuuucagguacaauggaguugcaaccccgggacgacccggcggaauccgcagaagccccuuggacgcuaccgccgccggaggaacgaaaggggcgcacuacccggggcaggcuucgcgcugccugcgcgcggggcgaggggagcaccguagcguucuccgcgccccggaugacgccgacccgcguggggagaauucgcccccgcccggguuucggccgcggccucgcggccacuuuggagacacucccuggcuccggccaggcggaccgaggcgugacucgcaggugcccacgcgugccagcugcggcugggcuagggacgcggggucgcccgguggggagcggggaccugacucucguaauucguugcaggauggaagggggcuguggucgcgcgugggaacccgcucgcggcucggcgggucuagggacuucggguuccugaaugucaaaggcgcgggcagcuccuagagcaaauugcgggauuucuuugggaaacgcgacuggugagcccuucccggcuccaguccacuuugggcgcuggaaccacuccccguucugcucgcgccucagugacugucuacccggcccagggcaccguggacaggaccgcacacgaaguagucaccuuccgcugcagcuuuggggagacaagcggaaucauuuucuuccagcgaauucuaaaaucguuaggugcaaacucuuugagugucgcaccccuggccuggguucuuccucccgcuccuugugguguggacaguggugagagcucggaugugcuguuguuggccagaaguguguucaaauuuggacuggccauuuccucgcugagugaccuugagaaauugacucuauauauuuagauuucgguuuucucguuugcaaaaaaggaaaauaaugcaugcaugcggguuguucgugagccgcgagugagauauugagggagcgcagagcacugggccuggcacguaguaggcacugggcagcguggcucaccucccacucuauccccccagaguaauggcugauguauuauuguugugacucuuguuuauuuuguuggcaguuuaauuuuauuugcaggggcucaguacguuggagagaaagguguauuugucuaccaguagggucaguuucagaggacggggaaagacaggaggugcagguuggggauucuuucucucuucucccaacaauccaaaggcgucaggauuugcagggccuccaggccugggucuggaguuaggucacuugcccgcugugugaccuugggcaaauuccuggcccuugcuaagccuuccugguggguguggaga

SEQ ID NO: 20716 - RNA, 3601 nt, Homo sapiens
ucuccacacccaccaggaaggcuuagcaagggccaggaauuugcccaaggucacacagcgggcaagugaccuaacuccagacccaggccuggaggcccugcaaauccugacgccuuuggauuguugggagaagagagaaagaauccccaaccugcaccuccugucuuuccccguccucugaaacugacccuacugguagacaaauacaccuuucucuccaacguacugagccccugcaaauaaaauuaaacugccaacaaaauaaacaagagucacaacaauaauacaucagccauuacucuggggggauagagugggaggugagccacgcugcccagugccuacuacgugccaggcccagugcucugcgcucccucaauaucucacucgcggcucacgaacaacccgcaugcaugcauuauuuuccuuuuuugcaaacgagaaaaccgaaaucuaaauauauagagucaauuucucaaggucacucagcgaggaaauggccaguccaaauuugaacacacuucuggccaacaacagcacauccgagcucucaccacuguccacaccacaaggagcgggaggaagaacccaggccaggggugcgacacucaaagaguuugcaccuaacgauuuuagaauucgcuggaagaaaaugauuccgcuugucuccccaaagcugcagcggaaggugacuacuucgugugcgguccuguccacggugcccugggccggguagacagucacugaggcgcgagcagaacggggagugguuccagcgcccaaaguggacuggagccgggaagggcucaccagucgcguuucccaaagaaaucccgcaauuugcucuaggagcugcccgcgccuuugacauucaggaacccgaagucccuagacccgccgagccgcgagcggguucccacgcgcgaccacagcccccuuccauccugcaacgaauuacgagagucagguccccgcuccccaccgggcgaccccgcgucccuagcccagccgcagcuggcacgcgugggcaccugcgagucacgccucgguccgccuggccggagccagggagugucuccaaaguggccgcgaggccgcggccgaaacccgggcgggggcgaauucuccccacgcgggucggcgucauccggggcgcggagaacgcuacggugcuccccucgccccgcgcgcaggcagcgcgaagccugccccggguagugcgccccuuucguuccuccggcggcgguagcguccaaggggcuucugcggauuccgccgggucgucccgggguugcaacuccauuguaccugaaaggaugcauuugguuuggcuuuugcucagaugaaaaaaaaaaaaaauuggaagaaaacgaaaacccacucagcaaaagacaauuucacaagcggagcgcucuacccacccagcgcggugucugggaagcggcccggcccggaggagcggggagcgucugcuaauugcagcuucguuagauuucggguuugggaggcugugguucgggcucuaauauccgccgcccauuaucccugcuaauaaauuugaccuauuguucguuuguuaaaaugaugucaccuuggaacagucccuaagcuccuauuuccaugaauuaggccuuuauugaaagccgggagccaaugagaggagagaggcuuguugaucgcagccaauggcugcggcaggagaggaauuagcagcggaaacuccagguucgguucaagaaagaugacacagagccugucgggcccgcgcacucuuggcaaaguuucagugcgacgagaggcgccgggcgcuccauggccgcgccguaacggggacccagccgccuccccgcccagcccagcccagcccuuccgcccgcccaggauggaggcgcccgccagcgcgcagaccccgcacccgcacgagcccaucagcuucggcaucgaccagauccuuaacagcccggaccaggacagcgcacccgccccgcggggccccgacggcgccagcuaccugggagggccccccgggggccguccgggcgccacauacccgucucugcccgccuccuuugcgggccucggcgcgcccuucgaggacgcgggaucuuacagugugaaccugagccuagcgcccgcaggcgugauccgggugccggcgcacaggccgcugcccggggccgugccaccgccucugccaagcgcgcuacccgccaugcccuccgugcccacggucuccagccuuggcggucucaauuuccccuggauggagagcagccgccgcuucgugaaagaccgcuucacaggugagcagagcuggcgaccaggcuccaggccuccgcccucucggggccagaggcgccgcgcccugugcgcuccacucccggaaaccauuucagaggcccaagcgcggcggaggccucggccccagggccccgggcagccgugguggggaggguaaucggagaguugcaggaaaauaagcccgugcccgggggaagggacagggggcgagggggucucccgaccggcuuggugucucuggaaacgcgcgcgaccagcgaaauagcggagcucuccgugucccacggggcgccacgggguccgcauggggccugaacgguggcggagccgggcugggcuucaggggcccuccugugucuccgcagcggcggccgcacucacgcccuucaccgugacccggcgcaucggccaccccuaccagaaccggacgccgcccaagcguaagaagccgcgcacguccuuuucccgggugcagaucugcgagcuggaaaagcgcuuccaucgccagaaguaccuggccucugccgagagggcggcgcucgccaagucccucaaaaugacggacgcgcaggucaagaccugguuccaaaaccggaggaccaaguggcggugagagaggccugacccggcccaccuuacaccugcccuucaccugucccgccccgagccgcagccucgcacuagcccuauuuuaaggcuauccacuacccccgccccccucugccucccccaaacacacccccaccccgccuucgcagauuguaccucuuccuuucacccuucucgcuggccugugcuucucucuccaucguggucucccacgccuugguuucuccuccauccccauccccaucuuucgugagccccuccaacucucuccccguguuuuguacggucuccugcguucacuugauuuccucucacccacccccgccccaaacacacaggcacacacacacacacacacacgcgcacacacacgggccucucgcacucuccuucuccuccuucuuccagcccgcccucucggauuuucaacaauccucguggacgccgguuuccucuccccccaucuccgcgucuccauuccagccgcguuuuuauccgaucucuguuuugauucaacccguaaacggcgaagcgaucgcgucuggaaagggguucaagacaggcccugggcgaacuggaugagacugacccagcccccgggcgucgugcggguggugcagagccagccugcucacccgcggaccccagcgaccccgguucccgcagggccaagucaguuacacauaggccc

SEQ ID NO: 20717 - RNA, 1507 nt, Homo sapiens
ggagcccacgcuuugccagcacuuuccccugccucgucugugacuguuuucauuuuguuuuaacccagaagaggcgucucaacacagcauguuggagaucuguguuuuauguuuuuaugugauugcucuuucuuuuccggccggcucucuuuucuucuuucccuucgcucuuccuuucccucuuuucuuuuuucuuucuuucuuucucuuccuuccuuccuuuuucuuucuuuuuucuuuuucuuucuuuuuuucuuuccuccuuuucuuuuuccuuuuucuuucucuuuccucuuccugccuuucuuuuuucuuucuuccuucuuuccuuucuccccccuuuauuuucuucucuucuccuuccucuuccuuucuuccccucuucccuccuuccauuucuuucguucuucguucuuuccugucucucuuccugccuucuuuucuuucuucuuucuuucauuuccuucucucauuucuuucccccaccuucccuuaauuucucccucacucuuuuccuuccucccuuccucucuccauuuucuuucucuucuuucuucagcuucccuccuuucuccucuuucuccuuuccuuaccucucuggcuuuccuguuuuuucgucccauuucuccccugagucuucucuuauuucugcuaucucguucuccuucccucccucucugucuuucaguuuuuucuuagucuaccgguagaauagcaacucccaacuuuaauucugauaucucccaaaagucuucuccagccccugucaccauggccccuuccagcccuucucucacucgcagcucccuagacacuagacuguguggccuggaggcauugcccuuggagguugaccugagggaacuuuccugggcacacccaaggcucuuucccaggcuccuggucccaagugagaaauggccuuuuuccccccauuaagccaccagcugagcuugggacagugggagaucugguggccccaggcccuaucggacucagagugcggaaggggaagaaggaagaugacuaauuacaucaucuccagcuucccugggcuggggacaaguguccccaacacuguucccauccccacugaguauuaggaugggggugggugguagugagagugaauuggguaacugggcuggaagugaaagugugugcgcggggcgcucguguguguucuucuaugugugugugugugccugugcgcgcuuguguugggcagguccggcugucaguggccgccuggcgccccaggcgcuccagccucccaucgccggccggcgcacugagccagcagcccuggccuuuaggauuucuggaaugagugugaggauuucugcggaacagcgaaacuuuguuaggacaggucuuuaagaaaacaccccucuucccuuuuucacagcgaccacccgcgacaguucugagccccgcccucggacccuucuccacaugcuuuuuggugguggggggauguggcuucccaaggccgggcacucgcagu

SEQ ID NO: 20718 - RNA, 1507 nt, Homo sapiens
acugcgagugcccggccuugggaagccacauccccccaccaccaaaaagcauguggagaaggguccgagggcggggcucagaacugucgcggguggucgcugugaaaaagggaagagggguguuuucuuaaagaccuguccuaacaaaguuucgcuguuccgcagaaauccucacacucauuccagaaauccuaaaggccagggcugcuggcucagugcgccggccggcgaugggaggcuggagcgccuggggcgccaggcggccacugacagccggaccugcccaacacaagcgcgcacaggcacacacacacacauagaagaacacacacgagcgccccgcgcacacacuuucacuuccagcccaguuacccaauucacucucacuaccacccacccccauccuaauacucaguggggaugggaacaguguuggggacacuuguccccagcccagggaagcuggagaugauguaauuagucaucuuccuucuuccccuuccgcacucugaguccgauagggccuggggccaccagaucucccacugucccaagcucagcugguggcuuaauggggggaaaaaggccauuucucacuugggaccaggagccugggaaagagccuugggugugcccaggaaaguucccucaggucaaccuccaagggcaaugccuccaggccacacagucuagugucuagggagcugcgagugagagaagggcuggaaggggccauggugacaggggcuggagaagacuuuugggagauaucagaauuaaaguugggaguugcuauucuaccgguagacuaagaaaaaacugaaagacagagagggagggaaggagaacgagauagcagaaauaagagaagacucaggggagaaaugggacgaaaaaacaggaaagccagagagguaaggaaaggagaaagaggagaaaggagggaagcugaagaaagaagagaaagaaaauggagagaggaagggaggaaggaaaagagugagggagaaauuaagggaaggugggggaaagaaaugagagaaggaaaugaaagaaagaagaaagaaaagaaggcaggaagagagacaggaaagaacgaagaacgaaagaaauggaaggagggaagaggggaagaaaggaagaggaaggagaagagaagaaaauaaaggggggagaaaggaaagaaggaagaaagaaaaaagaaaggcaggaagaggaaagagaaagaaaaaggaaaaagaaaaggaggaaagaaaaaaagaaagaaaaagaaaaaagaaagaaaaaggaaggaaggaagagaaagaaagaaagaaaaaagaaaagagggaaaggaagagcgaagggaaagaagaaaagagagccggccggaaaagaaagagcaaucacauaaaaacauaaaacacagaucuccaacaugcuguguugagacgccucuucuggguuaaaacaaaaugaaaacagucacagacgaggcaggggaaagugcuggcaaagcgugggcucc

SEQ ID NO: 20719 - RNA, 859 nt, Homo sapiens
ccggcgacccagagcguggcgaggaacagcgggaaguacucgcugcaguucacccugcggugggcgggugggaugagcgcgccggccgggaugguccugcgacccggacccgccuggggcucgcuccccgccccgcgcccucccgccgcgccucacugggcucgguagacgcgcucgaacucgggugggccgguggugagcggcggcgacacgcggaaggcccugcgcgccgagaucaccugcagggagaaguaggcugggggaggagggggagcgggagucaggucuggacacccgaagccccagagaugggagugggagggauccugcaaucuggcccuucacuuggccguguccucuccucccuaaggcggaaccccgcccccuccccgcccgaggagaccucucgucucacccaucccuggccugcccugugucccugacauucagcgaggagggcagggcugaagccuggggcgcagagaggcccugucccaaccugugaguguaugggggagggugagugauucaggcacagggacaccugcuccgcgagagagaccacuugaguccuuguuucugaaucauuucacucucaaaacacaggcaaaugcagcuuucaggucccuggccaggaagugccucgggagucugagggcagagcuggcugcauccucccaggugcaaggaagcacacucccuguagcuaacagucccuggucacccaccuaccagcgcccaccagcagggcccucugacccugccucaggccgggaucacuaaagccugcgucccugugccuccaaaccucaguuucucuguuccugcauuccggucccaggccuaaaucugacagaca

SEQ ID NO: 20720 - RNA, 859 nt, Homo sapiens
ugucugucagauuuaggccugggaccggaaugcaggaacagagaaacugagguuuggaggcacagggacgcaggcuuuagugaucccggccugaggcagggucagagggcccugcuggugggcgcugguaggugggugaccagggacuguuagcuacagggagugugcuuccuugcaccugggaggaugcagccagcucugcccucagacucccgaggcacuuccuggccagggaccugaaagcugcauuugccuguguuuugagagugaaaugauucagaaacaaggacucaaguggucucucucgcggagcaggugucccugugccugaaucacucacccucccccauacacucacagguugggacagggccucucugcgccccaggcuucagcccugcccuccucgcugaaugucagggacacagggcaggccagggaugggugagacgagaggucuccucgggcggggagggggcgggguuccgccuuagggaggagaggacacggccaagugaagggccagauugcaggaucccucccacucccaucucuggggcuucggguguccagaccugacucccgcucccccuccucccccagccuacuucucccugcaggugaucucggcgcgcagggccuuccgcgugucgccgccgcucaccaccggcccacccgaguucgagcgcgucuaccgagcccagugaggcgcggcgggagggcgcggggcggggagcgagccccaggcggguccgggucgcaggaccaucccggccggcgcgcucaucccacccgcccaccgcagggugaacugcagcgaguacuucccgcuguuccucgccacgcucugggucgccgg

SEQ ID NO: 20721 - RNA, 698 nt, Homo sapiens
cagcucugguggccacgaccaacaggcaugaauauaagggagaggcgcccgaguggaguucccugugggccaaucagagagcagugggccaucacgccaccugaggccagccaaugggaacgcggcaagcucuauaaaagcgagcaauccgcugaggucugggcagaggacaccgcggggccaacaguuucggauucauggcccgaaccaagcagacugcgcgcaagucaacggguggcaaggcgccgcgcaagcagcuggccaccaagguggcucgcaagagcgcaccugccacuggcggcgugaagaagccgcaccgcuaccggcccggcacgguggcgcuucgcgagauccgccgcuaccagaaguccacugagcugcuaauccgcaaguugcccuuccagcggcugaugcgcgagaucgcucaggacuuuaagaccgaccugcgcuuccagagcucggccgugauggcgcugcaggaggcgugcgagucuuaccugguggggcuguuugaggacaccaaccugugugucauccaugccaaacgggucaccaucaugccuaaggacauccagcuggcacgccguauccgcggggagcgggccuaggagggcuaucucgccaccugagagguugcgcaacguucaccccaaaggcucuuuuaagagccacccaccuggucgaagaguugcuguagc

SEQ ID NO: 20722 - RNA, 698 nt, Homo sapiens
gcuacagcaacucuucgaccagguggguggcucuuaaaagagccuuuggggugaacguugcgcaaccucucagguggcgagauagcccuccuaggcccgcuccccgcggauacggcgugccagcuggauguccuuaggcaugauggugacccguuuggcauggaugacacacagguugguguccucaaacagccccaccagguaagacucgcacgccuccugcagcgccaucacggccgagcucuggaagcgcaggucggucuuaaaguccugagcgaucucgcgcaucagccgcuggaagggcaacuugcggauuagcagcucaguggacuucugguagcggcggaucucgcgaagcgccaccgugccgggccgguagcggugcggcuucuucacgccgccaguggcaggugcgcucuugcgagccaccuugguggccagcugcuugcgcggcgccuugccacccguugacuugcgcgcagucugcuugguucgggccaugaauccgaaacuguuggccccgcgguguccucugcccagaccucagcggauugcucgcuuuuauagagcuugccgcguucccauuggcuggccucagguggcgugauggcccacugcucucugauuggcccacagggaacuccacucgggcgccucucccuuauauucaugccuguuggucguggccaccagagcug

SEQ ID NO: 20723 - RNA, 1208 nt, Homo sapiens
ugaugacgcagcgcuccuuguccuuggccuggcugccggcgcuggccuucucgcggauguacaugaggucgcuguguacgcugggccggcgcgcgaagggugccacgaugccaaaggcgucgcccgggucgccgccgccgccgccgcugccggcccgcagcagcuucuuguuccgcagcgccuucuugugcagcacgucgcaguacugcaccgagaccuugcggugcaggucugggcucaucucgcugggcagcuuggccauggcgaagagcgcgcggaacaucugguccaggcugcuguucuucuuggccgagaucucgaaguaggcgcagcgcugggggucgucgcccaccagcugcucgaucucgcgcugguccaccucgcgguagaagucgcggucacccuuguugccgcagaugaccaggggcacguccacguucuccuugguuuuguucuugaggcaagacuuggugucgaggaucugcugccugagccgcugcaccuccucgaaggagucgcgguuguccagacugaacaccaggaugaaaacgucuccuagagggggcacagagagcagaaaaggagaaggugaggguggccgcccaggggacaagucgggcugacuuugaggccgcgcggggcgcgcuagccucucuaagcgcgaagcgcacuacucggcgcgcggcagccggaccggcgcucgcggggcgcccuggccgaggguuccccgcccuucccucccgcaccugcccggcccccggcucaccugugaggauggagaggcgccgcauggcggggaacgggugguugccggacgugucgaggaugucgagcugguagaccucgccgcggauggaguagaacuugcgguggaaguccucgaugguaggcguguaggcguccucgaagcggccggugaggaagcgcgacacgauggccgucuugcccaccuuggacgagccgaggaugaccaugcgauagcaguucuuggccgggauacucagcuccgagucgcucgggcacaucuucuugaucaucgcggccaguuucauugggcagaggggccgcgagggcgggcgcggggccgagagaagggcagagagcggcugagggucgcugggguggcacgcggggugagcggcuggagggcucugcucgggcugggcgcggcucgggcuuggggcuccggcuccgcucgggcugggcuc

SEQ ID NO: 20724 - RNA, 1208 nt, Homo sapiens
gagcccagcccgagcggagccggagccccaagcccgagccgcgcccagcccgagcagagcccuccagccgcucaccccgcgugccaccccagcgacccucagccgcucucugcccuucucucggccccgcgcccgcccucgcggccccucugcccaaugaaacuggccgcgaugaucaagaagaugugcccgagcgacucggagcugaguaucccggccaagaacugcuaucgcauggucauccucggcucguccaaggugggcaagacggccaucgugucgcgcuuccucaccggccgcuucgaggacgccuacacgccuaccaucgaggacuuccaccgcaaguucuacuccauccgcggcgaggucuaccagcucgacauccucgacacguccggcaaccacccguuccccgccaugcggcgccucuccauccucacaggugagccgggggccgggcaggugcgggagggaagggcggggaacccucggccagggcgccccgcgagcgccgguccggcugccgcgcgccgaguagugcgcuucgcgcuuagagaggcuagcgcgccccgcgcggccucaaagucagcccgacuuguccccugggcggccacccucaccuucuccuuuucugcucucugugcccccucuaggagacguuuucauccugguguucagucuggacaaccgcgacuccuucgaggaggugcagcggcucaggcagcagauccucgacaccaagucuugccucaagaacaaaaccaaggagaacguggacgugccccuggucaucugcggcaacaagggugaccgcgacuucuaccgcgagguggaccagcgcgagaucgagcagcuggugggcgacgacccccagcgcugcgccuacuucgagaucucggccaagaagaacagcagccuggaccagauguuccgcgcgcucuucgccauggccaagcugcccagcgagaugagcccagaccugcaccgcaaggucucggugcaguacugcgacgugcugcacaagaaggcgcugcggaacaagaagcugcugcgggccggcagcggcggcggcggcggcgacccgggcgacgccuuuggcaucguggcacccuucgcgcgccggcccagcguacacagcgaccucauguacauccgcgagaaggccagcgccggcagccaggccaaggacaaggagcgcugcgucauca

SEQ ID NO: 20725 - RNA, 1322 nt, Homo sapiens
gaaaagagaagaggauaggcacuugcuccacucuggcugugagccgggcggggcuggcccaaggcggucuuguacagaaggucccggggcguugguuccagaggccccagacugguggaagauuuuaggagaaccguggagaaggugaaggccuggaggguuuugagggaaaagaggcggcgcggucgcgcuagguaucucccuuucuauacucagggccgccaggucugagcccggcaccgugcggcgcacgugcgugcgcgcagagaguccccaaaguucuccacugagacaaagagaaacugcaccagacggagacguagagagaaaagaggaggagagacacagagaggggaggagggaggacgagacugagagaggagaaugcgaagauccggggaggcgagcuacagaaacugaucuaggggcauugggagggggagcggagagggaucgaauggggccggcccuaggcaaucuggggucuuguggccgggguggaagccgggcucucccagcggcgggauccgacgccggggcggccgcacugagucucggucuggucggcccgcucuccuuuucucgcuggucgcagaugcucaagccgcuuguggagaagcggcgccgggaccgcaucaaccgcagccuggaagagcugaggcugcugcugcuggagcggacccgggaccaggucagucccuccgcuagcccuagguccccaagcuucccguuuccgcgucccagggcuucccacugggguggggacacaagcuugguuggcaacccuggccccaaggcauccucacccgagucccgccuuuggaauuccaucccagacccccacucgcucucagaacgcgaucuucuucgccaccccucgggucuguaaguuucacgccugguucuguaaauuucgcucccggggucggucaguuucacccuuugggucucuaaguguccgguucccccucccccacagccagccucugaugagccagccucuguuaugucgggugguuaauuucauucccuggguugcgguuucaaaucuccuccucacgcguugggcauugguuccaaccccuaggauuggacaguuucgucucagggugggccaggacuuuccuuggucaucuccacuccgcauuuggucgcgcguucugugggcagugcgcaaaugcgaucgggggcaccaccagcucccgcauccgucccucccuucuucccccugccacuuucccccuuucuccccaccccuuucugucucugcgcccuccccucccgucuguagaaccuccggaacccgaagcuggagaaagcgg

SEQ ID NO: 20726 - RNA, 1322 nt, Homo sapiens
ccgcuuucuccagcuucggguuccggagguucuacagacgggaggggagggcgcagagacagaaagggguggggagaaagggggaaaguggcagggggaagaagggagggacggaugcgggagcugguggugcccccgaucgcauuugcgcacugcccacagaacgcgcgaccaaaugcggaguggagaugaccaaggaaaguccuggcccacccugagacgaaacuguccaauccuagggguuggaaccaaugcccaacgcgugaggaggagauuugaaaccgcaacccagggaaugaaauuaaccacccgacauaacagaggcuggcucaucagaggcuggcugugggggagggggaaccggacacuuagagacccaaagggugaaacugaccgaccccgggagcgaaauuuacagaaccaggcgugaaacuuacagacccgagggguggcgaagaagaucgcguucugagagcgagugggggucugggauggaauuccaaaggcgggacucgggugaggaugccuuggggccaggguugccaaccaagcuuguguccccaccccagugggaagcccugggacgcggaaacgggaagcuuggggaccuagggcuagcggagggacugaccuggucccggguccgcuccagcagcagcagccucagcucuuccaggcugcgguugaugcggucccggcgccgcuucuccacaagcggcuugagcaucugcgaccagcgagaaaaggagagcgggccgaccagaccgagacucagugcggccgccccggcgucggaucccgccgcugggagagcccggcuuccaccccggccacaagaccccagauugccuagggccggccccauucgaucccucuccgcucccccucccaaugccccuagaucaguuucuguagcucgccuccccggaucuucgcauucuccucucucagucucguccucccuccuccccucucugugucucuccuccucuuuucucucuacgucuccgucuggugcaguuucucuuugucucaguggagaacuuuggggacucucugcgcgcacgcacgugcgccgcacggugccgggcucagaccuggcggcccugaguauagaaagggagauaccuagcgcgaccgcgccgccucuuuucccucaaaacccuccaggccuucaccuucuccacgguucuccuaaaaucuuccaccagucuggggccucuggaaccaacgccccgggaccuucuguacaagaccgccuugggccagccccgcccggcucacagccagaguggagcaagugccuauccucuucucuuuuc

SEQ ID NO: 20727 - RNA, 590 nt, Homo sapiens
ccgagguucguuggcaugcuccugcugccacuaacccuucuucuuucccccagugcucuacugugcggagaucaaggacauuggccaccugacccguugcacguuguaaccgaggaacucggaagcuacagccgaaggaaggugggagcugcagccucgcgggggcugaugucaagacuacucucucucagaucccaggauuggcaugugaugagagagaugagccgaaggcaggagggaacgcccugggagguguugaugcugaguuggggaggcuccuagacgaacucgcccccaucuacugacugugccagucuuacauuuucaggauggaguggccaagggaugauauaaacaaagccuacguuaccgugggaagaagacagacuguuuucuuagcugggacguuggcuuuuguccaggguggcucuggugugugggagcaacaggucccauuuuagcaauucuuugucaaugguuugaauuuuuuuuuuuuuuaagauggaacgggagagaagaggcuaauuuucgcgucauguuaaucucacuucucuggcauguaagggugcugguaugccugcugucucccc

SEQ ID NO: 20728 - RNA, 590 nt, Homo sapiens
ggggagacagcaggcauaccagcacccuuacaugccagagaagugagauuaacaugacgcgaaaauuagccucuucucucccguuccaucuuaaaaaaaaaaaaaauucaaaccauugacaaagaauugcuaaaaugggaccuguugcucccacacaccagagccacccuggacaaaagccaacgucccagcuaagaaaacagucugucuucuucccacgguaacguaggcuuuguuuauaucaucccuuggccacuccauccugaaaauguaagacuggcacagucaguagaugggggcgaguucgucuaggagccuccccaacucagcaucaacaccucccagggcguucccuccugccuucggcucaucucucucaucacaugccaauccugggaucugagagagaguagucuugacaucagcccccgcgaggcugcagcucccaccuuccuucggcuguagcuuccgaguuccucgguuacaacgugcaacgggucagguggccaauguccuugaucuccgcacaguagagcacugggggaaagaagaaggguuaguggcagcaggagcaugccaacgaaccucgg

SEQ ID NO: 20729 - RNA, 544 nt, Homo sapiens
cgcugaaacgucacuaggcgauuuuuccaaagacaccggcgccucgugcucagugacguagcugugcggcuggucuacagagcuuugccaguccuuggaacuuucuucgcucuccguucgguggaucgaaucacgugcuccugggacuggggguccuaagcaauccugccacaucucccggauggggguuccgcacaccaucucugggaggcagaccugugcguaacaggauuccagguccaguugcaguucagugccguccagugaaaacaugggcacuaggagugugaagccggcaucguagugagguccccgggcguagggacccaggggugcaugccccagauccagggagcccucgcgaaucccaccacgaagcagcaagagcucugccuggggaggaaagcgagggucccggcggugaacuagaccuaaaaaaagggaacggaucgugagggcgucgcccaaagccggggcgggggcgggggcguggugaggcugagagcugugaguucccaaaggcaaguaggguuacuuaccaagc

SEQ ID NO: 20730 - RNA, 544 nt, Homo sapiens
gcuugguaaguaacccuacuugccuuugggaacucacagcucucagccucaccacgcccccgcccccgccccggcuuugggcgacgcccucacgauccguucccuuuuuuuaggucuaguucaccgccgggacccucgcuuuccuccccaggcagagcucuugcugcuucguggugggauucgcgagggcucccuggaucuggggcaugcaccccugggucccuacgcccggggaccucacuacgaugccggcuucacacuccuagugcccauguuuucacuggacggcacugaacugcaacuggaccuggaauccuguuacgcacaggucugccucccagagauggugugcggaacccccauccgggagauguggcaggauugcuuaggacccccagucccaggagcacgugauucgauccaccgaacggagagcgaagaaaguuccaaggacuggcaaagcucuguagaccagccgcacagcuacgucacugagcacgaggcgccggugucuuuggaaaaaucgccuagugacguuucagcg

SEQ ID NO: 20731 - RNA, 954 nt, Homo sapiens
ggcccugccccauccacaaucaccuuuuagguguugagccgggcggccguccagcucucccaggugggaacuauccagcggaagaucagcucuuugacucucacauccucccaaauccucagggguggcugaggggauaggccccgccuuauuuagcaaagguuuucccacuucucagcuccucucugagaaaacagugcucagcccaggagcaucacuucuauaccugcccauccugacucccagccuccaccccuuauuugcuuggacucuuccggccaccgcucauuucuaagagaucuagggacagccaggcccgcaccucucagagcccaccccuaggcaaaggagagguaauucuaaggcagugggcaggccagguuggguacccacgugguaaggcuucucuccgguguggaugcgaacguggcucuugagggucugcagguggcggaagcggguuccgcagguagggcaaggguagggcuucuccccgguguggaucagcacgugcgcccgcagaugugccaccugggagggaggagacuucaaguccugccucugggaggaacagaacccucccuauuggcccaccccaccucuugcagguuugccuuggaagccacuuggaggcuggcuccguaccuguacaaagcgcgagccgcacgucucacacuuauacggcuucucucccgaauggaugcggcugugcguuuucagguuugcuggccgguuaaaacgggcuccgcagauugagcagugguaaggcuuuuccccuggaggcagagaacaugggagaucagggacuuugcccuaggacagcugugggcuugaaggccagggcccucucuuccccuaccugugugcacuguacgaugacuggcaagguugcccuuguagcggaacgaagaccggcacagcugacacuuauaggguuugucuucguccccagga

SEQ ID NO: 20732 - RNA, 954 nt, Homo sapiens
uccuggggacgaagacaaacccuauaagugucagcugugccggucuucguuccgcuacaagggcaaccuugccagucaucguacagugcacacagguaggggaagagagggcccuggccuucaagcccacagcuguccuagggcaaagucccugaucucccauguucucugccuccaggggaaaagccuuaccacugcucaaucugcggagcccguuuuaaccggccagcaaaccugaaaacgcacagccgcauccauucgggagagaagccguauaagugugagacgugcggcucgcgcuuuguacagguacggagccagccuccaaguggcuuccaaggcaaaccugcaagagguggggugggccaauagggaggguucuguuccucccagaggcaggacuugaagucuccucccucccagguggcacaucugcgggcgcacgugcugauccacaccggggagaagcccuacccuugcccuaccugcggaacccgcuuccgccaccugcagacccucaagagccacguucgcauccacaccggagagaagccuuaccacguggguacccaaccuggccugcccacugccuuagaauuaccucuccuuugccuaggggugggcucugagaggugcgggccuggcugucccuagaucucuuagaaaugagcgguggccggaagaguccaagcaaauaagggguggaggcugggagucaggaugggcagguauagaagugaugcuccugggcugagcacuguuuucucagagaggagcugagaagugggaaaaccuuugcuaaauaaggcggggccuauccccucagccaccccugaggauuugggaggaugugagagucaaagagcugaucuuccgcuggauaguucccaccugggagagcuggacggccgcccggcucaacaccuaaaaggugauuguggauggggcagggcc

SEQ ID NO: 20733 - RNA, 904 nt, Homo sapiens
ugcgacuccuaucuaguccccaaucccuaguuuagcccaauuucugggacucaggcucgcugauggcaagcuccacacaagcuccuacccucuugggggacccaggagucuggcucccucagucucuuguucuuacccccguccugcaggggccgcggcuucucuucuuaaggggggcggggucucucuccccucuuggccucggcuccuuuaucuggccgggaugucgggggcggggguggagguggggugaacgccugggucuguauccuuccuuccucccucgcucuccagauggcgaguccagggcggggucuccgucucgagggcgggaccucagaaacaagggguggucguaacguagggggucuugggucacugcaaguggacacgaggacggggauauuggaauuggggaggagguuagggauaucgagguuggcaauacgggagucugagucgucggaaggccugggccagugaaaauugguguguuggcuuuugggaggguuugccaggagccaaccuuugcugcaggacaaagugcauacggcaacccccucucccucucuuguacuguguuaagggagaaaagggggagcccaacgagacagcagguuugggcagacgacagugggcucccguagggucucagacggggaggguguggugugaaugacaggcuacucuacccgggccuacaaaaaggggggcucuggccgggcgggguacggagagggcggauaugauuucuaguugguuuccuuccauuguccugcgaccggacggcuccgccagcugcuuccccucgaggagguggggaaagccccgagguggggguggaggggcgagagacgcucgggagaccuaggcguccggccucucucgcucccgacucucuucu

SEQ ID NO: 20734 - RNA, 904 nt, Homo sapiens
agaagagagucgggagcgagagaggccggacgccuaggucucccgagcgucucucgccccuccacccccaccucggggcuuuccccaccuccucgaggggaagcagcuggcggagccguccggucgcaggacaauggaaggaaaccaacuagaaaucauauccgcccucuccguaccccgcccggccagagccccccuuuuuguaggcccggguagaguagccugucauucacaccacacccuccccgucugagacccuacgggagcccacugucgucugcccaaaccugcugucucguugggcucccccuuuucucccuuaacacaguacaagagagggagaggggguugccguaugcacuuuguccugcagcaaagguuggcuccuggcaaacccucccaaaagccaacacaccaauuuucacuggcccaggccuuccgacgacucagacucccguauugccaaccucgauaucccuaaccuccuccccaauuccaauauccccguccucguguccacuugcagugacccaagacccccuacguuacgaccaccccuuguuucugaggucccgcccucgagacggagaccccgcccuggacucgccaucuggagagcgagggaggaaggaaggauacagacccaggcguucaccccaccuccacccccgcccccgacaucccggccagauaaaggagccgaggccaagaggggagagagaccccgccccccuuaagaagagaagccgcggccccugcaggacggggguaagaacaagagacugagggagccagacuccugggucccccaagaggguaggagcuuguguggagcuugccaucagcgagccugagucccagaaauugggcuaaacuagggauuggggacuagauaggagucgca

SEQ ID NO: 20735 - RNA, 485 nt, Homo sapiens
caguguguaggagccgcggccgcaugaaugagccgccgcacgaguacuacgcgcgccuauaaaagccgccgcgccggccaggcugcgggaggcgaccgggcaguggcgacgcggcccgccagguaagcgggacggaccagccgcggagggacagaugugcggacacggacgggaggacgaggaggggacgggcaggcggcggguggggcggccccuccgggguggggaugggggcggacggggggcaccgggguccccucgcggcugcggagccggggccagagacgacacgagcccgcgcagcaccugccggcgcccgauggacacgcagcuacuucggaggagcaucgaguggaggaccgaccucggagacccccccccggcuuucuuggggcuccugcgccauucucccaggaaagugaggcgaaggugcuggcgccccaggagacgcgcccccuccucucccucccugcggcgcggugacu

SEQ ID NO: 20736 - RNA, 485 nt, Homo sapiens
agucaccgcgccgcagggagggagaggagggggcgcgucuccuggggcgccagcaccuucgccucacuuuccugggagaauggcgcaggagccccaagaaagccgggggggggucuccgaggucgguccuccacucgaugcuccuccgaaguagcugcguguccaucgggcgccggcaggugcugcgcgggcucgugucgucucuggccccggcuccgcagccgcgaggggaccccggugccccccguccgcccccauccccaccccggaggggccgccccacccgccgccugcccguccccuccucguccucccguccguguccgcacaucugucccuccgcggcugguccgucccgcuuaccuggcgggccgcgucgccacugcccggucgccucccgcagccuggccggcgcggcggcuuuuauaggcgcgcguaguacucgugcggcggcucauucaugcggccgcggcuccuacacacug

SEQ ID NO: 20737 - RNA, 449 nt, Homo sapiens
ucggcggcgcugcgcggacucgcgcucgccucccacacccccgcacacaaagacgccgcucggcggagggagcaggcgcccgcagcgggcgcgggggcgcacgggacgcgggccccggggacgccgccgcagggacgcgcgcccgcagcccccggguccccacagcugcauagcccggcccucagcccgagcggccggcgcgggauacggggauguggggaugauggggagagaggaaggggaccaggcgccccggguagagcuugucagcucagccccgcggcaucaugggguuuguaguccgccucgugaaacuggggguggcagguggccgaagagggucugcacuguccccggaucucgugggagagugggcggggagucaggccuggcccagacgcgggcggggcccugacgccaggugggcugggacgcaccucccccgcugg

SEQ ID NO: 20738 - RNA, 449 nt, Homo sapiens
ccagcgggggaggugcgucccagcccaccuggcgucagggccccgcccgcgucugggccaggccugacuccccgcccacucucccacgagauccggggacagugcagacccucuucggccaccugccacccccaguuucacgaggcggacuacaaaccccaugaugccgcggggcugagcugacaagcucuacccggggcgccugguccccuuccucucuccccaucauccccacauccccguaucccgcgccggccgcucgggcugagggccgggcuaugcagcuguggggacccgggggcugcgggcgcgcgucccugcggcggcguccccggggcccgcgucccgugcgcccccgcgcccgcugcgggcgccugcucccuccgccgagcggcgucuuugugugcgggggugugggaggcgagcgcgaguccgcgcagcgccgccga

SEQ ID NO: 20739 - RNA, 1317 nt, Homo sapiens
gcgccgcccucgcgcucaucuuggccgugcucgcccuucucggccugcucggcccgcggcuccggggacccugggggcgcgccgucggagagaggacccugccgggggcccaagaccgagacgacggggaggaggcggacggcggaggcccggcggaccaguucagcgacgggcgcgagccacugccgggagggugcagccuuguuugcaagccgucggcccuggcccagugccugcugcgcgcccugcggcgcucagaggcgcuggaggccggcccgcgcuccugguucuccgggccccaccugcagacccucugccacuucguccugcccguagcgccugggccugagcuggcccgggaguaccugcaguuggcggacgaugggcuaguggcccuggacugggugguaggaccuuguguucggggccgccggaucaccagcgccgggggccuuccugcggugcuucuggugauccccaaugcguggggucgccucacccgcaacgugcucggccuuugcuugcucgcccuggagcgcggcuacuacccggucaucuuccaucgccgcggccaccacgguugcccacuggucagcccccggcugcagccuuucggggacccguccgaccucaaggaggcggucacauacauccgcuuccgacacccggcggcgccgcuguucgcggugagcgaaggcucgggcucggcgcugcuccuguccuaccugggcgagugcggcuccuccagcuacgugacaggcgccgccugcaucucgcccgugcugcgcugccgagagugguucgaggccggccugcccuggcccuacgagcggggcuuucugcuccaccagaagaucgcccucagcagguggguaacggaggccgcagaccagcauggaaagaauagagggccugagcuggcuaagaaucagaaacagcuaugcauagcauuggaacaggcgugggccaguuugggcaaaguucucugaacacaucuuccaaagccuuccaaacccuguaaucuagacagaaccggggaagcggguuuaaaggucaucgauggacucagcuaguaucgcugugcuagagcagggacuccuaacccggccccuugccucaucucggcacccccugcuguauccuagcaaucugagcaccuggcccacgacagcagagauaccugacauuuaccacuuagcccacagcuuaacagcucagcaaagagcacucuggaagcaauugcaaacgauuaucugcccagaauguuuacucacagucucugagccuggaggugacaggaaucagaaauaugguggc

SEQ ID NO: 20740 - RNA, 1317 nt, Homo sapiens
gccaccauauuucugauuccugucaccuccaggcucagagacugugaguaaacauucugggcagauaaucguuugcaauugcuuccagagugcucuuugcugagcuguuaagcugugggcuaagugguaaaugucagguaucucugcugucgugggccaggugcucagauugcuaggauacagcagggggugccgagaugaggcaaggggccggguuaggagucccugcucuagcacagcgauacuagcugaguccaucgaugaccuuuaaacccgcuuccccgguucugucuagauuacaggguuuggaaggcuuuggaagauguguucagagaacuuugcccaaacuggcccacgccuguuccaaugcuaugcauagcuguuucugauucuuagccagcucaggcccucuauucuuuccaugcuggucugcggccuccguuacccaccugcugagggcgaucuucugguggagcagaaagccccgcucguagggccagggcaggccggccucgaaccacucucggcagcgcagcacgggcgagaugcaggcggcgccugucacguagcuggaggagccgcacucgcccagguaggacaggagcagcgccgagcccgagccuucgcucaccgcgaacagcggcgccgccgggugucggaagcggauguaugugaccgccuccuugaggucggacggguccccgaaaggcugcagccgggggcugaccagugggcaaccgugguggccgcggcgauggaagaugaccggguaguagccgcgcuccagggcgagcaagcaaaggccgagcacguugcgggugaggcgaccccacgcauuggggaucaccagaagcaccgcaggaaggcccccggcgcuggugauccggcggccccgaacacaagguccuaccacccaguccagggccacuagcccaucguccgccaacugcagguacucccgggccagcucaggcccaggcgcuacgggcaggacgaaguggcagagggucugcagguggggcccggagaaccaggagcgcgggccggccuccagcgccucugagcgccgcagggcgcgcagcaggcacugggccagggccgacggcuugcaaacaaggcugcacccucccggcaguggcucgcgcccgucgcugaacugguccgccgggccuccgccguccgccuccuccccgucgucucggucuugggcccccggcaggguccucucuccgacggcgcgcccccaggguccccggagccgcgggccgagcaggccgagaagggcgagcacggccaagaugagcgcgagggcggcgc

SEQ ID NO: 20741 - RNA, 1107 nt, Homo sapiens
aaugguucucgaggcuggaggaaggggguggggacuugcuuuuuauguuuuuuuuuuuuucuauuuuucuuaaauaaagguucauuucuguacaaccacgaacuccgcagaccgugcgagaccccgcuaccacacggccgccucguucauuucgggggggugggacaggugguuuccguagcucgccccaccguugaccgacagcgacgagaagggcgggcuggguccgaagaccucggccgacauggagugcagaggcccgggcaggcugggcucggggcugggcgaguccccgggugggugcgccaggaugucgguaaaccgcugcgccucgcucgacgggugguggcccggcagcgggugcuccaggccacccaggggcgucccggacggcccagaugacggcacgaaggguagguccacuggugucugggccugcgaggacggggggccuugcgggaagaagucguaguugcccccgggcccguaguacucgcucugguaaucugcggagcggcggggagggcgcaggacgucagggcccggccgggggccggcgggaccgaaagggagggaagacgcgaccucggcgggcugaggaaggccacgcggggaacucgcggaucgcggggagcccucgcgggccugggugcagggaggaggcugggcgcaagcccgggagcugccccuuaccagcuacccccguuauucagggccgugaauuggguccucggucucgccgccuccccuugauuuacucccagccuucucccuacucgccccaacucuccaguggcuuacagagagcgaggcgugcccccccgcgcugccacccgcuuccaacgaagcccgccccgaccuggccgugccccgccauucggcgcgcacccaccuccguagaaggagaagggaccauuggggaugagcucgcccggcuccaggcgguccaccagcggccgcauccggcgcggacugcggaagaaggcguggcgccgggcgcccagggcgcucagcugcuucauccuccgcuccuuggagcgccgguucuggaaccagaccugcagcacauggcggcggggugaggccaccgagacuccacccccgacc

SEQ ID NO: 20742 - RNA, 1107 nt, Homo sapiens
ggucggggguggagucucgguggccucaccccgccgccaugugcugcaggucugguuccagaaccggcgcuccaaggagcggaggaugaagcagcugagcgcccugggcgcccggcgccacgccuucuuccgcaguccgcgccggaugcggccgcugguggaccgccuggagccgggcgagcucauccccaauggucccuucuccuucuacggaggugggugcgcgccgaauggcggggcacggccaggucggggcgggcuucguuggaagcggguggcagcgcgggggggcacgccucgcucucuguaagccacuggagaguuggggcgaguagggagaaggcugggaguaaaucaaggggaggcggcgagaccgaggacccaauucacggcccugaauaacggggguagcugguaaggggcagcucccgggcuugcgcccagccuccucccugcacccaggcccgcgagggcuccccgcgauccgcgaguuccccgcguggccuuccucagcccgccgaggucgcgucuucccucccuuucggucccgccggcccccggccgggcccugacguccugcgcccuccccgccgcuccgcagauuaccagagcgaguacuacgggcccgggggcaacuacgacuucuucccgcaaggccccccguccucgcaggcccagacaccaguggaccuacccuucgugccgucaucugggccguccgggacgccccuggguggccuggagcacccgcugccgggccaccacccgucgagcgaggcgcagcgguuuaccgacauccuggcgcacccacccggggacucgcccagccccgagcccagccugcccgggccucugcacuccaugucggccgaggucuucggacccagcccgcccuucucgucgcugucggucaacgguggggcgagcuacggaaaccaccugucccacccccccgaaaugaacgaggcggccgugugguagcggggucucgcacggucugcggaguucgugguuguacagaaaugaaccuuuauuuaagaaaaauagaaaaaaaaaaaaacauaaaaagcaaguccccacccccuuccuccagccucgagaaccauu

SEQ ID NO: 20743 - RNA, 1649 nt, Homo sapiens
ggaccaguuccacaagcuaggcacggagauggucaucaccaaguccgggagguagggcugccggccggcuggaaggcgcgcgggcgggcgggcgggcuggggcacgggacugcacggaucagagcagagcuggggacucccggcucccggcucccggcuccagguucuggcccugacgccacgcuucgcucccacggacaaccaaguugacuuuucucguuuggcaccggagcgauuuuuuuuuaaaacaaaaacgcuaaaauccuccgaaugaaauaaaacgaaaacauacugcuaaagaauagccccaaccguucugagucccagcgcagaggaggccccgcggcuuggcccuggcggucuccuccgccccgcgcucucgcucuucugcguccggguccgucuccgagcucgggggaaauucagccucucucagacucugcuccgaccccgaagccccuagugggaccugggcccagcuaaccccacgcugguugcucgguuccuggcagcgagccccgggucagccgagcccuccgccucaccgggcugggagcccuuucuccaccgcgggcauccgagcccuggacgcauccgccgccccaggccuuaaagccugaagaaagccacagccccggccccuccacccuucgacucagccaccgagaauccaggccucggguucacccucuucccccgaacugcacggccaggaugucuuaucaggcucuguagcccaguucccaauacaaacacccuccagauuuauuucugggagcuuccgucccaaguggguauuuccccugaacgaauuucggggagauuaaggagaagcgagaauauuucuagagggccuagacuucucuccugggcaucagcuuucaucucagaucagggagaaagaggguccccagaucugagcacaaggccuaaaggaggcuguuuaggagagggucugacaggcagaaaugggaucuccugggagcaacaaccacagguggggucguccgggcagugaugagagggcagagcagccgaccacaggggaaacagccaggcggcagcggugugcgcaacgaggagggauaaauaaaggaggagugggguccuggaaccuagaacagccgguuccaaugggaucuccucccuucccucccucccaggcggauguucccccccuucaaggugcgagucagcggccuggacaagaaggccaaguauauccugcugauggacauuguagccgcugacgauugccgcuauaaguuccacaacucgcgcuggaugguggcgggcaaggccgacccugagaugcccaaacgcauguacauccacccagacagcccagccacgggggagcaguggauggcuaagccuguggccuuccacaagcugaagcugaccaacaacaucucugacaagcacggcuucgugaguguuggggcaggguggggacggugcaggagcuuguugacccagcacugcagcugagcaggagagcagggcggcaggaucucccagggggaagcgcugggcaaacccccagagugccccugcccgggucacugcccuguggucuacgugggcugggccugggccugggccccagcgcucuccuuugcaagccugggaaaugguggggucagugg

SEQ ID NO: 20744 - RNA, 1649 nt, Homo sapiens
ccacugaccccaccauuucccaggcuugcaaaggagagcgcuggggcccaggcccaggcccagcccacguagaccacagggcagugacccgggcaggggcacucuggggguuugcccagcgcuucccccugggagauccugccgcccugcucuccugcucagcugcagugcugggucaacaagcuccugcaccguccccacccugccccaacacucacgaagccgugcuugucagagauguuguuggucagcuucagcuuguggaaggccacaggcuuagccauccacugcucccccguggcugggcugucuggguggauguacaugcguuugggcaucucagggucggccuugcccgccaccauccagcgcgaguuguggaacuuauagcggcaaucgucagcggcuacaauguccaucagcaggauauacuuggccuucuuguccaggccgcugacucgcaccuugaagggggggaacauccgccugggagggagggaagggaggagaucccauuggaaccggcuguucuagguuccaggaccccacuccuccuuuauuuaucccuccucguugcgcacaccgcugccgccuggcuguuuccccuguggucggcugcucugcccucucaucacugcccggacgaccccaccugugguuguugcucccaggagaucccauuucugccugucagacccucuccuaaacagccuccuuuaggccuugugcucagaucuggggacccucuuucucccugaucugagaugaaagcugaugcccaggagagaagucuaggcccucuagaaauauucucgcuucuccuuaaucuccccgaaauucguucaggggaaauacccacuugggacggaagcucccagaaauaaaucuggaggguguuuguauugggaacugggcuacagagccugauaagacauccuggccgugcaguucgggggaagagggugaacccgaggccuggauucucgguggcugagucgaaggguggaggggccggggcuguggcuuucuucaggcuuuaaggccuggggcggcggaugcguccagggcucggaugcccgcgguggagaaagggcucccagcccggugaggcggagggcucggcugacccggggcucgcugccaggaaccgagcaaccagcgugggguuagcugggcccaggucccacuaggggcuucggggucggagcagagucugagagaggcugaauuucccccgagcucggagacggacccggacgcagaagagcgagagcgcggggcggaggagaccgccagggccaagccgcggggccuccucugcgcugggacucagaacgguuggggcuauucuuuagcaguauguuuucguuuuauuucauucggaggauuuuagcguuuuuguuuuaaaaaaaaaucgcuccggugccaaacgagaaaagucaacuugguuguccgugggagcgaagcguggcgucagggccagaaccuggagccgggagccgggagccgggaguccccagcucugcucugauccgugcagucccgugccccagcccgcccgcccgcccgcgcgccuuccagccggccggcagcccuaccucccggacuuggugaugaccaucuccgugccuagcuuguggaacuggucc

SEQ ID NO: 20745 - RNA, 872 nt, Homo sapiens
ucugaucaggugucuauuagcuuggaugaagacaaaacagguuuacuuuccaggcccuucuuuucuuuaggcuuuugagaaaaucccaaaagugaguuugaacuuaauuacagcgaaucuugcaguaguaaacuuuuuggguggccagaguaacaccuuucauuacaacuaucagcugaauggcaaaagacuucccagguuuaccaauguuuucagagacuuacuaguauucuccucugucauuauuucggaacaauuccauugagaaacgcaauuguaaaccguuucuauuucaggccuauaaaaaccagaacugggaugaaaggcaaagccuugaccuuucuauuuuagacuuucaucuguguagcuaagccaucugcuuucuccccaccccaucccaucuacuuaauggacugaaaauacugcaccuaauugcaauuuaaucaaaacagccugacuuuuccacuuuaaugaauuauggcucuuucacccgaaggcuugcuugcaaaauuuugcuuacccuucccucucaauuccuucccacuucccucaauuauggaaugucaaaugucuaaacuaagagacuaggcuucccugugugaaaacaucuaaaaagcccuucacuuucaacacugagcaccugacggaaaaucuacuccauucucucaucuggauacggggccgguauaaccaucauuguugcaguuacgcaggaggcaccucgcagcucagucuagaaaggagucgcgucucugccgccaaacaacaaggcacucagcccgggaaaagacagacuggggugggaggaaaccucccggagaaagaagggaucugggaagaagagggagcucaagccugggaggaaggaccuu

SEQ ID NO: 20746 - RNA, 872 nt, Homo sapiens
aagguccuuccucccaggcuugagcucccucuucuucccagaucccuucuuucuccgggagguuuccucccaccccagucugucuuuucccgggcugagugccuuguuguuuggcggcagagacgcgacuccuuucuagacugagcugcgaggugccuccugcguaacugcaacaaugaugguuauaccggccccguauccagaugagagaauggaguagauuuuccgucaggugcucaguguugaaagugaagggcuuuuuagauguuuucacacagggaagccuagucucuuaguuuagacauuugacauuccauaauugagggaagugggaaggaauugagagggaaggguaagcaaaauuuugcaagcaagccuucgggugaaagagccauaauucauuaaaguggaaaagucaggcuguuuugauuaaauugcaauuaggugcaguauuuucaguccauuaaguagaugggaugggguggggagaaagcagauggcuuagcuacacagaugaaagucuaaaauagaaaggucaaggcuuugccuuucaucccaguucugguuuuuauaggccugaaauagaaacgguuuacaauugcguuucucaauggaauuguuccgaaauaaugacagaggagaauacuaguaagucucugaaaacauugguaaaccugggaagucuuuugccauucagcugauaguuguaaugaaagguguuacucuggccacccaaaaaguuuacuacugcaagauucgcuguaauuaaguucaaacucacuuuugggauuuucucaaaagccuaaagaaaagaagggccuggaaaguaaaccuguuuugucuucauccaagcuaauagacaccugaucaga

SEQ ID NO: 20747 - RNA, 1332 nt, Homo sapiens
guguugaccaccuagaguccuuggccuuuguuucacagaacagaucucacggccacaucuccuucuuuaagaguaggcaggucugucggcgguuccuuuuucgaaucccuagagucggugggacuacguagcucuggcucccgcagccgcccagcccagacagcucagagagcugcugaucugcucugcguucucucuuuuuccucccucuucuccccgccacucagcaaaaagacccgccagacuccugggcaguuggagucccuucaagaacccugggagcacuguaauguaacuccuuuagcucccacuccgcacccucagaugucgcacagccugggugcugggaucaacacgggaagauucacuagauugacucugugcggaugaacgggcacccuuuccuuccccuccuccaucuccacuuaucuacccuuugugcaguucuuagaccgagguuuauacugaaauagcuucuaaacaucaaauauuaaaaguggauaaaaaauccccgcgggguauguguguguuuguguuuguuauguguguguucauccgcgcuugugcaaaaucuccuaacgucacaguucccaaucgggacaagcgcgccgagaaauccuggaucuucccagggauucccucuacgcucccuccucuucuucaauaaccccaaagagguagguuugagcuuucgcaaaccaccacugcagcgauggaagcagacaaaucuguugagauuuugucuuuccccuuucguucccagcccucuuaggcaagcaguucugagcacaggguuuucuucaauuccccugcauccacacugcaaccgggugcaagucuuuccuagguuauagacagcccgccuccccacgagaccuucugcggacuggcugccccuggccucggccuggguggguggguggugcucgcgccgccccuacuuuccccuggggcccuggagagccgcgcgcugggugugugugugugugcgcgcgcggguuugguggggaaaucuccuucaguggaagcugcugagugucguuggcggaaaguauccuggagcccagcaaaagccuccaaagcacuagagcuucccuaaagaaaagcagaauaaaagaaagacaagaagggaagcccguuccucuaaagcccggguuuccaauagucccggauccuccuggaguugggcgaaggcgcaguuggcagcagccgcugcuggcacccggacuuggaaaggcgguguucccccuuuucgggaggagggaggcagggacuugcaggcaagaguugcaccuggucuaggaaccugcagagaaaagaacucugggguaa

SEQ ID NO: 20748 - RNA, 1332 nt, Homo sapiens
uuaccccagaguucuuuucucugcagguuccuagaccaggugcaacucuugccugcaagucccugccucccuccucccgaaaagggggaacaccgccuuuccaaguccgggugccagcagcggcugcugccaacugcgccuucgcccaacuccaggaggauccgggacuauuggaaacccgggcuuuagaggaacgggcuucccuucuugucuuucuuuuauucugcuuuucuuuagggaagcucuagugcuuuggaggcuuuugcugggcuccaggauacuuuccgccaacgacacucagcagcuuccacugaaggagauuuccccaccaaacccgcgcgcgcacacacacacacacccagcgcgcggcucuccagggccccaggggaaaguaggggcggcgcgagcaccacccacccacccaggccgaggccaggggcagccaguccgcagaaggucucguggggaggcgggcugucuauaaccuaggaaagacuugcacccgguugcaguguggaugcaggggaauugaagaaaacccugugcucagaacugcuugccuaagagggcugggaacgaaaggggaaagacaaaaucucaacagauuugucugcuuccaucgcugcaguggugguuugcgaaagcucaaaccuaccucuuugggguuauugaagaagaggagggagcguagagggaaucccugggaagauccaggauuucucggcgcgcuugucccgauugggaacugugacguuaggagauuuugcacaagcgcggaugaacacacacauaacaaacacaaacacacacauaccccgcggggauuuuuuauccacuuuuaauauuugauguuuagaagcuauuucaguauaaaccucggucuaagaacugcacaaaggguagauaaguggagauggaggaggggaaggaaagggugcccguucauccgcacagagucaaucuagugaaucuucccguguugaucccagcacccaggcugugcgacaucugagggugcggagugggagcuaaaggaguuacauuacagugcucccaggguucuugaagggacuccaacugcccaggagucuggcgggucuuuuugcugaguggcggggagaagagggaggaaaaagagagaacgcagagcagaucagcagcucucugagcugucugggcugggcggcugcgggagccagagcuacguagucccaccgacucuagggauucgaaaaaggaaccgccgacagaccugccuacucuuaaagaaggagauguggccgugagaucuguucugugaaacaaaggccaaggacucuagguggucaacac

SEQ ID NO: 20749 - RNA, 694 nt, Homo sapiens
aagcccccugcaccuccccagcuucaauuuaucuuccccucuugcccucccacccccaacacccccuggcacuucccuacccuggcccgcaguuguagccaacacaucacauccucugggaaucccccagcccagcucccgccgcggccgccuggacccaggccgggccaggggugcgcucucccuuccggcaagaagugcccucuguuagcugggcccauggcgcccaggcucgugagggccuccccacucgucugagcccccgacuggcccacuggccuugagcgcaguuagggggcggggguucuguucaccgcuguccccuccagccucggcgccccggcugcucggcggacguuuguugaaugaaugaacuaaucgggagcccugauggacccggcagaggaggcggaagccccgugggucccguggcgggaccgccccggagccgcucccacccgcgcagacuccggugcgccgcgucucccgcgggcagagaaguagcugcaacuccgcuccccggccccagccgccuccuccccgccgcccucccccgcccccgcccccucgcucccucccgcucuuugucuccugggcgcccggcuucuccgccacgcgccccccaccccgacgccccuuccccggagacccccgcggaccccugccgacgcgacgccgcgcgaaucggcccugc

SEQ ID NO: 20750 - RNA, 694 nt, Homo sapiens
gcagggccgauucgcgcggcgucgcgucggcagggguccgcgggggucuccggggaaggggcgucgggguggggggcgcguggcggagaagccgggcgcccaggagacaaagagcgggagggagcgagggggcgggggcgggggagggcggcggggaggaggcggcuggggccggggagcggaguugcagcuacuucucugcccgcgggagacgcggcgcaccggagucugcgcgggugggagcggcuccggggcggucccgccacgggacccacggggcuuccgccuccucugccggguccaucagggcucccgauuaguucauucauucaacaaacguccgccgagcagccggggcgccgaggcuggaggggacagcggugaacagaacccccgcccccuaacugcgcucaaggccagugggccagucgggggcucagacgaguggggaggcccucacgagccugggcgccaugggcccagcuaacagagggcacuucuugccggaagggagagcgcaccccuggcccggccuggguccaggcggccgcggcgggagcugggcugggggauucccagaggaugugauguguuggcuacaacugcgggccaggguagggaagugccaggggguguugggggugggagggcaagaggggaagauaaauugaagcuggggaggugcagggggcuu

SEQ ID NO: 20751 - RNA, 1878 nt, Homo sapiens
uuugccuggaaggcaagacuugcagccaaucagcgcguaggagccucccucggcgacuccacuauugagucuauaaccggcuggccgggcggagcuggcagcauuugauuguggcuugggacgcgaggagaggcgcgcagcgaccgccugacggcaggcaaugguguaagcgccucucggccucccccuccccccagacgcggccggguccucccuucgccuucuggacacacaccccugccucgucucuuccgccucucucgcacuccgguccguuccuguccucugcggaggccagcccuggggaggugcagcgcccgccaggaugaguggcuccuucgaucgcaagcucagcagcauccucaccgacaucuccagcucccuuagcugccaugcgggcuccaaggacucgccuacccugcccgagucuucugucacugaccugggcuacuacagcgcuccccagcacgauuacuacucgggccagcccuauggccagacggugaaccccuacaccuaccaccaccaauucaaucucaaugggcuugcaggcacgggcgcuuacucgcccaagucggaauauaccuacggagccuccuaccggcaauacggggcguaucgggagcagccgcugccagcccaggacccaggugagggccacggggucgcgaggacagugggagacacuggaagguucccgagggaggaaaaggcauggacuggaagccaaaaucuaggaaaacuucuaagaaaaguacugucuggaguuagagaaguuggccuagaugacccucagagggaccaggcgaccuuccagccccgggugugcaagcauuuggggcgcgaugugcgcagugcgccgcggucccggaugaggaucgggaugagcugagagaggaaggggaaggcuguggguuguuaggaaaccuccgaaucgaggugauuucgugggcauuucagcaggcgauccucgaucaagucgcagagggcuuggggguaggcggcaggggcuggaaacucuaggggcccuccuuuggauaagggauggggagacuaggagucgugagggggcaaugagaaggacccacggaaguugcgggaaagcggagggaagcagccaccgagaggcagagaagcugaaaaagggaaaagugaaggcagcaagagggaaguauggaaagacagugagagaaagggcagaagaaacaagaaaggaaggagagaaggaaggggggaagaagggggacagggaaagaaagaaagucugcacuauccuugcaacuuuucugaaaaucuaaagagauucuaaaaugaaacuuuuuuaaagggcggggggcggacgggaaggagcgagagaaacaaccgacggcgagaugggacugggaagggggcggcuagcagccgggcggcgaggagccccgaggcugggaggcgagccgggaaggcgucgugagcgaagccgaggcgguccuggcgcaggcggcggcuggcgccggggacagugcugcggcggccgggcgcggagcugggagcgccgcguugugggccgcggccaguucuggcucuggggccgcggcuccccccugggccgcgggcagcggagcgcgcggccgggaaucccgcggcgagucggugggcggaagcgaggggcguccggcggggcccuggagggucgcaggagucgcaggccgaggcugaaccgcccccucuuccgcccggugcguuccccgcagugucggugaaggaggagccggaagcagaggugcgcauggugaaugggaagcccaagaagguccgaaagccgcguacgaucuacuccagcuaccagcuggccgcccugcagcgccgcuuccagaaggcccaguaccuggcgcugcc

SEQ ID NO: 20752 - RNA, 1878 nt, Homo sapiens
ggcagcgccagguacugggccuucuggaagcggcgcugcagggcggccagcugguagcuggaguagaucguacgcggcuuucggaccuucuugggcuucccauucaccaugcgcaccucugcuuccggcuccuccuucaccgacacugcggggaacgcaccgggcggaagagggggcgguucagccucggccugcgacuccugcgacccuccagggccccgccggacgccccucgcuuccgcccaccgacucgccgcgggauucccggccgcgcgcuccgcugcccgcggcccaggggggagccgcggccccagagccagaacuggccgcggcccacaacgcggcgcucccagcuccgcgcccggccgccgcagcacuguccccggcgccagccgccgccugcgccaggaccgccucggcuucgcucacgacgccuucccggcucgccucccagccucggggcuccucgccgcccggcugcuagccgcccccuucccagucccaucucgccgucgguuguuucucucgcuccuucccguccgccccccgcccuuuaaaaaaguuucauuuuagaaucucuuuagauuuucagaaaaguugcaaggauagugcagacuuucuuucuuucccugucccccuucuuccccccuuccuucucuccuuccuuucuuguuucuucugcccuuucucucacugucuuuccauacuucccucuugcugccuucacuuuucccuuuuucagcuucucugccucucgguggcugcuucccuccgcuuucccgcaacuuccguggguccuucucauugcccccucacgacuccuagucuccccaucccuuauccaaaggagggccccuagaguuuccagccccugccgccuacccccaagcccucugcgacuugaucgaggaucgccugcugaaaugcccacgaaaucaccucgauucggagguuuccuaacaacccacagccuuccccuuccucucucagcucaucccgauccucauccgggaccgcggcgcacugcgcacaucgcgccccaaaugcuugcacacccggggcuggaaggucgccuggucccucugagggucaucuaggccaacuucucuaacuccagacaguacuuuucuuagaaguuuuccuagauuuuggcuuccaguccaugccuuuuccucccucgggaaccuuccagugucucccacuguccucgcgaccccguggcccucaccuggguccugggcuggcagcggcugcucccgauacgccccguauugccgguaggaggcuccguagguauauuccgacuugggcgaguaagcgcccgugccugcaagcccauugagauugaauugguggugguagguguagggguucaccgucuggccauagggcuggcccgaguaguaaucgugcuggggagcgcuguaguagcccaggucagugacagaagacucgggcaggguaggcgaguccuuggagcccgcauggcagcuaagggagcuggagaugucggugaggaugcugcugagcuugcgaucgaaggagccacucauccuggcgggcgcugcaccuccccagggcuggccuccgcagaggacaggaacggaccggagugcgagagaggcggaagagacgaggcagggguguguguccagaaggcgaagggaggacccggccgcgucuggggggagggggaggccgagaggcgcuuacaccauugccugccgucaggcggucgcugcgcgccucuccucgcgucccaagccacaaucaaaugcugccagcuccgcccggccagccgguuauagacucaauaguggagucgccgagggaggcuccuacgcgcugauuggcugcaagucuugccuuccaggcaaa

SEQ ID NO: 20753 - RNA, 3908 nt, Homo sapiens
auauuuguaaagccuccacuuuuguugcucaaaauuuucuuucugucucucauuccucucccuugccaaucuacugcuacaggaggcuacugguucugacccucagacuggggccuucuaaagccuggccaccaccaucgugaagccggguaggcagggaacgcaguggccacagaguguggcacccagucagcuuguuccagcuuuccguguucagaccucugguucccaggucugcagggagagccagguuuaacuacaggcuccccaaggcgaaaggagagaaaaugggagacucagcaaccuugcuuuaucugaauuccacacccaagucaguuuagguggugacaguggcucaaaaggucuuggggacacugaggacuaauagaugcccucccaacacauacucugcaggcacugccuaggguggcugagagcauaggacagcggacacgaaggccaggugccagggccugauacccaaccuucuuuccuuuugaugcagugaugggcucagugguccccucucacccuuaggcacugcagaaggugugggggucggccugggaagguugggagcuauuaauaauugggcuuggcuacugggucccaaggccugggugcaagugucggguagcccauuggggcuucaucccucugauggcaucaggcccucucccuucaugcaaagucugcccucaaaagugcugaugggcugaagggccuucaggagacccccuuuucagcaagcagagagugcacaaaccugcagaaucggcaguggcagcucgaacuuugcucugugcuucaaccacugcucauuaaccagaaaguuucuucuucccucccguucccuccucaagaucucccagaucccuguuucacagaaaauuuuugcuuauuuguuuaaugagaggaaguuuugugacuggccagggcagggcagagagggcagggcagagaagggaccuuuugggggcuccagagaaggggugggggcaggugcuugccaggacggaaggaggugaaaaucucagaaaagucaccguuugugccaaaaaaaaauccccauaaucauucucauuucggcuucgucacccccaccgugcugcaaucgggcggcgggggcgaucgaagcugcaguuuuauagcuguagaggaaagaacucguaaaaugcuaacagcuuuuaugcgcugcggcauaaacaacaacagacuccggcuuuauugcguuuuauaguuucuuaaagaguuuacagccguuuuuuggggggccgguuauccagccaauucccuccacacgauaguuaaaccuuuaucaauaauaaggaaauugaucauuaaagcuuuaaauaugacuaccucguuuguuugaaaauacguuuaggagaggaagcuguaugauuugauaacuuguauuaaaauaccaauuacauuuauaggaccuuuuaaaacucggcgcaauuaaaccguguucuuuuacauuuuuccgaagcgacccugacauuuagaaagacuccaauugccucguuaaaaucgcgaaauuaacagcgugccuacgccuggcgcguuguguaugugugugugcguguuuuuuuccgugacucccccacaucagucuuuggggguggucugcgaagguauuugauuuguugugaggcgagagauaucucauuaauguagguaguuaaacagauuuaauccguauucauucucucucacccccucucccucucccccucucucucccccucucccccucucucucccuggguguuuuuuucuuccccuccuuuuuuuuuuuccgcucucuccucacucccuggcgcucucucgcucuagcucucucucucgcucgcucucucucgcucucacccucgcucugcguucuguccgggaggaguacgaagaagccaauaggaugcggggucucuaauggaugcaaaugaucaugaaaagacagugcaaaauaugaaacaacucauuugcagggaaguaaaucaccgaaaacuguuuaugaacuggcaucccuucuucgaaauguaaagcgaggaccucuuuaaguggugguauauuuuuguuuggggggugggggguggggggagggcgagcgagccgcggcugccaugcaagcuuagacuuuuggaggcuucucuguccuuuucuauuccuggaaaccacaaaaagugugucggcuucgagaucuucuucgccuuuucuuucuuuucuuuuuuucccuccucucuuucccucuccuuuccuggcgagggugacuaggagccggcgaauccgcguuuuuuucucucucucccucccuuucccccuccccacccccuccccaacagcccccaacuauagccuccgccgccgccgccgccucaaaauucaauaaaaugagcucuuauuucgucaacucacuguucuccaaauacaaaaccggggagucccugcgccccaauuauuaugacugcggcuucgcccaggaccugggcggccgacccaccgugguguacggucccagcagcggcggcagcuuccagcacccgucgcaaauccaggaguucuaccacgggccgucgucgcuguccacggcucccuaccagcagaacccgugcgccguggcgugccacggggaccccggcaauuucuacggcuacgacccgcugcaacgccagagccuauucggugcgcaggauccagaccuggugcaguacgcagacugcaagcuugccgccgccagcggccugggcgaggaggccgagggcuccgagcagagcccgucgcccacacagcucuuccccuggaugcgcccgcaaggugagcucgccucggggccgacaagggcaggagggggccggaagggcccaaggccuggcaggccggggcgcauuuccuccagcuucuggaagacuugccggcuccguuccgaucgccugccgcuuuuccccuuucuuucuuaucuuucuuucuucuuucuuuuuucuuucccuugaagggggucgcuuagaaacauuuccugaaucuauaaaccccucauccugccuuacuuuucuucuucuucuccuccuuuuuuuccccuuuuacuguuuuaugggggguagugaagagaggguggugggagugggggcgcucaacuuuugcacuucucaauugcuuuauaguuuaauuacccugaagaaacuuuucuucuggggcagaggcucugggggcuuuucaagguggguccauucguccccacccggcuuuuuuauucuuauuuuccccccuccuucacauccuuccuccuaaaguuuauggcacuucuaauagaucugaaccaccuccuacacaacucuggugcugguuaccgggggagggggcuccccuuucuggcucccuuagauucacuugugucuaaucccccucgccccuccuccuccgccgaccgcggccuucuugcgccccccccgcccccgcacgggguagaagguccccugcccuuauuauaauggucucccaggcucguucacgaaucuuccaaccuucuccgucccugcccccucccccacccuccccuccccucugucucgcccuuucccccauucccagcagccgccggacgcaggcgaggccgacagaccuacagccgcuaccagacccuggagcuggagaaggaguuccuauuuaaucccuaucugacucguaagcggcgaaucgagguaucgcacgcccugggacugacagagagacaggucaaaaucugguuccagaaccggaggaugaaguggaaaaaagagaacaacaaagacaaguuccccagcagcaaaugcgagcaggaggagcuggagaaacagaagcuggagcgggccccagaggcggcggacgagggcgacgcgcagaagggcgacaagaaguaggcuucagcuggg

SEQ ID NO: 20754 - RNA, 3908 nt, Homo sapiens
cccagcugaagccuacuucuugucgcccuucugcgcgucgcccucguccgccgccucuggggcccgcuccagcuucuguuucuccagcuccuccugcucgcauuugcugcuggggaacuugucuuuguuguucucuuuuuuccacuucauccuccgguucuggaaccagauuuugaccugucucucugucagucccagggcgugcgauaccucgauucgccgcuuacgagucagauagggauuaaauaggaacuccuucuccagcuccagggucugguagcggcuguaggucugucggccucgccugcguccggcggcugcugggaaugggggaaagggcgagacagaggggaggggagggugggggagggggcagggacggagaagguuggaagauucgugaacgagccugggagaccauuauaauaagggcaggggaccuucuaccccgugcgggggcggggggggcgcaagaaggccgcggucggcggaggaggaggggcgagggggauuagacacaagugaaucuaagggagccagaaaggggagcccccucccccgguaaccagcaccagaguuguguaggaggugguucagaucuauuagaagugccauaaacuuuaggaggaaggaugugaaggaggggggaaaauaagaauaaaaaagccggguggggacgaauggacccaccuugaaaagcccccagagccucugccccagaagaaaaguuucuucaggguaauuaaacuauaaagcaauugagaagugcaaaaguugagcgcccccacucccaccacccucucuucacuaccccccauaaaacaguaaaaggggaaaaaaaggaggagaagaagaagaaaaguaaggcaggaugagggguuuauagauucaggaaauguuucuaagcgacccccuucaagggaaagaaaaaagaaagaagaaagaaagauaagaaagaaaggggaaaagcggcaggcgaucggaacggagccggcaagucuuccagaagcuggaggaaaugcgccccggccugccaggccuugggcccuuccggcccccuccugcccuugucggccccgaggcgagcucaccuugcgggcgcauccaggggaagagcugugugggcgacgggcucugcucggagcccucggccuccucgcccaggccgcuggcggcggcaagcuugcagucugcguacugcaccaggucuggauccugcgcaccgaauaggcucuggcguugcagcgggucguagccguagaaauugccgggguccccguggcacgccacggcgcacggguucugcugguagggagccguggacagcgacgacggcccgugguagaacuccuggauuugcgacgggugcuggaagcugccgccgcugcugggaccguacaccacggugggucggccgcccagguccugggcgaagccgcagucauaauaauuggggcgcagggacuccccgguuuuguauuuggagaacagugaguugacgaaauaagagcucauuuuauugaauuuugaggcggcggcggcggcggaggcuauaguugggggcuguuggggaggggguggggagggggaaagggagggagagagagaaaaaaacgcggauucgccggcuccuagucacccucgccaggaaaggagagggaaagagaggagggaaaaaaagaaaagaaagaaaaggcgaagaagaucucgaagccgacacacuuuuugugguuuccaggaauagaaaaggacagagaagccuccaaaagucuaagcuugcauggcagccgcggcucgcucgcccuccccccaccccccaccccccaaacaaaaauauaccaccacuuaaagagguccucgcuuuacauuucgaagaagggaugccaguucauaaacaguuuucggugauuuacuucccugcaaaugaguuguuucauauuuugcacugucuuuucaugaucauuugcauccauuagagaccccgcauccuauuggcuucuucguacuccucccggacagaacgcagagcgagggugagagcgagagagagcgagcgagagagagagcuagagcgagagagcgccagggagugaggagagagcggaaaaaaaaaaaggaggggaagaaaaaaacacccagggagagagagggggagagggggagagagagggggagagggagagggggugagagagaaugaauacggauuaaaucuguuuaacuaccuacauuaaugagauaucucucgccucacaacaaaucaaauaccuucgcagaccacccccaaagacugaugugggggagucacggaaaaaaacacgcacacacacauacacaacgcgccaggcguaggcacgcuguuaauuucgcgauuuuaacgaggcaauuggagucuuucuaaaugucagggucgcuucggaaaaauguaaaagaacacgguuuaauugcgccgaguuuuaaaagguccuauaaauguaauugguauuuuaauacaaguuaucaaaucauacagcuuccucuccuaaacguauuuucaaacaaacgagguagucauauuuaaagcuuuaaugaucaauuuccuuauuauugauaaagguuuaacuaucguguggagggaauuggcuggauaaccggccccccaaaaaacggcuguaaacucuuuaagaaacuauaaaacgcaauaaagccggagucuguuguuguuuaugccgcagcgcauaaaagcuguuagcauuuuacgaguucuuuccucuacagcuauaaaacugcagcuucgaucgcccccgccgcccgauugcagcacggugggggugacgaagccgaaaugagaaugauuauggggauuuuuuuuuggcacaaacggugacuuuucugagauuuucaccuccuuccguccuggcaagcaccugcccccaccccuucucuggagcccccaaaaggucccuucucugcccugcccucucugcccugcccuggccagucacaaaacuuccucucauuaaacaaauaagcaaaaauuuucugugaaacagggaucugggagaucuugaggagggaacgggagggaagaagaaacuuucugguuaaugagcagugguugaagcacagagcaaaguucgagcugccacugccgauucugcagguuugugcacucucugcuugcugaaaagggggucuccugaaggcccuucagcccaucagcacuuuugagggcagacuuugcaugaagggagagggccugaugccaucagagggaugaagccccaaugggcuacccgacacuugcacccaggccuugggacccaguagccaagcccaauuauuaauagcucccaaccuucccaggccgacccccacaccuucugcagugccuaagggugagaggggaccacugagcccaucacugcaucaaaaggaaagaagguuggguaucaggcccuggcaccuggccuucguguccgcuguccuaugcucucagccacccuaggcagugccugcagaguauguguugggagggcaucuauuaguccucaguguccccaagaccuuuugagccacugucaccaccuaaacugacuuggguguggaauucagauaaagcaagguugcugagucucccauuuucucuccuuucgccuuggggagccuguaguuaaaccuggcucucccugcagaccugggaaccagaggucugaacacggaaagcuggaacaagcugacugggugccacacucuguggccacugcguucccugccuacccggcuucacgauggugguggccaggcuuuagaaggccccagucugagggucagaaccaguagccuccuguagcaguagauuggcaagggagaggaaugagagacagaaagaaaauuuugagcaacaaaaguggaggcuuuacaaauau

SEQ ID NO: 20755 - RNA, 817 nt, Homo sapiens
ugagcauacuuuuuuucccucggacuguuguuguugggggagcaggaggagaagggagaccgcucuucccugccucucccucucagggacuuggccaccuucgcucuguucugaggccauggcucucugccuuccuuccuucgcugccucugcuucucugguagucacgcuccacugaggcauccgccuccgggaaccgggagagcagcgcgcccgggccaaccuccacccuuccuuucucuccccacccucccaacccccuuuuucuuuuacuuucaaaccuuuuuuuuucuuuuucuuucuuucuuucuuuuuuuuuuugccaccagaaacggcagcguccaaggcccgugggcuggauccugugcccuaggagcaccuaggaagacuugcuccaucuccgcccgcauaucuggggcaccaagagagacagagucgugagccaggcucgccucauuccucgucuugggagaaccggaccaacuuccccaaaaggccuugccgugcagaauuggccugguuuaauaaagaacagaccugccccaagcacccacccacccaguugcgugcauucaaucccugcguuugucucucgcucgguaacgggcugaagaggauggguggagggugacacggaucgccccgagguuauuuauuuucccuuccacucaaucucuuccuccccaaaucucgccugcaagcggccuccagcccgcgggagucggcagcggcccuugagcccccagccccaauccacagggcucggcuuucccauucauuauugaucauauuuuauaaauccaacgccacacaauuu

SEQ ID NO: 20756 - RNA, 817 nt, Homo sapiens
aaauuguguggcguuggauuuauaaaauaugaucaauaaugaaugggaaagccgagcccuguggauuggggcugggggcucaagggccgcugccgacucccgcgggcuggaggccgcuugcaggcgagauuuggggaggaagagauugaguggaagggaaaauaaauaaccucggggcgauccgugucacccuccacccauccucuucagcccguuaccgagcgagagacaaacgcagggauugaaugcacgcaacugggugggugggugcuuggggcaggucuguucuuuauuaaaccaggccaauucugcacggcaaggccuuuuggggaaguugguccgguucucccaagacgaggaaugaggcgagccuggcucacgacucugucucucuuggugccccagauaugcgggcggagauggagcaagucuuccuaggugcuccuagggcacaggauccagcccacgggccuuggacgcugccguuucugguggcaaaaaaaaaaagaaagaaagaaagaaaaagaaaaaaaaagguuugaaaguaaaagaaaaaggggguugggaggguggggagagaaaggaaggguggagguuggcccgggcgcgcugcucucccgguucccggaggcggaugccucaguggagcgugacuaccagagaagcagaggcagcgaaggaaggaaggcagagagccauggccucagaacagagcgaagguggccaagucccugagagggagaggcagggaagagcggucucccuucuccuccugcucccccaacaacaacaguccgagggaaaaaaaguaugcuca

SEQ ID NO: 20757 - RNA, 465 nt, Homo sapiens
ccgcucucugcgccgccgccggcagccuggaaccuucuccgcugcacagagagagaggggggaaaauguugggggagguuauuucguuuccagaauucgggcauugguaggucaacuugaaauacgggguuauuucaggggaccugaaaaaccugggcugaauuuuuauuuuauuuuuugcuuccaaacauccgcugauugcaggaccaaaacuuggaggauggugucuaugcggcuagacccgcugaauugauuuuuagcauuuauucgauuauaaacucuggauuguuuaaauuuaaacagacuuuggauagaaagagggaagaggguugguuuuaggauaaucuguugaauuugaauuuguauguaaaaugcuuuuaaaccugcaguuucccccauuaaugaccacguaacgcccuggagagcgcauggagcugucauaggaaaccuggacuugccugcauu

SEQ ID NO: 20758 - RNA, 465 nt, Homo sapiens
aaugcaggcaaguccagguuuccuaugacagcuccaugcgcucuccagggcguuacguggucauuaaugggggaaacugcagguuuaaaagcauuuuacauacaaauucaaauucaacagauuauccuaaaaccaacccucuucccucuuucuauccaaagucuguuuaaauuuaaacaauccagaguuuauaaucgaauaaaugcuaaaaaucaauucagcgggucuagccgcauagacaccauccuccaaguuuugguccugcaaucagcggauguuuggaagcaaaaaauaaaauaaaaauucagcccagguuuuucagguccccugaaauaaccccguauuucaaguugaccuaccaaugcccgaauucuggaaacgaaauaaccucccccaacauuuuccccccucucucucugugcagcggagaagguuccaggcugccggcggcggcgcagagagcgg

SEQ ID NO: 20759 - RNA, 8954 nt, Homo sapiens
aggucggagcacugucguccuucagggcuccagccucuugauauuuuuguacuucaguaucagcucgauagagcaaaagagagagaggacgagagaggggggugaggagaaaagagagagagcgcgagagggagagggagagaaggaggggugggaauuacacaaagagagaaccaaaaauaauuuugauuccuaaguuaauuugcucacugaucugggauuuuagucaccauggaggguaaauggacaaucugcccaggacugcagcccgauacuauuuuucaaagccagaacuuacuccauuuucuaugcaaaugucagaaaaaugaaacacccucucucccaagucagagaaggggaagcaacggcucucacguugggacaauauuaucuggaagcugaagaagaaacugaauacuccuuccuuccuccccacccauuccuuuaaauccggagggggaaaaaaucccaaggucugcaaagguaagggagauucuacaauuuucuucuuguucuuuugcaucgcuuuuguaggguggggguggggcuuggguuuuucucccuccucccccguuccaagacggggcugaaccccaccucugggcgcugcagggagaagcuucccaggaaauucagugguggagauauggguggcugcuuccuggagggggagccaaggcagggaaagcgggaagaggaaucaaaagagggccaggagaccagcucuaagucgccuuuuuaagcuuggaggagagacucaagcaaggggggugcgaaagagaggaugggggguaucugggcuucaguggcacccaaagaagccagugguucuggccuccgcgggcuugccccucccccuccugccaucccucccuugucucggccucuggcuauugccccagcgcaguucucuugccuggugcggauaucgcuggguucccggcagcacuggcaugugaggcgguggcgcuaagggacguccugguuucuauagggccuggaaucuccgccgaggccggcgagggagaggaaacggcuagagaaacacagaaaagacaauuuacagagaaauguuuacuaucucccuucggagacauuuuugaaauuaaagggcuguggguggaaacaccaaaaaugagggagacuccccccucaccaggaagccugcccgagaaugcccaaguaucucgccacucccgcaggagggagccucgcucuacagggagacaguuuugugguuuuaaugcgguagguuacagcuguugguuucugcgugauacugauucuauuacuugcguuguauugguaugggauguguggauuucgguggaggaaaaaauugccaugugugugucugauaugauaacauuucaaacuuuccuggguccagacauggugauugugaagaagcuguuaagugccuuuuuguuuuaggcuuguaaauaaaaauaaaagagaaagaaaugaaagaagaaaauaaaaagaaaauccaauuaugggaccuagcggcgucuaaacugaaaagcuaacuggcacugagcucagacagucccgucccucggguguccaauuuuaucccucagucaggccuucuaggggguggggagggcggagaacauugggcaggugacagagauuccuaaaguagcucgugggguggaaguaggugccagccuugaggcaaggacuuaaaaaugggguaagggagcuucuggggaagcuuccagccaagagauaagugauguuggcuguggagggcaggagaaauugugauuuuuagucugguuugcacgaacaugugauugcuuuucucuuucuuaagaccagaugcaggacauucagccucgggccucugguugccccggaguuacagggucuggggcguuuuggaaguggggauauauuuauuaucucaguccuaagcuaggagagggacgacgcugccacuuguggcgcggaagaggcggcucuguggccccagguagaugcccuagguucaggcccggccugggcgccuggagggaccgcugggcuucguagcuagaguucuccgccagcacccacggcacucggggacuauucucaagggaaaaauuucccaaacccacccauacuaaaggucuuuuucuccuguagucuuggaggguuauaaauccucccuuagacaguucgcugugacccaaauuaugcggucugcugccaucuaccguccguucggagacacgcggcuucggcgccgcaagccccgcgacacuguccagaggugcccgacgccuggagccccggccucgcaggguccacgggauucgggggauuucgggcccacaccgacgcucucagcuagaucuugguuccccggugugaguuagagaacagaagucucuccuccacccaucauccccaauuucccacugcccccguccccgcccauccuagccccaaaccuggcggcuggcaagggaagcggcuuccucuagggcauauauaaaaaggucuaauucugcuuccagcgggcaggggcccugaaucaaaggguggagggaucagagccgacacccccaccgccauccccacccccaccccaccaaggcgcgggagaggaugaggccgcuugagacauccgaagccaaggcuguucaagguuuauuugguuuucuucucagccaagggaggggacccgcagggcaggcgccggccccgucaguuccacucgguugucaaaagacaaaccgggucuguguucuccugguugguuaguggguuuugccagcuccuugguugguggguccguggugaaggaauugaaccgaauuuucuggaaacuguugaugucugcaagugagugccgauccccuccuccauucucgaucuuuucaagcgaagucuaccuaaauaugauuugggaaaaauuugguagugggacuggggccaaauccuuaaggaaccacaccgucguaauuuccguuccuguuggacccuccacaccggcuuaacucgaccuccuucccaagaggggguggccagggcuaggcuaugcgccucugcugcagcguuugaauauuggccccugucucacggguuacugauuagcuugggcuuucaagccguaggaggaagcucuggcaguuccuuuaaaggugcugugguccccguuccugggugggggugggguuccaggaaauugccugcggugccaggcaaaccaagguguugccagagucuggccgagggcuagaggagcugacgagguuaaggggccugguggugcuggggacaaacacuguggcugcagcccucacccucuuucggcgccucuggagcagcucuuuauagcuuuccugcggcgaggugacuuucugguggcuauaaggcccgacucaaggagcugcucuauaggaggcccugagggagccagcccuagaagguccuuggccccucugagauuuugcuuuugggcaauccaaaggacauguagagaagucaagcugguacaugguauugaaacacuucagggcccucagguuguccccuggaccugcggguaggaaaccgggagaguggguucagcacuacugcucacuccccuaaagaucaaagaggaugccgcuccuuugcauaaugaaaaugaagucuuuguacuuugauuuggaggggccgauuuuagggcaaagugucucaucuaaacagccucccucaaccuaugggagugaucacucaguaccccugggaacauuuauuuauguuccccaaacccagagaaacagaguccaggacgagaauugaguugaaauauuuucaucccaccccaccccagccaaaguuggggguggugggagaaggugcucaucaccucaaagagcugagggagagggcuuuauagcuuagaggaaauuggaagccuggacaaugucucagcacccucccacacacaccacaccacaccacacacacacacacacacacacacacacgcaaauaucccuccugagguuaccuaucaagaauuuuacucccgaacugaacacaacuuaggaaacauuuuccugggagcuggaauguguuagcuugcccacaggacugcagacucacagcauagaaaauuacaauuauaaauccugccugugggguaucuguacaaucccucuguuauguacucaagaauugguacacacuucuauccaucucucugaacacacacuuccucauugaggcagggagagacaccccagacuggcggauggcugagcccgcuguguauuuacauauucccccaaggagacagacagagggcgguggaccgaaccacagacagauucguagggaucuggcuccagaaaggagucggucucuggccugcccugcccgccugcucuuuuucccaaacaaacggaucagacgaauaaacgcucauaaauaccucugggcuuagauaagagcgaugaggcgcuauuuucuuucaugcccgacuccaggcgcccaggcccgccuguaguggcuccaucuccagacaagcaaccugcagaggugagguuaauuugggggcugugacucuaaagauaaggcaauuauuucccugcuucugacacagggaaaugcucccuuccucaccagaucuuauuuuguucagacuucacugagaaaaccacacuauuuagugcuaggauggagacauugugggcagggaggaggcagggaaggcugaggcccagggcucagccucagcaguaggcagggaggugcaugcagguacucucucccacuuuucucccccuguucaaauggccccuaguccucucuagaagcaagcccagccauaccuagauauggaauauuuauccuucuucauuaucaggggguuuaaauuuguuuucuuaaaugcuuaucaaacacucccacagagucagguuaggaaguaauuggaggccaucuagggauggcuauuuugccauuaagguacagccaagaaguugcccugaguuuagagagccuuggagaccacguugcaaccaaauaaguucccacccuuggugauccaagcucaguccccugccaccuucccuagugucuuguaccaucuucagugggcagaacuuggccagaaaaaggagcccaaaggaaggacaaggcagaggagggucagccuggccugacaucugacuuuguuccaugcccuggccccuucuuguccccaggugugaagguugucacccuucacuacuuggccuguguauguauauuagaauguugggaaugcacuguggcccugucucccagccugggcucaaugcuuauuuuccuuggaugaaagagccagagacauacauucucugacacaccuaaauuuguaaggcggcaaagcugaugauacaaacacggggugugggagggaauuguagcgaugcugagauacagacagaagggagaggggaugcuggcugauggcuggaagcagccugcugaguccccaagagaacgcaaacgaccuucucucccuaucaaacuaaagcaaaaaccaagucuugggaaagaauuaauuuuaaaaagaacuggcagcuccuacagagacuuagaagaggagugaggaugcauuucuucccaguggucucugacugccucaacuaucaggaggguucaaagcccacaacuggaagaagaaugauuucuuccuugugcccagauuuacugggacaucccugauuccugaaaauccuauagcccaggcuauucuuaagucuuuugggauuguagaggguacuggagugaggguugcaggcaggauagggaucagacaaauaaagccaccuaggcugagggauaccccucacuccuucacuccauaucaccaagugaggagagggcuagucccuuuccccagugccccuuccccugccaagggugagcagcugcauacuagaaccaggcagaauguuuugggcagccacccucgucgccgccuuccaagaagcuccuagucuagccacagagucagaaggggaagcuugggcucagucccuccugccagcuccuccucuucugggucuucuaggcagugggaucuggccugcccccucagaccagaaggguuguggagaagcaggaacaauaagccgaggcuuggaggagacagagcagaucugauaaacaggaaaaacgauguucaaaaccuggggaggaggguguuucuucuuugcuuaucuuagcggagaacucuucucaccuucuaccgacacaaaacccuagaaacaaaccuucuuuaguucucucucaaggcgauucggagacauuuacccaacccuccccggagagaaggggucgaagcaacgcagggguuaacuuuucugaaaacacaauuaacuuuuuccaauccugcguggggugggggagagacauauuuauuuaaucacccgggagugggguggucucaaucuaaacguucccuccucccucaaaggcacugagccuguuucacagauccuacguagguggaacaggacgcguuguguuguuggggggagagaggagaaaggcgaaggagaaggaggaaaaaaaaaaagguugauagguuugugcgcgggucccucgugcgggcugcgcuccuccugggugcuauuugacaauuccugccucugccauuggucaguguuggaucagaugguuguauuuccuucuggcccucacuggcaccucgccauccccccucagcuaaaacccaaucucggauauacuacuaauaggcgcggcgcucggacuauaaaacacaacaaaucauaaacccggcggagcagcagcggccgcgcgcgccuccccucccaaugaguuccuauuucgugaacuccaccuuccccgucacucuggccagcgggcaggaguccuuccugggccagcuaccgcucuauucgucgggcuaugcggacccgcugagacauuaccccgcgcccuacgggccagggccgggccaggacaagggcuuugccacuuccuccuauuacccgccggcgggcgguggcuacggccgagcggcgcccugcgacuacgggccggcgccggccuucuaccgcgagaaagagucggccugcgcacucuccggcgccgacgagcagcccccguuccaccccgagccgcggaagucggacugcgcgcaggacaagagcguguucggcgagacagaagagcagaagugcuccacuccggucuacccguggaugcagcggaugaauucgugcaacagugagugagacuucccgucgccgucgccccggcuccccugggcgcccaccccgggacacagaacuagugagcgcccccugccccaaucucccacagggugcugggugggcaucucaguuaggagauagaagaagauugggcgccggccgggggucucucgcuguguccccuauuaggcaggaguuacaaaguuugcaaagucccagccgcacugggagccauggggagcaagugugcucuccuggggcgccuggccagagccgggguuccaggacagggaagggagcaggagccugcagucacuggcuuggcuuuacuuugagcccccaaccccccucucccagcccugguaggguuccccaaccaaagacggcuccauuaaaaacggagugcgucaugcaaggggguagggggugacgcugaagagaaagaguugagucugucugggacuguguuucccuguggguggggagcuggggcaagaugaggcaccaggaaaggggugguagucagaggagggaggaggaauaaggggaaggaagagagagggagcaggcggagcgagagagggagaaacaggcgcggggucucagguuggauuauuuguuggccuuaagucccaacugauguccauuagccggacucgaaagugaggagccguuaauguggacuauggaucgaucuacgucauuacggauuaacggccuggauuuaucauuggguuggggggaugacggggggugggaacaagauggauggaaagggagggaaagacaagaugcaacuaggaagagacacaccugaccagccccuccccccaggcucaggugggaguucaaacugcuccuccccucccccaucuagagucuagacagacggcacaggccuaggagacuaggagggaaucuggagggggcgcuggaggagugcgaaacgggggaagggagccggcagaauagagggcaucccgguacuggcuggagucuguguucgagggucgacuaggggaggggguccugggcccggugaccgcaggccucagcaucuccacucugcguaacagguuccuccuuugggcccagcggccggcgaggccgccagacauacacacguuaccagacgcuggagcuggagaaggaguuucacuacaaucgcuaccugacgcggcggcggcgcaucgagaucgcgcacgcccugugccugacggagaggcagaucaagauaugguuccagaaccgacgcaugaaguggaaaaaggagagcaaacugcucagcgcgucucagcucagugccgaggaggaggaagaaaaacaggccgagugaaggugcuggaaagggagggaggacgcgaggggaaaggccuguggggagccgagggcgucagagagacccgggaaggaaggcucucgggugggggagccaggagaccugcucuccggcgcagacaggcggggcccagcgcucuccuggacgcccccgcccgcacagcucccggcgggugcucugaggccucacuacucgagcccacccagcaucccgcgcgcccuuccuucccgaggaacucgccucagccugaucaggcuuccuggugagaacugaggagcggacucacuugauguuuccuggaagcagagcaaaaugcucuugucccugucgcgucucauuuuguccaugucccccgugcacgguucaaugguagauucgcuguccccucagcgggggccuug

SEQ ID NO: 20760 - RNA, 8954 nt, Homo sapiens
caaggcccccgcugaggggacagcgaaucuaccauugaaccgugcacgggggacauggacaaaaugagacgcgacagggacaagagcauuuugcucugcuuccaggaaacaucaagugaguccgcuccucaguucucaccaggaagccugaucaggcugaggcgaguuccucgggaaggaagggcgcgcgggaugcugggugggcucgaguagugaggccucagagcacccgccgggagcugugcgggcgggggcguccaggagagcgcugggccccgccugucugcgccggagagcaggucuccuggcucccccacccgagagccuuccuucccgggucucucugacgcccucggcuccccacaggccuuuccccucgcguccucccucccuuuccagcaccuucacucggccuguuuuucuuccuccuccucggcacugagcugagacgcgcugagcaguuugcucuccuuuuuccacuucaugcgucgguucuggaaccauaucuugaucugccucuccgucaggcacagggcgugcgcgaucucgaugcgccgccgccgcgucagguagcgauuguagugaaacuccuucuccagcuccagcgucugguaacguguguaugucuggcggccucgccggccgcugggcccaaaggaggaaccuguuacgcagaguggagaugcugaggccugcggucaccgggcccaggacccccuccccuagucgacccucgaacacagacuccagccaguaccgggaugcccucuauucugccggcucccuucccccguuucgcacuccuccagcgcccccuccagauucccuccuagucuccuaggccugugccgucugucuagacucuagaugggggaggggaggagcaguuugaacucccaccugagccuggggggaggggcuggucaggugugucucuuccuaguugcaucuugucuuucccucccuuuccauccaucuuguucccaccccccgucauccccccaacccaaugauaaauccaggccguuaauccguaaugacguagaucgauccauaguccacauuaacggcuccucacuuucgaguccggcuaauggacaucaguugggacuuaaggccaacaaauaauccaaccugagaccccgcgccuguuucucccucucucgcuccgccugcucccucucucuuccuuccccuuauuccuccucccuccucugacuaccaccccuuuccuggugccucaucuugccccagcuccccacccacagggaaacacagucccagacagacucaacucuuucucuucagcgucacccccuacccccuugcaugacgcacuccguuuuuaauggagccgucuuugguuggggaacccuaccagggcugggagagggggguugggggcucaaaguaaagccaagccagugacugcaggcuccugcucccuucccuguccuggaaccccggcucuggccaggcgccccaggagagcacacuugcuccccauggcucccagugcggcugggacuuugcaaacuuuguaacuccugccuaauaggggacacagcgagagacccccggccggcgcccaaucuucuucuaucuccuaacugagaugcccacccagcacccugugggagauuggggcagggggcgcucacuaguucugugucccggggugggcgcccaggggagccggggcgacggcgacgggaagucucacucacuguugcacgaauucauccgcugcauccacggguagaccggaguggagcacuucugcucuucugucucgccgaacacgcucuuguccugcgcgcaguccgacuuccgcggcucgggguggaacgggggcugcucgucggcgccggagagugcgcaggccgacucuuucucgcgguagaaggccggcgccggcccguagucgcagggcgccgcucggccguagccaccgcccgccggcggguaauaggaggaaguggcaaagcccuuguccuggcccggcccuggcccguagggcgcgggguaaugucucagcggguccgcauagcccgacgaauagagcgguagcuggcccaggaaggacuccugcccgcuggccagagugacggggaagguggaguucacgaaauaggaacucauugggaggggaggcgcgcgcggccgcugcugcuccgccggguuuaugauuuguuguguuuuauaguccgagcgccgcgccuauuaguaguauauccgagauuggguuuuagcugaggggggauggcgaggugccagugagggccagaaggaaauacaaccaucugauccaacacugaccaauggcagaggcaggaauugucaaauagcacccaggaggagcgcagcccgcacgagggacccgcgcacaaaccuaucaaccuuuuuuuuuuuccuccuucuccuucgccuuucuccucucuccccccaacaacacaacgcguccuguuccaccuacguaggaucugugaaacaggcucagugccuuugagggaggagggaacguuuagauugagaccaccccacucccgggugauuaaauaaauaugucucucccccaccccacgcaggauuggaaaaaguuaauuguguuuucagaaaaguuaaccccugcguugcuucgaccccuucucuccggggaggguuggguaaaugucuccgaaucgccuugagagagaacuaaagaagguuuguuucuaggguuuugugucgguagaaggugagaagaguucuccgcuaagauaagcaaagaagaaacacccuccuccccagguuuugaacaucguuuuuccuguuuaucagaucugcucugucuccuccaagccucggcuuauuguuccugcuucuccacaacccuucuggucugagggggcaggccagaucccacugccuagaagacccagaagaggaggagcuggcaggagggacugagcccaagcuuccccuucugacucuguggcuagacuaggagcuucuuggaaggcggcgacgaggguggcugcccaaaacauucugccugguucuaguaugcagcugcucacccuuggcaggggaaggggcacuggggaaagggacuagcccucuccucacuuggugauauggagugaaggagugagggguaucccucagccuagguggcuuuauuugucugaucccuauccugccugcaacccucacuccaguacccucuacaaucccaaaagacuuaagaauagccugggcuauaggauuuucaggaaucagggaugucccaguaaaucugggcacaaggaagaaaucauucuucuuccaguugugggcuuugaacccuccugauaguugaggcagucagagaccacugggaagaaaugcauccucacuccucuucuaagucucuguaggagcugccaguucuuuuuaaaauuaauucuuucccaagacuugguuuuugcuuuaguuugauagggagagaaggucguuugcguucucuuggggacucagcaggcugcuuccagccaucagccagcauccccucucccuucugucuguaucucagcaucgcuacaauucccucccacaccccguguuuguaucaucagcuuugccgccuuacaaauuuaggugugucagagaauguaugucucuggcucuuucauccaaggaaaauaagcauugagcccaggcugggagacagggccacagugcauucccaacauucuaauauacauacacaggccaaguagugaagggugacaaccuucacaccuggggacaagaaggggccagggcauggaacaaagucagaugucaggccaggcugacccuccucugccuuguccuuccuuugggcuccuuuuucuggccaaguucugcccacugaagaugguacaagacacuagggaagguggcaggggacugagcuuggaucaccaagggugggaacuuauuugguugcaacguggucuccaaggcucucuaaacucagggcaacuucuuggcuguaccuuaauggcaaaauagccaucccuagauggccuccaauuacuuccuaaccugacucugugggaguguuugauaagcauuuaagaaaacaaauuuaaacccccugauaaugaagaaggauaaauauuccauaucuagguauggcugggcuugcuucuagagaggacuaggggccauuugaacagggggagaaaagugggagagaguaccugcaugcaccucccugccuacugcugaggcugagcccugggccucagccuucccugccuccucccugcccacaaugucuccauccuagcacuaaauagugugguuuucucagugaagucugaacaaaauaagaucuggugaggaagggagcauuucccugugucagaagcagggaaauaauugccuuaucuuuagagucacagcccccaaauuaaccucaccucugcagguugcuugucuggagauggagccacuacaggcgggccugggcgccuggagucgggcaugaaagaaaauagcgccucaucgcucuuaucuaagcccagagguauuuaugagcguuuauucgucugauccguuuguuugggaaaaagagcaggcgggcagggcaggccagagaccgacuccuuucuggagccagaucccuacgaaucugucugugguucgguccaccgcccucugucugucuccuugggggaauauguaaauacacagcgggcucagccauccgccagucuggggugucucucccugccucaaugaggaaguguguguucagagagauggauagaaguguguaccaauucuugaguacauaacagagggauuguacagauaccccacaggcaggauuuauaauuguaauuuucuaugcugugagucugcaguccugugggcaagcuaacacauuccagcucccaggaaaauguuuccuaaguuguguucaguucgggaguaaaauucuugauagguaaccucaggagggauauuugcguguguguguguguguguguguguguguggugugguguggugugugugggagggugcugagacauuguccaggcuuccaauuuccucuaagcuauaaagcccucucccucagcucuuugaggugaugagcaccuucucccaccacccccaacuuuggcugggguggggugggaugaaaauauuucaacucaauucucguccuggacucuguuucucuggguuuggggaacauaaauaaauguucccagggguacugagugaucacucccauagguugagggaggcuguuuagaugagacacuuugcccuaaaaucggccccuccaaaucaaaguacaaagacuucauuuucauuaugcaaaggagcggcauccucuuugaucuuuaggggagugagcaguagugcugaacccacucucccgguuuccuacccgcagguccaggggacaaccugagggcccugaaguguuucaauaccauguaccagcuugacuucucuacauguccuuuggauugcccaaaagcaaaaucucagaggggccaaggaccuucuagggcuggcucccucagggccuccuauagagcagcuccuugagucgggccuuauagccaccagaaagucaccucgccgcaggaaagcuauaaagagcugcuccagaggcgccgaaagagggugagggcugcagccacaguguuuguccccagcaccaccaggccccuuaaccucgucagcuccucuagcccucggccagacucuggcaacaccuugguuugccuggcaccgcaggcaauuuccuggaaccccacccccacccaggaacggggaccacagcaccuuuaaaggaacugccagagcuuccuccuacggcuugaaagcccaagcuaaucaguaacccgugagacaggggccaauauucaaacgcugcagcagaggcgcauagccuagcccuggccacccccucuugggaaggaggucgaguuaagccgguguggaggguccaacaggaacggaaauuacgacggugugguuccuuaaggauuuggccccagucccacuaccaaauuuuucccaaaucauauuuagguagacuucgcuugaaaagaucgagaauggaggaggggaucggcacucacuugcagacaucaacaguuuccagaaaauucgguucaauuccuucaccacggacccaccaaccaaggagcuggcaaaacccacuaaccaaccaggagaacacagacccgguuugucuuuugacaaccgaguggaacugacggggccggcgccugcccugcggguccccucccuuggcugagaagaaaaccaaauaaaccuugaacagccuuggcuucggaugucucaagcggccucauccucucccgcgccuuggugggguggggguggggauggcggugggggugucggcucugaucccuccacccuuugauucagggccccugcccgcuggaagcagaauuagaccuuuuuauauaugcccuagaggaagccgcuucccuugccagccgccagguuuggggcuaggaugggcggggacgggggcagugggaaauuggggaugauggguggaggagagacuucuguucucuaacucacaccggggaaccaagaucuagcugagagcgucggugugggcccgaaaucccccgaaucccguggacccugcgaggccggggcuccaggcgucgggcaccucuggacagugucgcggggcuugcggcgccgaagccgcgugucuccgaacggacgguagauggcagcagaccgcauaauuugggucacagcgaacugucuaagggaggauuuauaacccuccaagacuacaggagaaaaagaccuuuaguauggguggguuugggaaauuuuucccuugagaauaguccccgagugccgugggugcuggcggagaacucuagcuacgaagcccagcggucccuccaggcgcccaggccgggccugaaccuagggcaucuaccuggggccacagagccgccucuuccgcgccacaaguggcagcgucgucccucuccuagcuuaggacugagauaauaaauauauccccacuuccaaaacgccccagacccuguaacuccggggcaaccagaggcccgaggcugaauguccugcaucuggucuuaagaaagagaaaagcaaucacauguucgugcaaaccagacuaaaaaucacaauuucuccugcccuccacagccaacaucacuuaucucuuggcuggaagcuuccccagaagcucccuuaccccauuuuuaaguccuugccucaaggcuggcaccuacuuccaccccacgagcuacuuuaggaaucucugucaccugcccaauguucuccgcccuccccacccccuagaaggccugacugagggauaaaauuggacacccgagggacgggacugucugagcucagugccaguuagcuuuucaguuuagacgccgcuaggucccauaauuggauuuucuuuuuauuuucuucuuucauuucuuucucuuuuauuuuuauuuacaagccuaaaacaaaaaggcacuuaacagcuucuucacaaucaccaugucuggacccaggaaaguuugaaauguuaucauaucagacacacacauggcaauuuuuuccuccaccgaaauccacacaucccauaccaauacaacgcaaguaauagaaucaguaucacgcagaaaccaacagcuguaaccuaccgcauuaaaaccacaaaacugucucccuguagagcgaggcucccuccugcgggaguggcgagauacuugggcauucucgggcaggcuuccuggugaggggggagucucccucauuuuugguguuuccacccacagcccuuuaauuucaaaaaugucuccgaagggagauaguaaacauuucucuguaaauugucuuuucuguguuucucuagccguuuccucucccucgccggccucggcggagauuccaggcccuauagaaaccaggacgucccuuagcgccaccgccucacaugccagugcugccgggaacccagcgauauccgcaccaggcaagagaacugcgcuggggcaauagccagaggccgagacaagggagggauggcaggagggggaggggcaagcccgcggaggccagaaccacuggcuucuuugggugccacugaagcccagauaccccccauccucucuuucgcaccccccuugcuugagucucuccuccaagcuuaaaaaggcgacuuagagcuggucuccuggcccucuuuugauuccucuucccgcuuucccugccuuggcucccccuccaggaagcagccacccauaucuccaccacugaauuuccugggaagcuucucccugcagcgcccagaggugggguucagccccgucuuggaacgggggaggagggagaaaaacccaagccccacccccacccuacaaaagcgaugcaaaagaacaagaagaaaauuguagaaucucccuuaccuuugcagaccuugggauuuuuucccccuccggauuuaaaggaauggguggggaggaaggaaggaguauucaguuucuucuucagcuuccagauaauauugucccaacgugagagccguugcuuccccuucucugacuugggagagaggguguuucauuuuucugacauuugcauagaaaauggaguaaguucuggcuuugaaaaauaguaucgggcugcaguccugggcagauuguccauuuacccuccauggugacuaaaaucccagaucagugagcaaauuaacuuaggaaucaaaauuauuuuugguucucucuuuguguaauucccaccccuccuucucucccucucccucucgcgcucucucucuuuucuccucaccccccucucucguccucucucucuuuugcucuaucgagcugauacugaaguacaaaaauaucaagaggcuggagcccugaaggacgacagugcuccgaccu

SEQ ID NO: 20761 - RNA, 3358 nt, Homo sapiens
ggauugccccaagcucuugcccucaaguuguccggaggaggagagucaaugggcucuaccuaagggcuucucuucuagucccaucuggguuuggagucugagagagugaagaagacacauccugugucccuccgcaacagccacacagaacaaaaaggggcgagacuccacuccucacucuggagucuuagaauucagagccucagggccuccaccccgauucucccacucucugaccaaacucccuuuaucaauccuagaaaaauuacugaaaucuggaggaaucuuuaagauuuaacugguauuaaauuuaugcauuugagguuuggaaauuuuuuuuuuuuggaaggagauggaggguggugaaggagagacagguaggagggaaccaggagaaugcaggucuccacuaguuuuaaacacuucaagaagagaauaaaaaauuccccuccucuucaccccgcuguaaacaucaccuggcugugcucauuguggcucucuagagagauauagggaguuauuuaagucugagugagugagccagcuacagcuauggauggcuagagagaggauaaauacaucuagagagaugagagguagggaacgaauauaaauauggagaaagauggacgaacagagagauggauugagacagagagaauauaaagagaggcugagggagagaaauggaugugugaaugaggagagaacauuuaugcaaagagagagagagggaagauggggcauuucucauccuuuucuccacauuucuguaguccugccuugcucccugaaaugccaauuucccaccccuggcuucaugaauucuuccucuagauucuagauccugccccacacccuuagguguuuuugcaccaccuucccccaccuccccaccacacagucauccauuuggcccaagauaacauaccucacccggcuguccuagcccaccacccuaagacaaauuggaagaaaggaacaugguuugggaguucugggcaaaguauggaagcuggauuccccaccuccagguccacagacuuagggggaagguuucucugaggggugggaagagugaggggcagcuggcuugaauuuguccaaaucuaauaacccaggagccuauugaaggccuuggggguugggagggaaggaaagucuugaauauucuccuaacuuuuucccccucucccucuggucccuucuuuccaaaagucuuugaagaaagauguuuuugacgcuuccaugucgcucucagauggaugggcugcgggugauugaagugucuuugucaugcuaaugcuuggggggugauggaugggcgcuggggcugccaaacucuggcccgcuuagcccauuggccugggagagaucacaugugcccccucacccccacucccuacccccuuccuagggaagcgcuugcccaggcgagcgggucaggccauggauucgagccccagcgcugugacauacugccgaaagguuguagggcaagagggugucucccccaaacgggccgacccuccugcggccuugacgcauggacuauaauaggaugaacuccuucuuagaguacccacucuguaaccggggacccagcgccuacagcgcccacagcgccccaaccuccuuucccccaagcucggcucaggcgguugacagcuaugcaagcgagggccgcuacgguggggggcuguccagcccugcguuucagcagaacuccggcuaucccgcccagcagccgccuucgacccugggggugcccuuccccagcuccgcgcccucgggguaugcuccugccgccugcagccccagcuacgggccuucucaguacuacccucugggucaaucagaaggagacggaggcuauuuucaucccucgagcuacggggcccagcuagggggcuuguccgauggcuacggagcagguggagccgguccggggccauauccuccgcagcaucccccuuaugggaacgagcagaccgcgagcuuugcaccggccuaugcugaucuccucuccgaggacaaggaaacacccugcccuucagaaccuaacacccccacggcccggaccuucgacuggaugaagguuaagagaaacccacccaagacagguagggcucagauguggccaccccuucuccggggcccaaagcaucucugcuuccccugcagugacauguccugggucugggcuggguucuucucuuucagcggcucugguagacacagguaagagcacaaccuacgucucaggucaggugaggucuccccacccaguauguaaccggucaccccaggaguaaguuuccauacacaccccacuuccugaucugugcacccagcacagacccaggaccuggugugcaugggggauggaaguauggggaaggcugcuccagacuuggugaucaccauggggguaccugguggucccugggaacuuugacaacuguacuugggcagaauggcaaauggagguccagagccagccccgggaggagggaagcggaaggagaaagaggugagagaauugaccuggccuuucucccugccccgccccuagcgaaggugucagagccaggccugggcucgcccaguggccuccgcaccaacuucaccacaaggcagcugacagaacuggaaaaggaguuccauuucaacaaguaccugagccgggcccggaggguggagauugccgccacccuggagcucaaugaaacacaggucaagauuugguuccagaaccgacgaaugaagcagaagaagcgcgagcgagaggaaggucggguccccccagccccaccaggcugccccaaggaggcagcuggagaugccucagaccagucgacaugcaccuccccggaagccucacccagcucugucaccuccugaacugaaccuagccaccaauggggcuuccaggcacuggagcgccccaguccagcccuaucccaggcucuccccaaccccaggccugggcuucacuggccuggggauccucucuagggcugaaaugccaguuuagagcugccugggggugggaggggggauggggaaacauuuuucucagaccuggguggcugggggcccuacaggaccagaggccugggaggcauggaaccugucaaauguagagggaagggcuucugccuuugaucuggggaucagcucagugucaacauguggugggggugggggccagccucauccuccuggauucauccuccuuucccuuccaacuuggguuuauucgguucagugccuucgagcuuugaggagucuccucacgcacucuuauccuaacucccccuucuaggccugacacagaaccuuaaauuuucuugug

SEQ ID NO: 20762 - RNA, 3358 nt, Homo sapiens
cacaagaaaauuuaagguucugugucaggccuagaagggggaguuaggauaagagugcgugaggagacuccucaaagcucgaaggcacugaaccgaauaaacccaaguuggaagggaaaggaggaugaauccaggaggaugaggcuggcccccacccccaccacauguugacacugagcugauccccagaucaaaggcagaagcccuucccucuacauuugacagguuccaugccucccaggccucugguccuguagggcccccagccacccaggucugagaaaaauguuuccccauccccccucccacccccaggcagcucuaaacuggcauuucagcccuagagaggauccccaggccagugaagcccaggccugggguuggggagagccugggauagggcuggacuggggcgcuccagugccuggaagccccauugguggcuagguucaguucaggaggugacagagcugggugaggcuuccggggaggugcaugucgacuggucugaggcaucuccagcugccuccuuggggcagccugguggggcuggggggacccgaccuuccucucgcucgcgcuucuucugcuucauucgucgguucuggaaccaaaucuugaccuguguuucauugagcuccaggguggcggcaaucuccacccuccgggcccggcucagguacuuguugaaauggaacuccuuuuccaguucugucagcugccuuguggugaaguuggugcggaggccacugggcgagcccaggccuggcucugacaccuucgcuaggggcggggcagggagaaaggccaggucaauucucucaccucuuucuccuuccgcuucccuccucccggggcuggcucuggaccuccauuugccauucugcccaaguacaguugucaaaguucccagggaccaccagguacccccauggugaucaccaagucuggagcagccuuccccauacuuccaucccccaugcacaccagguccugggucugugcugggugcacagaucaggaagugggguguguauggaaacuuacuccuggggugaccgguuacauacuggguggggagaccucaccugaccugagacguagguugugcucuuaccugugucuaccagagccgcugaaagagaagaacccagcccagacccaggacaugucacugcaggggaagcagagaugcuuugggccccggagaagggguggccacaucugagcccuaccugucuuggguggguuucucuuaaccuucauccagucgaagguccgggccguggggguguuagguucugaagggcaggguguuuccuuguccucggagaggagaucagcauaggccggugcaaagcucgcggucugcucguucccauaagggggaugcugcggaggauauggccccggaccggcuccaccugcuccguagccaucggacaagcccccuagcugggccccguagcucgagggaugaaaauagccuccgucuccuucugauugacccagaggguaguacugagaaggcccguagcuggggcugcaggcggcaggagcauaccccgagggcgcggagcuggggaagggcacccccagggucgaaggcggcugcugggcgggauagccggaguucugcugaaacgcagggcuggacagccccccaccguagcggcccucgcuugcauagcugucaaccgccugagccgagcuugggggaaaggagguuggggcgcugugggcgcuguaggcgcuggguccccgguuacagaguggguacucuaagaaggaguucauccuauuauaguccaugcgucaaggccgcaggagggucggcccguuugggggagacacccucuugcccuacaaccuuucggcaguaugucacagcgcuggggcucgaauccauggccugacccgcucgccugggcaagcgcuucccuaggaaggggguagggagugggggugagggggcacaugugaucucucccaggccaaugggcuaagcgggccagaguuuggcagccccagcgcccauccaucaccccccaagcauuagcaugacaaagacacuucaaucacccgcagcccauccaucugagagcgacauggaagcgucaaaaacaucuuucuucaaagacuuuuggaaagaagggaccagagggagagggggaaaaaguuaggagaauauucaagacuuuccuucccucccaacccccaaggccuucaauaggcuccuggguuauuagauuuggacaaauucaagccagcugccccucacucuucccaccccucagagaaaccuucccccuaagucuguggaccuggagguggggaauccagcuuccauacuuugcccagaacucccaaaccauguuccuuucuuccaauuugucuuaggguggugggcuaggacagccgggugagguauguuaucuugggccaaauggaugacugugugguggggaggugggggaagguggugcaaaaacaccuaaggguguggggcaggaucuagaaucuagaggaagaauucaugaagccaggggugggaaauuggcauuucagggagcaaggcaggacuacagaaauguggagaaaaggaugagaaaugccccaucuucccucucucucucuuugcauaaauguucucuccucauucacacauccauuucucucccucagccucucuuuauauucucucugucucaauccaucucucuguucguccaucuuucuccauauuuauauucguucccuaccucucaucucucuagauguauuuauccucucucuagccauccauagcuguagcuggcucacucacucagacuuaaauaacucccuauaucucucuagagagccacaaugagcacagccaggugauguuuacagcggggugaagaggaggggaauuuuuuauucucuucuugaaguguuuaaaacuaguggagaccugcauucuccugguucccuccuaccugucucuccuucaccacccuccaucuccuuccaaaaaaaaaaaauuuccaaaccucaaaugcauaaauuuaauaccaguuaaaucuuaaagauuccuccagauuucaguaauuuuucuaggauugauaaagggaguuuggucagagagugggagaaucgggguggaggcccugaggcucugaauucuaagacuccagagugaggaguggagucucgccccuuuuuguucuguguggcuguugcggagggacacaggaugugucuucuucacucucucagacuccaaacccagaugggacuagaagagaagcccuuagguagagcccauugacucuccuccuccggacaacuugagggcaagagcuuggggcaaucc

SEQ ID NO: 20763 - RNA, 1753 nt, Homo sapiens
gugaggaaguugcgagaguugagcugcagacagccggccaccagauugguggugggcugcgacagacccuugcacagagucugcacguaggacacuaggucuggccgcuugccggagcgcaggaucuccgagagcgcccagauauaguucuuggcuaggcgcagcgucucgaucuuggacagcuucugcgucuuggaguagcagggcaccaccuugcgcagguuguccagggcugcguucaggucgugcaugcgguugcgcucccgcgcguucgccuucugccgccgaagcuuggagcgcuccaagcgcgccuuggucaucuugcgcuucuugggcccgcgcuucuugggccgcucgcccuccgccucguccaguccuucuuccuccuccucuuccuccuccuccucuccccccagcucgccuuccuccuugaccucggccaacguggccuccguccccucuucuccacggagagggacuggcuuggccgcccgggcuggccccggagccccuggcccgggcgcaggcgguggcgguggcggcgcgucgcccuugucgcuccucggcucgucgucuucgccgucgccccagcuggcgaacuugggcacguccgagagaaggccgggcucgcugaacaggcgggucagcauggugccugagggcgccccgcgggcgggaaggggagacagacagcacaaagugaggggcgcgcugggguaccgacgcccccccacaacccuccuccacccccgagucucgugcgggcuccugccuaggcuacccuggaugcccaccuccgccgccugccccgcccagagccggcccagcccuacccggcugccggccugggaucucggcccaggcccucuccccggcgcugggccccggcuccgccccucgcuugaauggggggcugcuccccgcgccugcuucuucucagggucagggcagggaccggguggggguuuuagggaccagauaucuuugccaggggaggcggcgcgcucgcccugaaagcccguucucuccuggcgguggagagaggcuggucggccgccgguggggacagcugccccgcuccgcgcucucgcggcccgggccccccggcccagcucccucaccccucccguggcucucacccccacgcucccuaauccaauuugcaacuuggcugcgcgccgccccuugcucggcccccacccccgcacccccaauuccagaggcgggaggaucgucuccucuagccgaugcguccccagcucccggagccggcucugggcggcgaggacugaagcagcggggcguggggaggagacugagagaagcgagcccaguccguccccucugcggucagggacccccuucccccuucaagcugacucccucccacaaggcucuucagaucucguuguauuuugggauugaugggggaaaaauccaaauuuguuuguuugcuucccuuuuuucggugguggggaaagguggcaggcuuuuugggacaaccauggagggguccuccgucucggccucuucgcauaucccccuccgugauccugccuuccccccccaccgagcccaucgcaggcagagacaccuccucugcagcccccugggcugcagccccuaagggagagagaaccuggggccccuccgaugcccacccaaugaggggggcaucaucccaggaaggagguauuugaggacccuccugucggccgaagcugccgccccuccucccaaccggcgggucaga

SEQ ID NO: 20764 - RNA, 1753 nt, Homo sapiens
ucugacccgccgguugggaggaggggcggcagcuucggccgacaggaggguccucaaauaccuccuuccugggaugaugccccccucauugggugggcaucggaggggccccagguucucucucccuuaggggcugcagcccagggggcugcagaggaggugucucugccugcgaugggcucgguggggggggaaggcaggaucacggagggggauaugcgaagaggccgagacggaggaccccuccaugguugucccaaaaagccugccaccuuuccccaccaccgaaaaaagggaagcaaacaaacaaauuuggauuuuucccccaucaaucccaaaauacaacgagaucugaagagccuugugggagggagucagcuugaagggggaagggggucccugaccgcagaggggacggacugggcucgcuucucucagucuccuccccacgccccgcugcuucaguccucgccgcccagagccggcuccgggagcuggggacgcaucggcuagaggagacgauccucccgccucuggaauugggggugcgggggugggggccgagcaaggggcggcgcgcagccaaguugcaaauuggauuagggagcgugggggugagagccacgggaggggugagggagcugggccggggggcccgggccgcgagagcgcggagcggggcagcuguccccaccggcggccgaccagccucucuccaccgccaggagagaacgggcuuucagggcgagcgcgccgccuccccuggcaaagauaucuggucccuaaaacccccacccggucccugcccugacccugagaagaagcaggcgcggggagcagccccccauucaagcgaggggcggagccggggcccagcgccggggagagggccugggccgagaucccaggccggcagccggguagggcugggccggcucugggcggggcaggcggcggaggugggcauccaggguagccuaggcaggagcccgcacgagacucggggguggaggaggguugugggggggcgucgguaccccagcgcgccccucacuuugugcugucugucuccccuucccgcccgcggggcgcccucaggcaccaugcugacccgccuguucagcgagcccggccuucucucggacgugcccaaguucgccagcuggggcgacggcgaagacgacgagccgaggagcgacaagggcgacgcgccgccaccgccaccgccugcgcccgggccaggggcuccggggccagcccgggcggccaagccagucccucuccguggagaagaggggacggaggccacguuggccgaggucaaggaggaaggcgagcuggggggagaggaggaggaggaagaggaggaggaagaaggacuggacgaggcggagggcgagcggcccaagaagcgcgggcccaagaagcgcaagaugaccaaggcgcgcuuggagcgcuccaagcuucggcggcagaaggcgaacgcgcgggagcgcaaccgcaugcacgaccugaacgcagcccuggacaaccugcgcaagguggugcccugcuacuccaagacgcagaagcuguccaagaucgagacgcugcgccuagccaagaacuauaucugggcgcucucggagauccugcgcuccggcaagcggccagaccuaguguccuacgugcagacucugugcaagggucugucgcagcccaccaccaaucugguggccggcugucugcagcucaacucucgcaacuuccucac

SEQ ID NO: 20765 - RNA, 1165 nt, Homo sapiens
agggcuugggauagaagagacuaaauguggcgggugcugggcugaacuggugauaaagacaccccgcgugccuggagggaggaaacuagaaguucuauauaaaucaauucauguaacuuuuuuuuuuuuuugagacggagucucgcucuugucgcccaggcuguagugcaguggugcgaucucggcucacugcaaccucugccugccggguucaagccauucuccugccucagccucuucauguagcugggacuacaggcgcccgccaccacguccggcuaauuuuuuuuuuuuuuuugagacggagucucgcucggucucccaggcuggagugcaguggcgcgaucucggcucacugcaagcuccgccucccggguucaugccauucuccugccucagccucccgaguagcugggacuacaggcgcccaccaccacgcccggcuaauuuuuugcauuuuuaguagagacgggguuucaccguguuagccaggauggucucggcccgucucggccucccaaaguguugggauuacaggcgugagccaccgcguuuggccguaauuuuuguauuuuuaguagagacgggguuucuccauguuggucaggcuggucucgaacuccugaccucaggugauccgcccgccucagccucccaaagugcugggauuacaggcgugggccaccgcgcccggcccauuucagguaacuuguuauugcaucgcucaauugguuaagaacuugggcucuggcaccagaugcccgggguuacauuccuguuuuucugugacuuugggccacuguuuaucucaguuuucucauguguaaaauaaaggcuaauaauaguaccuacuccuaagaucguuguuaaacgaguugguaccuaaaguguuuauaacagcgcccuuccacguaguagguagacaacaaaugucagcuguucuugcauagauuuggaugugaagcaaaagugaaugcuaaaauaagugugauaacauaauuaggaaauaaguguuaaucaucaguauaaauaaauuccauguuaguuauuuucucuucacuuucacauauugacuaguuguccucuuauuuuuuuuaaucuagcugugcugucgucaugccucaaacccgaucccaggcacaggcuacaaucaguuuuccaaaaa

SEQ ID NO: 20766 - RNA, 1165 nt, Homo sapiens
uuuuuggaaaacugauuguagccugugccugggaucggguuugaggcaugacgacagcacagcuagauuaaaaaaaauaagaggacaacuagucaauaugugaaagugaagagaaaauaacuaacauggaauuuauuuauacugaugauuaacacuuauuuccuaauuauguuaucacacuuauuuuagcauucacuuuugcuucacauccaaaucuaugcaagaacagcugacauuuguugucuaccuacuacguggaagggcgcuguuauaaacacuuuagguaccaacucguuuaacaacgaucuuaggaguagguacuauuauuagccuuuauuuuacacaugagaaaacugagauaaacaguggcccaaagucacagaaaaacaggaauguaaccccgggcaucuggugccagagcccaaguucuuaaccaauugagcgaugcaauaacaaguuaccugaaaugggccgggcgcgguggcccacgccuguaaucccagcacuuugggaggcugaggcgggcggaucaccugaggucaggaguucgagaccagccugaccaacauggagaaaccccgucucuacuaaaaauacaaaaauuacggccaaacgcgguggcucacgccuguaaucccaacacuuugggaggccgagacgggccgagaccauccuggcuaacacggugaaaccccgucucuacuaaaaaugcaaaaaauuagccgggcgugguggugggcgccuguagucccagcuacucgggaggcugaggcaggagaauggcaugaacccgggaggcggagcuugcagugagccgagaucgcgccacugcacuccagccugggagaccgagcgagacuccgucucaaaaaaaaaaaaaaaauuagccggacgugguggcgggcgccuguagucccagcuacaugaagaggcugaggcaggagaauggcuugaacccggcaggcagagguugcagugagccgagaucgcaccacugcacuacagccugggcgacaagagcgagacuccgucucaaaaaaaaaaaaaaguuacaugaauugauuuauauagaacuucuaguuuccucccuccaggcacgcggggugucuuuaucaccaguucagcccagcacccgccacauuuagucucuucuaucccaagcccu

SEQ ID NO: 20767 - RNA, 556 nt, Homo sapiens
acugcccgcccugcuccgaggagaagcuggcgcgcugccgcccccccgugggcugcgaggagcuggugcgagagccgggcugcggcuguugcgccacuugcgcccugggcuuggggaugcccugcgggguguacaccccccguugcggcucgggccugcgcugcuacccgccccgagggguggagaagccccugcacacacugaugcacgggcaaggcgugugcauggagcuggcggagaucgaggccauccaggaaagccugcagcccucugguaagguaccccuggccucccaauucccuccugagugcgcucccuucccagcggcuucuuccccauuccagccgcccuggaaggcccuuaaaaauccccuaugaguugaagagaaggcagguacguggcagggcccgacuggcaugggacaggcucaucaaggaaacugcuaccgagucccuagcagccuguugccaccaccaagggagacugucccaucgcuccaucucaaaccuccaaggguugucuguuugauaagggggucccagugggaggccuggcu

SEQ ID NO: 20768 - RNA, 556 nt, Homo sapiens
agccaggccucccacugggacccccuuaucaaacagacaacccuuggagguuugagauggagcgaugggacagucucccuuggugguggcaacaggcugcuagggacucgguagcaguuuccuugaugagccugucccaugccagucgggcccugccacguaccugccuucucuucaacucauaggggauuuuuaagggccuuccagggcggcuggaauggggaagaagccgcugggaagggagcgcacucaggagggaauugggaggccagggguaccuuaccagagggcugcaggcuuuccuggauggccucgaucuccgccagcuccaugcacacgccuugcccgugcaucagugugugcaggggcuucuccaccccucggggcggguagcagcgcaggcccgagccgcaacgggggguguacaccccgcagggcauccccaagcccagggcgcaaguggcgcaacagccgcagcccggcucucgcaccagcuccucgcagcccacgggggggcggcagcgcgccagcuucuccucggagcagggcgggcagu

SEQ ID NO: 20769 - RNA, 930 nt, Homo sapiens
uggggagagcugcaaagaaagcaacaaguggccccgggcggagccggggggugggggcgccagccuccucccgccggcugcgcugcugcgccuggcccccgcccccgcaggcaugcggggugauucaccucgcccagacugcgcccagaccgccggaccccgcaggggcuguccacccacuccaccagccccucuugcacuccugacgcccacucuuccccgcccagccccgcccgcuuccaggaggcccagggugccagcgcgccgcgggugaggguguccucaagggccugaaaaugccugguggccaggagcagagagcagcgaggggacaggggugggccgccgaggccgaugugggggcgcgggggcgcagggucuggggaggagguuggcggucgcguuccccgcuuggcacagcccccgcuggugcgugccugagcccugaaucacccgcuauaucaggcccgcaggcgcagaggccccaggcccgggccccgcagccaguguccgcuuacagcggaccccaacgaucgcgagggaccccugacuuuccuagaaacuucccccaaguaggaagaaguuugacagagccaauuagggagggagcggucugcgaggggcagcguccucgaguccacccgcuaauucgguucugcuacaaguuugggacccgagggaaggaucugaguggggaggugcgaggugcagagcgcgccccucuacgcgccccaggaguccgccgcucccuccaccccauccuaccccacccaaccccaccccagccgcgcucaccggaaggaggguggaucugccgggcgcccgggccaggcugggaggggagcagcgccacgggcaggucuccccaccccaacucccaggcaggggacgcgggccgggcgcgggagcucugggcgccuuccgcccugu

SEQ ID NO: 20770 - RNA, 930 nt, Homo sapiens
acagggcggaaggcgcccagagcucccgcgcccggcccgcguccccugccugggaguugggguggggagaccugcccguggcgcugcuccccucccagccuggcccgggcgcccggcagauccacccuccuuccggugagcgcggcuggggugggguugggugggguaggaugggguggagggagcggcggacuccuggggcgcguagaggggcgcgcucugcaccucgcaccuccccacucagauccuucccucgggucccaaacuuguagcagaaccgaauuagcggguggacucgaggacgcugccccucgcagaccgcucccucccuaauuggcucugucaaacuucuuccuacuugggggaaguuucuaggaaagucaggggucccucgcgaucguugggguccgcuguaagcggacacuggcugcggggcccgggccuggggccucugcgccugcgggccugauauagcgggugauucagggcucaggcacgcaccagcgggggcugugccaagcggggaacgcgaccgccaaccuccuccccagacccugcgcccccgcgcccccacaucggccucggcggcccaccccuguccccucgcugcucucugcuccuggccaccaggcauuuucaggcccuugaggacacccucacccgcggcgcgcuggcacccugggccuccuggaagcgggcggggcugggcggggaagagugggcgucaggagugcaagaggggcugguggaguggguggacagccccugcgggguccggcggucugggcgcagucugggcgaggugaaucaccccgcaugccugcgggggcgggggccaggcgcagcagcgcagccggcgggaggaggcuggcgcccccaccccccggcuccgcccggggccacuuguugcuuucuuugcagcucucccca

SEQ ID NO: 20771 - RNA, 1757 nt, Homo sapiens
agccgagcgccccacccuucccgggaugguuggaauaguuggagcgggagacuagggccuccgcuggcggcgggagcgggacgggcggaggaaugcgagcugaggaacggaaucagguucuaagaguguugcucucuguuucccucucacuugaauugcucauccgaaaauccucaagaucugggagccggguggaccaggagauucugaaauuauaggcaaaaucuuguauuugccuuuaccuagauuuugagcacaaaaggacccuugcccuuuacaauauuuucuaagaggccucucggauuuccucaucaccaaccccaaccagguuacuaacucagggguaagcuuaggggguuguuuguggggggcggggggagaaagagagaacguauuuggggucacggugguggugaagggcugcgaagcuccucuaaguucuuuuuagaauugcccuaacagaguagaauuaagaugggcaaucaaacggaaaauaaagcccaccucccaaccccccuuucugagacagggugucacucugucacccaggcuggagugcagcggucugaucacaguucacugcagccucgaccucuugggcucaggcaauccucccacuucagccuccugaguagaugagacuauaggcgcuugccaccacgcccagcuaauuucaauuuuuauuuuuuucaauuuuuauuuuuuuaagagacgggguguacacuauuuugaccaggcuggucucgaacuccugagcucaagugaucugcugguuucagccucucaaagugcugggagccaccgcgccugguguaaagcccuuuuuaaaagcccaccucucuuaggccaggcgcgguggcucaugccuguaaucccagcacuuugggaggcccaggcggguggaucacgaggucaggaguucaagaccagccuggcccaagauggugaaaccccgucucuguuacaaauacaaaaauuaggccaggcgcaguggcucauuuugggaggcggagguggguggaucaccugaggucgggaguucgaccucagccugaccaacauggagaaaccccaucucuacuaaaaauacaaaauuagccaggcgugguggcgcaugccuguaaucccagcuauucgggaggcugaggcaggagaaucacuugaacccggggggcagagguugcaaugagcugagauucgcgccauugcacuccagccugaguggaauucuacagaguagaauuccucuuuuuuccaaaagcuuuuucaauccuuaguagaaggaauuuaaauuacuuuaauacauuucuccuaaauucuaaaguaaguugguaaucugccaguugguaauccacugucugagugcagacagagugagacucugucucaaaaaaacaaaaaaaacaaaaacaaaagcaacccacaaacccacgucucaccucucucuaaaacucaccuuucccuguguucccccucccaccgcccccucagaggcagcugacaccaaucucagugagcaggaucuaggaguccauuucucuuucaagauuccagggacuaacaguaagccaucggagagaccaucaaaucccacccccucauuugacagacaggaaaaggaaagccugcagaagacagguggcuugccagagaucacucgcagguuaguguuggcauuggcacuugaacccaggucuggacuccugcuuucaugcucuuuccaccuucugcucuaagccuuccacuggggcagggag

SEQ ID NO: 20772 - RNA, 1757 nt, Homo sapiens
cucccugccccaguggaaggcuuagagcagaagguggaaagagcaugaaagcaggaguccagaccuggguucaagugccaaugccaacacuaaccugcgagugaucucuggcaagccaccugucuucugcaggcuuuccuuuuccugucugucaaaugagggggugggauuugauggucucuccgauggcuuacuguuagucccuggaaucuugaaagagaaauggacuccuagauccugcucacugagauuggugucagcugccucugagggggcggugggagggggaacacagggaaaggugaguuuuagagagaggugagacguggguuuguggguugcuuuuguuuuuguuuuuuuuguuuuuuugagacagagucucacucugucugcacucagacaguggauuaccaacuggcagauuaccaacuuacuuuagaauuuaggagaaauguauuaaaguaauuuaaauuccuucuacuaaggauugaaaaagcuuuuggaaaaaagaggaauucuacucuguagaauuccacucaggcuggagugcaauggcgcgaaucucagcucauugcaaccucugccccccggguucaagugauucuccugccucagccucccgaauagcugggauuacaggcaugcgccaccacgccuggcuaauuuuguauuuuuaguagagaugggguuucuccauguuggucaggcugaggucgaacucccgaccucaggugauccacccaccuccgccucccaaaaugagccacugcgccuggccuaauuuuuguauuuguaacagagacgggguuucaccaucuugggccaggcuggucuugaacuccugaccucgugauccacccgccugggccucccaaagugcugggauuacaggcaugagccaccgcgccuggccuaagagaggugggcuuuuaaaaagggcuuuacaccaggcgcgguggcucccagcacuuugagaggcugaaaccagcagaucacuugagcucaggaguucgagaccagccuggucaaaauaguguacaccccgucucuuaaaaaaauaaaaauugaaaaaaauaaaaauugaaauuagcugggcgugguggcaagcgccuauagucucaucuacucaggaggcugaagugggaggauugccugagcccaagaggucgaggcugcagugaacugugaucagaccgcugcacuccagccugggugacagagugacacccugucucagaaagggggguugggaggugggcuuuauuuuccguuugauugcccaucuuaauucuacucuguuagggcaauucuaaaaagaacuuagaggagcuucgcagcccuucaccaccaccgugaccccaaauacguucucucuuucuccccccgccccccacaaacaacccccuaagcuuaccccugaguuaguaaccugguugggguuggugaugaggaaauccgagaggccucuuagaaaauauuguaaagggcaaggguccuuuugugcucaaaaucuagguaaaggcaaauacaagauuuugccuauaauuucagaaucuccugguccacccggcucccagaucuugaggauuuucggaugagcaauucaagugagagggaaacagagagcaacacucuuagaaccugauuccguuccucagcucgcauuccuccgcccgucccgcucccgccgccagcggaggcccuagucucccgcuccaacuauuccaaccaucccgggaaggguggggcgcucggcu

SEQ ID NO: 20773 - RNA, 896 nt, Homo sapiens
gcgggagccgcucuggggcgaucucccuggcccucucugcccggcucacauuagcugugugccaggcacuugggcugggcgcauggcacgcauugugccaccugcugaccuagcugcugaaguguugguauuguuauggggaagcuccagcccagagagguuaggugacuggcccaaggucacacagcggccagggaccccgcuagauucgaauccugacaccagggcucccuuguagccucagauggauuugggagggcugcuccggcaggaacccgcguuucaaauguucugguuauccccagcgcccuuuccgccucacuucccagcgcagcggugcugcucgcggucgggggccgggacgugguuggggcugggacugggguuggggcugggacuggggccuggcuggcguccgcccccucccacucguugcucuccggccagcagcuugagccugaucgagugcggcccagugcacaccgccuucauggagaagguguugggcagcccagaggaggugcuggaccgcacggacauccacaccuuccaccgcuucuaccaauaccucgcccacagcaagcaagucuuucgcgaggcggcgcagaacccugaggagguggcggaggugagcgccgggcuggacuccaggagugggggcggugcguccuccggcgcgcagcgguggccacagcucuccucccgccgccgcaggucuuccucaccgcuuugcgcgccccgaagccgacccugcgcuacuucaccaccgagcgcuuccugccccugcugcggaugcgccuggacgaccccagcggcuccaacuacgucaccgccaugcaccgggaaguguucggcgacguuccggcaaaggccgaggcuggggccgaggcuggggg

SEQ ID NO: 20774 - RNA, 896 nt, Homo sapiens
cccccagccucggccccagccucggccuuugccggaacgucgccgaacacuucccggugcauggcggugacguaguuggagccgcuggggucguccaggcgcauccgcagcaggggcaggaagcgcucgguggugaaguagcgcagggucggcuucggggcgcgcaaagcggugaggaagaccugcggcggcgggaggagagcuguggccaccgcugcgcgccggaggacgcaccgcccccacuccuggaguccagcccggcgcucaccuccgccaccuccucaggguucugcgccgccucgcgaaagacuugcuugcugugggcgagguauugguagaagcgguggaagguguggauguccgugcgguccagcaccuccucugggcugcccaacaccuucuccaugaaggcggugugcacugggccgcacucgaucaggcucaagcugcuggccggagagcaacgagugggagggggcggacgccagccaggccccagucccagccccaaccccagucccagccccaaccacgucccggcccccgaccgcgagcagcaccgcugcgcugggaagugaggcggaaagggcgcuggggauaaccagaacauuugaaacgcggguuccugccggagcagcccucccaaauccaucugaggcuacaagggagcccuggugucaggauucgaaucuagcggggucccuggccgcugugugaccuugggccagucaccuaaccucucugggcuggagcuuccccauaacaauaccaacacuucagcagcuaggucagcagguggcacaaugcgugccaugcgcccagcccaagugccuggcacacagcuaaugugagccgggcagagagggccagggagaucgccccagagcggcucccgc

SEQ ID NO: 20775 - RNA, 1461 nt, Homo sapiens
guuccagaccugccaucacuccgcggacaagcccuucgccgucaucgaggugagcggagcccggcgugggccgugacgcagcgaggggaugggguugugcggccaccuguccucaggcauggcaggauacgcugcgggcucugcgcagcggaagcgggaaggagcccggcagggcccagaccagcgccgccgggaaugggagaggccguaagcuccuccggaagccucccgcccagcccgagugaggauccugggggaccccacccgccaggugugaugcucugaagaaggcccccaacaugggcgcaguuagggguucagaaggaccuggacaggagccgcuugcacugccccucccccaaagaugucccggaguccaaggucggagggaggagggcgggagguaccccagcgugagacaagggaguggcaagacccaacggggcaaagggcggagcaggugggcacugguggccagaacuggguccugacagcuucuggaaggguagggucaccgagacggcccugcaggccaggcugugggagccagcggcucagguccgugucacgcuccuugaaagcccacuccuccgcagguggacgaggaggugcucaagugccagcagggcguauccagucuggccuuugcccuggccuucuugcagcgcauggacaugaagccgcuggugguccuggggcugccggccccuacggcucccucgggcugucuuuccuucugggaggccaaggcgcagcuggccaagagcugcaaggugcugguagacgcgcuucgacacaacgccgccgcugcugugccauuuuuuggcggcgggucugugcuacgcgcugccgagccggcuccccaugccaggugagugcccgcccugcccgcccaggcguccucagagcgugcuacucugcccgcccugccccguccggcaggccuggagggggcccucucgagcaccacgucuggcccacagcuacggcggcaucgucucgguggagacagaccugcugcaguggugccuggagucgggcagcauccccauccugugccccaucggggagacggccgcgcgccgcuccgugcuucucgacucccuggaggugaccgcgucgcuggccaaggcgcugcggcccaccaaaaucaucuuccucaauaacacaggcggccugcgcgacagcagucauaaggugcggcccuuucuuucaccuucccccacgccggcgauccgggccuucucuugcgccccucgcacuucuccccgacgggccgcagacucacuagcaagccggguggguagaaaagccuaagggaguauaggggaggaguucagcccugggugcccagaucugcgcccucccuggcuaaggacuccgggcggaaguaaggauaaaggggucagagaaaagagagguccguggggguaggggggcaguccgugccggcugugggcc

SEQ ID NO: 20776 - RNA, 1461 nt, Homo sapiens
ggcccacagccggcacggacugccccccuacccccacggaccucucuuuucucugaccccuuuauccuuacuuccgcccggaguccuuagccagggagggcgcagaucugggcacccagggcugaacuccuccccuauacucccuuaggcuuuucuacccacccggcuugcuagugagucugcggcccgucggggagaagugcgaggggcgcaagagaaggcccggaucgccggcgugggggaaggugaaagaaagggccgcaccuuaugacugcugucgcgcaggccgccuguguuauugaggaagaugauuuuggugggccgcagcgccuuggccagcgacgcggucaccuccagggagucgagaagcacggagcggcgcgcggccgucuccccgauggggcacaggauggggaugcugcccgacuccaggcaccacugcagcaggucugucuccaccgagacgaugccgccguagcugugggccagacguggugcucgagagggcccccuccaggccugccggacggggcagggcgggcagaguagcacgcucugaggacgccugggcgggcagggcgggcacucaccuggcauggggagccggcucggcagcgcguagcacagacccgccgccaaaaaauggcacagcagcggcggcguugugucgaagcgcgucuaccagcaccuugcagcucuuggccagcugcgccuuggccucccagaaggaaagacagcccgagggagccguaggggccggcagccccaggaccaccagcggcuucauguccaugcgcugcaagaaggccagggcaaaggccagacuggauacgcccugcuggcacuugagcaccuccucguccaccugcggaggagugggcuuucaaggagcgugacacggaccugagccgcuggcucccacagccuggccugcagggccgucucggugacccuacccuuccagaagcugucaggacccaguucuggccaccagugcccaccugcuccgcccuuugccccguugggucuugccacucccuugucucacgcugggguaccucccgcccuccucccuccgaccuuggacuccgggacaucuuugggggaggggcagugcaagcggcuccuguccagguccuucugaaccccuaacugcgcccauguugggggccuucuucagagcaucacaccuggcggguggggucccccaggauccucacucgggcugggcgggaggcuuccggaggagcuuacggccucucccauucccggcggcgcuggucugggcccugccgggcuccuucccgcuuccgcugcgcagagcccgcagcguauccugccaugccugaggacagguggccgcacaaccccauccccucgcugcgucacggcccacgccgggcuccgcucaccucgaugacggcgaagggcuuguccgcggagugauggcaggucuggaac

SEQ ID NO: 20777 - RNA, 536 nt, Homo sapiens
acagcuccccaacucccggauuuugcaaagggugucagauucgcccaauggucccuucuccagggcaggggaggcacugcagccagggcuguaagcaccgggcucccuuugccuuugugccccaaacauuuccugcagccagccuucuccgcucgcgcccauggccacgcgccuaggcgcccgcgggcgcggaugcugcuucucccuguuccauacgccagagcccauccuugcccuccccuuaucgcccacugcugucggcccgaauccacuucccaaggggcaagcccccaagggcaaguccgugcaccugggagcccugcgcucugacuaguuggguucauuucccgcauuuccaguagcguuccagacggugcccagcagcgucugucuuggagcgggaacccaggaacugaggaucggcgauguccgcuggcuccgaccauccccacacgugaugaccaagcggggccgcuguggggugggaucuccaccugcguccgccuggcgcccccgccaacuccgaucagguaccc

SEQ ID NO: 20778 - RNA, 536 nt, Homo sapiens
ggguaccugaucggaguuggcgggggcgccaggcggacgcagguggagaucccaccccacagcggccccgcuuggucaucacguguggggauggucggagccagcggacaucgccgauccucaguuccuggguucccgcuccaagacagacgcugcugggcaccgucuggaacgcuacuggaaaugcgggaaaugaacccaacuagucagagcgcagggcucccaggugcacggacuugcccuugggggcuugccccuugggaaguggauucgggccgacagcagugggcgauaaggggagggcaaggaugggcucuggcguauggaacagggagaagcagcauccgcgcccgcgggcgccuaggcgcguggccaugggcgcgagcggagaaggcuggcugcaggaaauguuuggggcacaaaggcaaagggagcccggugcuuacagcccuggcugcagugccuccccugcccuggagaagggaccauugggcgaaucugacacccuuugcaaaauccgggaguuggggagcugu

SEQ ID NO: 20779 - RNA, 1628 nt, Homo sapiens
cuggagacgcccgcagaaagaggcgggauggcggggcggaugcuggcggcccgggucuggccaccugggucagcugcacgcccccgccccgggcuggccggaccucguagcccaggucccaccacgccgugaaguuugcggaaaguuuugcaguugcuuccccgcccgcgccagcgggggaguugugacgcagcgucuggggauccuggccgggacagaagagagggaaggcgaggcggggagagacugggaaacagagcagcaagagaaagggcgcacgcugggguccuccuggacccggcguguccuccucuccgccaccccuuucucucccucccgacgcucuagccccagacccgcgccuccuccccuuccccucccacgcugcccacuucccuuccccucuaccccucgaacccuccuccccgguucugcgcuccucccuccgcccucccuccgcccgggcugccuccucccuccuccuccccgggaggcaucacuucgucccgacccggaggaggacgcgagccccuugcgggcggucaucacagcccagccucggggcugccacagcgcguugcgccugugcgcccucgguccccgcguccacugagcgccgcgcucggggauggggcccggccggccggcccccgcgcccuggccucgucaccugcugcgcugcguccugcuccucgggugccugcaccucggccgucccggcgccccuggggacgccgcccucccggguaaggcgcugccaacuuggccaacuucagggcccgggcggggggagcgccgaggcgcgggccgcucucgacuuuucccuccuuuuccccccucuuuucuccagaagcgugugugcgugugugugugacuggguuuuuaaaacucgucuccgcuuuucugaaagcgggggaggagaggggaggaggagcgcgccuagaggugggggaggaccugaguggaaccagauguggcgggcggcgggggaggggagcccgggggacuccagcagccuaggaggaagcgggugggcucuugaggacccccgcgcaccgcgcucccggaccacccggcgccggcccguccucggcaggggaccugcagggcgcgcccggggagccagggcucucuguccgggaguucccgggcccagucuccucgcucugccccaggacugaugcguuaggacggcuuuccaacuauccgcgaggguucguuucccccaccuuccccccgcccccugcaucucgugggcguugauauuuucuuuuccacacuuagucuucaaggaggcuuguggcgcgcggcauccgccccgcgugagcucggcagcccugugaggaggcuccugccacugggacgcagcaacaggcugggcgccgccgugcugugauguugcguagcgugggcagcucugggcacacuaguggcccuccagaggggacagaccuugagcggcaaaagagcugcuaaagauuuuaaaacccaacgaacaggaaacaaaacaaaaaucagaaaaccccaaaacugugccauucucuuccugcuccuuauucagggguaacagugaaguguggggacagacagaucccucgccaagaaucuaagaguugaaaggaaagauc

SEQ ID NO: 20780 - RNA, 1628 nt, Homo sapiens
gaucuuuccuuucaacucuuagauucuuggcgagggaucugucuguccccacacuucacuguuaccccugaauaaggagcaggaagagaauggcacaguuuugggguuuucugauuuuuguuuuguuuccuguucguuggguuuuaaaaucuuuagcagcucuuuugccgcucaaggucuguccccucuggagggccacuagugugcccagagcugcccacgcuacgcaacaucacagcacggcggcgcccagccuguugcugcgucccaguggcaggagccuccucacagggcugccgagcucacgcggggcggaugccgcgcgccacaagccuccuugaagacuaaguguggaaaagaaaauaucaacgcccacgagaugcagggggcggggggaaggugggggaaacgaacccucgcggauaguuggaaagccguccuaacgcaucaguccuggggcagagcgaggagacugggcccgggaacucccggacagagagcccuggcuccccgggcgcgcccugcagguccccugccgaggacgggccggcgccgggugguccgggagcgcggugcgcggggguccucaagagcccacccgcuuccuccuaggcugcuggagucccccgggcuccccucccccgccgcccgccacaucugguuccacucagguccucccccaccucuaggcgcgcuccuccuccccucuccucccccgcuuucagaaaagcggagacgaguuuuaaaaacccagucacacacacacgcacacacgcuucuggagaaaagaggggggaaaaggagggaaaagucgagagcggcccgcgccucggcgcuccccccgcccgggcccugaaguuggccaaguuggcagcgccuuacccgggagggcggcguccccaggggcgccgggacggccgaggugcaggcacccgaggagcaggacgcagcgcagcaggugacgaggccagggcgcgggggccggccggccgggccccauccccgagcgcggcgcucaguggacgcggggaccgagggcgcacaggcgcaacgcgcuguggcagccccgaggcugggcugugaugaccgcccgcaaggggcucgcguccuccuccgggucgggacgaagugaugccucccggggaggaggagggaggaggcagcccgggcggagggagggcggagggaggagcgcagaaccggggaggaggguucgagggguagaggggaagggaagugggcagcgugggaggggaaggggaggaggcgcgggucuggggcuagagcgucgggagggagagaaagggguggcggagaggaggacacgccggguccaggaggaccccagcgugcgcccuuucucuugcugcucuguuucccagucucuccccgccucgccuucccucucuucugucccggccaggauccccagacgcugcgucacaacucccccgcuggcgcgggcggggaagcaacugcaaaacuuuccgcaaacuucacggcguggugggaccugggcuacgagguccggccagcccggggcgggggcgugcagcugacccagguggccagacccgggccgccagcauccgccccgccaucccgccucuuucugcgggcgucuccag

SEQ ID NO: 20781 - RNA, 1621 nt, Homo sapiens
cccgcccgccagcuccggcuccuuugugucucgcgcggagccagcgccgcgcccacccucuccccggcccgcgcgccgggcagugugugcgcgugugugugugugcgcgcgcgcgcgcgcgcguguguauauguguguguguguguguguguguguggggcggcgaggggucggggcuggccguaccuucgaugcagcacacccgccacagaccagagugggugaggucgccgcgggcgcggcggggcgggggcccgucguccauggucagguuggugccguugcagaugugcgcgcuggaguacagccaguagucggugccgauggcgauggccaugagcgagaaggcggcgaaggcuccggccguggucagcagcaucugcagcccgcggucgcaucgcaccauggugggcgccucauaguccgccgcccgccggcccggcccgccgcgcccgcccgcccuccucccuccgcgcgccgcuccgggggcgccgggguuggggggccgagggccggggggcggcgccgcgcugcgcgcuccgaccccgcgccccgggcgugccugcgcuccggcagcgcuggggcucaaacuccgaggcgcggcgacgagugcgggcugcgcggccgccgggcgggcuggcggcggcggccgggggcuccucccucuccgcucgcccuccccccucggcccgcgccuccgcccugcgcccuccgcgccucccccgccgccgccgcgcuccggguccgcgccccguuucucucggcgccgccccucgagccucggcccccgcccggcugugcgcuccucugagcuccccucucuccccagccaggauuuucucccccucgccucccuuccccucgccuccccuccccucccuuccccuccccuccccgcgcccgcgcgcgcucucucucucucccagaguucauucacauuauuggagugaaggaagccgagggaaguguuccccaggaggaccgaagggaaagcgcgucuccagccaccucucuuacccgcccaggacauccagccuccccuccgacggcccugcggauucuuuaauuuguggaggagggcgugggugggugugucccuccuuuccccucugugccuguucaccuggugaugaaggugagugugggagugcguguucaggucagaauuccugaaaccccagaugugggacacagcugccagacccugcaagccacgccaggcccgggccaggccccaccccaacccaggugguuccugcuccuccagauccccuugcagggccuggaaggacccugacuugggguugagggagaagggcgaugacagcgagaaguccuuuggggagaacacagggucucugcuuucuagagugguggcaaggcugagauugaagauggggcguuccucugugcucacauuucugagggucuauuacugcuagaguccagggacacuccaguuguguuagauuccaacacuccacccgccagccuuuucccuuucucucccaaccuuucgcaaugccuuuauuucguuuugccuuuugcucugcucgagcuuaaccggcuuucccuccccuggccuuuauugucagccucugaccccaaccccugcuggcuu

SEQ ID NO: 20782 - RNA, 1621 nt, Homo sapiens
aagccagcagggguuggggucagaggcugacaauaaaggccaggggagggaaagccgguuaagcucgagcagagcaaaaggcaaaacgaaauaaaggcauugcgaaagguugggagagaaagggaaaaggcuggcggguggaguguuggaaucuaacacaacuggagugucccuggacucuagcaguaauagacccucagaaaugugagcacagaggaacgccccaucuucaaucucagccuugccaccacucuagaaagcagagacccuguguucuccccaaaggacuucucgcugucaucgcccuucucccucaaccccaagucaggguccuuccaggcccugcaaggggaucuggaggagcaggaaccaccuggguugggguggggccuggcccgggccuggcguggcuugcagggucuggcagcugugucccacaucugggguuucaggaauucugaccugaacacgcacucccacacucaccuucaucaccaggugaacaggcacagaggggaaaggagggacacacccacccacgcccuccuccacaaauuaaagaauccgcagggccgucggaggggaggcuggauguccugggcggguaagagagguggcuggagacgcgcuuucccuucgguccuccuggggaacacuucccucggcuuccuucacuccaauaaugugaaugaacucugggagagagagagagcgcgcgcgggcgcggggaggggaggggaagggaggggaggggaggcgaggggaagggaggcgagggggagaaaauccuggcuggggagagaggggagcucagaggagcgcacagccgggcgggggccgaggcucgaggggcggcgccgagagaaacggggcgcggacccggagcgcggcggcggcgggggaggcgcggagggcgcagggcggaggcgcgggccgaggggggagggcgagcggagagggaggagcccccggccgccgccgccagcccgcccggcggccgcgcagcccgcacucgucgccgcgccucggaguuugagccccagcgcugccggagcgcaggcacgcccggggcgcggggucggagcgcgcagcgcggcgccgccccccggcccucggccccccaaccccggcgcccccggagcggcgcgcggagggaggagggcgggcgggcgcggcgggccgggccggcgggcggcggacuaugaggcgcccaccauggugcgaugcgaccgcgggcugcagaugcugcugaccacggccggagccuucgccgccuucucgcucauggccaucgccaucggcaccgacuacuggcuguacuccagcgcgcacaucugcaacggcaccaaccugaccauggacgacgggcccccgccccgccgcgcccgcggcgaccucacccacucuggucuguggcgggugugcugcaucgaagguacggccagccccgaccccucgccgccccacacacacacacacacacacacacauauacacacgcgcgcgcgcgcgcgcgcacacacacacacgcgcacacacugcccggcgcgcgggccggggagagggugggcgcggcgcuggcuccgcgcgagacacaaaggagccggagcuggcgggcggg

SEQ ID NO: 20783 - RNA, 648 nt, Homo sapiens
gccuuugccuuggccugcgccugcaggagagaagauggucucaagaguggggcagggcccuguccacccccacaggacuccuccucuaucccugaccuccuaucuuuacccuaugaugccugggaauuucuacauggaugcauggauggguggguggguggguggguggauggcuggaugaaugggugggauggcuguuggagcugagagguagaaggaugagagaagagguagaagauuuggcuggaaguagucauuugcaaaaaguacacuuuuugcauuugauuauuguguccauuugggagggggagcguaaaggaauucuaguguggccaagcccguccccccagacacaguuggugcugcuacugacuuggugacaucuugucagggaacucccuccuacauuacaaauaggcaacauguguggacaccccauuggcucacagcccucagagcccccuucccacaaaucacuccauaacaugguccuccaccauuggacacugccaaccuacuuugaggaggaagguuuugggcuuggguccacgcuuuuuggggccauagagcuccaucucucuuucccuggagaaagaagaaaaggagaaagggugcgugaguaaagaaagcaagugggacucuagucca

SEQ ID NO: 20784 - RNA, 648 nt, Homo sapiens
uggacuagagucccacuugcuuucuuuacucacgcacccuuucuccuuuucuucuuucuccagggaaagagagauggagcucuauggccccaaaaagcguggacccaagcccaaaaccuuccuccucaaaguagguuggcaguguccaaugguggaggaccauguuauggagugauuugugggaagggggcucugagggcugugagccaaugggguguccacacauguugccuauuuguaauguaggagggaguucccugacaagaugucaccaagucaguagcagcaccaacugugucuggggggacgggcuuggccacacuagaauuccuuuacgcucccccucccaaauggacacaauaaucaaaugcaaaaaguguacuuuuugcaaaugacuacuuccagccaaaucuucuaccucuucucucauccuucuaccucucagcuccaacagccaucccacccauucauccagccauccacccacccacccacccacccauccaugcauccauguagaaauucccaggcaucauaggguaaagauaggaggucagggauagaggaggaguccuguggggguggacagggcccugccccacucuugagaccaucuucucuccugcaggcgcaggccaaggcaaaggc

SEQ ID NO: 20785 - RNA, 1706 nt, Homo sapiens
guggagagggaggccggagaggcacacuggggcugcacgaggagcacuuucucugagauucccugcagauccucugccucucccugcucaccagcccugccacucuguuucccccaagagggaggagggagaggaggccucucaggcucagccagccaagcugagcuccccagaaaggauuuaucuccugucugagaccaugguagaacuagcucaaccuuaagaagacucuggugccugugcccacuuagagcccagcacaccccccuucuccugcagccugggacccuucagucccugucccugugcaccagaacuagggcguccuauaaguaucccagcauccagcccaggggccaugucaggccgucagagaaggcuugauaguucuaaccgaaccacagggccauuuggggauuggguaccaagauuuccagguaccaaaaauaaggcagucugugcuaggcacugggcaugugcuggcagggauggaugaccuggucacuugcaaggccucugccugccuucccaggcuaggaccugagguaugcugacugucaguggcucccaagcagggcugccucagccccacccgcucacuucccagcccuauucgccuuucuuucccuccugcccuccaugcugggucucuggcuggauagaauuaaggccgaaauuacuugcauuuccgccugaaauuagguaaauuuucucuaucugucugcuuuaaugauuucaauggagauuaauaaaauccagaugacauacagcagccacaccacagccucaccuacaucuuaccuuuggaaggcccagggcagaacaagguggggugcuuagucuaagagaggccugcauuccugcaggguccccagcaggccucuccuccccacaccaccaggauccuugaccucuggcucucccaggggcccagcaccagacacaggcacccauagcugcacaugucacacacacacaaaccaccaccacccagaccaaccugcugagcagggcacuccucauaccugguuaugccaccagccucuccagggccauuuacuuuagucugauaccugccucugcccuaguuuucccugggcuucccccaauuuguguggcccgcaggagacugggagcugcagaaauugcugcaaggaaggagccaucacccucaccaccgugcagucccucucgccgugacucccgggaacacagcucuugcccuccuuucuucucugagggcuccgaggccacuccagaccauuccccaagaagcgaaucuuggccuccgccugccuccucgaggggaccagccggccugcaaggccagggagaccugggagagggaccagucagcccucugggacugggccccgggagcugccgcgacucucgccacaguccaggugcagcgggcuggagaguguuggccucggcgaaguuucuuucuaucaccugagggugggccgcauggggccgcggcuccaaauguaacggagcugcggcacggcuccggggcuggucucagcccaggaccugacgggaugggcgggcacagaagaggcguaaguaccuugggucgccuggucugugaagccggugaucguguccgcgcgaccauggcccgaggcggagacagcggcugccccggccggagcccucccggccaggcuccgguaaagcgacaucaugaaguggugcggcac

SEQ ID NO: 20786 - RNA, 1706 nt, Homo sapiens
gugccgcaccacuucaugaugucgcuuuaccggagccuggccgggagggcuccggccggggcagccgcugucuccgccucgggccauggucgcgcggacacgaucaccggcuucacagaccaggcgacccaagguacuuacgccucuucugugcccgcccaucccgucagguccugggcugagaccagccccggagccgugccgcagcuccguuacauuuggagccgcggccccaugcggcccacccucaggugauagaaagaaacuucgccgaggccaacacucuccagcccgcugcaccuggacuguggcgagagucgcggcagcucccggggcccagucccagagggcugacuggucccucucccaggucucccuggccuugcaggccggcugguccccucgaggaggcaggcggaggccaagauucgcuucuuggggaauggucuggaguggccucggagcccucagagaagaaaggagggcaagagcuguguucccgggagucacggcgagagggacugcacgguggugagggugauggcuccuuccuugcagcaauuucugcagcucccagucuccugcgggccacacaaauugggggaagcccagggaaaacuagggcagaggcagguaucagacuaaaguaaauggcccuggagaggcugguggcauaaccagguaugaggagugcccugcucagcagguuggucugggugguggugguuugugugugugugacaugugcagcuaugggugccugugucuggugcugggccccugggagagccagaggucaaggauccuggugguguggggaggagaggccugcuggggacccugcaggaaugcaggccucucuuagacuaagcaccccaccuuguucugcccugggccuuccaaagguaagauguaggugaggcugugguguggcugcuguaugucaucuggauuuuauuaaucuccauugaaaucauuaaagcagacagauagagaaaauuuaccuaauuucaggcggaaaugcaaguaauuucggccuuaauucuauccagccagagacccagcauggagggcaggagggaaagaaaggcgaauagggcugggaagugagcggguggggcugaggcagcccugcuugggagccacugacagucagcauaccucagguccuagccugggaaggcaggcagaggccuugcaagugaccaggucauccaucccugccagcacaugcccagugccuagcacagacugccuuauuuuugguaccuggaaaucuugguacccaauccccaaauggcccugugguucgguuagaacuaucaagccuucucugacggccugacauggccccugggcuggaugcugggauacuuauaggacgcccuaguucuggugcacagggacagggacugaagggucccaggcugcaggagaaggggggugugcugggcucuaagugggcacaggcaccagagucuucuuaagguugagcuaguucuaccauggucucagacaggagauaaauccuuucuggggagcucagcuuggcuggcugagccugagaggccuccucucccuccucccucuugggggaaacagaguggcagggcuggugagcagggagaggcagaggaucugcagggaaucucagagaaagugcuccucgugcagccccagugugccucuccggccucccucuccac

SEQ ID NO: 20787 - RNA, 541 nt, Homo sapiens
uucccgcagcccugugcagagcccgagugcgcgcucaggaacccgaguucagcuacggcugcgcagaaggcagcugcuaucccgccacgggcgaccuucucaucggccgagcacagaagcuuucggugaccucgacgugcgggcugcacaagcccgaacccuacuguaucgucagccacuugcaggugagggcugagagcgggguucgaggcucugcuagcgccuccucccguccagaccuaaggggcaggcccuggggacuccgcauccuuccagcaauccagauaggaagcgcagccagccggggagucccgggauuaggcuuguagcucaaccuuucgccccaucucaguuugcacaguugcauccgccacacauuuccugccggcgcggugaguauggaaaggcaggacugccgacagcccuggcugcccugacccagagccuccaaaaggccugauuguguguguguuuuuuaaaacuuuaguuuuggaagugugcauuaaaggugauuuauccucuuuuuaaaacccuuggguuu

SEQ ID NO: 20788 - RNA, 541 nt, Homo sapiens
aaacccaaggguuuuaaaaagaggauaaaucaccuuuaaugcacacuuccaaaacuaaaguuuuaaaaaacacacacacaaucaggccuuuuggaggcucugggucagggcagccagggcugucggcaguccugccuuuccauacucaccgcgccggcaggaaauguguggcggaugcaacugugcaaacugagauggggcgaaagguugagcuacaagccuaaucccgggacuccccggcuggcugcgcuuccuaucuggauugcuggaaggaugcggaguccccagggccugccccuuaggucuggacgggaggaggcgcuagcagagccucgaaccccgcucucagcccucaccugcaaguggcugacgauacaguaggguucgggcuugugcagcccgcacgucgaggucaccgaaagcuucugugcucggccgaugagaaggucgcccguggcgggauagcagcugccuucugcgcagccguagcugaacucggguuccugagcgcgcacucgggcucugcacagggcugcgggaa

SEQ ID NO: 20789 - RNA, 939 nt, Homo sapiens
caguccaccucgauuuccuccccucucccacucuccgcucagccuucccaccucacuuggcaccguugccucgcgcccccagcguccccggaaggccggucugaccccgcuagggagagcagucuccagggggaugcgcccuggugaggggugugugugcgcgugagugugcgugacaggaggggagacagagacacccagggucacggguaaggaccguuuugucagcgccacccuuucuuucggcuuucaauuuuuguucuccuuaaaacaaauguuuuaaaacaaauuccaccuccuccuccuuuccacccacccacuuccucuugcccuugggcugaaauccuuccagguuguucagcuuaauuucucagugguggugauaagaacagugcucacuagucuuagaaaacagccgcagagaccuaaacaauaaccgacuccccccccccccucuggguuuuugcagaugucauuguuuccagagaaggagaaaauggacagucuagagacucuggagcuggauaacuaaaaauaaaaauauaugccaaagauuuucuuggaaauuagaagagcaaaauccaaauucaaagaaacagggcguggggcgcacuuuuaaaagagaaagcgagacaggcccguggacagugauucccagacgggcagcggcaccauccucacaccucugcauucugauagaagucugaacaguuguuuguguuuuuuuuuuuuuuuuuuuugacgaagaauguuuuuauuuuuauuuuuuucaugcaugcauucucaagaggucgugccaaucagccacugaaaggaaaggcaucacuauggacuuucucuauuuuaaaaugguaacaaucagaggaacuauaagaacaccuuuagaaauaaaaauacugggaucaaacuggccugcaaaaccauagucaguuaauucuu

SEQ ID NO: 20790 - RNA, 939 nt, Homo sapiens
aagaauuaacugacuaugguuuugcaggccaguuugaucccaguauuuuuauuucuaaagguguucuuauaguuccucugauuguuaccauuuuaaaauagagaaaguccauagugaugccuuuccuuucaguggcugauuggcacgaccucuugagaaugcaugcaugaaaaaaauaaaaauaaaaacauucuucgucaaaaaaaaaaaaaaaaaaaacacaaacaacuguucagacuucuaucagaaugcagaggugugaggauggugccgcugcccgucugggaaucacuguccacgggccugucucgcuuucucuuuuaaaagugcgccccacgcccuguuucuuugaauuuggauuuugcucuucuaauuuccaagaaaaucuuuggcauauauuuuuauuuuuaguuauccagcuccagagucucuagacuguccauuuucuccuucucuggaaacaaugacaucugcaaaaacccagaggggggggggggagucgguuauuguuuaggucucugcggcuguuuucuaagacuagugagcacuguucuuaucaccaccacugagaaauuaagcugaacaaccuggaaggauuucagcccaagggcaagaggaaguggguggguggaaaggaggaggagguggaauuuguuuuaaaacauuuguuuuaaggagaacaaaaauugaaagccgaaagaaaggguggcgcugacaaaacgguccuuacccgugacccugggugucucugucuccccuccugucacgcacacucacgcgcacacacaccccucaccagggcgcaucccccuggagacugcucucccuagcggggucagaccggccuuccggggacgcugggggcgcgaggcaacggugccaagugaggugggaaggcugagcggagagugggagaggggaggaaaucgagguggacug

SEQ ID NO: 20791 - RNA, 224 nt, Homo sapiens
accuuaacgccgaucuuguuggauguacacguaacggaguggaccgaguccuccuuaauuggcuugaguggaggcucgggggcugccucgcguuuguuuuagcccggcgccagguuuuaggcagccaccagaggcggggcguaagcgcuaaagcaacaagacaauagaagccuacaucuugcccgagauaauuagcuuacaugcugaugacaagguaaacaccu

SEQ ID NO: 20792 - RNA, 224 nt, Homo sapiens
agguguuuaccuugucaucagcauguaagcuaauuaucucgggcaagauguaggcuucuauugucuuguugcuuuagcgcuuacgccccgccucugguggcugccuaaaaccuggcgccgggcuaaaacaaacgcgaggcagcccccgagccuccacucaagccaauuaaggaggacucgguccacuccguuacguguacauccaacaagaucggcguuaaggu

SEQ ID NO: 20793 - RNA, 9773 nt, Homo sapiens
gagguaagaggucagcucuuucguugguccuggugaggguaaaauuuuuaggcaggaggagcacugacuggcaaagggaagaggaaaggguucgcccuggaccccacaaauccgccucuuggagcaaacagccugcagguagaggggccuauuagagccugcccaguucccgggagggccaaccccagccaguaagaagaccugaggcguaggaucccugcgcaggagguugcaggaaugcccccgcuagccgcaagguuccugcuggccuguagagcuuucgugauccccgccaagaugcgaacaguaagguccucguauggaucgcaguuuuuguccgaaaccugaaaacacuaacuugggauuucgcaguucuggcccucgggcccgccucggaggcgcacccccaauccccacggaacgaauuccgcggcuaaaaugcauuuucccaaggcaguaaaagugaccccugcaccuaacaaccuuugggcuuucucuucuccugacuaccaccucucgcagggugcgcugaaaucucuuuaucguuaucguuuuuuauaaaugaaaugauuuauuuauucgcuguuugcagggaaugaaaggaguugauccugacuccaagaugcauuccaaagaaagaaaacgcaacuguagcccggacuccgcggaggaaggccaacugacuccacuacgugcacuuccgagccacuugggcccagcuagcuguguuaauuauggguucuaauuuuauugcaacucggcaccuccugguuuguucccacuauaguggucuuaaaaagaaacacacacaggcauaccccagaaugaauccccgggaaggcaaagguagauuuuuucggugcuugaguugaugcucugagagcgcgcugagagucucgggcaugucuuggcacucuuggaaacaaauugcagccaagagcacgguucuuccgguccucuccuugcuccucugugcgccgcucggccgcgggacuccuggaacauguugugcaccgcccgaguggcugcggaccucaccucgacgcccuggauagccggggccaggaggagacgagcaggcagucucccgcccucaccuagucagcugcgaccuccgcggcguggacucuuggccagcagugaggaggacaagguugcagauccucuuugcugcggguucuggguccggccuugggcggcauucugucuucuaaaguguggagguggguagaagaguguccacuuucaguguagacaccugagguaugggggcuucuuugggggcuccagcgugagcugcuccugcagauuagggaaauggagagaacaacaauggggacaugguggaauucagauuucccccuguuaauuaacaauaugauuucgcuuaguccaagugucuucuguguucuuauuuaaugucucuuguaaaaugggaacuagaauaauaccuccuugguaugguuguuguguuugacgugagcccucaacaaaugguaggaugaacuggagaagaauggguccaucacuccccacacccuucccugcagagcuucuuugcugucuccagcucucccgcccugacgcaaggacagcucacaaccaguguccuugaguagccccugggggccgcaagagaauccgcccgguagggcauagaagauggguuuucggugaaucgugaaaagacaugaucggguuucccuuggagcaugguggagaaugaugcggagccuuggggucaauggagaguugagggugcagagggaucugaaagggggaaccaaaaauaucgggcuuugaaauucuguggauuuucaaaggcgguucccaaccuugucaaaaacuacagugggugcgcgaucuaaucuggcuccuauagguggcgcugugacaaggugcgguggccgggagaggcggcugggggacucgaagacugcgggaaauuuucugcgacuccgacgcuaacccgcugcucccagccuccgcuuccuguuuucgagggauuagcuaggacugugcaacaccagucuccgcucucggagucggcacgggggcugguggguggcgggaugaacucggggaaggcgacaggcuggaaacgcagcuccucgacuuugcagcgcaccaacccccuaucgccccguccgcugcucaggugcgaggauucgccagacgccacaggacugggggcgacucgcaagggcaucaugccaccuagaggaaacgcgcagugagugagcccugggucacugaaaaugggagaacguucgagucggucaagaugacuccggccugcgaguugauucagacuccucggaagccagaaauugggucuagaguggguuggucccuccgucagcaguucgggcccagccgaagcuuggggccuagagggcagacguccggcucugaucagaguacagcgggcugggccuggcagccugcaggcaaccuggaccuugcaauaaagcugcauucaacauaacucagaccacagugggagcccccgaagggcuucaugugagucccgaaaccagaguuuagaggcgcggccugguucucguuuaucuuuuccagacagcauuuaggccaauaaggucuuugaaaggaggcagccccaaagcccucaggccgacaccugagggcagggucucaaacagcugugcuugaagaaccggcaaucuugcuuuucccacacgcagcugcaccucuccugagcgcugcagcugauggcuguauagugaccacggacugcguccuccucacgaagcugcgcaacuucugcuaaugcugcaacccuggcaagacgaaaucccccucccucuggcuagaucagcccagccuccccucagggaccuuccugccccucccuaccccucccuaccccuaggccgcuccccccuuccucuguugggauccgauccuuguucgcucuugcaaucccgcagcccggaguuuugccccgugcauuaaaacauguucucuuucauuugcagauuuaauaaacaaacguaaccauaucacauggagcuccacacuguccuucugaaagcaauuccgcuguugaaaacugaaaaauggguguaauuugcuuucagaaaguaauguuagggucacggcaauuucucgggccguuauuuauuuuuacuuuaaagucuuuaggaaagauuugcuuauaugcucggaaaacuuccaaaugcgcgaauaccagcaaucccgcucgccuucaacgcgugggguaaggggggguggggaacaauuacugagugacgcuaauauggggaaacugaaaagaaaugucgauuguuuuuauuguaauagaaggagugagcaaacagaaaaaccaaccccgggugaucggaaacaggcaggcggagaauuaaaagcggguuucagacagcaacaggccccuccccugcucucgcaaggagaaagcgggcgacgagcgcucgcagcccguggggcugaucccaccucccgcagggcuccggucgugucgcugucggaccgcagaacgccgggacgcauuuccgagcucgggcccgacccaacccgcugccauucuagcuaccuaguggagccgcggagagacucuugaaccgugaggcuccuugaugagaagguggagaggcugccgggcuauucuccgagcaucuuccggccgagcucugcuccucuccgugcgcuugcggcuucuccuugggcuagcgcguccgcagucccuccaaguccaggccgcaggucagugugcgggcgccuccuguccuccucucccaccagaggaccccugagggcugucuccauccccaauccccgcgacugcuccuuuuagccgccauccccucccgcagcgcagauccugcaggggccagcgguccagggcggacccucccucgcccugggcgcggggcgagcuucuggcugucacuugccgcugcaguuucagggaaacucagcuggccgcuuacccugcaagacggggacauagcagagggccgaguucuggagaagcugggcuuguuuuucucucugcaccgcgcgcaaugccccaacugacccugaagggucuugccuuuacugcauuugcccccagacggcuagaagucaaugcacuaugaaaaucccagucccggaccucggacucuggcugucuuacaaucccugcaacuccuccgaguggacaagaggcgggcaccgucgccugggccucgcuugggggggggggguccuguccccagcagggggcaaguuggaggaaucagcuccuuaauauuuucugcuagcucugcuugucauaacugcaacucggaauagaacaaccucucucccgugcauacgcacccccaacucucgcccuauccucccauccacagucaucacugaccuguagacccggaggagcaggcuuccgggggucgguccagguuggggauacagggagggguccucgcguuccgcacaaccuguagugcuugggucugacuucggcagcccucggguacagucugccgggcuagauucccguugcuucuccgcgucucuccgcgggccgcucuagcgccgggaagggggcgccgcaggugacugcccgcggcacugggacggcugacagauuuauggagacuucacagcaucuggcugggguccgcgagggcagggcggaguccggucgauccgaugcuggggucuaaagcuuccccagccacacgccugggccgagucgcccccagaguccccggccccugcuccccuugggcggguguacacaaggauccggccagcgccgaguguacugguuccucccacccaguguagcccccuccuucacacucucggcccggcuuccagucucccacugaguaaauauuuauccagagagcgagucgccccucggaggaggccucgacgcggcuagggaaaggcuuuuuggcuucucccuggccugagccagcugcaggccuuacugguguuuugguuuuggucuuaaauuucuccuuuuagucgaaauucuuccgaucucuuugagaucuucugaguccagagugagcaguguaaccaggcggcagacuccagcugacccuuguucuuguucuagguccugcauccuuacauucaucgggacugaccagaccuuaguguucucucuuuuccuuccuucauccucuuucucugccucagauccgucgucucucggucggucucagcgggucgcugacuaccucgcccuagcacucgguccgcgccccgggaaggcuucagcaucacccucuucugcugggaucccgcugacccugucugcagcuucggcuucucuugcucccagagcggggucuucggcuugccgcggauacuuaguggcccaaaacaccuaaaauugacucuuccugcgcucuugagaaugccaagagcacccaguaccugcaaccgccggcaugaguggggccugcggggagccgccagagcugcggacaggcccccugcccacugaguugcuaccccuggcacgcccaggggauccgcagcagcugaggccacauggucacagccaaguucagcagguggaaagggagagauggcauugaaccuaugugagaacugggaagauguguggcagcugaaggaguugguaggaacaagagggaguuguauguuaccuccauauaaccagagcucuaaaccauaucaguuucugaaccagucuaggcuggugcugcagaacugcuaaagcucucgcagaguccccagaccccccgcgggacaugaggucuugccuguucguaugcgaacauccuuguacccgccuagcagcccugcagacugcaaauuuucccugggugcacggaaguagagcagauuuggcgcagaggucgauacucacugccugucugugaggggggaggaggauuccuuccuggucaaguugccgggcauguucauucccucccgcaagccuaaggcagagucauaagcuccccuacgaugcggcaaagucucaacuaauuuaucuaccagccuuaagaaggagcugcugcuucuaaaaucuuuagauuuccgaaggcucuccuuguguaaaaaugccaggcggugccacacgaugucacccaacagguauuggaggucagaccaggcugaaauugcuaucaagucaaacuucaagaagauuuuaaacauuugaaaccaaccaacaaaaagggacaaguucaaguaugucuaguugugggauuucccccaagauuccgauucuaaagagugguguuuuaguucaucuuuaccuuucacauccuccauucuguuagguaauuuugaauuuagagugcauccuaaccauagaagugggaaucuggagaucuguuccuuugcagaagcauggcugaucauaguuuuuuccuggguucuugcaacuuacugaccugagaucugggaccagucagcuucucuggguguagaccgcagccacacacaucccuggggacuguuggggaagcagccugaauccugugugcacaaggagccuucuggauugucaaguagcaguaacagaguucacgaccccaagcaguacaaacucccaaauucacgaaaauauuucucuucuuguuuauuauuuugauucacauucuccacaacccuaacugcaaauauuaauaacuuuggcugcaaaaaagcauacgguacacuuuagauuagacuuacagugaauaaaagugaaaauucagaaguaggcagaacgacagggccucuggagcuuaauggaagacgagggaauuacauccaugugcagcgucgguguccacugucuugggacuaagucucuuucauauuuaaacaaaacucuuucgagagggcucgcugguuuggagaacccucacaaacgcugccaccgagggccaggggcccaggacaguggcugaauguggcagagccuugggcuccguagugagugccccacgcacuggcaauuggucgacuuggggcugugcgcuagcguuagccgccugugguucaguuccccgcacacggcguggcccgugccucgagccuguguggcuagugguuggccgguccaccuggacuggggggucgccgcaggaagcuggcgguaggaggaaccucccuggccuuaacaguggcccccaccuguggcucgggcuccccgcaaccuccugguuucuuuggccggccuaucuucucacaccugcgcucucgccaccuggcauggacugaagugagguagaaucggcaggugacacagauccucuccugacaguccccagaggcccgcaugacagauuuugcuaagacaacucccucaccccugugcacgguggcgcccgccucccaccuauagccuuaacuucaauucugagauguccaucguuccccggaggaggucuccucgggccccuucucccuucgagucauucacauucagaccaaacgcuuucauuuguuuauucagcauuuuaccagccugauuuugcugucuuuuugugccgcuucugggaagaugucaaacacccauuuucauuguauuuagucacccagguggggagcuagccugaaagagacagcggaaggaguuuccuggacugcgcugucgcucaccgacccgcaccaaucaccaugcagcuugcccucggacccgccccuuuuagggcguguccccagugagugauagacggagccgcccugcccugcucagcccagcccacguugcugcuuagauugaaaugcagaacucaagccucuuucaucggggcacagacuuccuuuuacuucuuccuuuugcccucucgccuccuccuccugggaagaagcggaggcgccggcggucggccgggauagcaacaggccgggccacugaggcggugcggaaaguuucugucugggagugcggaacuggggccggguugguguacugcucggagcaaugggugaguggcggcgggggacucugucagagccgggaagggagggagggagcgagcgggcaagggagggagggagggagggagcgcgagggcgcgcgccacuaggcgcucacauucucuauugacuuugcucguguuccuacaaguuguaggaacacgcuaagggucagcggcgcacagcaguucaaugugaacgcuggcuacuggguggcuguugaugccauuuucugauuuuaagagaagggagcuguggcaucagcgagccccucagcccgaguagcaaaccaaguuuuguuucacacgcgcgcacacaugcaaacaaaacaggaaaagaaaagaaaagaaaacaaacaacaacaaauaaaacacccucuagcuuccccuagacuuuguuuaacuggccgggucuccagaaggaacgcuggggaugggauggguggagagagggagcggcucaaggacuuuagugaggagcaggcgagaaggagcacguucaggcgucaagaccgauuucucccccugcuucgggagacuuuugaacgcucggagaggcccggcaucucaccacuuuacuuggccguaggggccuccggcacggcaggaaugagggaggggguccgauuggacagugacgguuuggggccguucggcuauguucagggaccauaugguuuggggacagccccaguaguuaguaggggacgggugcguucgcccaguccccggaugcguagggaggcccaguggcaggcagcugucccaagcagcgggugcgcgucccugcgcgcuguguguucauuuugcagagccagccuucggggaggugaaccagcugggaggaguguucgugaacgggaggccgcugcccaacgccauccggcuucgcaucguggaacuggcccaacugggcauccgaccgugugacaucagccgccagcuacgggucucgcacggcugcgucagcaagauccuggcgcgauacaacgagacgggcucgaucuugccaggagccaucgggggcagcaagccccgggucacuacccccaccguggugaaacacauccggaccuacaagcagagagaccccggcaucuucgccugggagauccgggaccgccugcuggcggacggcgugugcgacaaguacaaugugcccuccgugagcuccaucagccgcauucugcgcaacaagaucggcaacuuggcccagcagggucauuacgacucauacaagcagcaccagccgacgccgcagccagcgcugcccuacaaccacaucuacucguaccccagcccuaucacggcggcggccgccaaggugcccacgccacccggggugccugccauccccgguucgguggccaugccgcgcaccuggcccuccucgcacuccgucaccgacauccugggcauccgcuccaucaccgaccaagguaggggcucagaggcugggcguguggaugugcagcgucugcccccgcacucucgcggaggucccaguaucugcagccucagggacacugucuuucccaccaccugaggcuuuuuccuuuggaaacguaaggagucuuccuaggggguguucugaucucauuaacuugaaacucaugccccugguuuccuugccacacacagucuucugccucaucucaaacuaccagacccauaacauccccccauccccaacacaugguucgcauuuuccacccucccccgccucucgcgccgaggcagccucagcccggcuugcucacuuggagagugcggccggggcuggacuuggggcgcagcccgggaggcccgagccugcuuggggcugccggcugcagacuccgcugu

SEQ ID NO: 20794 - RNA, 9773 nt, Homo sapiens
acagcggagucugcagccggcagccccaagcaggcucgggccucccgggcugcgccccaaguccagccccggccgcacucuccaagugagcaagccgggcugaggcugccucggcgcgagaggcgggggaggguggaaaaugcgaaccauguguuggggauggggggauguuaugggucugguaguuugagaugaggcagaagacuguguguggcaaggaaaccaggggcaugaguuucaaguuaaugagaucagaacacccccuaggaagacuccuuacguuuccaaaggaaaaagccucagguggugggaaagacagugucccugaggcugcagauacugggaccuccgcgagagugcgggggcagacgcugcacauccacacgcccagccucugagccccuaccuuggucggugauggagcggaugcccaggaugucggugacggagugcgaggagggccaggugcgcggcauggccaccgaaccggggauggcaggcaccccggguggcgugggcaccuuggcggccgccgccgugauagggcugggguacgaguagaugugguuguagggcagcgcuggcugcggcgucggcuggugcugcuuguaugagucguaaugacccugcugggccaaguugccgaucuuguugcgcagaaugcggcugauggagcucacggagggcacauuguacuugucgcacacgccguccgccagcaggcggucccggaucucccaggcgaagaugccggggucucucugcuuguagguccggauguguuucaccacgguggggguagugacccggggcuugcugcccccgauggcuccuggcaagaucgagcccgucucguuguaucgcgccaggaucuugcugacgcagccgugcgagacccguagcuggcggcugaugucacacggucggaugcccaguugggccaguuccacgaugcgaagccggauggcguugggcagcggccucccguucacgaacacuccucccagcugguucaccuccccgaaggcuggcucugcaaaaugaacacacagcgcgcagggacgcgcacccgcugcuugggacagcugccugccacugggccucccuacgcauccggggacugggcgaacgcacccguccccuacuaacuacuggggcuguccccaaaccauauggucccugaacauagccgaacggccccaaaccgucacuguccaaucggacccccucccucauuccugccgugccggaggccccuacggccaaguaaaguggugagaugccgggccucuccgagcguucaaaagucucccgaagcagggggagaaaucggucuugacgccugaacgugcuccuucucgccugcuccucacuaaaguccuugagccgcucccucucuccacccaucccauccccagcguuccuucuggagacccggccaguuaaacaaagucuaggggaagcuagaggguguuuuauuuguuguuguuuguuuucuuuucuuuucuuuuccuguuuuguuugcaugugugcgcgcgugugaaacaaaacuugguuugcuacucgggcugaggggcucgcugaugccacagcucccuucucuuaaaaucagaaaauggcaucaacagccacccaguagccagcguucacauugaacugcugugcgccgcugacccuuagcguguuccuacaacuuguaggaacacgagcaaagucaauagagaaugugagcgccuaguggcgcgcgcccucgcgcucccucccucccucccucccuugcccgcucgcucccucccucccuucccggcucugacagagucccccgccgccacucacccauugcuccgagcaguacaccaacccggccccaguuccgcacucccagacagaaacuuuccgcaccgccucaguggcccggccuguugcuaucccggccgaccgccggcgccuccgcuucuucccaggaggaggaggcgagagggcaaaaggaagaaguaaaaggaagucugugccccgaugaaagaggcuugaguucugcauuucaaucuaagcagcaacgugggcugggcugagcagggcagggcggcuccgucuaucacucacuggggacacgcccuaaaaggggcggguccgagggcaagcugcauggugauuggugcgggucggugagcgacagcgcaguccaggaaacuccuuccgcugucucuuucaggcuagcuccccaccugggugacuaaauacaaugaaaauggguguuugacaucuucccagaagcggcacaaaaagacagcaaaaucaggcugguaaaaugcugaauaaacaaaugaaagcguuuggucugaaugugaaugacucgaagggagaaggggcccgaggagaccuccuccggggaacgauggacaucucagaauugaaguuaaggcuauaggugggaggcgggcgccaccgugcacaggggugagggaguugucuuagcaaaaucugucaugcgggccucuggggacugucaggagaggaucugugucaccugccgauucuaccucacuucaguccaugccagguggcgagagcgcaggugugagaagauaggccggccaaagaaaccaggagguugcggggagcccgagccacaggugggggccacuguuaaggccagggagguuccuccuaccgccagcuuccugcggcgaccccccaguccagguggaccggccaaccacuagccacacaggcucgaggcacgggccacgccgugugcggggaacugaaccacaggcggcuaacgcuagcgcacagccccaagucgaccaauugccagugcguggggcacucacuacggagcccaaggcucugccacauucagccacuguccugggccccuggcccucgguggcagcguuugugaggguucuccaaaccagcgagcccucucgaaagaguuuuguuuaaauaugaaagagacuuagucccaagacaguggacaccgacgcugcacauggauguaauucccucgucuuccauuaagcuccagaggcccugucguucugccuacuucugaauuuucacuuuuauucacuguaagucuaaucuaaaguguaccguaugcuuuuuugcagccaaaguuauuaauauuugcaguuaggguuguggagaaugugaaucaaaauaauaaacaagaagagaaauauuuucgugaauuugggaguuuguacugcuuggggucgugaacucuguuacugcuacuugacaauccagaaggcuccuugugcacacaggauucaggcugcuuccccaacaguccccagggauguguguggcugcggucuacacccagagaagcugacuggucccagaucucaggucaguaaguugcaagaacccaggaaaaaacuaugaucagccaugcuucugcaaaggaacagaucuccagauucccacuucuaugguuaggaugcacucuaaauucaaaauuaccuaacagaauggaggaugugaaagguaaagaugaacuaaaacaccacucuuuagaaucggaaucuugggggaaaucccacaacuagacauacuugaacuugucccuuuuuguugguugguuucaaauguuuaaaaucuucuugaaguuugacuugauagcaauuucagccuggucugaccuccaauaccuguugggugacaucguguggcaccgccuggcauuuuuacacaaggagagccuucggaaaucuaaagauuuuagaagcagcagcuccuucuuaaggcugguagauaaauuaguugagacuuugccgcaucguaggggagcuuaugacucugccuuaggcuugcgggagggaaugaacaugcccggcaacuugaccaggaaggaauccuccuccccccucacagacaggcagugaguaucgaccucugcgccaaaucugcucuacuuccgugcacccagggaaaauuugcagucugcagggcugcuaggcggguacaaggauguucgcauacgaacaggcaagaccucaugucccgcggggggucuggggacucugcgagagcuuuagcaguucugcagcaccagccuagacugguucagaaacugauaugguuuagagcucugguuauauggagguaacauacaacucccucuuguuccuaccaacuccuucagcugccacacaucuucccaguucucacauagguucaaugccaucucucccuuuccaccugcugaacuuggcugugaccauguggccucagcugcugcggauccccugggcgugccagggguagcaacucagugggcagggggccuguccgcagcucuggcggcuccccgcaggccccacucaugccggcgguugcagguacugggugcucuuggcauucucaagagcgcaggaagagucaauuuuagguguuuugggccacuaaguauccgcggcaagccgaagaccccgcucugggagcaagagaagccgaagcugcagacagggucagcgggaucccagcagaagagggugaugcugaagccuucccggggcgcggaccgagugcuagggcgagguagucagcgacccgcugagaccgaccgagagacgacggaucugaggcagagaaagaggaugaaggaaggaaaagagagaacacuaaggucuggucagucccgaugaauguaaggaugcaggaccuagaacaagaacaagggucagcuggagucugccgccugguuacacugcucacucuggacucagaagaucucaaagagaucggaagaauuucgacuaaaaggagaaauuuaagaccaaaaccaaaacaccaguaaggccugcagcuggcucaggccagggagaagccaaaaagccuuucccuagccgcgucgaggccuccuccgaggggcgacucgcucucuggauaaauauuuacucagugggagacuggaagccgggccgagagugugaaggagggggcuacacugggugggaggaaccaguacacucggcgcuggccggauccuuguguacacccgcccaaggggagcaggggccggggacucugggggcgacucggcccaggcguguggcuggggaagcuuuagaccccagcaucggaucgaccggacuccgcccugcccucgcggaccccagccagaugcugugaagucuccauaaaucugucagccgucccagugccgcgggcagucaccugcggcgcccccuucccggcgcuagagcggcccgcggagagacgcggagaagcaacgggaaucuagcccggcagacuguacccgagggcugccgaagucagacccaagcacuacagguugugcggaacgcgaggaccccucccuguauccccaaccuggaccgacccccggaagccugcuccuccgggucuacaggucagugaugacuguggaugggaggauagggcgagaguugggggugcguaugcacgggagagagguuguucuauuccgaguugcaguuaugacaagcagagcuagcagaaaauauuaaggagcugauuccuccaacuugcccccugcuggggacaggaccccccccccccaagcgaggcccaggcgacggugcccgccucuuguccacucggaggaguugcagggauuguaagacagccagaguccgagguccgggacugggauuuucauagugcauugacuucuagccgucugggggcaaaugcaguaaaggcaagacccuucagggucaguuggggcauugcgcgcggugcagagagaaaaacaagcccagcuucuccagaacucggcccucugcuauguccccgucuugcaggguaagcggccagcugaguuucccugaaacugcagcggcaagugacagccagaagcucgccccgcgcccagggcgagggaggguccgcccuggaccgcuggccccugcaggaucugcgcugcgggaggggauggcggcuaaaaggagcagucgcggggauuggggauggagacagcccucagggguccucuggugggagaggaggacaggaggcgcccgcacacugaccugcggccuggacuuggagggacugcggacgcgcuagcccaaggagaagccgcaagcgcacggagaggagcagagcucggccggaagaugcucggagaauagcccggcagccucuccaccuucucaucaaggagccucacgguucaagagucucuccgcggcuccacuagguagcuagaauggcagcggguugggucgggcccgagcucggaaaugcgucccggcguucugcgguccgacagcgacacgaccggagcccugcgggaggugggaucagccccacgggcugcgagcgcucgucgcccgcuuucuccuugcgagagcaggggaggggccuguugcugucugaaacccgcuuuuaauucuccgccugccuguuuccgaucacccgggguugguuuuucuguuugcucacuccuucuauuacaauaaaaacaaucgacauuucuuuucaguuuccccauauuagcgucacucaguaauuguuccccacccccccuuaccccacgcguugaaggcgagcgggauugcugguauucgcgcauuuggaaguuuuccgagcauauaagcaaaucuuuccuaaagacuuuaaaguaaaaauaaauaacggcccgagaaauugccgugacccuaacauuacuuucugaaagcaaauuacacccauuuuucaguuuucaacagcggaauugcuuucagaaggacaguguggagcuccaugugauaugguuacguuuguuuauuaaaucugcaaaugaaagagaacauguuuuaaugcacggggcaaaacuccgggcugcgggauugcaagagcgaacaaggaucggaucccaacagaggaaggggggagcggccuagggguagggagggguagggaggggcaggaaggucccugaggggaggcugggcugaucuagccagagggagggggauuucgucuugccaggguugcagcauuagcagaaguugcgcagcuucgugaggaggacgcaguccguggucacuauacagccaucagcugcagcgcucaggagaggugcagcugcgugugggaaaagcaagauugccgguucuucaagcacagcuguuugagacccugcccucaggugucggccugagggcuuuggggcugccuccuuucaaagaccuuauuggccuaaaugcugucuggaaaagauaaacgagaaccaggccgcgccucuaaacucugguuucgggacucacaugaagcccuucgggggcucccacuguggucugaguuauguugaaugcagcuuuauugcaagguccagguugccugcaggcugccaggcccagcccgcuguacucugaucagagccggacgucugcccucuaggccccaagcuucggcugggcccgaacugcugacggagggaccaacccacucuagacccaauuucuggcuuccgaggagucugaaucaacucgcaggccggagucaucuugaccgacucgaacguucucccauuuucagugacccagggcucacucacugcgcguuuccucuagguggcaugaugcccuugcgagucgcccccaguccuguggcgucuggcgaauccucgcaccugagcagcggacggggcgauaggggguuggugcgcugcaaagucgaggagcugcguuuccagccugucgccuuccccgaguucaucccgccacccaccagcccccgugccgacuccgagagcggagacugguguugcacaguccuagcuaaucccucgaaaacaggaagcggaggcugggagcagcggguuagcgucggagucgcagaaaauuucccgcagucuucgagucccccagccgccucucccggccaccgcaccuugucacagcgccaccuauaggagccagauuagaucgcgcacccacuguaguuuuugacaagguugggaaccgccuuugaaaauccacagaauuucaaagcccgauauuuuugguucccccuuucagaucccucugcacccucaacucuccauugaccccaaggcuccgcaucauucuccaccaugcuccaagggaaacccgaucaugucuuuucacgauucaccgaaaacccaucuucuaugcccuaccgggcggauucucuugcggcccccaggggcuacucaaggacacugguugugagcuguccuugcgucagggcgggagagcuggagacagcaaagaagcucugcagggaaggguguggggagugauggacccauucuucuccaguucauccuaccauuuguugagggcucacgucaaacacaacaaccauaccaaggagguauuauucuaguucccauuuuacaagagacauuaaauaagaacacagaagacacuuggacuaagcgaaaucauauuguuaauuaacagggggaaaucugaauuccaccauguccccauuguuguucucuccauuucccuaaucugcaggagcagcucacgcuggagcccccaaagaagcccccauaccucaggugucuacacugaaaguggacacucuucuacccaccuccacacuuuagaagacagaaugccgcccaaggccggacccagaacccgcagcaaagaggaucugcaaccuuguccuccucacugcuggccaagaguccacgccgcggaggucgcagcugacuaggugagggcgggagacugccugcucgucuccuccuggccccggcuauccagggcgucgaggugagguccgcagccacucgggcggugcacaacauguuccaggagucccgcggccgagcggcgcacagaggagcaaggagaggaccggaagaaccgugcucuuggcugcaauuuguuuccaagagugccaagacaugcccgagacucucagcgcgcucucagagcaucaacucaagcaccgaaaaaaucuaccuuugccuucccggggauucauucugggguaugccuguguguguuucuuuuuaagaccacuauagugggaacaaaccaggaggugccgaguugcaauaaaauuagaacccauaauuaacacagcuagcugggcccaaguggcucggaagugcacguaguggagucaguuggccuuccuccgcggaguccgggcuacaguugcguuuucuuucuuuggaaugcaucuuggagucaggaucaacuccuuucauucccugcaaacagcgaauaaauaaaucauuucauuuauaaaaaacgauaacgauaaagagauuucagcgcacccugcgagaggugguagucaggagaagagaaagcccaaagguuguuaggugcaggggucacuuuuacugccuugggaaaaugcauuuuagccgcggaauucguuccguggggauugggggugcgccuccgaggcgggcccgagggccagaacugcgaaaucccaaguuaguguuuucagguuucggacaaaaacugcgauccauacgaggaccuuacuguucgcaucuuggcggggaucacgaaagcucuacaggccagcaggaaccuugcggcuagcgggggcauuccugcaaccuccugcgcagggauccuacgccucaggucuucuuacuggcugggguuggcccucccgggaacugggcaggcucuaauaggccccucuaccugcaggcuguuugcuccaagaggcggauuugugggguccagggcgaacccuuuccucuucccuuugccagucagugcuccuccugccuaaaaauuuuacccucaccaggaccaacgaaagagcugaccucuuaccuc

SEQ ID NO: 20795 - RNA, 1311 nt, Homo sapiens
uaacaugacuuuacauguacaccuuugcaagcuauuuagaaacucgcauuaauuuugucaccacuuuacaguccccuguuugaaaaauuuggugacacaguuugucaaaauaaaucuuuuuuuuuuuucacaugcugauguugcugccgaugauuucaacgccuggcuuugagauuccgugaguagucuugaauaauuuaaaauucgaaaaucaaauucuacuuauuuucucuuaaugcuauuguauuuccuaauucucagcuuuaacauguaagaaaguacuuucgcuaggggucuuaauugaaugguggggucgagaugacugcgucagaauuaaaucucuggaagaccucugagcuccuuuuaaaaucaucaacaagcgaaaauccuuaucaauagcgaugugggaaugcauuagguacaguauuuuaaacauacaaaaccuaggcauauuaaaaagcacuccucugguaauuuaauaaggaauaaugauguccuuaaguuuauuuuaaucagcaaguaugacucaauuugaaaauaugagaacaaauagauuuaaauaggaacacccaguaaacuaugguaugcaaauaaacucagagguaaacuugugaauacauaaaucuaaauaagucaguuaccaucaaaauauuacgugauccuauauuuuucuguccacgucuuaaaaguauuuuuuaccuuggggcuuuauuuucuuucccucuucccaagauuauccaaggcaguuccaauacgcguuuucaauaaugguaauuaaacuuuuggaggguaaucgccagcuguuuccagaaaaauacuuuuaauaggugguaguccucccuguaacugguuuucccuguaauccuuuugugcacauuguaaaaauaacccccaugaacgugccaccaaggggacaaugaagagaaacagguucucggcccagaguugugaagaagauuuuggucgcacuagcgccacccagcgguuuuagagaaggagcacacuucuccccaaauagggcuuuugaagaacaaguuuuacaaaauuuagaaaucguuucauuauugagacacccaacuuggcggcagagcgcuuuaaucagaagacgucugcgaauuaaacggugggacgaagaggucgccuuguggguaugcuccggcuuucucagaguugcuuccaacucgcaccggcgcucgcccgcccgcugcaccccgggcccggcuccugcucccgcucgcugcugggaagaggcaagcgcuuccuagagccgcuguuuucaaagcccggaguuuccuaaaacucccucuccgg

SEQ ID NO: 20796 - RNA, 1311 nt, Homo sapiens
ccggagagggaguuuuaggaaacuccgggcuuugaaaacagcggcucuaggaagcgcuugccucuucccagcagcgagcgggagcaggagccgggcccggggugcagcgggcgggcgagcgccggugcgaguuggaagcaacucugagaaagccggagcauacccacaaggcgaccucuucgucccaccguuuaauucgcagacgucuucugauuaaagcgcucugccgccaaguugggugucucaauaaugaaacgauuucuaaauuuuguaaaacuuguucuucaaaagcccuauuuggggagaagugugcuccuucucuaaaaccgcuggguggcgcuagugcgaccaaaaucuucuucacaacucugggccgagaaccuguuucucuucauuguccccuugguggcacguucauggggguuauuuuuacaaugugcacaaaaggauuacagggaaaaccaguuacagggaggacuaccaccuauuaaaaguauuuuucuggaaacagcuggcgauuacccuccaaaaguuuaauuaccauuauugaaaacgcguauuggaacugccuuggauaaucuugggaagagggaaagaaaauaaagccccaagguaaaaaauacuuuuaagacguggacagaaaaauauaggaucacguaauauuuugaugguaacugacuuauuuagauuuauguauucacaaguuuaccucugaguuuauuugcauaccauaguuuacuggguguuccuauuuaaaucuauuuguucucauauuuucaaauugagucauacuugcugauuaaaauaaacuuaaggacaucauuauuccuuauuaaauuaccagaggagugcuuuuuaauaugccuagguuuuguauguuuaaaauacuguaccuaaugcauucccacaucgcuauugauaaggauuuucgcuuguugaugauuuuaaaaggagcucagaggucuuccagagauuuaauucugacgcagucaucucgaccccaccauucaauuaagaccccuagcgaaaguacuuucuuacauguuaaagcugagaauuaggaaauacaauagcauuaagagaaaauaaguagaauuugauuuucgaauuuuaaauuauucaagacuacucacggaaucucaaagccaggcguugaaaucaucggcagcaacaucagcaugugaaaaaaaaaaaagauuuauuuugacaaacugugucaccaaauuuuucaaacaggggacuguaaaguggugacaaaauuaaugcgaguuucuaaauagcuugcaaagguguacauguaaagucauguua

SEQ ID NO: 20797 - RNA, 4021 nt, Homo sapiens
cucuggaucggaaccucgcagccggagaaggccgggggcgguggcgucggagacugggcuuagagaccuugugggauaacugaccccggggucccuccccagagguacacgccaccuuccgagcgcgggcugcggcccagucucgcgccccuccugcucuuugcuuccucccuccugauuccugacccaaaguucaaccccgggagacuggagaauacagacuuuuuuuuuucuuuccuccugagagcuucagacuagaaaagggaaaaagccccacuuuugcuucgucacuagaaaccgggucaucugagucagccgagccaagugacguuaggccgacccgggccccgggcuagcagagcggaggcgcugccacgaaacucguaccugcggcuaagagcaggugagucacagcaccgguuuauaucuuuaugacauaacuuuuuuuuuuuguuccgccucgguccgcuccucuccccuugucaucuguagcgaccacaaagaggaagaaacugagagcagaugucugugugauagggcaggcggacccaagucgggccguccucccccugccgggcuccuccucccgccccccuucagccgcuucagggagugagcuggagacgaccgucugguuucugauaggaaaaggucagggggaggggacaucucccauaacacgcgcguuagcugggagagcaagggccugggcgcgggaacgcaucugcacugcgaaagagaugccaggcagaagcccgagacugcccgcagcggcgcuugguccugucugugacccggaggguccgggcugagaucucaggggcucgcuugguuccuaaucgguccuggacgucggugggagagucuucccaacgcaaagucucuuuacucucaugaggcccuggguggugguugcccacuuguccugggagagagaacaacugaagugaccgggugauaggcaauuaguuggugauagauugggagauggugcguguguuuugagugugugaccguuuguauauuucugagcaugugugacuguguguguuucugagugucugugaccauguguuuguuguacugccuguagaaccacuagguuuccuuaaguaacaauaaaauaaaaucuaaaguaauuaagaauccgcaaaaucuucuuguuuugcaaaguuuuuaaaauguuauuaaucucauuuuaagaaauguguuuuaacuugucuuccaaacagauaccuuuuucccugugcuuuguucuuuuaaaucucuuuuacuugaaaucuggcaagagaaucacuuuaaaucccugaaccaaacaaaucucuuaagucagcaggggagcagagagggugaagaugugcaguuaaggaaauaaaaaaagauaaaagcauuggauuacauuuuuuuuuuuuuuuuuuacaaaaaggguggggggguagaaacgucacaucauaaggaaaggaaugagugaaauuaaauccaccuggaacucaguagggcaggaacccucccuaaugcagccugcuccugugacugcaaguugucccaucaguuuguguaaauguaucugcgaauugugugucagaaacuaauucuuuugugcaaaguucccauuaguagcugacuuuaguuccauuuguaaaguauacggaugcuuagcuuccugggccugauccgggggacuuucagugcuaaugagcuuccuuguuccuucuggaggugauucuccaauacccucuuggcucuucaauaacaccgagcaagacuagguuauuuucuaccgagaguaacaauuuauggauaguaauagcuuuuauagugcacaaaaaaguuggcgcuuuaaguaggggaaaaacacugucaccuuaaagggggggucaauuacaauaucaaauguucuuuuagcccacuucccaaaccuacuaagucucauauuuucaaaaaaaaaaaauugacuuaagaaaaaaaaauccacuuuucauagcgugauggccgaagcggaauuucuccuaggcuucuucaaagcccaagaccggugaugcagaauggacucugccagcuucggagacuugauccaggucagggaucccagguucgcagccgggggauuuccacgaaaacagcgccuccugucguggagagggaaagcugaauuuucccgcaggcgccuccggggagcaccgccaggcgauacuggauugaacuccgcacgcaucccagucagggauuuagguucuuagagccgaggccaagauggaaggagagauggccguucguccagcucccagccucucuccaucucaguggccgcauugcaagauaccuaacaaauuuaggaggugagguucuaguguacccagaugccagccagucacuuucccugagguuuaaaagcgaaucagcagggucguguugggucuuugacuuggaaaugcauacauacauacauaaaguaaugcugcugucugggaguugcuggccagucgguagccagguccagcggcugcagccugcucuuuuccaaccucuuuucccaaauaggcaccuacaccauuggaaacugugcuuugcaaggauugugcugcucguuggaggaaaccaggccugucuucagcuguggggaggauggguggacucggggcaggguacccgcgagggcaggcacguggcggcuccugcggugucccggguuaaacuugccuguguuuaagacgggucugcgacagcuuggggcgguccaggucgcggggagggcgggcuccucaagugggggauccgcggcagugaggacuguagggugcgcggguacuccggguagccgccagcggaggaagcggcuccgcccuucccggaagcugcccuugcuacacccguggggccugcucccggcgcagucccgcaguaccugagcggcacucgguccuuugaccacgcuuggcugccucagcuuacacuucccagcaggaucuggcugggagccccuuccucagauauucaccaggcagguagaagcagagggagacgacggcgaaagguggaaggagaggccgcggccucgggccucgggccccgggcccagacggcggccucucgcggcgacaggguccuuccuauuuagcaggaccgcaggguuggcagacagcagggccugggccggcggggcucugcggugcccauucgagucucuccagggcuucccucuguggcugucccucgccugcccccuuuccuugccuacccuucccuggacgggguuguugucaggugacggcuucagcaacccagccaugcuugguguggagugguucgaguuccuccgcgggcccccaccccccacccagauaagaagcuuaaguccuccuucugcaggggagaaucggaugcaaugaaacuaagaccuguggucguuaacgcgguucaaagccgaccccaacugggacacggcucagcuuagaagugaggaaggccugggacgcuggaaacaaggggucacacgugcgugugccuggccuucgcagguggaugugugcgccgagcuggggaaggggccagggagccgcgagacugcggucccccgcgagagagaaguaugggccuggccaggguucgaacuccguuccuucgcugccuuccuuuuauuuuucuuccucaucuuccuuccucucucccuugguuccaucauuaaaucuuuaagggauuaauucacaacucuguaguagguaggggcccugggaccacuugacgggccuuugcaggcaguucuguacagaguccuaacccguaacgggccucaaccccggcugugugugcgugugcuugugucugugugucuuuguguguaaaagcaacgcauaaacauacccagggcuuucacuuauuuuauugaagcaaacaaacaaaaacagccacuggguuugucuuuuccccuacuccugccugagcgccgccggguuucugagcugcuccgggcgcggaccuagcucacccgcagccggaugucggagccggagcugcuccccac

SEQ ID NO: 20798 - RNA, 4021 nt, Homo sapiens
guggggagcagcuccggcuccgacauccggcugcgggugagcuagguccgcgcccggagcagcucagaaacccggcggcgcucaggcaggaguaggggaaaagacaaacccaguggcuguuuuuguuuguuugcuucaauaaaauaagugaaagcccuggguauguuuaugcguugcuuuuacacacaaagacacacagacacaagcacacgcacacacagccgggguugaggcccguuacggguuaggacucuguacagaacugccugcaaaggcccgucaaguggucccagggccccuaccuacuacagaguugugaauuaaucccuuaaagauuuaaugauggaaccaagggagagaggaaggaagaugaggaagaaaaauaaaaggaaggcagcgaaggaacggaguucgaacccuggccaggcccauacuucucucucgcgggggaccgcagucucgcggcucccuggccccuuccccagcucggcgcacacauccaccugcgaaggccaggcacacgcacgugugaccccuuguuuccagcgucccaggccuuccucacuucuaagcugagccgugucccaguuggggucggcuuugaaccgcguuaacgaccacaggucuuaguuucauugcauccgauucuccccugcagaaggaggacuuaagcuucuuaucuggguggggggugggggcccgcggaggaacucgaaccacuccacaccaagcauggcuggguugcugaagccgucaccugacaacaaccccguccagggaaggguaggcaaggaaagggggcaggcgagggacagccacagagggaagcccuggagagacucgaaugggcaccgcagagccccgccggcccaggcccugcugucugccaacccugcgguccugcuaaauaggaaggacccugucgccgcgagaggccgccgucugggcccggggcccgaggcccgaggccgcggccucuccuuccaccuuucgccgucgucucccucugcuucuaccugccuggugaauaucugaggaaggggcucccagccagauccugcugggaaguguaagcugaggcagccaagcguggucaaaggaccgagugccgcucagguacugcgggacugcgccgggagcaggccccacggguguagcaagggcagcuuccgggaagggcggagccgcuuccuccgcuggcggcuacccggaguacccgcgcacccuacaguccucacugccgcggaucccccacuugaggagcccgcccuccccgcgaccuggaccgccccaagcugucgcagacccgucuuaaacacaggcaaguuuaacccgggacaccgcaggagccgccacgugccugcccucgcggguacccugccccgaguccacccauccuccccacagcugaagacaggccugguuuccuccaacgagcagcacaauccuugcaaagcacaguuuccaaugguguaggugccuauuugggaaaagagguuggaaaagagcaggcugcagccgcuggaccuggcuaccgacuggccagcaacucccagacagcagcauuacuuuauguauguauguaugcauuuccaagucaaagacccaacacgacccugcugauucgcuuuuaaaccucagggaaagugacuggcuggcaucuggguacacuagaaccucaccuccuaaauuuguuagguaucuugcaaugcggccacugagauggagagaggcugggagcuggacgaacggccaucucuccuuccaucuuggccucggcucuaagaaccuaaaucccugacugggaugcgugcggaguucaauccaguaucgccuggcggugcuccccggaggcgccugcgggaaaauucagcuuucccucuccacgacaggaggcgcuguuuucguggaaaucccccggcugcgaaccugggaucccugaccuggaucaagucuccgaagcuggcagaguccauucugcaucaccggucuugggcuuugaagaagccuaggagaaauuccgcuucggccaucacgcuaugaaaaguggauuuuuuuuucuuaagucaauuuuuuuuuuuugaaaauaugagacuuaguagguuugggaagugggcuaaaagaacauuugauauuguaauugacccccccuuuaaggugacaguguuuuuccccuacuuaaagcgccaacuuuuuugugcacuauaaaagcuauuacuauccauaaauuguuacucucgguagaaaauaaccuagucuugcucgguguuauugaagagccaagaggguauuggagaaucaccuccagaaggaacaaggaagcucauuagcacugaaagucccccggaucaggcccaggaagcuaagcauccguauacuuuacaaauggaacuaaagucagcuacuaaugggaacuuugcacaaaagaauuaguuucugacacacaauucgcagauacauuuacacaaacugaugggacaacuugcagucacaggagcaggcugcauuagggaggguuccugcccuacugaguuccagguggauuuaauuucacucauuccuuuccuuaugaugugacguuucuacccccccacccuuuuuguaaaaaaaaaaaaaaaaaauguaauccaaugcuuuuaucuuuuuuuauuuccuuaacugcacaucuucacccucucugcuccccugcugacuuaagagauuuguuugguucagggauuuaaagugauucucuugccagauuucaaguaaaagagauuuaaaagaacaaagcacagggaaaaagguaucuguuuggaagacaaguuaaaacacauuucuuaaaaugagauuaauaacauuuuaaaaacuuugcaaaacaagaagauuuugcggauucuuaauuacuuuagauuuuauuuuauuguuacuuaaggaaaccuagugguucuacaggcaguacaacaaacacauggucacagacacucagaaacacacacagucacacaugcucagaaauauacaaacggucacacacucaaaacacacgcaccaucucccaaucuaucaccaacuaauugccuaucacccggucacuucaguuguucucucucccaggacaagugggcaaccaccacccagggccucaugagaguaaagagacuuugcguugggaagacucucccaccgacguccaggaccgauuaggaaccaagcgagccccugagaucucagcccggacccuccgggucacagacaggaccaagcgccgcugcgggcagucucgggcuucugccuggcaucucuuucgcagugcagaugcguucccgcgcccaggcccuugcucucccagcuaacgcgcguguuaugggagauguccccucccccugaccuuuuccuaucagaaaccagacggucgucuccagcucacucccugaagcggcugaaggggggcgggaggaggagcccggcagggggaggacggcccgacuuggguccgccugcccuaucacacagacaucugcucucaguuucuuccucuuuguggucgcuacagaugacaaggggagaggagcggaccgaggcggaacaaaaaaaaaaaguuaugucauaaagauauaaaccggugcugugacucaccugcucuuagccgcagguacgaguuucguggcagcgccuccgcucugcuagcccggggcccgggucggccuaacgucacuuggcucggcugacucagaugacccgguuucuagugacgaagcaaaaguggggcuuuuucccuuuucuagucugaagcucucaggaggaaagaaaaaaaaaagucuguauucuccagucucccgggguugaacuuugggucaggaaucaggagggaggaagcaaagagcaggaggggcgcgagacugggccgcagcccgcgcucggaagguggcguguaccucuggggagggaccccggggucaguuaucccacaaggucucuaagcccagucuccgacgccaccgcccccggccuucuccggcugcgagguuccgauccagag

SEQ ID NO: 20799 - RNA, 271 nt, Homo sapiens
ccuuucccgccccuuccccgcccccuccccuccgcggggccucccccgcccgcgcgguacagcugggucagugacgcgggcgcugcagccgucgcuaccgccgcguucuauucuccgaagccggcgaccgccccaccuccucccucccucccgcccgcuuccucugcccacagcgccggccagagcgagcuagacaagggcacgcggggccucgccuagacccgagaagacugcgggcgcgcgcaagcggcggcguggaagcugugagcgc

SEQ ID NO: 20800 - RNA, 271 nt, Homo sapiens
gcgcucacagcuuccacgccgccgcuugcgcgcgcccgcagucuucucgggucuaggcgaggccccgcgugcccuugucuagcucgcucuggccggcgcugugggcagaggaagcgggcgggagggagggaggagguggggcggucgccggcuucggagaauagaacgcggcgguagcgacggcugcagcgcccgcgucacugacccagcuguaccgcgcgggcgggggaggccccgcggaggggagggggcggggaaggggcgggaaagg

SEQ ID NO: 20801 - RNA, 1147 nt, Homo sapiens
cccuggcuccccucuguacccuccaaacuucccucucccaugcucaccccgugagccgcccucgcggcgggguugggggcgcagccccagaccgcugugggguccccaggcgugggagagccggcgcggcccggguccggggugcugguugcugcuggcccaggggagugcuucuccgggucugcgcagguggcuggacacgccgcgacugcugcgcgcgggacggccuccuggccuccgccucggugggccuccuggggcucccccagcccggcugggcccgcuccacgggcugcaagcccgcgacaggcgcguccugcucccggaacagacuguacaccuuggcugcagccgcugccggguagcugcccccagggcgccgcagucgauucgcgucuccaccagccggcucguaucucccuacggggucccuuugggcaugacccgcgcccacgaagagagccagggugagcggcaggaagccucuccagggguuccgcagggcgcgccccgggcugcgggcuuugguccgcggccucauggcgcggggcggcuggagaguggugcgcgcgggcaccgcgaagagcuuuguggucggcacgcuggacgcccgcgggcuguucucccggccccgcccggcggccagcuucucugagucuagggggcccugaagcggccgacugggggcccggcucucggcggaacgagggcugcgcgccccgagccucgaguccgcgcuccuacuccagcugggcucgcacggcugcugcaccuucgcgccuccucccugugccugcagccgucugaaggggacccggacgguuuuauuuuuggaaaccucccccggcuuuuucgucucuuuuauccacaccaggcccccuccucggagggacagcucagcccccucauuaccggagagggagcgaggaauuccagcaacacccacuuuggcaccgggaagccagcgggcggcgagcgggcggcgagggggauuaacccgugcggagcagggggcggcgcggggcugacccaggcgcuggucgggcagauggcgccugccacgaccgggacacugggccgccuuucuccugcucugggcaaguucgaacugcagaccugccccgaaucguucucccgccccucgccu

SEQ ID NO: 20802 - RNA, 1147 nt, Homo sapiens
aggcgaggggcgggagaacgauucggggcaggucugcaguucgaacuugcccagagcaggagaaaggcggcccagugucccggucguggcaggcgccaucugcccgaccagcgccugggucagccccgcgccgcccccugcuccgcacggguuaaucccccucgccgcccgcucgccgcccgcuggcuucccggugccaaaguggguguugcuggaauuccucgcucccucuccgguaaugagggggcugagcugucccuccgaggagggggccugguguggauaaaagagacgaaaaagccgggggagguuuccaaaaauaaaaccguccggguccccuucagacggcugcaggcacagggaggaggcgcgaaggugcagcagccgugcgagcccagcuggaguaggagcgcggacucgaggcucggggcgcgcagcccucguuccgccgagagccgggcccccagucggccgcuucagggcccccuagacucagagaagcuggccgccgggcggggccgggagaacagcccgcgggcguccagcgugccgaccacaaagcucuucgcggugcccgcgcgcaccacucuccagccgccccgcgccaugaggccgcggaccaaagcccgcagcccggggcgcgcccugcggaaccccuggagaggcuuccugccgcucacccuggcucucuucgugggcgcgggucaugcccaaagggaccccguagggagauacgagccggcugguggagacgcgaaucgacugcggcgcccugggggcagcuacccggcagcggcugcagccaagguguacagucuguuccgggagcaggacgcgccugucgcgggcuugcagcccguggagcgggcccagccgggcugggggagccccaggaggcccaccgaggcggaggccaggaggccgucccgcgcgcagcagucgcggcguguccagccaccugcgcagacccggagaagcacuccccugggccagcagcaaccagcaccccggacccgggccgcgccggcucucccacgccuggggaccccacagcggucuggggcugcgcccccaaccccgccgcgagggcggcucacggggugagcaugggagagggaaguuuggaggguacagaggggagccaggg

SEQ ID NO: 20803 - RNA, 3684 nt, Homo sapiens
ggacuucccuaucuucuuccccaauaauugggucgcauuuuuccuuacgaccugcuggcugccgguaggccugcccuuccgccuggcaggcccagaguggauucccugggccgcaguggccuggacgauggccgggucugauagcggcaggcggccgcgaugauuugcgggauucucggcauggcacggccagccugcccgagccacgggaggcgcagccagcccaccacucacggcaagcaggcggccgagcgcccuucgagaagguaggcgacgguacgcgcggaacaaaagcagucccccagauccuguggaccgggugcaagcucccggcuugcaacucaggccacuccaggggaaggggcaguacccgacccaggcgauacccccgagagccggagagggagaugggguugcgggagaccucggguuuccugaaggaaguccgccuuuaacucacaccuauuuuucgcgauuucucucaggcuaauuaaccaagggaccccgcaaaguugucugaagucgccgccguaaggcuaaguaagugggcugcccacuccccggcucaggggcaaaggggaaagcccacuugucaauuucuguucggguuucaaagagccauugcacggagguuuaguccuguccgagggcacuacuguggcggcgcgcagaagcggcccaguggagccaggcggcgacguuucuccuccuaggccucccagcguggaccucuguguccucacggccaccagcuuguggccugagaguugcuccuuccagugcugcgcaaacuagaggugguuguaaauggggauuaggacaugacggagaugggucucaauuuggggaagugaauagaguuuuccuuuuuuucuuuuuuaacaauaaaaacaaagagggagugugacccuccccuuagagaggucaggucuaggguaagaagugaggcaccuuccaucucccacugacuaggaugaagucuuuuuuauuguuguuccguucucagagacuuaagucaccaugcuccagggcagauacucccccaccaaucuuucccagguuuaaagcuacagggcaguugauggacgacaacuagaggcugcaacuuaucagugacugccugcguuuguguuggaggcugggugugcgcugcggugcgcgugugaguggaucuuuuaagaccuuugucugagccgggcagaggcacaagugccaccugacgcuuggggcagauuccucguccuguucuugcaaagaugccaaaucaggagagugucaagauuucaaccgcagaccuaaaaaaagugucuccauguuuuuaaaaguaucagacaaccaccuccacacaccccuccgucuccccuuccaccuggaacauuguucuuuuuaauaaccagguuuagcaaacugcuauacugcgccugugcuuuccugcagcccuccgcuguaccagcugagcccuguacagaaucugagcgucagaguugcagacccaaccuugccaccuugcaaaucaucccuucucuggaggccucaggauuuuaguugaucaaaccaacaccaacauucauugggucccuuugcaacccuaacauuuaaugagacuugguaauugucauccguucgccaaggagguuggggaugaacuugggggcauuuucuuguuuauuuuucauugagacaaaggagugugcuguccccaccuccgcccccagacaaggacaggguuccuacaucagcugggucuaaaauaaggaaaagcgagugcugccgcagaggggacuuuccgggaagggggucacaggaaccccaaggccacacagcuccagacacucugccggagcucuaggggagcucaccccugcgcggcgggaccucccccaucggguugccccuucaaucugcagccgcgcggaggcaggccccgggaaaggcagucggcgcucggugcucgcacugcgccucggcgggcggaaacucacaaguguccucaacgugcuaaacaaaccaucagggccccgcaucgccuggcgcaauuggaauaacaaaugcgacgcacgcaaauuguccaccucguguugcuaagcgauuguuugucggccccgcacgcacagcucagcaugggaggaccgcgagcguccagaggcagccggcgagcgcuuaggucggaaaugcaguaaacaugccgcugauuuucccuauuaucacccaaacacgauuucacacaaagcaaucaccacgcagaagucuaugaaaauguguuuguugaggagucacucgccccaguaauaguccucauuuuuaagauauuaaagaauagcucagcggauuccacaugcauaaggucuauuugccguucggcaucugucacggcgcuuuugcacugcggucaucacuaaauugauucauagaguguagauuaaauugcuucucugauuuaaaacaguguccaacuuuggaguaugcgugugaguaucuucucccgccccaagguauuuuugucagggagaaaacugucgccccacuauccuuacaccccauuccgcauaacuguaaaaaaauaaugcaucuucgaccccaacuucuuacgguucguuucaggaacuuucuuaauucucuccgucuccugcccggccacagagcagaguucacaaucggaugcguuuaagucggauuuuucgugucaugugcaaaaagccgguguguccuuuucaagguacggagcccucaucggagggcgcauuagcggggucagaggaauuaggagcaaugcgcagagcccccugcagcccgcgugcugcgccgagaccucagccguccucacugagcggaaugguuguguuguuuguauugggacuuuuaaaaaauccagucucaaagcuaagugcucaaaccccguuccauggcucugcugcuuucuggaggacaucuccgguagccccaggggauuguccgugugagguuggguggguggaguagagccagaggcgcaaaugccuccuggcuaaggggcagcgcgcauuagagcugggucuccugcuuucggagcggagggcguaagggagcuuucuagcugauuuuuugcuagaaguuuuccaacgcuccaaauaaaagcacccgauccccuaaggacgaaauaaucaagguguuagggaagcucaacagaagagaagagacgagaagagaagagaagagaagaaggggcuaucgaaaaaugacguguucccaaggccuuagaaaaauaaauaaauaaauaaauaaauaaauaaauagcuuggacuuuccgggguugcagaaauccgauuucagccgggcuauuuaccaaaauuuguuucaaaaugacugcaccuuugcuuuugcaagucacagaaugcaaaugacgauaauuuguucucagaagaaguuucucuugaaaugauuagcaaagucagucauuugaaaauuagaacgaagcccuucgcuaacugauaucugcuucuaaaguuuucauucauguaaaccucauuaaugaagaucuuuuauuuaaacgucaaggggauuugaaauuuagaguaaauuaugaagcuuguaugucuagccaagucaugggucaaaugcauuugugaaaaacugcuaaagagcauaugguuuugaauuuuucuacaaugacuaguguuuaaauaaauugcuuguacugcuuaacuu

SEQ ID NO: 20804 - RNA, 3684 nt, Homo sapiens
aaguuaagcaguacaagcaauuuauuuaaacacuagucauuguagaaaaauucaaaaccauaugcucuuuagcaguuuuucacaaaugcauuugacccaugacuuggcuagacauacaagcuucauaauuuacucuaaauuucaaauccccuugacguuuaaauaaaagaucuucauuaaugagguuuacaugaaugaaaacuuuagaagcagauaucaguuagcgaagggcuucguucuaauuuucaaaugacugacuuugcuaaucauuucaagagaaacuucuucugagaacaaauuaucgucauuugcauucugugacuugcaaaagcaaaggugcagucauuuugaaacaaauuuugguaaauagcccggcugaaaucggauuucugcaaccccggaaaguccaagcuauuuauuuauuuauuuauuuauuuauuuauuuuucuaaggccuugggaacacgucauuuuucgauagccccuucuucucuucucuucucuucucgucucuucucuucuguugagcuucccuaacaccuugauuauuucguccuuaggggaucgggugcuuuuauuuggagcguuggaaaacuucuagcaaaaaaucagcuagaaagcucccuuacgcccuccgcuccgaaagcaggagacccagcucuaaugcgcgcugccccuuagccaggaggcauuugcgccucuggcucuacuccacccacccaaccucacacggacaauccccuggggcuaccggagauguccuccagaaagcagcagagccauggaacgggguuugagcacuuagcuuugagacuggauuuuuuaaaagucccaauacaaacaacacaaccauuccgcucagugaggacggcugaggucucggcgcagcacgcgggcugcagggggcucugcgcauugcuccuaauuccucugaccccgcuaaugcgcccuccgaugagggcuccguaccuugaaaaggacacaccggcuuuuugcacaugacacgaaaaauccgacuuaaacgcauccgauugugaacucugcucuguggccgggcaggagacggagagaauuaagaaaguuccugaaacgaaccguaagaaguuggggucgaagaugcauuauuuuuuuacaguuaugcggaaugggguguaaggauaguggggcgacaguuuucucccugacaaaaauaccuuggggcgggagaagauacucacacgcauacuccaaaguuggacacuguuuuaaaucagagaagcaauuuaaucuacacucuaugaaucaauuuagugaugaccgcagugcaaaagcgccgugacagaugccgaacggcaaauagaccuuaugcauguggaauccgcugagcuauucuuuaauaucuuaaaaaugaggacuauuacuggggcgagugacuccucaacaaacacauuuucauagacuucugcguggugauugcuuugugugaaaucguguuugggugauaauagggaaaaucagcggcauguuuacugcauuuccgaccuaagcgcucgccggcugccucuggacgcucgcgguccucccaugcugagcugugcgugcggggccgacaaacaaucgcuuagcaacacgagguggacaauuugcgugcgucgcauuuguuauuccaauugcgccaggcgaugcggggcccugaugguuuguuuagcacguugaggacacuugugaguuuccgcccgccgaggcgcagugcgagcaccgagcgccgacugccuuucccggggccugccuccgcgcggcugcagauugaaggggcaacccgaugggggaggucccgccgcgcaggggugagcuccccuagagcuccggcagagugucuggagcuguguggccuugggguuccugugacccccuucccggaaaguccccucugcggcagcacucgcuuuuccuuauuuuagacccagcugauguaggaacccuguccuugucugggggcggagguggggacagcacacuccuuugucucaaugaaaaauaaacaagaaaaugcccccaaguucauccccaaccuccuuggcgaacggaugacaauuaccaagucucauuaaauguuaggguugcaaagggacccaaugaauguugguguugguuugaucaacuaaaauccugaggccuccagagaagggaugauuugcaagguggcaagguugggucugcaacucugacgcucagauucuguacagggcucagcugguacagcggagggcugcaggaaagcacaggcgcaguauagcaguuugcuaaaccugguuauuaaaaagaacaauguuccagguggaaggggagacggagggguguguggaggugguugucugauacuuuuaaaaacauggagacacuuuuuuuaggucugcgguugaaaucuugacacucuccugauuuggcaucuuugcaagaacaggacgaggaaucugccccaagcgucagguggcacuugugccucugcccggcucagacaaaggucuuaaaagauccacucacacgcgcaccgcagcgcacacccagccuccaacacaaacgcaggcagucacugauaaguugcagccucuaguugucguccaucaacugcccuguagcuuuaaaccugggaaagauuggugggggaguaucugcccuggagcauggugacuuaagucucugagaacggaacaacaauaaaaaagacuucauccuagucagugggagauggaaggugccucacuucuuacccuagaccugaccucucuaaggggagggucacacucccucuuuguuuuuauuguuaaaaaagaaaaaaaggaaaacucuauucacuuccccaaauugagacccaucuccgucauguccuaauccccauuuacaaccaccucuaguuugcgcagcacuggaaggagcaacucucaggccacaagcugguggccgugaggacacagagguccacgcugggaggccuaggaggagaaacgucgccgccuggcuccacugggccgcuucugcgcgccgccacaguagugcccucggacaggacuaaaccuccgugcaauggcucuuugaaacccgaacagaaauugacaagugggcuuuccccuuugccccugagccggggagugggcagcccacuuacuuagccuuacggcggcgacuucagacaacuuugcggggucccuugguuaauuagccugagagaaaucgcgaaaaauaggugugaguuaaaggcggacuuccuucaggaaacccgaggucucccgcaaccccaucucccucuccggcucucggggguaucgccugggucggguacugccccuuccccuggaguggccugaguugcaagccgggagcuugcacccgguccacaggaucugggggacugcuuuuguuccgcgcguaccgucgccuaccuucucgaagggcgcucggccgccugcuugccgugaguggugggcuggcugcgccucccguggcucgggcaggcuggccgugccaugccgagaaucccgcaaaucaucgcggccgccugccgcuaucagacccggccaucguccaggccacugcggcccagggaauccacucugggccugccaggcggaagggcaggccuaccggcagccagcaggucguaaggaaaaaugcgacccaauuauuggggaagaagauagggaagucc

SEQ ID NO: 20805 - RNA, 856 nt, Homo sapiens
gcagccggauccgggcugcguggacgcgggcgcugcugcugccgcugcugcuggcggggccugugggcugccugagccgccaggagcucuuucccuucggccccggacagggggaccuggagcuggaggacggggaugacuucgucucuccugcccuggagcugaguggggcgcuccgcuucuacgacagauccgacaucgacgcagucuacgugagugagccccgggagggcgggcgaggggcugcagggcgcggcgggccgggggcgcccguggagccggacggacuugggcguagcaggcggggacccggacccgcuggccgccggggcaccgggcacggcgcagggucucccgccucugcaggguccgcgaaggucuucccgacccggucccugcuauccgaagagcgggucgcggggucuggguggcuccgcgcgccccgggccgugaccccggcacccauggaccccgcggagcuuccuccccggcggcugugggcugcaucgccgcagggaggucaguccgcgucccucggcuguccagucccuucggggcuaggaccuggccggucccggguggagccagguucucgcgcggagccuccgcagggcaagagccggagcuggaucgcagucugcgcgcgggccccgggacucuuguggcugcgggagaguuucgccggcagccuccuguauuuguguguggacuccggaugugucuuggcagugaugcugcuuuccaguugggcucguuucagaguccagaguccagagcgggaaacacagggcucccagugaucccauuuccuguggccaggcauugucaccacggaggccccaaacgaggagcggga

SEQ ID NO: 20806 - RNA, 856 nt, Homo sapiens
ucccgcuccucguuuggggccuccguggugacaaugccuggccacaggaaaugggaucacugggagcccuguguuucccgcucuggacucuggacucugaaacgagcccaacuggaaagcagcaucacugccaagacacauccggaguccacacacaaauacaggaggcugccggcgaaacucucccgcagccacaagagucccggggcccgcgcgcagacugcgauccagcuccggcucuugcccugcggaggcuccgcgcgagaaccuggcuccacccgggaccggccagguccuagccccgaagggacuggacagccgagggacgcggacugaccucccugcggcgaugcagcccacagccgccggggaggaagcuccgcgggguccaugggugccggggucacggcccggggcgcgcggagccacccagaccccgcgacccgcucuucggauagcagggaccgggucgggaagaccuucgcggacccugcagaggcgggagacccugcgccgugcccggugccccggcggccagcggguccggguccccgccugcuacgcccaaguccguccggcuccacgggcgcccccggcccgccgcgcccugcagccccucgcccgcccucccggggcucacucacguagacugcgucgaugucggaucugucguagaagcggagcgccccacucagcuccagggcaggagagacgaagucauccccguccuccagcuccaggucccccuguccggggccgaagggaaagagcuccuggcggcucaggcagcccacaggccccgccagcagcagcggcagcagcagcgcccgcguccacgcagcccggauccggcugc

SEQ ID NO: 20807 - RNA, 591 nt, Homo sapiens
cagggaggaucauguccugguuuaugcucuaacagaauuacucugauuuccaccuggaagucaagggcagagcaggaaaaauggugagaaugcuguggccguaauccagguaaggaaugcugguggucugcacagugauacaguggcuuacuucagacagagacgcagaaauagaaagaacacaggauaagagaaagacagauagggagagucagagacccagaaauggaaagagaaaaaacaagacccuaugaaacacagaagaaaacagagggaaccagagacucagagguugacuucagacaguggaggagagagacacagaugcagagaugccaaagcacagacauuccuguccuuugaccauaaacacuuucccuuccuccacucacgcaaggcggcuggacaagaagcggagcugggccauuuccaggccuccagcagguauacucaggccauaaaaucuguguuccaggcuuaucaccagggcgccccaggcuggggccaaggcugcgggauggccugugaagaguguaugggugggggguggggaggugagaugcaaguugaguuuaagcccuuucacuccuc

SEQ ID NO: 20808 - RNA, 591 nt, Homo sapiens
gaggagugaaagggcuuaaacucaacuugcaucucaccuccccaccccccacccauacacucuucacaggccaucccgcagccuuggccccagccuggggcgcccuggugauaagccuggaacacagauuuuauggccugaguauaccugcuggaggccuggaaauggcccagcuccgcuucuuguccagccgccuugcgugaguggaggaagggaaaguguuuauggucaaaggacaggaaugucugugcuuuggcaucucugcaucugugucucucuccuccacugucugaagucaaccucugagucucugguucccucuguuuucuucuguguuucauagggucuuguuuuuucucuuuccauuucugggucucugacucucccuaucugucuuucucuuauccuguguucuuucuauuucugcgucucugucugaaguaagccacuguaucacugugcagaccaccagcauuccuuaccuggauuacggccacagcauucucaccauuuuuccugcucugcccuugacuuccagguggaaaucagaguaauucuguuagagcauaaaccaggacaugauccucccug

SEQ ID NO: 20809 - RNA, 845 nt, Homo sapiens
uucaagugcgcgccccuccccaccgcagcccgucuggugugcgaggauuguguuugaaagggaggaagcauccuugaaguggugggugauggauugucuaaacccuucugggacguucuggguggggguuuucgaggcagcucaucaauaaagaccccccuggagagaaggggcggcuggagaccagcccccgccgcgcagccccgaggccccaggccuggaacacaguccucgguguggggcacagggcgugaggggaggaugagcucccccugagcagauggagauuucuccuugccugggccguuugacccccaaagccuugcagacuggccgcgugggugccauggggcgauuucuugggaaaggagggcagcagaaaggcccgugggcucucagcgccuuggagucaggggagcaggaaggggaguggaggugcggacacgccuccagccaccgugcuccccuaggaggaucucccuucagccccuguagaacccugcaucucaaccacccucgugcaugugguuuaccuuggcauagauuuccaagccgcuacagaaaaccuguccaccucccccaagguggaggcgggaguugggaggcaggggugcuggaaagggucaccuggcucaagccgaccccaggucugacgggcggagagccucgagggccacgccccaggccagugguguccucugaggccgcaaagccgacuggcuucuggaggagcagcagccucggccucagccucggcugggaaaagacgcagucggggcccuccgugcuccaaacuugaacuacucuggguccccacgaggaggaggcugcccuggggucagaaa

SEQ ID NO: 20810 - RNA, 845 nt, Homo sapiens
uuucugaccccagggcagccuccuccucguggggacccagaguaguucaaguuuggagcacggagggccccgacugcgucuuuucccagccgaggcugaggccgaggcugcugcuccuccagaagccagucggcuuugcggccucagaggacaccacuggccuggggcguggcccucgaggcucuccgcccgucagaccuggggucggcuugagccaggugacccuuuccagcaccccugccucccaacucccgccuccaccuugggggagguggacagguuuucuguagcggcuuggaaaucuaugccaagguaaaccacaugcacgagggugguugagaugcaggguucuacaggggcugaagggagauccuccuaggggagcacgguggcuggaggcguguccgcaccuccacuccccuuccugcuccccugacuccaaggcgcugagagcccacgggccuuucugcugcccuccuuucccaagaaaucgccccauggcacccacgcggccagucugcaaggcuuugggggucaaacggcccaggcaaggagaaaucuccaucugcucagggggagcucauccuccccucacgcccugugccccacaccgaggacuguguuccaggccuggggccucggggcugcgcggcgggggcuggucuccagccgccccuucucuccaggggggucuuuauugaugagcugccucgaaaacccccacccagaacgucccagaaggguuuagacaauccaucacccaccacuucaaggaugcuuccucccuuucaaacacaauccucgcacaccagacgggcugcgguggggaggggcgcgcacuugaa

SEQ ID NO: 20811 - RNA, 1914 nt, Homo sapiens
ggugggccccgcggccccuccaacccugcccagcgugugugcgcggccuagccaucuuucuccccagccugggaaggcgggcgggaggaggggauccgaggccgggggccgcggagcaaaaggcacgcggaccccuaaacgacccccgagcguugccacagccgggagggcggagggaaggugugcagagcucgggggucucccaggacgcagcuuggcuccuaccgguuuccaaggcaucugcaagcucuguccugcgaccuaaagcauggggacgucccuuccagcagcaucagugggcgaaaaguuaacaugcugagggccaccggcacccacacuugcuuccaggaauacuugcgguacaggcuuccugacuuauuuucuuuagccgcugggugcccccccuucuucccccguugggagacgcagaccgacucuguuccaaccuaagccccuucucucugccuuuuggacaaagcgggccgccucugcucuccacucacuccccgcaaccccgcaacucgccaccccuaaacgcagcgggcuguaggcgaagucgaagaggugcuccgccugguaccgcggccugcgcacugggaucggggccugcaggccgcugggcuggcuccugggaucaucccaagguuuuggucucgcaaccgaggggacccgcgcccggcaauuugggaagugcggaaauggggugaggccggucuucgcuugagggucucguagauuggaccccuuuuucccccuucaagcacccucagaccuggccagugggucaucgagucgugcccaccgcccaggccaggagaucuggggcuacugggagaucucucaugaagguggcuauaaaaagagcccugaccgggacacaagccuuuggagagcggaagacucuauccaaauaaacacugggaacuggguggcugguguucaggcccggaggucuggggguuucuggaccuaggaaggagagcagacuccaggagaggugugaaauucccacucccggccaccuugcucucuccaacccccgccuccgcgcguccuccuauugcuguucccguccgcaucuucugcuguuaugugaaguuucuaaagaggccucugcagcgugcaggcuggugcucuuccagcauuuccucaaucacgcugacacccccaggccccagcacugaguucucgccguccacauuuagaaaggccucgcaggaguucgagaauccucuacacgacuuaacuuugcgccuaaauacagagcgaaaacaggggucagucucauuuugaauugggaagaggcuucccuccucccgggcccaggcggaaggcagggaggggugcgucuuagauggccgcaaacagugcggugcggaugcgucucuccugucggugacugguuuagucuaagccauuucaugugaaacccacgaagcagaggaagcaugcuaagaacacagaauuuaaaccgcaauaaugaggagauuuccuagaauaaaacgccgauuacagaacaaaaucggagaaacccaagcuuguugaaguuuacauucccuugcgcuggggcaggggugggaccuaaaggguuggaggggaaaggaacccgcagcccagacgggacagucaaccaaagcgggauggagagaggacccaucgcggcggaggcugcauaguuuugguuaaccaaggacugccugggcugaucuagacucauuuauaugaaccauaccuucccuucccguaagaaaaaaaaugucaagauucauguuauuuauagggagugaaagugagugaagagcucacccccauaagaaggaaccccaguaggggggugggggagccauccuaagcaaggcucuguuucagagacaaacacagcuuuccuuuuaaacccugucugcuaaccagaaa

SEQ ID NO: 20812 - RNA, 1914 nt, Homo sapiens
uuucugguuagcagacaggguuuaaaaggaaagcuguguuugucucugaaacagagccuugcuuaggauggcucccccaccccccuacugggguuccuucuuaugggggugagcucuucacucacuuucacucccuauaaauaacaugaaucuugacauuuuuuuucuuacgggaagggaagguaugguucauauaaaugagucuagaucagcccaggcaguccuugguuaaccaaaacuaugcagccuccgccgcgauggguccucucuccaucccgcuuugguugacugucccgucugggcugcggguuccuuuccccuccaacccuuuaggucccaccccugccccagcgcaagggaauguaaacuucaacaagcuuggguuucuccgauuuuguucuguaaucggcguuuuauucuaggaaaucuccucauuauugcgguuuaaauucuguguucuuagcaugcuuccucugcuucguggguuucacaugaaauggcuuagacuaaaccagucaccgacaggagagacgcauccgcaccgcacuguuugcggccaucuaagacgcaccccucccugccuuccgccugggcccgggaggagggaagccucuucccaauucaaaaugagacugaccccuguuuucgcucuguauuuaggcgcaaaguuaagucguguagaggauucucgaacuccugcgaggccuuucuaaauguggacggcgagaacucagugcuggggccugggggugucagcgugauugaggaaaugcuggaagagcaccagccugcacgcugcagaggccucuuuagaaacuucacauaacagcagaagaugcggacgggaacagcaauaggaggacgcgcggaggcggggguuggagagagcaagguggccgggagugggaauuucacaccucuccuggagucugcucuccuuccuagguccagaaacccccagaccuccgggccugaacaccagccacccaguucccaguguuuauuuggauagagucuuccgcucuccaaaggcuugugucccggucagggcucuuuuuauagccaccuucaugagagaucucccaguagccccagaucuccuggccugggcggugggcacgacucgaugacccacuggccaggucugagggugcuugaagggggaaaaagggguccaaucuacgagacccucaagcgaagaccggccucaccccauuuccgcacuucccaaauugccgggcgcggguccccucgguugcgagaccaaaaccuugggaugaucccaggagccagcccagcggccugcaggccccgaucccagugcgcaggccgcgguaccaggcggagcaccucuucgacuucgccuacagcccgcugcguuuagggguggcgaguugcgggguugcggggagugaguggagagcagaggcggcccgcuuuguccaaaaggcagagagaaggggcuuagguuggaacagagucggucugcgucucccaacgggggaagaagggggggcacccagcggcuaaagaaaauaagucaggaagccuguaccgcaaguauuccuggaagcaagugugggugccgguggcccucagcauguuaacuuuucgcccacugaugcugcuggaagggacguccccaugcuuuaggucgcaggacagagcuugcagaugccuuggaaaccgguaggagccaagcugcguccugggagacccccgagcucugcacaccuucccuccgcccucccggcuguggcaacgcucgggggucguuuagggguccgcgugccuuuugcuccgcggcccccggccucggauccccuccucccgcccgccuucccaggcuggggagaaagauggcuaggccgcgcacacacgcugggcaggguuggaggggccgcggggcccacc

SEQ ID NO: 20813 - RNA, 2353 nt, Homo sapiens
aaaacugggagcuacuaguauagaagguuaucacugguccugccuggauuuuaagguuagcgccuuuuauucuucagucuccggguccuaaaaccuuuuaaggccugcucuuaacaaguuggaucuguauucccugagauccaaauacauauaauuuucaggcacagagaaucagagagaguccauggcuaagugacaaugaguacugaauguuuccaaagcccguugcccaccgcccccaccuacaaaugagauaauuguccuuuucccccacaagcuucuccccugggcucuuuccauuuaaagcacacacacacacacacacacacacacacacacacugaacucuaugucaguagagcuccuuuaagauccuaucuguccuccccacuccagcuucuauuuuaugaaaauaauuauauuuuaggcacuuagagcauugguuuagugaacacauuauauuuacuuucauauuuaguuauguauuuuuaaguuauuccacacaaaaugacaaaugagggcaagagaaaaaaauaccaugaaauauauggggacgcaccccccaaaaacgcucagcagucagucagaaauucuuagaaaguggaaacaacugcgaagcccuaccccaacccaaucaaaacaucccacccggaaaagagcgacuuguuucuuuuuucuauuggaaaugagugguaaacugaguucgguuuggcgguguuuucuuagcugacucucggcuacaaucaagccauuuucggacacauucccauguagguaccaggggugcucuggaggaagcugucgacgccuguucagcuaauuuagguuuucuuugucuaauuacuguggagcuuagggagaaggagccggcucagggcaguaaacugacacucggucucugugugugguauccaggcaggguuugauggaaaaagccugcuuccacucaaccucaggucacugucuggggccagccccggcccaccccccucccacauaccccuccccuccccacccgcccucucugcaucuacagccccaccagcacacucagccaggagcagucccccggcacuccaggggcacacagggcuccugccgccccagggggccugccuaggcugugcggcugugaaggcucuuugccuggugucuuccuccugauuacugcacaaccucccuuucuccugccuccugcaacuccccaggcuccccagcaggcacacccgugcaccucgguccuuucagccuagacgcagcggggugcccagcucuaccuccuguuugguccgcuggucugcagcaccuucuuucugggccucccccuucagcccuugggaggccccgccagcuccggccuccugcucuccuccucccucucccagcuccuaucccuggucggacuacauuucccugcacguguaauccaauaacuaacugucgggucucauuggaagugauugcucccgagggcacaucucucucagagccugacucuuacuuagggaggaauuagccacaacuggggagaaguguucucggacaggaguuagcugagaccuggcacaguuuugggugggcaauguuaagacggaggauguaaaccuagugacagcugcacaccccuucaggacugacuauaaauauagccaucucgcuuaucucagggucuuucuuuuucuuucucuuucuuucuuuucuuccuuccuuccuuuuucuuuugcacuuuuuucuuacagaacacuaacuggggugcggggguggggggaagaaguggaagcaaaugcaacccuaagucccaugagauccagguuuccagagucuuugaaacuuggccuagguuucucaguguaaaucccucugcucaaaguuccgaaaacguccacgaucgccagcggcccgcaacccugcggcggcccccagucgcccuaacaauugucggggagccugcaggcccugccagaaagagagaggauuggcacguuaccuuugggcgucuggcaccccggcguguggcugagggcggcaaagucuaaacgaaguugacagauggagucaguaucggcccuggggagggcggccagggaggcuccgagcagccgcacccgcagcagcaccacucggcccggcgggccaggaggaggaagggggcgcggaggggcggggcuggguccugggaugggacgcggggcuugcugcggggggcaaacagaaagaauauuucaugaagucagagguggucgaguuuugcgaggggugggggucgucccccuggcagaaccggagugagucugugaucccucaauuggaaagagggugagugagggaaaggggaggaggccgcgagaggaau

SEQ ID NO: 20814 - RNA, 2353 nt, Homo sapiens
auuccucucgcggccuccuccccuuucccucacucacccucuuuccaauugagggaucacagacucacuccgguucugccagggggacgacccccaccccucgcaaaacucgaccaccucugacuucaugaaauauucuuucuguuugccccccgcagcaagccccgcgucccaucccaggacccagccccgccccuccgcgcccccuuccuccuccuggcccgccgggccgaguggugcugcugcgggugcggcugcucggagccucccuggccgcccuccccagggccgauacugacuccaucugucaacuucguuuagacuuugccgcccucagccacacgccggggugccagacgcccaaagguaacgugccaauccucucucuuucuggcagggccugcaggcuccccgacaauuguuagggcgacugggggccgccgcaggguugcgggccgcuggcgaucguggacguuuucggaacuuugagcagagggauuuacacugagaaaccuaggccaaguuucaaagacucuggaaaccuggaucucaugggacuuaggguugcauuugcuuccacuucuuccccccacccccgcaccccaguuaguguucuguaagaaaaaagugcaaaagaaaaaggaaggaaggaagaaaagaaagaaagagaaagaaaaagaaagacccugagauaagcgagauggcuauauuuauagucaguccugaaggggugugcagcugucacuagguuuacauccuccgucuuaacauugcccacccaaaacugugccaggucucagcuaacuccuguccgagaacacuucuccccaguuguggcuaauuccucccuaaguaagagucaggcucugagagagaugugcccucgggagcaaucacuuccaaugagacccgacaguuaguuauuggauuacacgugcagggaaauguaguccgaccagggauaggagcugggagagggaggaggagagcaggaggccggagcuggcggggccucccaagggcugaagggggaggcccagaaagaaggugcugcagaccagcggaccaaacaggagguagagcugggcaccccgcugcgucuaggcugaaaggaccgaggugcacgggugugccugcuggggagccuggggaguugcaggaggcaggagaaagggagguugugcaguaaucaggaggaagacaccaggcaaagagccuucacagccgcacagccuaggcaggcccccuggggcggcaggagcccugugugccccuggagugccgggggacugcuccuggcugagugugcugguggggcuguagaugcagagagggcggguggggaggggagggguaugugggaggggggugggccggggcuggccccagacagugaccugagguugaguggaagcaggcuuuuuccaucaaacccugccuggauaccacacacagagaccgagugucaguuuacugcccugagccggcuccuucucccuaagcuccacaguaauuagacaaagaaaaccuaaauuagcugaacaggcgucgacagcuuccuccagagcaccccugguaccuacaugggaauguguccgaaaauggcuugauuguagccgagagucagcuaagaaaacaccgccaaaccgaacucaguuuaccacucauuuccaauagaaaaaagaaacaagucgcucuuuuccgggugggauguuuugauuggguugggguagggcuucgcaguuguuuccacuuucuaagaauuucugacugacugcugagcguuuuuggggggugcguccccauauauuucaugguauuuuuuucucuugcccucauuugucauuuuguguggaauaacuuaaaaauacauaacuaaauaugaaaguaaauauaauguguucacuaaaccaaugcucuaagugccuaaaauauaauuauuuucauaaaauagaagcuggaguggggaggacagauaggaucuuaaaggagcucuacugacauagaguucagugugugugugugugugugugugugugugugugugcuuuaaauggaaagagcccaggggagaagcuugugggggaaaaggacaauuaucucauuuguaggugggggcggugggcaacgggcuuuggaaacauucaguacucauugucacuuagccauggacucucucugauucucugugccugaaaauuauauguauuuggaucucagggaauacagauccaacuuguuaagagcaggccuuaaaagguuuuaggacccggagacugaagaauaaaaggcgcuaaccuuaaaauccaggcaggaccagugauaaccuucuauacuaguagcucccaguuuu

SEQ ID NO: 20815 - RNA, 1644 nt, Homo sapiens
ccccgcuccggcgccuccgcuucccgcccggggcccgcccucgcggcccggccucgcucccgggucccagaugaccaccgagggcgggccgccgccggccccgcuccgccgcgcgugcagcccgguccccggcgcgcuccaggccgcccugaugagcccgccgcccgccgccgccgccgccgccgccgccgccccggagaccaccuccuccuccucgucgucguccuccgccuccugcgccucguccucguccuccuccaauucggccagcgcccccucggcugccugcaagagcgcgggcggcggcggcgcgggcgccgggagcgggggcgccaagaaggcgagcucggggcugcggcggcccgagaagccgcccuacucguacaucgcgcucaucgucauggccauccagagcucgcccagcaagcgccugacgcucagcgagaucuaccaguuccugcaggcgcgcuuccccuucuuccgcggcgccuaccagggcuggaagaacucggugcgccacaaucucucgcucaacgagugcuucaucaagcugccuaagggccucgggcggcccggcaagggccacuacuggaccaucgacccggccagcgaguucauguucgaggagggcucguuccgccgccggccgcgcggcuucaggcggaagugccaggcgcucaagcccauguaccaccgcguggugagcggcuugggcuucggggcgucgcugcugccccagggcuucgacuuccaggcgcccccgucggcgccgcucggcugccacagccagggcggcuacggcggccucgacaugaugcccgcgggcuacgacgccggcgcgggcgcccccagccacgcgcacccucaccaccaccaccaccaccacgucccgcacaugucgcccaacccggguuccaccuacauggccagcugcccggugcccgcgggacccgggggcgucggugcggccgggggcggcggcggcggcgacuacgggccggacagcagcagcagcccgguacccucguccccggccauggcgagcgccaucgaaugccacucgcccuacacgagcccugcggcgcacuggagcucgccuggcgccucgccuuaccucaagcagccgccugcccugacgcccagcagcaaccccgccgccucggcaggccugcacuccagcauguccuccuacucgcuggagcagagcuacuugcaccagaacgcucgcgaggaccucucagguaacgcagcacgcuccagcccagccagcugggcgcaccgcuucuaggccuccagggcuggcggccacugccacucccacaaacagggaccccgaagcuaggaggucugagggcacugggaaaagcagaugcuggggaaagccggcaucuuauucgugggagcagggaucagggucuuacuguccucccaguaucccuggccagcagccgaagcuucagaauugucuggcugcugugagcgugguguaaaguccccugccuuccugggcucuuuggggaucccugugcaggagacugcaggucucccguucagagucucacuuagcuuggagagaaggcaucuggccuuuggggaacuuggucaggaagcugugucuaguuccuuuugucccuuuuuuuccuu

SEQ ID NO: 20816 - RNA, 1644 nt, Homo sapiens
aaggaaaaaaagggacaaaaggaacuagacacagcuuccugaccaaguuccccaaaggccagaugccuucucuccaagcuaagugagacucugaacgggagaccugcagucuccugcacagggauccccaaagagcccaggaaggcaggggacuuuacaccacgcucacagcagccagacaauucugaagcuucggcugcuggccagggauacugggaggacaguaagacccugaucccugcucccacgaauaagaugccggcuuuccccagcaucugcuuuucccagugcccucagaccuccuagcuucggggucccuguuugugggaguggcaguggccgccagcccuggaggccuagaagcggugcgcccagcuggcugggcuggagcgugcugcguuaccugagagguccucgcgagcguucuggugcaaguagcucugcuccagcgaguaggaggacaugcuggagugcaggccugccgaggcggcgggguugcugcugggcgucagggcaggcggcugcuugagguaaggcgaggcgccaggcgagcuccagugcgccgcagggcucguguagggcgaguggcauucgauggcgcucgccauggccggggacgaggguaccgggcugcugcugcuguccggcccguagucgccgccgccgccgcccccggccgcaccgacgcccccgggucccgcgggcaccgggcagcuggccauguagguggaacccggguugggcgacaugugcgggacgugguggugguggugguggugagggugcgcguggcugggggcgcccgcgccggcgucguagcccgcgggcaucaugucgaggccgccguagccgcccuggcuguggcagccgagcggcgccgacgggggcgccuggaagucgaagcccuggggcagcagcgacgccccgaagcccaagccgcucaccacgcggugguacaugggcuugagcgccuggcacuuccgccugaagccgcgcggccggcggcggaacgagcccuccucgaacaugaacucgcuggccgggucgaugguccaguaguggcccuugccgggccgcccgaggcccuuaggcagcuugaugaagcacucguugagcgagagauuguggcgcaccgaguucuuccagcccugguaggcgccgcggaagaaggggaagcgcgccugcaggaacugguagaucucgcugagcgucaggcgcuugcugggcgagcucuggauggccaugacgaugagcgcgauguacgaguagggcggcuucucgggccgccgcagccccgagcucgccuucuuggcgcccccgcucccggcgcccgcgccgccgccgcccgcgcucuugcaggcagccgagggggcgcuggccgaauuggaggaggacgaggacgaggcgcaggaggcggaggacgacgacgaggaggaggagguggucuccggggcggcggcggcggcggcggcggcggcgggcggcgggcucaucagggcggccuggagcgcgccggggaccgggcugcacgcgcggcggagcggggccggcggcggcccgcccucgguggucaucugggacccgggagcgaggccgggccgcgagggcgggccccgggcgggaagcggaggcgccggagcgggg

SEQ ID NO: 20817 - RNA, 3655 nt, Homo sapiens
gauuugggacagcucccagccgugaauuaauaaagaccgagguucuguugcaggaaagggcagacauuagggaacaaauacguucaauuucaauuccacagucaacaaauagucauuuuuggaccgagguuaauguguucaaaacgcgucccucaggcacgaccaccgucuuuuuuuucccuccaaaccucucaaaguaagguuauuuccuaccgggaaaacagagucccaaaucuuguccgauuaaaauuucuaucucaaaaacaacucucucuccugcucucuaaaaauucaaagguuuauugcaaaaugccacauucacuuauuuccaacauuuaaggaauuugcugccauuagaaauauuauuuacagcagcucuuuucacuaaugucaaagauucaaaacaaccagauuuaaagcauugucauuuuuuggaacuaaaggaaaacaccaauauccugcacucacacacucuaaaaucuuuauaauguuucugcauuauaaaaucucaaaaucaugucaguugcauaaaaccccacugcaaagaauccauuuuaaggucuagagaacuccaaaccuuguuuccuucacauuucuuauggaaaaaacauauuaugcauucuccuuucuugccccaaaccaauuaccuaaagcacccccucccccaauacugcaaggauuugucugcaaagaaugccacagccugaacugauaggagguaacaauuccguuucaggaguuucuuuuuucccccguguuguccauucuauuaauaaccugcuucacuuucacuuuuaggccacguuaauuaauguucugacccagugucggagaaggggguuuucuagugcccucuucuauaucuuuucuucauucuggaugguaaaaaugugaacuuuaaaaagaccccugacagcguaacuacaacucaacauuccuuaacauaaaauggggacuaaauaauuccuuccauaaccaaucccaaacaaacaaaaauaacaaacacccgacaugacauauuccaaacacuucuuaacccuuuccuauauauaaaaugcagacaccaauguguaaaguagcaggcaaaugcaucuagaaaaguauaucuacguaaauuuggcugaauucauccucuucaaugguaagcauguuaaaauauguggucugaaguucccuaucacucucgauuugcccaccagccgggucugcggugcccgugcaaacgcugcagcuaggauauaggggggaggaggggcgggagaaugacaaaguucuaaaugcagcagucugagcccuggaauaucuuugcuuucagcacauaaacuuuccaguccuggcugccuagccauuuuauuccugcauucacauuucgacucuucaaaaucauaucuugcaguaucgcaggggccaguacauugccccagagcgcaccaaaccugguauaaacccagaaagggaaacaaaaauggaugugugcucaggaaaaagggggaaaaaaaccguguccagaaaauguccggccgcacacauuuccuggcgaacauuuggaaucuauagcuuuaggaaaaaccgaucugggacgcgcuaguccccaggaacugaugcccccacccucgggggauugccggcuucuccgcacccuggggcggccgcggacccgcuagucccccuccgcgccucgggccggggcaggcugccucccgccuccagccuccagccgggcugagcggccacuuaccuauuugcaccgcgaggaucagugaaauauaucugccguucaacuuaagucccauccuacguuuagucaaaccauuugcgaccgcagaccuuuaaauaguuaguuuagagaacgcgggggaaagccaaaaaauaggcauugccaacaaguuccgggagcgacagagacuuuaugcacugggaaggcagagggaggagagaaagagagggagcgaggaagagacagaaagagagagagagagagaaagagagagagagagagaggcugaggggggggggagagcugggaaugguucacuccauuagaagggggcggaggaaguacagccucacgcccacgagcaggccugacgugggggaugacacggaaugauuuuuuuuuuaauauagacaccuugguagagaaucgccauuuauagucaucagaagcuggaauuaaucagauaucuccaauuaaugugcgaucugaacgaaauuuugccucccgggggugagcacuuuccuauucuagcggucaccccugccucuuccucguuccgggggccccccagccccgccgccucccugcgcagaacaggggcucccccucccuuccccgccaggagcuggggaguccuggcgcgcccacucgauuguuucaaccugcucccccuccuccaucagcaccacagagaauccagcccgcucucuacgaugcagggggguuuaaaggagcgggagagggaaaaacagcuaagcuagcucgauuaauucgaaagcgcuccucggccgcccgcccccugcgcuugccuacccucuuuuucuccaacccagcagcugagcucugggcgcagccuggagcgcgugagcacgcagcccggccccccgcacgagcacacacacacacacacacacacacacacacaaacgcgcgcgcgcacgcccgccagccgcgccgagcgcccccaugcccgcccgcacacaaggcacgcgagcgcgcgcacacgcccaggccccggggguuugguuugcacacguggggccccagaaauaaacaccgaauguccucugaauuuuacccaccugcgaugccccagcgggccaaaggccgcuucaagggacacagcgacaccuguuuuagggggcgaguagggcaccggggaaggagccucugauaagacaguuuucggauacuagugauuuaccaaccaacucucagcgcuuuaggaaauuuccaaggcaagcgcuggugugcggacuucuuucuaaucuugaugcgccucuugggcuuauuuguugggcuacacacacacguacccacacgcacacacguacaucacguacgcacacgcacacccggacccacacacaccugcacugucuuuugaugcucaggcacagacccuguguagguguagccuacccugcaacaaaauacuucugcagcuggcuuugugcuaggugcaagcugcuaucgacgacagcuugagucaaaaccgaaaaacuaacagggcuauuuccuuucuaaacgccuuuaagcucugguuuucuuccuuucuucugcaccaaacagaaaaaaaaaaagucuaaauuguagcgucuuuaauaaaaugcuaaagaaggcauuggccagcuuuaauccuuaagccuguggagagaaaaaaaugaaaacgaccccccaaauuuugccaaacuacacuagaggacgucaagcugucaaacuguagaaaugcacacggauuaaggagaagcguugaauuugcuucuacaggcagcuugcccucuagggccaaucuugccguccccauacucagauauuuggagaugcauagacaaagggggagaaaggugcaaaauaacggggguaggacaggcuguggaggguagggggccgaggggaagcugcggggguccuacugcagcacuuggugacgugagg

SEQ ID NO: 20818 - RNA, 3655 nt, Homo sapiens
ccucacgucaccaagugcugcaguaggacccccgcagcuuccccucggcccccuacccuccacagccuguccuacccccguuauuuugcaccuuucucccccuuugucuaugcaucuccaaauaucugaguauggggacggcaagauuggcccuagagggcaagcugccuguagaagcaaauucaacgcuucuccuuaauccgugugcauuucuacaguuugacagcuugacguccucuaguguaguuuggcaaaauuuggggggucguuuucauuuuuuucucuccacaggcuuaaggauuaaagcuggccaaugccuucuuuagcauuuuauuaaagacgcuacaauuuagacuuuuuuuuuuucuguuuggugcagaagaaaggaagaaaaccagagcuuaaaggcguuuagaaaggaaauagcccuguuaguuuuucgguuuugacucaagcugucgucgauagcagcuugcaccuagcacaaagccagcugcagaaguauuuuguugcaggguaggcuacaccuacacagggucugugccugagcaucaaaagacagugcagguguguguggguccgggugugcgugugcguacgugauguacgugugugcguguggguacguguguguguagcccaacaaauaagcccaagaggcgcaucaagauuagaaagaaguccgcacaccagcgcuugccuuggaaauuuccuaaagcgcugagaguugguugguaaaucacuaguauccgaaaacugucuuaucagaggcuccuuccccggugcccuacucgcccccuaaaacaggugucgcugugucccuugaagcggccuuuggcccgcuggggcaucgcagguggguaaaauucagaggacauucgguguuuauuucuggggccccacgugugcaaaccaaacccccggggccugggcgugugcgcgcgcucgcgugccuugugugcgggcgggcaugggggcgcucggcgcggcuggcgggcgugcgcgcgcgcguuugugugugugugugugugugugugugugugugcucgugcggggggccgggcugcgugcucacgcgcuccaggcugcgcccagagcucagcugcuggguuggagaaaaagaggguaggcaagcgcagggggcgggcggccgaggagcgcuuucgaauuaaucgagcuagcuuagcuguuuuucccucucccgcuccuuuaaaccccccugcaucguagagagcgggcuggauucucuguggugcugauggaggagggggagcagguugaaacaaucgagugggcgcgccaggacuccccagcuccuggcggggaagggagggggagccccuguucugcgcagggaggcggcggggcuggggggcccccggaacgaggaagaggcaggggugaccgcuagaauaggaaagugcucacccccgggaggcaaaauuucguucagaucgcacauuaauuggagauaucugauuaauuccagcuucugaugacuauaaauggcgauucucuaccaaggugucuauauuaaaaaaaaaaucauuccgugucaucccccacgucaggccugcucgugggcgugaggcuguacuuccuccgcccccuucuaauggagugaaccauucccagcucuccccccccccucagccucucucucucucucucuuucucucucucucucucuuucugucucuuccucgcucccucucuuucucuccucccucugccuucccagugcauaaagucucugucgcucccggaacuuguuggcaaugccuauuuuuuggcuuucccccgcguucucuaaacuaacuauuuaaaggucugcggucgcaaaugguuugacuaaacguaggaugggacuuaaguugaacggcagauauauuucacugauccucgcggugcaaauagguaaguggccgcucagcccggcuggaggcuggaggcgggaggcagccugccccggcccgaggcgcggagggggacuagcggguccgcggccgccccagggugcggagaagccggcaaucccccgagggugggggcaucaguuccuggggacuagcgcgucccagaucgguuuuuccuaaagcuauagauuccaaauguucgccaggaaaugugugcggccggacauuuucuggacacgguuuuuuucccccuuuuuccugagcacacauccauuuuuguuucccuuucuggguuuauaccagguuuggugcgcucuggggcaauguacuggccccugcgauacugcaagauaugauuuugaagagucgaaaugugaaugcaggaauaaaauggcuaggcagccaggacuggaaaguuuaugugcugaaagcaaagauauuccagggcucagacugcugcauuuagaacuuugucauucucccgccccuccuccccccuauauccuagcugcagcguuugcacgggcaccgcagacccggcuggugggcaaaucgagagugauagggaacuucagaccacauauuuuaacaugcuuaccauugaagaggaugaauucagccaaauuuacguagauauacuuuucuagaugcauuugccugcuacuuuacacauuggugucugcauuuuauauauaggaaaggguuaagaaguguuuggaauaugucaugucggguguuuguuauuuuuguuuguuugggauugguuauggaaggaauuauuuaguccccauuuuauguuaaggaauguugaguuguaguuacgcugucaggggucuuuuuaaaguucacauuuuuaccauccagaaugaagaaaagauauagaagagggcacuagaaaacccccuucuccgacacugggucagaacauuaauuaacguggccuaaaagugaaagugaagcagguuauuaauagaauggacaacacgggggaaaaaagaaacuccugaaacggaauuguuaccuccuaucaguucaggcuguggcauucuuugcagacaaauccuugcaguauugggggagggggugcuuuagguaauugguuuggggcaagaaaggagaaugcauaauauguuuuuuccauaagaaaugugaaggaaacaagguuuggaguucucuagaccuuaaaauggauucuuugcagugggguuuuaugcaacugacaugauuuugagauuuuauaaugcagaaacauuauaaagauuuuagagugugugagugcaggauauugguguuuuccuuuaguuccaaaaaaugacaaugcuuuaaaucugguuguuuugaaucuuugacauuagugaaaagagcugcuguaaauaauauuucuaauggcagcaaauuccuuaaauguuggaaauaagugaauguggcauuuugcaauaaaccuuugaauuuuuagagagcaggagagagaguuguuuuugagauagaaauuuuaaucggacaagauuugggacucuguuuucccgguaggaaauaaccuuacuuugagagguuuggagggaaaaaaaagacgguggucgugccugagggacgcguuuugaacacauuaaccucgguccaaaaaugacuauuuguugacuguggaauugaaauugaacguauuuguucccuaaugucugcccuuuccugcaacagaaccucggucuuuauuaauucacggcugggagcugucccaaauc

SEQ ID NO: 20819 - RNA, 786 nt, Homo sapiens
cuguagcucagagggagaagcuacuuagaacuucgugaagcacagaggaucuggagcgagccccgcagcugggaucaguggucuuaaguugaacccgcuuacaggaagaugcagcccagcucacagcgaagugugggggggccgucucuaaagccgagaagggaaccgcuuuagaaguggggguggggggaagaaagaaugaaugaaugaaugaaugaaugaauagaaagaagaaggaauauuaaagaucggagaggaaguucaagagagaaaagaguuuucucuuuccuuucuguuccuggugacuugggcccucaaucucgaugaagauaacacgaggagugcacaggcaagugcccaguugccagcaauugcuucaaaagcccauguucuucuuuucccccauucuuaggcacagccaaaauuggucagaaaggggaguaaagugggacacgagcuucaaaguagggaaaccaaagaagggagcauccacguccucucucugcagcuucucccccgcguucuucgggcgaauccgagggacgggcgcugcgcuggggaaaguuugucccacccgcguuucgcagcugguugcaaggagaggaggaggagagggagggucaagcucggagccugugaccgcacggaugaucgagccggcgucgcgcuuaccucgcaguccucguacuugauauuauccgucaauuuccaaagcauuuucauggaucggcgugaacggauaugccccucucggucucgcacccaaguggagcuacucucugggug

SEQ ID NO: 20820 - RNA, 786 nt, Homo sapiens
cacccagagaguagcuccacuugggugcgagaccgagaggggcauauccguucacgccgauccaugaaaaugcuuuggaaauugacggauaauaucaaguacgaggacugcgagguaagcgcgacgccggcucgaucauccgugcggucacaggcuccgagcuugacccucccucuccuccuccucuccuugcaaccagcugcgaaacgcgggugggacaaacuuuccccagcgcagcgcccgucccucggauucgcccgaagaacgcgggggagaagcugcagagagaggacguggaugcucccuucuuugguuucccuacuuugaagcucgugucccacuuuacuccccuuucugaccaauuuuggcugugccuaagaaugggggaaaagaagaacaugggcuuuugaagcaauugcuggcaacugggcacuugccugugcacuccucguguuaucuucaucgagauugagggcccaagucaccaggaacagaaaggaaagagaaaacucuuuucucucuugaacuuccucuccgaucuuuaauauuccuucuucuuucuauucauucauucauucauucauucauucuuucuuccccccacccccacuucuaaagcgguucccuucucggcuuuagagacggcccccccacacuucgcugugagcugggcugcaucuuccuguaagcggguucaacuuaagaccacugaucccagcugcggggcucgcuccagauccucugugcuucacgaaguucuaaguagcuucucccucugagcuacag

SEQ ID NO: 20821 - RNA, 8491 nt, Homo sapiens
cuuuuccccaccuagaccccagaacucuugccuguaaaagaagcaccaugcccccuguuccauccccucccgagcagcacccagugggaggugcagcuggaggaggcaguacccagcccccucucccuuccaguccuggcaaggugguggaggggggagguggcaggugaagacaggacugguagccacaguagaguccugugucaggaaggacagaugcaagugugagucccugcuggaaugugggcaggccaaugugaucuggccuggccucccugccaccaggagacauucuggaggagaugcugugguccaccucaccuggcuaaggggccagggcccagaccccuuccccaaucccaggccuagcuccccaggcugcccaagcuggaaagaauuccccacccccuacacaggcuauagaacccuccaagagcucugugccuauuaaacguauuaaaucugcagagcgucuggcaccuggugggcacaccgcgagcaugaaggccucuucucuuauuaggaggacgggacuguggcuuggccguccuucugaugaaaaggaacagaaaguggggggagcgggagcagaagaggagacaagagcgagagugaacgagcaacaaaagaaagaagagggguggggggaggacuaaaaaaaaacaaaagaaagaggagggggaaauggguggaagaagggaagagaggaaaaaaaaaagcaaauaaagaaagaaaaggggaaaagaaagaaaagccgagucguuuccgcgggcgccucgccgcguucuggcccgcacgagccggccgcucucuggggucucaggcucugcacgucggggaggcuccucgaaaagccgggucugcagcuuccaggggcugugaccagcgcuucaugggcucugugggagcccgggguggaaaccaggucucgagcugcggccuggcaccagcccagauggggcaagggagggccugcggagucgguccgcaccgacccugacucuccucggaaggccgaagcuguaugcucguggggaucaguccugggccaagggagcauucucgaaggguccacacucgccggggggagagcgccugugcgggucgcaaacaccauccccgcccggccuugcaguccgcgcccagcagcgcggccgugcccacagagccccggcacccagacggcuacuuccuggcucuggguguggccucaggcgccgcugguucgcguaacuggacucggaugcaaggucucugcgggagccgccggggcuggcgagcggugggugugaaauggaggcgggacccguccagggccuggagggcugggagcggcgggcuggcggcuccgcgaguccaggagcaucgccucagguuccuggaccacuaagaaccgggucaucuccgggucacaggagcgaguuauuuauuuccuaucuaaggaucugucuuuuauuuuuauuuauuauuuugguuaagagacggggucuggaucuguugcccaggcuugugcaguggggcaaucauuguucacugcagccucgaacuguugggcucaaggaaucccccuaccucaaccugccuagaagcugggacuacaggcgcuugccaccacgcugggcuguuggauguauuuaaacuaacacuuccauagaaaauuaaacauuaaaaaaaucaacaacaaaacuuacaaaacaaaaauaaaguagcgaauuccaaaggaacaaauuuguaaauugcuccaagagggggagcuuggaaagagagggggaugugucuaaaggcgcugucacccgaaacacaauuugaccccgagcuucuagggcuuugaaaugacucaaaacgaaugcccacauuugaguucgaaauuuucaugaaagaaagggucacagagacuggcuucuccaaagagaaagcgaguugguggucuccaggagauaaugaccuguaagcguggggaggggguaauuuuauaauuccaaaauuuucuguuuugaagcuagaaaagauguugccagucucggcucggggcaaaagcagggcgaacgccgcagcccacccggacagggcguuccgggcgcgguccaggcggccucugucgggcacagcacaccugcggccaaggccggugccccagucccagcagcaccaccaacgccaccaacagccugcugggccaaggacaaucagaaccaaagguuuaaaaaaaaaaaagaagaagaagaaaaaagaaaagaggaaacgagcuccauucccggcgcucgcgacgcguccccagggacggaccgugugcuggguggcugggcgcgcaaggcugcgcggggagcagaaggccgcgagguggggcggcccggggccgccugggccccuaggggcuggacgucaaccuguuagauagagggcgugggaccccccgcaggcggcugcucggacgaccgcauccggaggugagcugaccguucuggaagaagccuccgcuccaccgcggccccaacuucguuuugccaauuaagaugcagacccgcugcaagugggagcggaaacaaacugcccacggcugaggcggauggaggagagcccagcgcccuccaagcgaugcacgaucccccugccgcuggcugcuggccgcugagccugcucgagugcuccuuccagacuuagcuuccuccucuguacaacgaacggcuccuggacccguucgcacgcggagccauuucacaaucccgucugggaggcgcuggaguaggagaaggguguggguggaggggaggugguucuggaaccuacaccugaaugcuuaggggauucgguugugggaaugaggugguccccucccugucccgcagccuccaaaggggcuguagggucugaggggcagaacauggguggggagggggccgguucugcgcuccgagggccccucauccagcgaccgggcggcgccgaggaaccccugccgcccggagccccucgccgcccggcugcuagggagggcggcuggcccggggcgcugaggucaccuuuuccacugcgcccgccgcgagcaggacgguuuccgggauuuucgcggcggcggcuagaggccucgggagggggugugucccaggcguugggcuggcagcugcgccccugggguggggacugcaaucccagacugcaccccacuggggaggaggcuuccccucucugggccucgguguccucgacagggaggggguuccccuucucugggacccucuuuuuucggccgccaacgcggcagugccugagcagaggaggccccgccgccgccgccguuuuuguguaauuuucgccuaaaagggguuuaucugcugguuugcccuggggucgggcgacggggaggcugugucuaucaagagccgggggaucagggacagaccuacaagggagguguuuugggcgaccgggggcaggacccuggcucucucagccccuggagccagcugcggucucccaaaguucccuaggcgcugggcauucuccuuccagcccucagggccucauucccaaagccacccucugcucaugcugcagggcuggccuggggcugcaggaaaugguccuggccagaguccaaggagcugggggugcacaccuguggaauggggugagggcugggcugcacuacucuuuugacuccccaaaaucuagagaugaggccuccauccugaaaaugacccccuuccccacaagcugaccaagaagcuaccccagggggauggcucauaguaaaauaaguuuagugacagcugaugaacagugugauccccaaauccuuggaucuggaaucuggggacccauuuugaggaugugagacccucaggucuugagcauggggcagagaugguucaaauuuggguagcuucuguuagggcccaaauaacaggggaugggacagaggcuagcugggccuacucaggggagaaaccaccacuaggcuaugcccuuagggagaugcagaagccagggggugaggaaggggcaggggcccugcuaagaugggggaggugagggaggaagccggaaaaaggagcuugauauggcucuguacaagaagcaauaguaaaccagcccuacucacuggagucccugcaccagggcugccucuugcugggccucaguuucccaucugaaaaaggagaugguuggauugagugauacuauugcacucaucuagggaggguucucugagucuacccguugauagggggagccugacugggcugccccagccucccaggagacacuggcuuguuucuauuugccagguaggaugucaguggcugcuuggccaacagcgacagggccagcuuccuggucucuuggucucucaggaggaggccugcucagugugggauacuguugcucuuagugcgccccucuccacccuuuccaaagaaccauguaggcucacagcaccacucuccgagggaguccgaagcaacuggcggccauugaggccaccuucuuucagucccaaugguaacucugaguucagaaagucaugcaacaacugggaaggagagacagugggcucuugggacugggaucuuaccagaguaagguagucuuuguccucacuccaggcccuacagacaaaggaucugggccacuuccuaguccccaccugccccccacccccacucccgagucuggggcaggugccagggacugagggccagccugaaggccuccccaccagcagcuggagcuggagaaaggacuucaacuuggguggggggcauggcuguaggugugguaagcccuaguuaccugagguaaagacugaggccccacauggagcucacagaggaaguccggguggcccaggacacccccagugcaucaggcgcugacuggcaaugguggauggggcuaggagguaggcccugugauuccugagaaggaggagggcagaugcuccucccccaaccuccuggggacacuucuccccucuugccuggaggaacuguuuucucuccaaacagaccuaagggcucccagggugcaggacccucggagugcaggacccccucacugaguucucacagucucucuggagccaaaggucagcaucuccucaggacagguaaggaaacaggcccagaaagggucagugguuucaccaguaguggcaggaccaaagagaggaguucagcguaggguagcuuugggguuguucacuccacggcuugggcuuauacucuucuaaggauggaaagaaagaucuagagaagguacugccaacuuccuccaccauguuggagcuuuugaggcuccgcaauggagccaggucccaccagaguuuggucuuuacacucucagagcacccacuggcccccuggccccaacuccgcccaguaacaguuucuugaugccccaaagcugggaaaaggcaaagcugcauccuucccuucuccucgaauccuuuuccuuuucuaacuagggggauguaaccagccuacagucuucugggggcugucaaggaggauguguccauggaucacuugaauuuccaauucaagcaaaucucggcuggagaacauuuuucucucagggcagcccggagagaaaugaggccguacaugguaaacugaggcagaggugggaggggugcacaggugccgcuaccgcucugccccuugcaucccugaacgcugccucacccuugccggguuggcgguguugagcccgggacuggaggcugcuugagaccaccuccuucccagcugaggagcgcggccuuugccccuccuccucccgaccuuuccggggcuaccuaaaagccgaucaagccgccgguuuucuagcuguucccauuucuuuaccgcccccuuccucugccccgccugccucugugcccuccgucacgucacagcccgcuggcucucacgccucuuuuggucucucugcgcacaucucgguggcgucucuggugcccucacaucacugucuggaaucuuguuuggcccacgccgucugccucugccccuucucucaccugugucguuugaucccuccgacucucgucucugggggucuugccucccgaacucuccggcucucuccuuccagggcgugcgcuccgcucagucucccucggucucggucggccggccucuuucacguggcccccuccuuuuuggccucccuuccgccucccucccuucugggucccucccuccggcucagccuagggguugggggcggcggcgcggggcggggcggggcggggcggugacgcggggcuggccgggcaagaggcgcggcggcguggggagggggcgcagucccggguucgaccggccgagccccgcgcgccccgcccgcgcccugcgccuccgcccggccggccggcgggggagggggcaugagccggcgcccgcgcgccgccccgagcugcgggccggccuagagccccgcgcgggccccgcgccggagccaagccgucgccgccgccgccgccaaaccgcgggcgcagcagugggcgccgcgaugcagcggccgggggagccgggcgccgcgcgcuucggcccgcccgagggcugcgcggaccaccggccgcaccgcuaucgcagcuucaugauugaggagauccucacggagccacccgggcccaagggcgccgcgcccgcagccgccgcugccgcggcgggcgagcugcugaaguucggcgugcaggcgcugcuggcggcgcggcccuuccacagccaccuggguacguguggcggccgcggggucgcgggccgggcuuggcgggagacagcgagcugaaccgcgggggcgccccgagccuccuccggcaucgaagcagccccgggaagcugcucugggagcgcagguucugggaccgucucucggagcccuccaggcgggaggcggagggugcaagcuccaggccucacagaaaccaggccucgugcccgcgggccgcccggggaggguguucgcucuuuccuucacugcuucccuucggccuccagcccggggaccccgagugagcauccccagugcaggcgcacugccaggcuacggacucucguggguggaagcgaccucaggccacgggcgccugggcuucgccgcagagggauggccgggaguggccgcggcugcccaacccagggaagucggaccucuggggaggaggccugcgcucccgagggcugggugcugacgcgggcccaagccggcccggaguccccgggagcuccagcgggcgaggaacgcggccuuggccgcagugcggaccugcuucggccuugccuuggggccagaggccugacugugagcagcugccuggcugucccuucugguuucaggucggcugggccucugcagggcuugaacggccugcgcagaccuuuucagcuucugcccuuucuucuaauuuggcggggccugcucugcccugauggugcugucuccaucgcacuccacccucgucuugucuuucccuaucucgcuuuccaaccgucugccggucggccucccucgcuucucucauuggggucggccugccucccaucucccaccuuuucccuacggguccucugccccacauuuaccugcgccuugcccugcccuuuccgacuccagccaggcuaggacucgcaccucagugacaggccugucggggaagggaggcuccuacgcuguagccgggaccccagcccuucaagucgccuucccugcacccccccaccuccuagucggugcucccuagccuggagacggcagggccagcgcgcuccuucuaaguccagcugggacucggccauucggcuaccuuucgucuccaucugcucuguugcuacuaauucguuugaagcgggcacacaaucauuuuaggacugaagaaaauggaaacaucugcauggggaagcgucugaaaauagaaaacgugaacaauaauuuccagguucucaggguacuuuggaauuuccgggaagcacccaacuccggcccagaugacuccuggccaccgcauggcuguugugccacgcacggaagagcaaaugugcacgcuccgugcauguucuuuuucuaacgcagcaaggcugauuugguuggagcaaacgccaucuucuuaggaccagcugccguuuucuuuuugguuucuacuuuccccgaaagacaagacacacuccgaguuucucgcagcugcaaacauguucaucaggaaccccgagaucucagaggcagcugaggccuggggaacuccaggacagaacacggacagggucgaggagauacucccucccaaaucuggggaacggcaacguugaggagggucuccaucugcgccaccggcgccgaccggcagggcguggagguuuugcgcugggaggcacuggccaagcgcgagcacccccgcggcacguggugcggcagucccuggggcagaggagcgcggccguagcucacccggguccucauucucuuucuucgcagccgugcugaaggccga

SEQ ID NO: 20822 - RNA, 8491 nt, Homo sapiens
ucggccuucagcacggcugcgaagaaagagaaugaggacccgggugagcuacggccgcgcuccucugccccagggacugccgcaccacgugccgcgggggugcucgcgcuuggccagugccucccagcgcaaaaccuccacgcccugccggucggcgccgguggcgcagauggagacccuccucaacguugccguuccccagauuugggagggaguaucuccucgacccuguccguguucuguccuggaguuccccaggccucagcugccucugagaucucgggguuccugaugaacauguuugcagcugcgagaaacucggagugugucuugucuuucggggaaaguagaaaccaaaaagaaaacggcagcugguccuaagaagauggcguuugcuccaaccaaaucagccuugcugcguuagaaaaagaacaugcacggagcgugcacauuugcucuuccgugcguggcacaacagccaugcgguggccaggagucaucugggccggaguugggugcuucccggaaauuccaaaguacccugagaaccuggaaauuauuguucacguuuucuauuuucagacgcuuccccaugcagauguuuccauuuucuucaguccuaaaaugauugugugcccgcuucaaacgaauuaguagcaacagagcagauggagacgaaagguagccgaauggccgagucccagcuggacuuagaaggagcgcgcuggcccugccgucuccaggcuagggagcaccgacuaggaggugggggggugcagggaaggcgacuugaagggcuggggucccggcuacagcguaggagccucccuuccccgacaggccugucacugaggugcgaguccuagccuggcuggagucggaaagggcagggcaaggcgcagguaaauguggggcagaggacccguagggaaaaggugggagaugggaggcaggccgaccccaaugagagaagcgagggaggccgaccggcagacgguuggaaagcgagauagggaaagacaagacgaggguggagugcgauggagacagcaccaucagggcagagcaggccccgccaaauuagaagaaagggcagaagcugaaaaggucugcgcaggccguucaagcccugcagaggcccagccgaccugaaaccagaagggacagccaggcagcugcucacagucaggccucuggccccaaggcaaggccgaagcagguccgcacugcggccaaggccgcguuccucgcccgcuggagcucccggggacuccgggccggcuugggcccgcgucagcacccagcccucgggagcgcaggccuccuccccagagguccgacuucccuggguugggcagccgcggccacucccggccaucccucugcggcgaagcccaggcgcccguggccugaggucgcuuccacccacgagaguccguagccuggcagugcgccugcacuggggaugcucacucgggguccccgggcuggaggccgaagggaagcagugaaggaaagagcgaacacccuccccgggcggcccgcgggcacgaggccugguuucugugaggccuggagcuugcacccuccgccucccgccuggagggcuccgagagacggucccagaaccugcgcucccagagcagcuucccggggcugcuucgaugccggaggaggcucggggcgcccccgcgguucagcucgcugucucccgccaagcccggcccgcgaccccgcggccgccacacguacccagguggcuguggaagggccgcgccgccagcagcgccugcacgccgaacuucagcagcucgcccgccgcggcagcggcggcugcgggcgcggcgcccuugggcccggguggcuccgugaggaucuccucaaucaugaagcugcgauagcggugcggccggugguccgcgcagcccucgggcgggccgaagcgcgcggcgcccggcucccccggccgcugcaucgcggcgcccacugcugcgcccgcgguuuggcggcggcggcggcgacggcuuggcuccggcgcggggcccgcgcggggcucuaggccggcccgcagcucggggcggcgcgcgggcgccggcucaugcccccucccccgccggccggccgggcggaggcgcagggcgcgggcggggcgcgcggggcucggccggucgaacccgggacugcgcccccuccccacgccgccgcgccucuugcccggccagccccgcgucaccgccccgccccgccccgccccgcgccgccgcccccaaccccuaggcugagccggagggagggacccagaagggagggaggcggaagggaggccaaaaaggagggggccacgugaaagaggccggccgaccgagaccgagggagacugagcggagcgcacgcccuggaaggagagagccggagaguucgggaggcaagacccccagagacgagagucggagggaucaaacgacacaggugagagaaggggcagaggcagacggcgugggccaaacaagauuccagacagugaugugagggcaccagagacgccaccgagaugugcgcagagagaccaaaagaggcgugagagccagcgggcugugacgugacggagggcacagaggcaggcggggcagaggaagggggcgguaaagaaaugggaacagcuagaaaaccggcggcuugaucggcuuuuagguagccccggaaaggucgggaggaggaggggcaaaggccgcgcuccucagcugggaaggagguggucucaagcagccuccagucccgggcucaacaccgccaacccggcaagggugaggcagcguucagggaugcaaggggcagagcgguagcggcaccugugcaccccucccaccucugccucaguuuaccauguacggccucauuucucuccgggcugcccugagagaaaaauguucuccagccgagauuugcuugaauuggaaauucaagugauccauggacacauccuccuugacagcccccagaagacuguaggcugguuacaucccccuaguuagaaaaggaaaaggauucgaggagaagggaaggaugcagcuuugccuuuucccagcuuuggggcaucaagaaacuguuacugggcggaguuggggccagggggccagugggugcucugagaguguaaagaccaaacucuggugggaccuggcuccauugcggagccucaaaagcuccaacaugguggaggaaguuggcaguaccuucucuagaucuuucuuuccauccuuagaagaguauaagcccaagccguggagugaacaaccccaaagcuacccuacgcugaacuccucucuuugguccugccacuacuggugaaaccacugacccuuucugggccuguuuccuuaccuguccugaggagaugcugaccuuuggcuccagagagacugugagaacucagugaggggguccugcacuccgaggguccugcacccugggagcccuuaggucuguuuggagagaaaacaguuccuccaggcaagaggggagaaguguccccaggagguugggggaggagcaucugcccuccuccuucucaggaaucacagggccuaccuccuagccccauccaccauugccagucagcgccugaugcacuggggguguccugggccacccggacuuccucugugagcuccauguggggccucagucuuuaccucagguaacuagggcuuaccacaccuacagccaugccccccacccaaguugaaguccuuucuccagcuccagcugcugguggggaggccuucaggcuggcccucagucccuggcaccugccccagacucgggaguggggguggggggcagguggggacuaggaaguggcccagauccuuugucuguagggccuggagugaggacaaagacuaccuuacucugguaagaucccagucccaagagcccacugucucuccuucccaguuguugcaugacuuucugaacucagaguuaccauugggacugaaagaagguggccucaauggccgccaguugcuucggacucccucggagaguggugcugugagccuacaugguucuuuggaaaggguggagaggggcgcacuaagagcaacaguaucccacacugagcaggccuccuccugagagaccaagagaccaggaagcuggcccugucgcuguuggccaagcagccacugacauccuaccuggcaaauagaaacaagccagugucuccugggaggcuggggcagcccagucaggcucccccuaucaacggguagacucagagaacccucccuagaugagugcaauaguaucacucaauccaaccaucuccuuuuucagaugggaaacugaggcccagcaagaggcagcccuggugcagggacuccagugaguagggcugguuuacuauugcuucuuguacagagccauaucaagcuccuuuuuccggcuuccucccucaccucccccaucuuagcagggccccugccccuuccucacccccuggcuucugcaucucccuaagggcauagccuaguggugguuucuccccugaguaggcccagcuagccucugucccauccccuguuauuugggcccuaacagaagcuacccaaauuugaaccaucucugccccaugcucaagaccugagggucucacauccucaaaauggguccccagauuccagauccaaggauuuggggaucacacuguucaucagcugucacuaaacuuauuuuacuaugagccaucccccugggguagcuucuuggucagcuuguggggaagggggucauuuucaggauggaggccucaucucuagauuuuggggagucaaaagaguagugcagcccagcccucaccccauuccacaggugugcacccccagcuccuuggacucuggccaggaccauuuccugcagccccaggccagcccugcagcaugagcagaggguggcuuugggaaugaggcccugagggcuggaaggagaaugcccagcgccuagggaacuuugggagaccgcagcuggcuccaggggcugagagagccaggguccugcccccggucgcccaaaacaccucccuuguaggucugucccugaucccccggcucuugauagacacagccuccccgucgcccgaccccagggcaaaccagcagauaaaccccuuuuaggcgaaaauuacacaaaaacggcggcggcggcggggccuccucugcucaggcacugccgcguuggcggccgaaaaaagagggucccagagaaggggaacccccucccugucgaggacaccgaggcccagagaggggaagccuccuccccaguggggugcagucugggauugcaguccccaccccaggggcgcagcugccagcccaacgccugggacacacccccucccgaggccucuagccgccgccgcgaaaaucccggaaaccguccugcucgcggcgggcgcaguggaaaaggugaccucagcgccccgggccagccgcccucccuagcagccgggcggcgaggggcuccgggcggcagggguuccucggcgccgcccggucgcuggaugaggggcccucggagcgcagaaccggcccccuccccacccauguucugccccucagacccuacagccccuuuggaggcugcgggacagggaggggaccaccucauucccacaaccgaauccccuaagcauucagguguagguuccagaaccaccuccccuccacccacacccuucuccuacuccagcgccucccagacgggauugugaaauggcuccgcgugcgaacggguccaggagccguucguuguacagaggaggaagcuaagucuggaaggagcacucgagcaggcucagcggccagcagccagcggcagggggaucgugcaucgcuuggagggcgcugggcucuccuccauccgccucagccgugggcaguuuguuuccgcucccacuugcagcgggucugcaucuuaauuggcaaaacgaaguuggggccgcgguggagcggaggcuucuuccagaacggucagcucaccuccggaugcggucguccgagcagccgccugcggggggucccacgcccucuaucuaacagguugacguccagccccuaggggcccaggcggccccgggccgccccaccucgcggccuucugcuccccgcgcagccuugcgcgcccagccacccagcacacgguccgucccuggggacgcgucgcgagcgccgggaauggagcucguuuccucuuuucuuuuuucuucuucuucuuuuuuuuuuuuaaaccuuugguucugauuguccuuggcccagcaggcuguugguggcguugguggugcugcugggacuggggcaccggccuuggccgcaggugugcugugcccgacagaggccgccuggaccgcgcccggaacgcccuguccgggugggcugcggcguucgcccugcuuuugccccgagccgagacuggcaacaucuuuucuagcuucaaaacagaaaauuuuggaauuauaaaauuacccccuccccacgcuuacaggucauuaucuccuggagaccaccaacucgcuuucucuuuggagaagccagucucugugacccuuucuuucaugaaaauuucgaacucaaaugugggcauucguuuugagucauuucaaagcccuagaagcucggggucaaauuguguuucgggugacagcgccuuuagacacaucccccucucuuuccaagcucccccucuuggagcaauuuacaaauuuguuccuuuggaauucgcuacuuuauuuuuguuuuguaaguuuuguuguugauuuuuuuaauguuuaauuuucuauggaaguguuaguuuaaauacauccaacagcccagcgugguggcaagcgccuguagucccagcuucuaggcagguugagguagggggauuccuugagcccaacaguucgaggcugcagugaacaaugauugccccacugcacaagccugggcaacagauccagaccccgucucuuaaccaaaauaauaaauaaaaauaaaagacagauccuuagauaggaaauaaauaacucgcuccugugacccggagaugacccgguucuuagugguccaggaaccugaggcgaugcuccuggacucgcggagccgccagcccgccgcucccagcccuccaggcccuggacgggucccgccuccauuucacacccaccgcucgccagccccggcggcucccgcagagaccuugcauccgaguccaguuacgcgaaccagcggcgccugaggccacacccagagccaggaaguagccgucugggugccggggcucugugggcacggccgcgcugcugggcgcggacugcaaggccgggcggggaugguguuugcgacccgcacaggcgcucuccccccggcgaguguggacccuucgagaaugcucccuuggcccaggacugauccccacgagcauacagcuucggccuuccgaggagagucagggucggugcggaccgacuccgcaggcccucccuugccccaucugggcuggugccaggccgcagcucgagaccugguuuccaccccgggcucccacagagcccaugaagcgcuggucacagccccuggaagcugcagacccggcuuuucgaggagccuccccgacgugcagagccugagaccccagagagcggccggcucgugcgggccagaacgcggcgaggcgcccgcggaaacgacucggcuuuucuuucuuuuccccuuuucuuucuuuauuugcuuuuuuuuuuccucucuucccuucuuccacccauuucccccuccucuuucuuuuguuuuuuuuuaguccuccccccaccccucuucuuucuuuuguugcucguucacucucgcucuugucuccucuucugcucccgcuccccccacuuucuguuccuuuucaucagaaggacggccaagccacagucccguccuccuaauaagagaagaggccuucaugcucgcggugugcccaccaggugccagacgcucugcagauuuaauacguuuaauaggcacagagcucuuggaggguucuauagccuguguaggggguggggaauucuuuccagcuugggcagccuggggagcuaggccugggauuggggaaggggucugggcccuggccccuuagccaggugagguggaccacagcaucuccuccagaaugucuccugguggcagggaggccaggccagaucacauuggccugcccacauuccagcagggacucacacuugcaucuguccuuccugacacaggacucuacuguggcuaccaguccugucuucaccugccaccuccccccuccaccaccuugccaggacuggaagggagagggggcuggguacugccuccuccagcugcaccucccacugggugcugcucgggaggggauggaacagggggcauggugcuucuuuuacaggcaagaguucuggggucuagguggggaaaag

SEQ ID NO: 20823 - RNA, 585 nt, Homo sapiens
ccccuccggaacccggccggcugcgcugggcagcggauucgcugccccacugcccgcgccggccacccgcgggcccaguucgcugcuggaaaaaagcuccagcucggacaaaaaaaggcagcgcggagggagacgcgcaggagccggggcgggggccagagccgggcugcuccgggcuucggccgcgcacgugggccggaucccuugaucggcguuccggcuggccuugcugggaguccggccgcgccuguuggcccgcucgcccucaccguccucugugucucccuucuacuugaugaccccucuccccccguuuacccuucccgcccgccccuucucuuuggucucuuucauucugucgccuacugucacgguguuaaccucccucucugucucucugagugcguucucucgcccgucaccccucuuccuuucucggucuccuccucucccuucguccgagccgcuccuuagcgcccaguugcgcaaaucaaauucuuucccguucuauuuacuccugaucaagaggggcugucaguccaacccuccagcuguaggcucgugcaucugccagucucuuggcgc

SEQ ID NO: 20824 - RNA, 585 nt, Homo sapiens
gcgccaagagacuggcagaugcacgagccuacagcuggaggguuggacugacagccccucuugaucaggaguaaauagaacgggaaagaauuugauuugcgcaacugggcgcuaaggagcggcucggacgaagggagaggaggagaccgagaaaggaagaggggugacgggcgagagaacgcacucagagagacagagagggagguuaacaccgugacaguaggcgacagaaugaaagagaccaaagagaaggggcgggcgggaaggguaaacggggggagaggggucaucaaguagaagggagacacagaggacggugagggcgagcgggccaacaggcgcggccggacucccagcaaggccagccggaacgccgaucaagggauccggcccacgugcgcggccgaagcccggagcagcccggcucuggcccccgccccggcuccugcgcgucucccuccgcgcugccuuuuuuuguccgagcuggagcuuuuuuccagcagcgaacugggcccgcggguggccggcgcgggcaguggggcagcgaauccgcugcccagcgcagccggccggguuccggagggg

SEQ ID NO: 20825 - RNA, 1060 nt, Homo sapiens
gcaucuggccugcgagucccgggcggcucgugcacaccucaggccucaaaugacuuguuucgccuagaaucaacucccgucucggccgccucgaaguccccagcccuggcgagaacagcccaggaugagugaauguuugccgaacaggaucgcaccgagcgggcgccuucgagccagcgccggggcgggggcagagcccggggcccguuccggcagcucccagcgguguccucgucgaggggccgccugccccuccuucuccagccucuucucccgggaacucagcccggcugagugacagcagccugcgcucuaaugggcccccggaugcugccuccuaauuagcuuggaccuucuccccuacggcugcuucucaggccucccucucugcaccgcagucaauuuuccgggauugggauagaaaugauggcuucuaaucagacgaaacguuucugcuggcucuaggcguuuggagaaugcagaaggaagaccccaaggaucccagccagaccccacagccucuuguaccucuccccuuguuuuacaccuuaggccuuggccaaaugggccaggccuggccuuggcaggcaugggguuggccuuggcagccuuugcccuccuucaggguagcuuugucccagccuggggccugcguccuggcuucccagggcuucaggcauaggccugguaagccaggugacugcugucucccaacccugggccagcagcccaggaagcccucagucuuccagcuucucucccacacagugguagcugagcugcagcuccaaugggccuucacugggcacaggcaaagacauuacucucccacuccuaagagugauucccuccucgaguccuugcacguaggugaaguuugucgaaggauuuugcucaacaauuguuagcuggccccgagaccucagcgucuugagcaaacaggccacagcuggggcggcaaggcgccgcccugaccugcuccucuggccauaggcggaccccagacugcccucugccccucaccugugaucagcuccaccagacacagcaacccaaggga

SEQ ID NO: 20826 - RNA, 1060 nt, Homo sapiens
ucccuuggguugcugugucugguggagcugaucacaggugaggggcagagggcagucugggguccgccuauggccagaggagcaggucagggcggcgccuugccgccccagcuguggccuguuugcucaagacgcugaggucucggggccagcuaacaauuguugagcaaaauccuucgacaaacuucaccuacgugcaaggacucgaggagggaaucacucuuaggagugggagaguaaugucuuugccugugcccagugaaggcccauuggagcugcagcucagcuaccacugugugggagagaagcuggaagacugagggcuuccugggcugcuggcccaggguugggagacagcagucaccuggcuuaccaggccuaugccugaagcccugggaagccaggacgcaggccccaggcugggacaaagcuacccugaaggagggcaaaggcugccaaggccaaccccaugccugccaaggccaggccuggcccauuuggccaaggccuaagguguaaaacaaggggagagguacaagaggcuguggggucuggcugggauccuuggggucuuccuucugcauucuccaaacgccuagagccagcagaaacguuucgucugauuagaagccaucauuucuaucccaaucccggaaaauugacugcggugcagagagggaggccugagaagcagccguaggggagaagguccaagcuaauuaggaggcagcauccgggggcccauuagagcgcaggcugcugucacucagccgggcugaguucccgggagaagaggcuggagaaggaggggcaggcggccccucgacgaggacaccgcugggagcugccggaacgggccccgggcucugcccccgccccggcgcuggcucgaaggcgcccgcucggugcgauccuguucggcaaacauucacucauccugggcuguucucgccagggcuggggacuucgaggcggccgagacgggaguugauucuaggcgaaacaagucauuugaggccugaggugugcacgagccgcccgggacucgcaggccagaugc

SEQ ID NO: 20827 - RNA, 5183 nt, Homo sapiens
uguacacacacauguauucacugcacuauggaagugcugaguuuaggcauauaugugcuacuuggcaugaacgcgggcuggcaggggauaggagguguguucuaacccugccacaugucaggccaaggugggaagcacagugcgucucuggguagagacuuagaaaugaauggucugucugugggccucuagaggagguuaagacucacagccuucucacuugccuucucacuucccagagggaccaaagugacucuuugggccaucccccaauggggacuauucugugagcagcacucacugcuuagucugaggggcguguuuccucacuguuagugcauuuaaugcaguuauugagcaccugcugugugccccucugggcccaaaccucuggcagggcuccaggcaggcacaauagucccuuuauuuggugaucuugaugccugcuguguagaaggaaaagcccucagaccauuucaggugaagccccauauccucaggggaccugagacccaaagaggagcuggggcuaguggggccugcuggcagagucuguucugcugggccugggcagcacugagugaucaaggagugaggaggcaauugauugugaggaggcuguggccugaucuugggcguuggcuggggaagggaccuggacaugcucucaauucuuccccagcuacacucacuggccauugucccagucaagauaggggcuucuugcacgcucacagacacgucacacauacaggacagaaaacagcacucuuucaggaguaagcagaggcuuuguguucccccagcugugcuaugugaccuguguuucccucaagguuaaggcuugaucugcacugugccucaguucccauguccaacaccggacucugccugcugcuucagcauccagcucacuugcugaugggacacgaagagaggagggaagggggcuuaguggagcuggaaccaugugcccuguuccccaccccuccgugaccacacaaagccagcaaugauucucugauuuucaagaauuuuggaguuuagggucuuggcugggcugagcagaagagcuugggcuguugugggguugaaguagucaccaugaggacccuuccugaagccuggcucacuaaaaacacccugugcccaagaaugguuuaguaauguaauuugggaagggugguuggaaggcucucagugggggggcauccuucuacccacccacgggggcaccgugcccuaauccuugcucccagaaucaagguauuuuaggaaaaaggaaggaaugugccauggccugccaccagggcuauccaugacucucugggacauuccagcccuaagccucuuaguccguggagaaguucaaacuugaaaacccuguuuugggagugcagguuuggaccaccuaccucuuucugccugaucuaacacccccuccccaauaaaagcucccguuucuuugaauacagcaauuacuggguaaguggggaggagggugcucagguaggggcuggaaagaccucacuggcuccuuuaggcuuccugggaccccagucugaggcuuccugccaaauggggauccccagccugucccggggagagccaggauguauuugagcaggacugccgccagugaggcacagaugggaguauggaacucaggacucugugccgugggccgcucagucagcggcugguaggacccauggcucuacccggcccaucucucaccuaaguccauggacgcugucugguuccugagaauggcugagcuguggggaagaagacuaggaaggagguagcagcuggucgcacaacuggggagcagaggggcaacuuauggaugcaccauagccuccuccucccagcggcugcuuucaugggagaagagcacccugagccugucuggaggccucugcauccuagaguccagacagccuggucuccaagccccagcccaccucuuuuccuuucccuggaagagaugcgggaggccgaaagcagccccgggaaagggcacggggacagcaagucuccugugcugccccugcugccuguagcuuuugcccugacuaccguagaccugaacccuagaccugaauccucccccaguggacagcaaccugggauuuccucccucuggcccugguggcuuucagaggucacagggaugucaagagaauuuguguuuuucagaauuuaguuuuucagaaaaguggacuaaauauuuguagauucggggaauuccuaaaucggaaaagcuugggacccggauuccagccugggguucccauuacugcgaucccggcuuuggggcccugccuuugccgcgggagaauaggcuccaauuuacgaagcuggucaauuucagaaauccgagacccgguucuugagaagcgacugcgugcuccgggacccugcgucaacaaccaaaccugggagaagccgcgggaaugucuuuauuggacguuacgaagggaauugggguuucucuccugggaagaaaaagcccgaccugugccggcgagagcaggcugccuugggcugggggcaccuccgagcgcugcggcgggacgucgggguccggggcgaagagagccagggcgcggaccgacgucugcugcuuuucugcggcauugcugcccgaacgaacgaacgaacgaacgaacgaagcgguuucguuuaggaaaaauacccucuugacgcgaagccacggcugaagucccgggccacgcagaggggccagcaauuccaugggugguggggcccuccaucccuggacgcagcggggagcagcgggcggcccucucuccugcccacuucuccugggggugggggagcccugugucacccgacgcugcgaggggcugccacgggcuucucagguugugcccuucgcggggccguggcccgugcccccgaggcugcuacccucuugaggugcccggagccaaagcagaggguugaucccgccgguugggugagguagcacccggugacggcggcuaugacugugcccugggcgcaggaacgagcuccucgcgcugccucgaaggcuccugaccuuccgcgccuugcgcugucccgcgccgccggguggacccacacacgccaggagcaaacugcgcaggacucggccgccaccucccugcgccccuccaccgcggagacccugcgccccuagcccagcgucucuuaccccaccugggcagcgcugcgucugcggcucgugggcuccgggcucgcccgccgcggacucuggcucagguuucggcuccggcuggggccccggauccagcucuggcucuggcacugcacgguucuucggccccugcugguucgcuacaucccagcgcgcgaggccggggcuuccucggcucggcccgcuccucccgccgccgccgcccgucgcccgcggggaaggcggggacacuggccgggaggcgggaaggguggggggaggggaagcuagguguucgccgggaccugcggggagaggggcggcgcgcagucccgccggcuagggguccuggccucccucggggcguaggcugggguccgcgcggcuggcggccgggccucgaggccggggagcgcgcccugggaccuccguggaggggcccugccgcaugcggacgaagccagagcgggucccagccuggcccuggggcacuuucucucccugggcccaguuucccaccugacucgugaggggcuggcccuacuuccguuuagacgggggcugguggucgaguuugggguuuugagauuggaccuuucuucuuucugcucagccugcgggagggagcuggucuugcguguuggcagggagaguccgcugcccagagcguggcagccagggagguuugaggacagaccccagguuuucuguguuuggggguaggggguguuaggguggggcaaccgcccgaccugcccugguugggggaauugccuucuucccucuccucaggggcugggcuggugaggaaagggcacaccaaccccucaggacagacacuucuggggccccuuguccaaccccuaugccugcacaucccccagcgaccauccugcugcgggccugcgaacggugacgccuccaccccuguggccccgcaggccguuccuggcuggcugccgcugggagacgggcuggacgcaagggaacugggagccuguccuuugcccacccucaggccacagggcuccccagcguugccucguggccagauaacccugugcgcgaagccucaugguggaaaccaguuggccgaaccuacuccugguaccccgaagugcccagccugagccugcuugcuguugggauuaugggaugggaccacagggcaggucgggcuguggccugccuuucucagggacuggagcggcuaagccugcccgccgacggccacgggcuccagagcgaccguuuccggcgcaaggugccgggagauggcagcgcggcagccgggccugaaucuuucaugagaugcagucagcagcggcgccucccugccugguucucgccgacagcugcugcgggagaggccgcgacccgcgccaccucggcguccugcuaguccgugccuccagggccgcuuggccugggaacgcagagacccacgacccccuccccaaccuccgaagcgggaagccggcccgacccaagcucacagaggccucgguguucaggcccugccagguggccucugcacccugucgugcuguuccagggacuccauacccuccucucaacccucgacagcaggaaccccucuccaguggugugugcagggcucugugcacccagggucgcaaguuaagauaacgaguccccgaugccggcacuagcggaccugcgccuggagaaagugcagucuaccaacuuggacccugugcuguggggaguuuagcccccuacgucuacccccucccauugacugcuuuauguguaaaauggcuuguuggcggguccagcccuagagcugcuaagcugagaaguuucuaaucuugucucuggaaucuuccuuccacuccaagcaccaggggcaucuuugggcauaaaugcagccgcuggaccuuacuauggagggcugcacaggcacuccugggguggcuuuuacucuggcgucuguagcaggaaaucacaccuuccccccucccugcacgcuagc

SEQ ID NO: 20828 - RNA, 5183 nt, Homo sapiens
gcuagcgugcagggaggggggaaggugugauuuccugcuacagacgccagaguaaaagccaccccaggagugccugugcagcccuccauaguaagguccagcggcugcauuuaugcccaaagaugccccuggugcuuggaguggaaggaagauuccagagacaagauuagaaacuucucagcuuagcagcucuagggcuggacccgccaacaagccauuuuacacauaaagcagucaaugggaggggguagacguagggggcuaaacuccccacagcacaggguccaaguugguagacugcacuuucuccaggcgcagguccgcuagugccggcaucggggacucguuaucuuaacuugcgacccugggugcacagagcccugcacacaccacuggagagggguuccugcugucgaggguugagaggaggguauggagucccuggaacagcacgacagggugcagaggccaccuggcagggccugaacaccgaggccucugugagcuugggucgggccggcuucccgcuucggagguuggggagggggucgugggucucugcguucccaggccaagcggcccuggaggcacggacuagcaggacgccgagguggcgcgggucgcggccucucccgcagcagcugucggcgagaaccaggcagggaggcgccgcugcugacugcaucucaugaaagauucaggcccggcugccgcgcugccaucucccggcaccuugcgccggaaacggucgcucuggagcccguggccgucggcgggcaggcuuagccgcuccagucccugagaaaggcaggccacagcccgaccugcccuguggucccaucccauaaucccaacagcaagcaggcucaggcugggcacuucgggguaccaggaguagguucggccaacugguuuccaccaugaggcuucgcgcacaggguuaucuggccacgaggcaacgcuggggagcccuguggccugagggugggcaaaggacaggcucccaguucccuugcguccagcccgucucccagcggcagccagccaggaacggccugcggggccacagggguggaggcgucaccguucgcaggcccgcagcaggauggucgcugggggaugugcaggcauagggguuggacaaggggccccagaagugucuguccugagggguuggugugcccuuuccucaccagcccagccccugaggagagggaagaaggcaauucccccaaccagggcaggucgggcgguugccccacccuaacacccccuacccccaaacacagaaaaccuggggucuguccucaaaccucccuggcugccacgcucugggcagcggacucucccugccaacacgcaagaccagcucccucccgcaggcugagcagaaagaagaaagguccaaucucaaaaccccaaacucgaccaccagcccccgucuaaacggaaguagggccagccccucacgagucaggugggaaacugggcccagggagagaaagugccccagggccaggcugggacccgcucuggcuucguccgcaugcggcagggccccuccacggaggucccagggcgcgcuccccggccucgaggcccggccgccagccgcgcggaccccagccuacgccccgagggaggccaggaccccuagccggcgggacugcgcgccgccccucuccccgcaggucccggcgaacaccuagcuuccccuccccccacccuucccgccucccggccaguguccccgccuuccccgcgggcgacgggcggcggcggcgggaggagcgggccgagccgaggaagccccggccucgcgcgcugggauguagcgaaccagcaggggccgaagaaccgugcagugccagagccagagcuggauccggggccccagccggagccgaaaccugagccagaguccgcggcgggcgagcccggagcccacgagccgcagacgcagcgcugcccaggugggguaagagacgcugggcuaggggcgcagggucuccgcgguggaggggcgcagggagguggcggccgaguccugcgcaguuugcuccuggcguguguggguccacccggcggcgcgggacagcgcaaggcgcggaaggucaggagccuucgaggcagcgcgaggagcucguuccugcgcccagggcacagucauagccgccgucaccgggugcuaccucacccaaccggcgggaucaacccucugcuuuggcuccgggcaccucaagaggguagcagccucgggggcacgggccacggccccgcgaagggcacaaccugagaagcccguggcagccccucgcagcgucgggugacacagggcucccccacccccaggagaagugggcaggagagagggccgcccgcugcuccccgcugcguccagggauggagggccccaccacccauggaauugcuggccccucugcguggcccgggacuucagccguggcuucgcgucaagaggguauuuuuccuaaacgaaaccgcuucguucguucguucguucguucguucgggcagcaaugccgcagaaaagcagcagacgucgguccgcgcccuggcucucuucgccccggaccccgacgucccgccgcagcgcucggaggugcccccagcccaaggcagccugcucucgccggcacaggucgggcuuuuucuucccaggagagaaaccccaauucccuucguaacguccaauaaagacauucccgcggcuucucccagguuugguuguugacgcagggucccggagcacgcagucgcuucucaagaaccgggucucggauuucugaaauugaccagcuucguaaauuggagccuauucucccgcggcaaaggcagggccccaaagccgggaucgcaguaaugggaaccccaggcuggaauccgggucccaagcuuuuccgauuuaggaauuccccgaaucuacaaauauuuaguccacuuuucugaaaaacuaaauucugaaaaacacaaauucucuugacaucccugugaccucugaaagccaccagggccagagggaggaaaucccagguugcuguccacugggggaggauucaggucuaggguucaggucuacgguagucagggcaaaagcuacaggcagcaggggcagcacaggagacuugcuguccccgugcccuuucccggggcugcuuucggccucccgcaucucuuccagggaaaggaaaagaggugggcuggggcuuggagaccaggcugucuggacucuaggaugcagaggccuccagacaggcucagggugcucuucucccaugaaagcagccgcugggaggaggaggcuauggugcauccauaaguugccccucugcuccccaguugugcgaccagcugcuaccuccuuccuagucuucuuccccacagcucagccauucucaggaaccagacagcguccauggacuuaggugagagaugggccggguagagccauggguccuaccagccgcugacugagcggcccacggcacagaguccugaguuccauacucccaucugugccucacuggcggcaguccugcucaaauacauccuggcucuccccgggacaggcuggggauccccauuuggcaggaagccucagacuggggucccaggaagccuaaaggagccagugaggucuuuccagccccuaccugagcacccuccuccccacuuacccaguaauugcuguauucaaagaaacgggagcuuuuauuggggaggggguguuagaucaggcagaaagagguaggugguccaaaccugcacucccaaaacaggguuuucaaguuugaacuucuccacggacuaagaggcuuagggcuggaaugucccagagagucauggauagcccugguggcaggccauggcacauuccuuccuuuuuccuaaaauaccuugauucugggagcaaggauuagggcacggugcccccguggguggguagaaggaugcccccccacugagagccuuccaaccacccuucccaaauuacauuacuaaaccauucuugggcacaggguguuuuuagugagccaggcuucaggaaggguccucauggugacuacuucaaccccacaacagcccaagcucuucugcucagcccagccaagacccuaaacuccaaaauucuugaaaaucagagaaucauugcuggcuuuguguggucacggagggguggggaacagggcacaugguuccagcuccacuaagcccccuucccuccucucuucgugucccaucagcaagugagcuggaugcugaagcagcaggcagaguccgguguuggacaugggaacugaggcacagugcagaucaagccuuaaccuugagggaaacacaggucacauagcacagcugggggaacacaaagccucugcuuacuccugaaagagugcuguuuucuguccuguaugugugacgugucugugagcgugcaagaagccccuaucuugacugggacaauggccagugaguguagcuggggaagaauugagagcauguccaggucccuuccccagccaacgcccaagaucaggccacagccuccucacaaucaauugccuccucacuccuugaucacucagugcugcccaggcccagcagaacagacucugccagcaggccccacuagccccagcuccucuuugggucucagguccccugaggauauggggcuucaccugaaauggucugagggcuuuuccuucuacacagcaggcaucaagaucaccaaauaaagggacuauugugccugccuggagcccugccagagguuugggcccagaggggcacacagcaggugcucaauaacugcauuaaaugcacuaacagugaggaaacacgccccucagacuaagcagugagugcugcucacagaauaguccccauugggggauggcccaaagagucacuuuggucccucugggaagugagaaggcaagugagaaggcugugagucuuaaccuccucuagaggcccacagacagaccauucauuucuaagucucuacccagagacgcacugugcuucccaccuuggccugacauguggcaggguuagaacacaccuccuauccccugccagcccgcguucaugccaaguagcacauauaugccuaaacucagcacuuccauagugcagugaauacauguguguguaca

SEQ ID NO: 20829 - RNA, 2271 nt, Homo sapiens
ggaaugaaacagggcguuguguggagcaagucuuugggcaggcuugggaaggagaaaacagggucgccggggcgguaggugaagucuucggaggcggcugggcuacuggggucagagagcggggaggcggcggcggcaccugagccccaggacuccgcgucgcuggcggggcuugggggaccgggcaggcaggggacgcacugcggcggcaggaggcgcucccgggcaccgccuccgggcagcccuugauccgccaggcgcagugucucggccagagcccagauguaguuguaggcgaagcgcagcgucucgauuuuggugagcuuggugucgucggggaacgagggcagcacgcugcgcagugcguccagggccgcguucaaguugugcaugcgguugcgcucgcgaucguuggccuugacgcgccggcuccugcgcagcgagugcagcagcgccucggagcggacccgcguccggccgcggcgccgccgccucuccugcucgucguccugugccccuggaaccucagacgcccgggagauauugggcgcgccccugcgggccggcgcgggcggccccgaagcggaggcugccuguuggagucuggcacagucuuccucgucggugaggaagccggauaggucacugccgcugcugcuggcgcagucgaggucggagaugcaggucucaaggcgggcuggcaucguugcgcugugcaggaccgacggacagauagaaaggcgcucagagcgcugcagcccggacugagggcagagccgccagggcgcacuuacguucccaacagccugggguuguuacucugugccaguugcgggugcgagagccuggaagggugcaggggcgcacggagaacuuggccuggccuccucgccucgccugcaggggccacgcgcccggccggucuccugagugaugucgccggcgaucagaucagcucgugugagcaccgaguguggcacacgacuggccucaggaccccuuaaguacccggcgcaacaaugggcgccccccucccuugccaccuccgcccccgcggcagcccgggugaauggagcgaggcggcaggucauccccgugcagcgcccggguauuugcauaauuuaugcucgcgggaggccgccaucgccccucccccaacccggagugugcccguaauuaccgccggccaaucggcggcgucgcgcggccccgggagucggcucgggcuaagcuggccagggcgucuccaggcagugaaacagaggcggggucggcgggcgauuagcggccgaggcacgcuccucuuggggcgggcugggcgccccucgcuggggugggacggggaggcggggcgcgagcgcgaaagugugagccgcccagugaguugcggaaaccuggaggguacuuggaguuuggguucgcauccccucuccagcugcuuaguggucgcgugacuuuggacgaguaauuuaacuucccugagcauugcuuuccccaccuguaagaugagacaaaaguuuacccuguggaggaugaucagauauaauguuuguggaacacuaaaugugcagcauccgcugaacagggugaaaaucauuuucaaauagacuggagaguggccaugccagaggcacagggcgcagggcaaggauaagugucgcugcuccguucaggcugaugaagaaacgggaaagaaucugaccuucaucuggggagugcgaagaggagaguggaaaagaggaucgggugauuucccagguugccuugagucuuggucucacccuucccuucuuucccuucccuucuccacccuccuccgcaccucugcccacaagucaccucaagauucuuaauaagaauuaauaauaugagaauuuauauaaauaauaauaugagaauauaauuauuaauaugagaauuuccuuuucuuuggcguuccugaaaccuugccugccccaugcccggagaaauccguugcacaccgucucuuggagcccugcuugcagccucuguggcccucuucagggugagccagccaggggauccagcuccccuggcccgagagagagcuggccccuggagggcagcaggugacaguggaaccccuuuccuccaaacccccucccgccuucggugucuuaaacucgccuauuccagcaggucuucccucugcaugucaggaguuacuuuucucuugucaccuacacucacccaggagccacaggggcccagacaucacccaacuuuguacuuggaggauaaauaguaagg

SEQ ID NO: 20830 - RNA, 2271 nt, Homo sapiens
ccuuacuauuuauccuccaaguacaaaguugggugaugucugggccccuguggcuccugggugaguguaggugacaagagaaaaguaacuccugacaugcagagggaagaccugcuggaauaggcgaguuuaagacaccgaaggcgggaggggguuuggaggaaagggguuccacugucaccugcugcccuccaggggccagcucucucucgggccaggggagcuggauccccuggcuggcucacccugaagagggccacagaggcugcaagcagggcuccaagagacggugugcaacggauuucuccgggcauggggcaggcaagguuucaggaacgccaaagaaaaggaaauucucauauuaauaauuauauucucauauuauuauuuauauaaauucucauauuauuaauucuuauuaagaaucuugaggugacuugugggcagaggugcggaggaggguggagaagggaagggaaagaagggaagggugagaccaagacucaaggcaaccugggaaaucacccgauccucuuuuccacucuccucuucgcacuccccagaugaaggucagauucuuucccguuucuucaucagccugaacggagcagcgacacuuauccuugcccugcgcccugugccucuggcauggccacucuccagucuauuugaaaaugauuuucacccuguucagcggaugcugcacauuuaguguuccacaaacauuauaucugaucauccuccacaggguaaacuuuugucucaucuuacagguggggaaagcaaugcucagggaaguuaaauuacucguccaaagucacgcgaccacuaagcagcuggagaggggaugcgaacccaaacuccaaguacccuccagguuuccgcaacucacugggcggcucacacuuucgcgcucgcgccccgccuccccgucccaccccagcgaggggcgcccagcccgccccaagaggagcgugccucggccgcuaaucgcccgccgaccccgccucuguuucacugccuggagacgcccuggccagcuuagcccgagccgacucccggggccgcgcgacgccgccgauuggccggcgguaauuacgggcacacuccggguugggggaggggcgauggcggccucccgcgagcauaaauuaugcaaauacccgggcgcugcacggggaugaccugccgccucgcuccauucacccgggcugccgcgggggcggagguggcaagggaggggggcgcccauuguugcgccggguacuuaagggguccugaggccagucgugugccacacucggugcucacacgagcugaucugaucgccggcgacaucacucaggagaccggccgggcgcguggccccugcaggcgaggcgaggaggccaggccaaguucuccgugcgccccugcacccuuccaggcucucgcacccgcaacuggcacagaguaacaaccccaggcuguugggaacguaagugcgcccuggcggcucugcccucaguccgggcugcagcgcucugagcgccuuucuaucuguccgucgguccugcacagcgcaacgaugccagcccgccuugagaccugcaucuccgaccucgacugcgccagcagcagcggcagugaccuauccggcuuccucaccgacgaggaagacugugccagacuccaacaggcagccuccgcuucggggccgcccgcgccggcccgcaggggcgcgcccaauaucucccgggcgucugagguuccaggggcacaggacgacgagcaggagaggcggcggcgccgcggccggacgcggguccgcuccgaggcgcugcugcacucgcugcgcaggagccggcgcgucaaggccaacgaucgcgagcgcaaccgcaugcacaacuugaacgcggcccuggacgcacugcgcagcgugcugcccucguuccccgacgacaccaagcucaccaaaaucgagacgcugcgcuucgccuacaacuacaucugggcucuggccgagacacugcgccuggcggaucaagggcugcccggaggcggugcccgggagcgccuccugccgccgcagugcguccccugccugcccggucccccaagccccgccagcgacgcggaguccuggggcucaggugccgccgccgccuccccgcucucugaccccaguagcccagccgccuccgaagacuucaccuaccgccccggcgacccuguuuucuccuucccaagccugcccaaagacuugcuccacacaacgcccuguuucauucc

SEQ ID NO: 20831 - RNA, 1581 nt, Homo sapiens
ggagaagccggggcaggaaauugucaauuuguuccuuauuuuaccuuaaugcgaccuaaauggacuaauuucuuuaaaaguaauugugcugcauuaaaguuuaauuugauuuaacaucgccuuuaaaaaaaaaucuauggaauauguagauccaagaaaggaguuggggaauguuguuacuuuuuguuuuucuuauuuuucucuuccccccucccccgccuuuuuuuuuuuuucgaaaggcgauauaccccgugauaauuuguuaggagguguuucucucucuuuuuucccucuccuguuuguuuugauuugggauuucuuucuccuucccuccccccguuucucucuccccaccaucuucuucucuccuccuuuucuaagugugguguaauuuguaaaaaaucuggcauaaaggagaagcugcugccaucaaggcggauuugcuaagugugcugguugagaaggagagaagccaaauucaaccucacagucaucccccccucuucugcaagggacucagcguugccaauggcugugaggaaugcgccuuuuauuucucuggaaagaaaaguugaaaucucuaaaguuugauucacgguuguccauagaguucacucgaguuuccuuaaugcuaucuggguugcugagcucuggguuuccggauugggaaucuucggugauggaugugacuccauuuuccaaacacuuucucugauuugagggggaggcggagcugauuuggguugauuucggggggugaaagcuuggaggcuuauucaucuuccgaaaguaagagggaaucggcugagggccggagguacaguucgucaggcugccgaagcgcaggugccgcagcaaccgaggaauuguuuaauuuucuuucugccccccgcaccccuguguccaaagauuugcucucgauuuccuggggcgccugggguacgguuuauggaagggauucagaggcauguuuuauugccgggacugggaguguuuuauugugggagagacgaaagcuugugcuguuuacuacgggagccggcugcggcgagggcaaggggccgggagauauuauuccaacccggcuguccaaauucuggggaacccagcugaauacccugggaguuucuuccuuaggacaagcgcgggugcggagggggccgaggacggguugaaggaaggcugcgcggggaagacagccccuccuggcaucgccaagaaaguagugaccgcgauccccuugccuccucagguaugaaagaugccgccgagcuucugggccaccgggaggcggugaaguguaggcugggcguggggggcuccgaccccgggggccauccgggggaccuggcgcccaacucugacccaguggagggagccacucugcugcccggggaggacaucaccacagugggcucuacuccggccucgcuggcggugagcgccaaagacccggacaagcagcccgggccccagggcggcccgaaccccagccaagccggccagcagcagggccaacagaagcagaagcgccaccggacgcgcuucacccccgcacagcucaacgaguuggagaggagc

SEQ ID NO: 20832 - RNA, 1581 nt, Homo sapiens
gcuccucuccaacucguugagcugugcgggggugaagcgcguccgguggcgcuucugcuucuguuggcccugcugcuggccggcuuggcugggguucgggccgcccuggggcccgggcugcuuguccgggucuuuggcgcucaccgccagcgaggccggaguagagcccacuguggugauguccuccccgggcagcagaguggcucccuccacugggucagaguugggcgccaggucccccggauggcccccggggucggagccccccacgcccagccuacacuucaccgccucccgguggcccagaagcucggcggcaucuuucauaccugaggaggcaaggggaucgcggucacuacuuucuuggcgaugccaggaggggcugucuuccccgcgcagccuuccuucaacccguccucggcccccuccgcacccgcgcuuguccuaaggaagaaacucccaggguauucagcuggguuccccagaauuuggacagccggguuggaauaauaucucccggccccuugcccucgccgcagccggcucccguaguaaacagcacaagcuuucgucucucccacaauaaaacacucccagucccggcaauaaaacaugccucugaaucccuuccauaaaccguaccccaggcgccccaggaaaucgagagcaaaucuuuggacacaggggugcggggggcagaaagaaaauuaaacaauuccucgguugcugcggcaccugcgcuucggcagccugacgaacuguaccuccggcccucagccgauucccucuuacuuucggaagaugaauaagccuccaagcuuucaccccccgaaaucaacccaaaucagcuccgccucccccucaaaucagagaaaguguuuggaaaauggagucacauccaucaccgaagauucccaauccggaaacccagagcucagcaacccagauagcauuaaggaaacucgagugaacucuauggacaaccgugaaucaaacuuuagagauuucaacuuuucuuuccagagaaauaaaaggcgcauuccucacagccauuggcaacgcugagucccuugcagaagagggggggaugacugugagguugaauuuggcuucucuccuucucaaccagcacacuuagcaaauccgccuugauggcagcagcuucuccuuuaugccagauuuuuuacaaauuacaccacacuuagaaaaggaggagagaagaagaugguggggagagagaaacggggggagggaaggagaaagaaaucccaaaucaaaacaaacaggagagggaaaaaagagagagaaacaccuccuaacaaauuaucacgggguauaucgccuuucgaaaaaaaaaaaaaggcgggggaggggggaagagaaaaauaagaaaaacaaaaaguaacaacauuccccaacuccuuucuuggaucuacauauuccauagauuuuuuuuuaaaggcgauguuaaaucaaauuaaacuuuaaugcagcacaauuacuuuuaaagaaauuaguccauuuaggucgcauuaagguaaaauaaggaacaaauugacaauuuccugccccggcuucucc

SEQ ID NO: 20833 - RNA, 2927 nt, Homo sapiens
guuucccccacggcauuugcccacuuuuaaaauggaguucuacuaaggccugccuuuuagaguuguugggauaauuaaaugagaaaauacagaaugcuuuuaccacagugccucacgugcaggaggcacugcugcccacuauuucccgaaauggccuggaaacugccaaaagguggagaaucaugucuuaccgaucucccuauccucugcuccgucaccuaacaaaggaggccccuaauaacuaaauaaauugcaaaacgaccaaaaaaaaaguguugcuuuguuugaggaaauaucucugccucccacacacacuuaagaugucuauuuuaaagcaccacuaagaaaauauucauaaaggcugggugugguggcuuacgccuguaaucccagcacuuugggaggccaaggcgggcgaaucaccugaggucaggaguucgagaccagccugaccaaauggcaaaacccugucucuacuaaaaauacaaaaauuagcugugcauacuagugggugccuguaaucccagcuauucgggaggcugagcaggagaaucgcuugaacccgggaggcagagguugcagugagcccagaugaugccacugcacugggggacagagccagacuccgucucggaaaaacacacacacacacacacacaagcaccucauauguacagugcaaaagaacuacuguuacuauuguuacacuugggaacgccuaguuuucuaucacaccaagaaucaccaaaaaacaccauaagugccuucaugggaaacguuucucuuuuccagguaucccaauaauacaccuguugccuaagggccacacacugacuggccuggaaagccgccgccuccuccucgagcaggguaauuccccaagcgggcaguguggccagcgagccccggguccggccuaaggaugccgcggcuuuucccucgggcccgguggcuucccgaggagcgcgaggggcucggcgccgcucccaaccccuaggcgcagaggccaucuuggcccucgaccccugcuccccgcacgcuuccuccgacgcaggcaacauggcuggcgcgcggggccggcccagucccggagguccccaaacuccguggcccggcugggcgcgggucccggcuuccgugcgcaccgaggcgcucccaggcagcgcgcgcccacguucgccgggcaggcaccgcccggaggcaguuccgccccccugggggcagcccuuuuggucacggaugagaauccgaagcgugagcagcuucccucgaaguccagccucacucgaaauuaacuccccgccccccagcuuaaaucgacgcggguucacacaacucgcaacaaguggauucgaaguagccaguguggcccacaccgugacuccuggaauauuucacagauugaauccagcccccgucuccccgggauauccaaagggguggggugggagcggaaggaaugaaauuccccccgggaucuaagccgcccgggccgccgaacagccgccucgcugcagccucaggcuuaggacccccaaggagcugggcgcaggaucccucuccaugaaggccgcccccccaaacugcagccccagagcggaugcaggaucgucgcuguucaggaaugucgugccccauaaaagugaaaaguugcccgcgccgcugaggcacugcuagcuuucagcguuuccgcggaauaaagcuugaucggcggcuccaagccaccccucgccccaggaggcagccucccaaguuggccggugcugcucucuccgcagacccgcgccucucugguucccacgagucccagcucggggacgaaacugccaccgaaaccagcgcggagcguccuccccccggcaccuccccuaacauagucgccgcgguccccccacggggacccucgggcucccgugcgccccugacgccgcgcccaacacucacccgcucgccgcaacugggcccgacccuccgggggccaacggugccagggagcgcgcucaccuggcgggcgcaccugacgccgcaccgaccgccagcgcucagccggggacugggcuggggacgucuccucccccuucucccucuccuuucccuccucccuacaaccggcccugcccccgggcaugcgcaccaacguggaagggggugcgggaagccugcgggccagcgccgcgagucccaccugcugcguccuagaccggcuccucggcgcucuggaccuggcucucgguuccugccgccuccgccagaggaagcagggagggagagguggacgcgggaguguagguguggugugucggccuccucccucggugaccaauucaccugaaacucggaugggagggggcgggaggacgcgguccugcuucccacacccugccagcgcgcuguuaaaggaaccgcgcgacguugcggcccgagaggcggggcgcagaggagaggcgcgggcuccuagggggcagcacggaugggggucccugaccaccccggggugcguucggugcuccgccugcuucggauggaaccuuggggugucugauggagagaggccgaacgagguccagaggggacuguuuccuccggaaagaggguccaggcacucagcacuuugauaggaaaggcacguccucacaggacacuuuucugcuuccagaauuugauuaaacuguugcuggaaaaaggcaucuagauguauugcuccaacgaaagacuccugggaaaauuucaaaagucguguguaaacauuggcgcuguuucugaaucucuagauucagaauaagagacaauuacuuagagggguuaaaaugagggugaacuacuguagguguuaguugccauccagcaggcuaaagugcauaauacaguuuacacaucaccaccccaggguccucuccugcccacccgguccgcucuugaggaccggg

SEQ ID NO: 20834 - RNA, 2927 nt, Homo sapiens
cccgguccucaagagcggaccgggugggcaggagaggacccugggguggugauguguaaacuguauuaugcacuuuagccugcuggauggcaacuaacaccuacaguaguucacccucauuuuaaccccucuaaguaauugucucuuauucugaaucuagagauucagaaacagcgccaauguuuacacacgacuuuugaaauuuucccaggagucuuucguuggagcaauacaucuagaugccuuuuuccagcaacaguuuaaucaaauucuggaagcagaaaaguguccugugaggacgugccuuuccuaucaaagugcugagugccuggacccucuuuccggaggaaacaguccccucuggaccucguucggccucucuccaucagacaccccaagguuccauccgaagcaggcggagcaccgaacgcaccccgggguggucagggacccccauccgugcugcccccuaggagcccgcgccucuccucugcgccccgccucucgggccgcaacgucgcgcgguuccuuuaacagcgcgcuggcagggugugggaagcaggaccgcguccucccgcccccucccauccgaguuucaggugaauuggucaccgagggaggaggccgacacaccacaccuacacucccgcguccaccucucccucccugcuuccucuggcggaggcggcaggaaccgagagccagguccagagcgccgaggagccggucuaggacgcagcaggugggacucgcggcgcuggcccgcaggcuucccgcacccccuuccacguuggugcgcaugcccgggggcagggccgguuguagggaggagggaaaggagagggagaagggggaggagacguccccagcccaguccccggcugagcgcuggcggucggugcggcgucaggugcgcccgccaggugagcgcgcucccuggcaccguuggcccccggagggucgggcccaguugcggcgagcgggugaguguugggcgcggcgucaggggcgcacgggagcccgaggguccccguggggggaccgcggcgacuauguuaggggaggugccggggggaggacgcuccgcgcugguuucgguggcaguuucguccccgagcugggacucgugggaaccagagaggcgcgggucugcggagagagcagcaccggccaacuugggaggcugccuccuggggcgagggguggcuuggagccgccgaucaagcuuuauuccgcggaaacgcugaaagcuagcagugccucagcggcgcgggcaacuuuucacuuuuauggggcacgacauuccugaacagcgacgauccugcauccgcucuggggcugcaguuugggggggcggccuucauggagagggauccugcgcccagcuccuuggggguccuaagccugaggcugcagcgaggcggcuguucggcggcccgggcggcuuagaucccggggggaauuucauuccuuccgcucccaccccaccccuuuggauaucccggggagacgggggcuggauucaaucugugaaauauuccaggagucacggugugggccacacuggcuacuucgaauccacuuguugcgaguugugugaacccgcgucgauuuaagcuggggggcggggaguuaauuucgagugaggcuggacuucgagggaagcugcucacgcuucggauucucauccgugaccaaaagggcugcccccaggggggcggaacugccuccgggcggugccugcccggcgaacgugggcgcgcgcugccugggagcgccucggugcgcacggaagccgggacccgcgcccagccgggccacggaguuuggggaccuccgggacugggccggccccgcgcgccagccauguugccugcgucggaggaagcgugcggggagcaggggucgagggccaagauggccucugcgccuagggguugggagcggcgccgagccccucgcgcuccucgggaagccaccgggcccgagggaaaagccgcggcauccuuaggccggacccggggcucgcuggccacacugcccgcuuggggaauuacccugcucgaggaggaggcggcggcuuuccaggccagucaguguguggcccuuaggcaacagguguauuauugggauaccuggaaaagagaaacguuucccaugaaggcacuuaugguguuuuuuggugauucuuggugugauagaaaacuaggcguucccaaguguaacaauaguaacaguaguucuuuugcacuguacauaugaggugcuuguguguguguguguguguguuuuuccgagacggagucuggcucugucccccagugcaguggcaucaucugggcucacugcaaccucugccucccggguucaagcgauucuccugcucagccucccgaauagcugggauuacaggcacccacuaguaugcacagcuaauuuuuguauuuuuaguagagacaggguuuugccauuuggucaggcuggucucgaacuccugaccucaggugauucgcccgccuuggccucccaaagugcugggauuacaggcguaagccaccacacccagccuuuaugaauauuuucuuaguggugcuuuaaaauagacaucuuaagugugugugggaggcagagauauuuccucaaacaaagcaacacuuuuuuuuuggucguuuugcaauuuauuuaguuauuaggggccuccuuuguuaggugacggagcagaggauagggagaucgguaagacaugauucuccaccuuuuggcaguuuccaggccauuucgggaaauagugggcagcagugccuccugcacgugaggcacugugguaaaagcauucuguauuuucucauuuaauuaucccaacaacucuaaaaggcaggccuuaguagaacuccauuuuaaaagugggcaaaugccgugggggaaac

SEQ ID NO: 20835 - RNA, 1070 nt, Homo sapiens
cuccgaaggggucggggggugcucaggggcguaggucccggcgagcggcgcguagccucgcugcgcugaaccccgggacgccgugcauggugcccgggguucauucauugcccucugcccgcucuccaaguccccgccgcgaccccggccgugcugcucacccggcgggggccgcugcaggagacggcucggcggcgggcgcccgcuucuccccgggcucggccgcugcgggacucgaggcgccgcuguccggcgccgccaccgacucgguaaggugggcgccgccgcggcucgcggcuccguggggcggcggcaccgccacaggcuggaagccggucccacuccccgcugcguccgcgggcuccggcgacggggaagucgaggaggccggcggugaggcggcaaggaagagcggcugcucaggcagcugguccagcuccacacuccgcacuuugcgcagcugccgccgccgccaguccgcccgcucgcggcccccgcugcccgccucccgcagcagucccgcggcagccgcgggcgcgcugcucgccuugagggcuccuccgccgccgccugccucagggcucguagcccuggcgcccgggaaucccgacgacgaggcgcgauuccccgccgccgccgccauuuucucucgcgggcuacauucgcucggccccugcgagggagggagggggcggggagagcgcagggggcgggcacugcgccgccagcguaaggccuccugcgccaacugcgugagcgcggcccgccgggcgccuggccuggacugaccgacgggcgggcgcacuggguccggccugcggcagagguguggguggagggcggcccggcggccgcaggugggagggagugggcugugcucuccgccgggcgagagggcgggcgggcgagguggacugggaggcggagggggcgggggcggaggcggaggcgugggcucccgggacucugcgcgcugcacgcgccgcgccgccagguagucccggccgcaccggcgacaggaggagccuuggcggcagcgcugcgccgcuuccucucggcaaucucggccc

SEQ ID NO: 20836 - RNA, 1070 nt, Homo sapiens
gggccgagauugccgagaggaagcggcgcagcgcugccgccaaggcuccuccugucgccggugcggccgggacuaccuggcggcgcggcgcgugcagcgcgcagagucccgggagcccacgccuccgccuccgcccccgcccccuccgccucccaguccaccucgcccgcccgcccucucgcccggcggagagcacagcccacucccucccaccugcggccgccgggccgcccuccacccacaccucugccgcaggccggacccagugcgcccgcccgucggucaguccaggccaggcgcccggcgggccgcgcucacgcaguuggcgcaggaggccuuacgcuggcggcgcagugcccgcccccugcgcucuccccgcccccucccucccucgcaggggccgagcgaauguagcccgcgagagaaaauggcggcggcggcggggaaucgcgccucgucgucgggauucccgggcgccagggcuacgagcccugaggcaggcggcggcggaggagcccucaaggcgagcagcgcgcccgcggcugccgcgggacugcugcgggaggcgggcagcgggggccgcgagcgggcggacuggcggcggcggcagcugcgcaaagugcggaguguggagcuggaccagcugccugagcagccgcucuuccuugccgccucaccgccggccuccucgacuuccccgucgccggagcccgcggacgcagcggggagugggaccggcuuccagccuguggcggugccgccgccccacggagccgcgagccgcggcggcgcccaccuuaccgagucgguggcggcgccggacagcggcgccucgagucccgcagcggccgagcccggggagaagcgggcgcccgccgccgagccgucuccugcagcggcccccgccgggugagcagcacggccggggucgcggcggggacuuggagagcgggcagagggcaaugaaugaaccccgggcaccaugcacggcgucccgggguucagcgcagcgaggcuacgcgccgcucgccgggaccuacgccccugagcaccccccgaccccuucggag

SEQ ID NO: 20837 - RNA, 4428 nt, Homo sapiens
gcacacgaacggucuggcuccgguguggaccggcauguggcgggugagauuauagugagcguuaaacaccuauggaaagacauggggggccuuguggugcgucuguccgagggccuacaaucagccccgggggggccacagccuaccucccccaaccaacacccccuucagaaaccagagccuuuuucaguuuguaaagugcugcccaaacuccugcuuacaccaauacuguguggccgcugacaagggcauccccauuuuacagaauaggaaacugaggcccaacgaggcucccaguuuggguagucaacuacuggggagcuccucagcuugaaaaaggggcauuccaggcugccccaaggaagccgccgccgccgaucgccccucccggccccccucgccgaacccugggccucaccuugccgcacaccucgcaggugaaguuuuugggcuugccaucugcggagccuccuggcagcuugcuguggcccuugacgccuccgcgcucggcagucagggccgaguuuuccuucaguaccugcuccagcggcgccggcaagcgcuccuuauggggauagggagccgggugggggaacuuguccgcagccaggccggccagcuuggcguucuccagcagaaagagcuuggggugagcagccagggcggcgggggccugcgcauugaggaggccagacgggaagagguggccgcugaggagcucagacggcggguacgcggucgaguccagguaguugaaguaguagagcgagccgcuggccggcagccccacagccugguugaugaccugcggcuugaugacccugcccgcgggcagcgcggacggcgccaggcccagcucggccuugcagcacacgccacaguugguuuugcacaagccgcuggcgccgcacacuggggcccccccgccgccgccgccgccaccgccgccgccgccuccgccgccgcccgcccggaggcugcuuuuccagagcuccgaguaacugagcagugucuuugacggcaccucguagccuaggggcuggagggggaucauacagggcagcggcgagcagagguugagcaguuucuugcccuggcugccguccgccucuagcgcuccaggccggggcucaaagggcgcacggggcuccgacgucuuggccaugaugcgcucgauggaaaaggccagugucuuggaaguggccggcgacgcuccggcgcgcgggcaggccgggggcaccauggucuccagggaagccgagcuugccauggcgcgcggagcugagccgagccaggcugggccagggcgcagccucucuccucuaagucugcauuccggaaaaggcaggggggaaaacugcaauuuaauaagcaccuagucgggcccgggucacccauuugcauucaaaugaacaggggcaaaacaaagugcacccaaggguaccaaauuaccgcccauuaacccggcgcgcaaaggaacccaccagccccugcccugggacuuugaaagggggaagaagggggaggguuuacaaaagaaaagggggggggcggugagaaaagagucucaaauuaaccccccugagcccuucccuggacccgggccucugccacgcgugcugggagcuggacagugaaggggcaaaguuaaagaggaccggagagccaccucgcauuuaccucuuucccccaccaccaaggagaugcguuccgagccaugcagcgugucucuucugucacauuuugauggcaaacaucuuccccuccgcgugagaucacugucuuuuacauucagcugacaucacaugaagucacuugaaguggaaugacaugggcggcggcgcggcucccguagcggccccuguguucccccgcgccugccggccgccgccaccaccgccccucaaacuuuaaaaggaggcaacuggcgcccgcgcuccucucgggaaagugcgagcgguuugcgaauagggaaagagggaagagacgggagggggagggggaggaaucgugaugguuuugccgguggaaggaaagggggggggggacccaaacccaaaccuaggcagaguuccgugcgugauucacaacuuuggaggccugcagguuugggggacgcggggagggcggagggucccggacgcggcgcccccaaagggccccuggguaucagucuaguagccgaaguaucccuuagcccuccgcagccgagcugggcaucgugcuaauaaacugccauuuacccacggaaccggcgccagccccgaacacgcgcaaaugauaauuaccucauuaggauguggcgcauggacgcgggcgccgcguuuggaggggggaacuuguuaauggggaaauauuaauuuaugcaaaagcaaugagcucgccuuggcuggcgucggaggucgggagaaagcucccacugacuaaggacgaccccgaagcgucacggagagcaaggccgcucgccggcaucucgggggccucggcgccgcgcaggugcgccuccagcuuuauggccagcucugggucugaggcugggggagacuaaaccgagagcuggaagacuuucggagauccuaauagaucagaauuguugauuuaugaucggguuucugaggcaaagccgaguucugcuucugguuuagggcugcgugcggggaggauucggagggcagcucucccagcugauggguacuuacuguuuguauaauugagaaggucccaucuccaccuguuuaaggagcagauugaaacagcagaaccucccccuggauccuauuaaaacguuuuuccuccuaaggccauucagucgaaccaauuuuccgaagugauucauagagcugaauucugccaaggcagcucuuucacuuuuagccacuaaagcaccgcguggaaccggguuuuguguuuuucuaaaauaaagagaaggauuaucagagaggagagggagggggccugaagggggacgggcagagacuuaguguggccagagguacaagcagagggaagaaaagacccuuuucuagacaggccccaaguaaguucggaggaauucagcguuuugugccuggcgcacaaaagcagcgcgcuccgcgcuugguuuggaggggcugaauucaucuguuugcagaccauuccaccugcguaucacaacaaacugcucaaagacgcuccagcacuuucaacaggccgggugcucuuggcgacaacaaaaguggucgaggcugaggguucuuacggagggggguggugguggcuagcaagagagcgagcgagagaauuagguuuaggaaagggggaggacugggugcaaggguuuuuugaaaaguuuuggcugguuuuguucgcgggacaauuauaucuugcuagccagcuuuugcaagaccacgagcuuuguagccgcaaucacaguuuaagaggauuaccguggauauaauaugagcaaacaggguuugauagugaauuccaucuccaaagacacacgaucaugugaagccagagaaaguggugguagagguaaacccucuguuucuucacccaggaacaagucuugagagggcugaguauccuguccuaggccccuccaugcugcgaaacaucccuggagaacguuaagggacgggggagaaaagcucuaguuuuaacuucaggcaaaucgcucccuuuuucccuucaauaaaagucucuuuccuucugcccacccauccaguugcggcuccuuugaggugcaauuuuaggcaggauuuggacauagcagguaaaggaaggaaaaguguacuuggaaagaaaagagagggaacagagagaggucccugagggaaaguggcuuggagguggacugcaauaggcuaaugcucucacccugccaaacucugaaacugccccuaaauuccgcaaucauaagucuguucccauaacgucacccucccacccccuccccaaacuaccagauuucuaagccaagaggcuugcucaucuggagaagaacauuuccauauagcccauuuaauuuagaagauguucagagagacagaauuccagacccaggguaccccuaucccuauguuaaugugaacacaacagcacagauuacucccuccucccaccaaacaugaaacaaaccaacucaccccaacauugaaacaauaucaauacaccugcagcaucucaagacccgaauuucuaucccgacucuccuguggaucccguuugccacaaguacugcaccccaacccuuuuuccaaauuggguaauuguugcucuccgcagcagcucgaaagaucugcugguuugaaagcuccaucaggcugaaaggcuuccaagggcuucccaugaaccugccuugccauuucuaucgcuuuuuguggcugcauaagccaucucucgcucucucuccagcaucacaaaggagugcuaccuccacagaaa

SEQ ID NO: 20838 - RNA, 4428 nt, Homo sapiens
uuucuguggagguagcacuccuuugugaugcuggagagagagcgagagauggcuuaugcagccacaaaaagcgauagaaauggcaaggcagguucaugggaagcccuuggaagccuuucagccugauggagcuuucaaaccagcagaucuuucgagcugcugcggagagcaacaauuacccaauuuggaaaaaggguuggggugcaguacuuguggcaaacgggauccacaggagagucgggauagaaauucgggucuugagaugcugcagguguauugauauuguuucaauguuggggugaguugguuuguuucauguuuggugggaggagggaguaaucugugcuguuguguucacauuaacauagggauagggguacccugggucuggaauucugucucucugaacaucuucuaaauuaaaugggcuauauggaaauguucuucuccagaugagcaagccucuuggcuuagaaaucugguaguuuggggagggggugggagggugacguuaugggaacagacuuaugauugcggaauuuaggggcaguuucagaguuuggcagggugagagcauuagccuauugcaguccaccuccaagccacuuucccucagggaccucucucuguucccucucuuuucuuuccaaguacacuuuuccuuccuuuaccugcuauguccaaauccugccuaaaauugcaccucaaaggagccgcaacuggaugggugggcagaaggaaagagacuuuuauugaagggaaaaagggagcgauuugccugaaguuaaaacuagagcuuuucucccccgucccuuaacguucuccagggauguuucgcagcauggaggggccuaggacaggauacucagcccucucaagacuuguuccugggugaagaaacagaggguuuaccucuaccaccacuuucucuggcuucacaugaucgugugucuuuggagauggaauucacuaucaaacccuguuugcucauauuauauccacgguaauccucuuaaacugugauugcggcuacaaagcucguggucuugcaaaagcuggcuagcaagauauaauugucccgcgaacaaaaccagccaaaacuuuucaaaaaacccuugcacccaguccucccccuuuccuaaaccuaauucucucgcucgcucucuugcuagccaccaccaccccccuccguaagaacccucagccucgaccacuuuuguugucgccaagagcacccggccuguugaaagugcuggagcgucuuugagcaguuuguugugauacgcagguggaauggucugcaaacagaugaauucagccccuccaaaccaagcgcggagcgcgcugcuuuugugcgccaggcacaaaacgcugaauuccuccgaacuuacuuggggccugucuagaaaagggucuuuucuucccucugcuuguaccucuggccacacuaagucucugcccgucccccuucaggcccccucccucuccucucugauaauccuucucuuuauuuuagaaaaacacaaaacccgguuccacgcggugcuuuaguggcuaaaagugaaagagcugccuuggcagaauucagcucuaugaaucacuucggaaaauugguucgacugaauggccuuaggaggaaaaacguuuuaauaggauccagggggagguucugcuguuucaaucugcuccuuaaacagguggagaugggaccuucucaauuauacaaacaguaaguacccaucagcugggagagcugcccuccgaauccuccccgcacgcagcccuaaaccagaagcagaacucggcuuugccucagaaacccgaucauaaaucaacaauucugaucuauuaggaucuccgaaagucuuccagcucucgguuuagucucccccagccucagacccagagcuggccauaaagcuggaggcgcaccugcgcggcgccgaggcccccgagaugccggcgagcggccuugcucuccgugacgcuucggggucguccuuagucagugggagcuuucucccgaccuccgacgccagccaaggcgagcucauugcuuuugcauaaauuaauauuuccccauuaacaaguuccccccuccaaacgcggcgcccgcguccaugcgccacauccuaaugagguaauuaucauuugcgcguguucggggcuggcgccgguuccguggguaaauggcaguuuauuagcacgaugcccagcucggcugcggagggcuaagggauacuucggcuacuagacugauacccaggggcccuuugggggcgccgcguccgggacccuccgcccuccccgcgucccccaaaccugcaggccuccaaaguugugaaucacgcacggaacucugccuagguuuggguuugggucccccccccccuuuccuuccaccggcaaaaccaucacgauuccucccccucccccucccgucucuucccucuuucccuauucgcaaaccgcucgcacuuucccgagaggagcgcgggcgccaguugccuccuuuuaaaguuugaggggcggugguggcggcggccggcaggcgcgggggaacacaggggccgcuacgggagccgcgccgccgcccaugucauuccacuucaagugacuucaugugaugucagcugaauguaaaagacagugaucucacgcggaggggaagauguuugccaucaaaaugugacagaagagacacgcugcauggcucggaacgcaucuccuugguggugggggaaagagguaaaugcgagguggcucuccgguccucuuuaacuuugccccuucacuguccagcucccagcacgcguggcagaggcccggguccagggaagggcucagggggguuaauuugagacucuuuucucaccgcccccccccuuuucuuuuguaaacccucccccuucuucccccuuucaaagucccagggcaggggcugguggguuccuuugcgcgccggguuaaugggcgguaauuugguacccuugggugcacuuuguuuugccccuguucauuugaaugcaaaugggugacccgggcccgacuaggugcuuauuaaauugcaguuuuccccccugccuuuuccggaaugcagacuuagaggagagaggcugcgcccuggcccagccuggcucggcucagcuccgcgcgccauggcaagcucggcuucccuggagaccauggugcccccggccugcccgcgcgccggagcgucgccggccacuuccaagacacuggccuuuuccaucgagcgcaucauggccaagacgucggagccccgugcgcccuuugagccccggccuggagcgcuagaggcggacggcagccagggcaagaaacugcucaaccucugcucgccgcugcccuguaugaucccccuccagccccuaggcuacgaggugccgucaaagacacugcucaguuacucggagcucuggaaaagcagccuccgggcgggcggcggcggaggcggcggcggcgguggcggcggcggcggcgggggggccccagugugcggcgccagcggcuugugcaaaaccaacuguggcgugugcugcaaggccgagcugggccuggcgccguccgcgcugcccgcgggcagggucaucaagccgcaggucaucaaccaggcuguggggcugccggccagcggcucgcucuacuacuucaacuaccuggacucgaccgcguacccgccgucugagcuccucagcggccaccucuucccgucuggccuccucaaugcgcaggcccccgccgcccuggcugcucaccccaagcucuuucugcuggagaacgccaagcuggccggccuggcugcggacaaguucccccacccggcucccuauccccauaaggagcgcuugccggcgccgcuggagcagguacugaaggaaaacucggcccugacugccgagcgcggaggcgucaagggccacagcaagcugccaggaggcuccgcagauggcaagcccaaaaacuucaccugcgaggugugcggcaaggugaggcccaggguucggcgaggggggccgggaggggcgaucggcggcggcggcuuccuuggggcagccuggaaugccccuuuuucaagcugaggagcuccccaguaguugacuacccaaacugggagccucguugggccucaguuuccuauucuguaaaauggggaugcccuugucagcggccacacaguauugguguaagcaggaguuugggcagcacuuuacaaacugaaaaaggcucugguuucugaaggggguguugguugggggagguaggcuguggcccccccggggcugauuguaggcccucggacagacgcaccacaaggccccccaugucuuuccauagguguuuaacgcucacuauaaucucacccgccacaugccgguccacaccggagccagaccguucgugugc

SEQ ID NO: 20839 - RNA, 2194 nt, Homo sapiens
aaagugcgcaggugcgcccagggcgccgagaggggcgcgcaggccuggagugugcgccugcccucucggugucggagagacgcccuuccaccucugggagccucggucuguuggggucgcggaguucgggcgcggcuccggguacccgagaccagcggcggcaacuucuaacacgggagauuucccgccaccccaccccgccgccgcgaguccucgcggggcguguugcgugcggaggucaggcugccacccucuguaguucccuaaccccaaacucggagacuucuaagagccacaccaccaaggaacuucuaguccuggaggucaaugguggggcaaaccucgccucaauucuuugacccccucgggucguaagcagggcuaagaggcugcgaagaagaggccuggccauggguguaugggggaagaaacaucucaggcucacucaugcccccuccccgaccuucucccaccugccgccauccccgcaggcuggggagccaggguaacucggggcugcucucucgaauuuauuggaacgccgagucggaaugagcugcgcuaggagagccgagggaaggagcgagagagggagggggcggcugccugugggaacgcggguucuuccagggaagcggagcgggacugccgcguuccccucgauuugcaccgucacucggguuguuugggaagaaaaggggaggcgcugugcgugccaccggguaccuggaccuggaugcccaguguguaugcaugccuguggcgcugcgugaguuaucggggcucugauagcguccggagcggguucgagggucuccuccaggaacucgcagaaauuagaggggguggggaggaggacacacccccuuccucggaacgacuuagaagacuuugaaucuccccuccuccgcuuuuccgccccggcucuucuuuuguugucaaguccuuuugauaaaugguggggcugggagcucugggagucgggagccagucugugcccgcguggggggcgggggccgagccuggagacccgguuucgaccggcgcgcaccuggggcugagccgggugcgcgcgggggucgggucuggaacugcccuugguaugcucgcccucuccucuuggcccaucucacuccccucccccaccugacuccccuccccggcuucuuucucugucucccacuccgcacggguaccgagaacuuuccggggugaguuuuagaauuugcuccuaggcauucuuuuucugcguuuggauuuuaucccuugauucuuuggguugguaaacuuuaugaaaugguaacuugacugaagcucauuuggagagaagaggggagugaggcggugugugcuuggggcugguguuugucagugugagcguguaagagcacaccugcauucaaggggguuuguaguguccgugcgacaucugagggaggugagucggcgagcggguggcgaggccccacgcugagggaggcgguugucuggucuccggggagcaagucccaggugcgcguuucggagggcgggacaguccuacgcugucucugcggggcagcgcgucugugaagcacucuuauccuucggguguguccaugugugccugguuacugagugcgcggccgucuaggugucgacccaaccaaugguagugcuccuaacgccgcgagcccaccuuugggccgcuaucgccgcggccuccccgcgaggcccgggcacugaaauucuggggccugcgacagggccgggggggacgcagccaagggcgucccuccccagccuccagacucagcucuucccccucuccucuaauuccagcagcuuauuacgccggcggcucaggggaggcagccucagcaccugaagccugggggggccguggaguggcuccugcgucccccgguguggccacacacgcucguggggcugcgcugugcugcgugggugcgggucguggucagcgugcguucgcuuuucucaaaacuccacuccgaggguccgagcgcaugggggcgccugggggccugcgcgcccggggcuuuugggaggcgccagcguccgagccugcgcaccucgcgcaggaggccaaacccccgaaggccggcgcgggcccgggagugggggccauuaauuacucugcgccaggccuaaagccuccaacccccagcagcaguuggcguggauguccugc

SEQ ID NO: 20840 - RNA, 2194 nt, Homo sapiens
gcaggacauccacgccaacugcugcuggggguuggaggcuuuaggccuggcgcagaguaauuaauggcccccacucccgggcccgcgccggccuucggggguuuggccuccugcgcgaggugcgcaggcucggacgcuggcgccucccaaaagccccgggcgcgcaggcccccaggcgcccccaugcgcucggacccucggaguggaguuuugagaaaagcgaacgcacgcugaccacgacccgcacccacgcagcacagcgcagccccacgagcguguguggccacaccgggggacgcaggagccacuccacggcccccccaggcuucaggugcugaggcugccuccccugagccgccggcguaauaagcugcuggaauuagaggagagggggaagagcugagucuggaggcuggggagggacgcccuuggcugcgucccccccggcccugucgcaggccccagaauuucagugcccgggccucgcggggaggccgcggcgauagcggcccaaaggugggcucgcggcguuaggagcacuaccauugguugggucgacaccuagacggccgcgcacucaguaaccaggcacacauggacacacccgaaggauaagagugcuucacagacgcgcugccccgcagagacagcguaggacugucccgcccuccgaaacgcgcaccugggacuugcuccccggagaccagacaaccgccucccucagcguggggccucgccacccgcucgccgacucaccucccucagaugucgcacggacacuacaaacccccuugaaugcaggugugcucuuacacgcucacacugacaaacaccagccccaagcacacaccgccucacuccccucuucucuccaaaugagcuucagucaaguuaccauuucauaaaguuuaccaacccaaagaaucaagggauaaaauccaaacgcagaaaaagaaugccuaggagcaaauucuaaaacucaccccggaaaguucucgguacccgugcggagugggagacagagaaagaagccggggaggggagucaggugggggaggggagugagaugggccaagaggagagggcgagcauaccaagggcaguuccagacccgacccccgcgcgcacccggcucagccccaggugcgcgccggucgaaaccgggucuccaggcucggcccccgccccccacgcgggcacagacuggcucccgacucccagagcucccagccccaccauuuaucaaaaggacuugacaacaaaagaagagccggggcggaaaagcggaggaggggagauucaaagucuucuaagucguuccgaggaaggggguguguccuccuccccacccccucuaauuucugcgaguuccuggaggagacccucgaacccgcuccggacgcuaucagagccccgauaacucacgcagcgccacaggcaugcauacacacugggcauccagguccagguacccgguggcacgcacagcgccuccccuuuucuucccaaacaacccgagugacggugcaaaucgaggggaacgcggcagucccgcuccgcuucccuggaagaacccgcguucccacaggcagccgcccccucccucucucgcuccuucccucggcucuccuagcgcagcucauuccgacucggcguuccaauaaauucgagagagcagccccgaguuacccuggcuccccagccugcggggauggcggcaggugggagaaggucggggagggggcaugagugagccugagauguuucuucccccauacacccauggccaggccucuucuucgcagccucuuagcccugcuuacgacccgagggggucaaagaauugaggcgagguuugccccaccauugaccuccaggacuagaaguuccuuggugguguggcucuuagaagucuccgaguuugggguuagggaacuacagaggguggcagccugaccuccgcacgcaacacgccccgcgaggacucgcggcggcggggugggguggcgggaaaucucccguguuagaaguugccgccgcuggucucggguacccggagccgcgcccgaacuccgcgaccccaacagaccgaggcucccagagguggaagggcgucucuccgacaccgagagggcaggcgcacacuccaggccugcgcgccccucucggcgcccugggcgcaccugcgcacuuu

SEQ ID NO: 20841 - RNA, 2402 nt, Homo sapiens
cccgcggugcacucgcugcucuucgcccuucgcccuggaaaaacggggaaaagagagaucaacccgaagagagaaagaacgggauacgugguggggggggggagcccgcgucuccccuggguuagucgcaccccuccagcucaccgcacagcaauaaguuccggggcgacuuucaccuauuuugcuccccguuuuugccgaacccuaaaaugaaaggacacaauuuggggcugacucuugcagcucagauggcgacuugugcguuuucagcggcaucucccggagaaaaagccaugcgcgccugauuguucuguggccccaaagcugcagcggggguguguguguuggggugugugucuguguguguacagagacguccacacuaacucgcggcugcaggaucagcgucuggaagcagacguuucggcuacagacccagagaggaggagcuggagaucaggaggcgugagccgccaagaguuugcagaaucuguggugugaaugaacugggggcaccugggcgcacagaucgccccccuucccccgccccgggccacaguugaguagugguacauuuuuuucacccucuugugaagaauuucuuuuuauuauuauuugucguaaggucuuuugcacaaucacgcccacauuugggguuggaaagcccuaauuaccgccgucgcugauggacguuggaaacggagcgccucuccguggaacaguugccugcgcgcccucgccggaccggcggcucccuaguugcgccccgaccaggcccugcccuugcugccggcucgcgcgcguccgcgcccccuccauuccugggcgcaucccagcucugccccaacucgggaguccaggcccgggcgccagugcccgcuucagcuccgguucacugcgcccgccggacgcgcgccggaggacuccgcagcccugcuccugaccguccccccaggcuuaacccggucgcuccgcucggauuccucggcugcgcucgcucggguggcgacuuccuccccgcgcccccucccccucgccaugaagguagguguucagugcgcugccacuuuuuuucuuuacuuccccccacccccuguuggaaguuaacugaguucccuucgccucuuccuaucccuccauuuccccaaccgccugaagaagcuggaacuccagcgucgcuggcaggaaccccuaccccuucgcccuccacgccgggcgcacugccucagugucccaggagaucacuucuggucgcaccacccguucugcaaacaauuuugauuuuugagaaaaaguggggaagagcgauaguagacaaacugagugcgguucacugacgacuuuccuuuugcucugagaacaucgaguguaauuuacuauguauauuucaguaacaggauaaugauucaauucaacaaauauuuaccaagcgcccacugcgcgggcaccgggacgguguguggccggggcucgggauggggaaagggacuccuugguugagagaacccgcagaggaacuaggggccaacuacuccagagcggcguacaccuuccccgacacccccccgcaccgacggaggccagauuguaggcuugccuuggccgaguaacucgagcgcuucaggccccuuugccuuuaagagugccuggcggggggccagcgcgcaccccggcgcggggagcggggucgcguuauuagcauuauuagccgccacugggugagcucaggcacuuugcagcaguggugggggcggggaguuguggugguaguggcuguaaucccguacuccgggacagcgcuccccggcccccugagcggaguccgccuuguccuuuagaaaacacuugggccuccgcuuugggagagcaggcgggggccaguuugcgaacucuuguuuguuuuaauugucaguuguauguuaaagccgaaucacacacuccgagggucacugagaguucacuuuuacgaaaaguuaacguuucuuccugcaacauaaguuuuuauuuucuaaacaauuuuucuuaucuguccuccaagcuucgauuccuauuuccauuuuucuggucuuucccauuuuaaguuucuuagaaaauaagguuagaauugaaauuaagauguuuccuggaagcaaauaaccccucuuccccccaaaaaguuaaaaaaaacaacaacaaaaaacuucaagucuggagaccccacggcccuguuugacuuucuaaucccugucugguaucgaggccccuucuccucucucgccucucuuuucucucuucucucuuuaaauggguaauucgcuguuuggaaguaacuugggccuugcggugaggucgcaccuccucagccccugcccuccccccagccaccuucgcacauucacugccgaaccagccagauuuaguuu

SEQ ID NO: 20842 - RNA, 2402 nt, Homo sapiens
aaacuaaaucuggcugguucggcagugaaugugcgaagguggcuggggggagggcaggggcugaggaggugcgaccucaccgcaaggcccaaguuacuuccaaacagcgaauuacccauuuaaagagagaagagagaaaagagaggcgagagaggagaaggggccucgauaccagacagggauuagaaagucaaacagggccguggggucuccagacuugaaguuuuuuguuguuguuuuuuuuaacuuuuuggggggaagagggguuauuugcuuccaggaaacaucuuaauuucaauucuaaccuuauuuucuaagaaacuuaaaaugggaaagaccagaaaaauggaaauaggaaucgaagcuuggaggacagauaagaaaaauuguuuagaaaauaaaaacuuauguugcaggaagaaacguuaacuuuucguaaaagugaacucucagugacccucggagugugugauucggcuuuaacauacaacugacaauuaaaacaaacaagaguucgcaaacuggcccccgccugcucucccaaagcggaggcccaaguguuuucuaaaggacaaggcggacuccgcucagggggccggggagcgcugucccggaguacgggauuacagccacuaccaccacaacuccccgcccccaccacugcugcaaagugccugagcucacccaguggcggcuaauaaugcuaauaacgcgaccccgcuccccgcgccggggugcgcgcuggccccccgccaggcacucuuaaaggcaaaggggccugaagcgcucgaguuacucggccaaggcaagccuacaaucuggccuccgucggugcgggggggugucggggaagguguacgccgcucuggaguaguuggccccuaguuccucugcggguucucucaaccaaggagucccuuuccccaucccgagccccggccacacaccgucccggugcccgcgcagugggcgcuugguaaauauuuguugaauugaaucauuauccuguuacugaaauauacauaguaaauuacacucgauguucucagagcaaaaggaaagucgucagugaaccgcacucaguuugucuacuaucgcucuuccccacuuuuucucaaaaaucaaaauuguuugcagaacggguggugcgaccagaagugaucuccugggacacugaggcagugcgcccggcguggagggcgaagggguagggguuccugccagcgacgcuggaguuccagcuucuucaggcgguuggggaaauggagggauaggaagaggcgaagggaacucaguuaacuuccaacaggggguggggggaaguaaagaaaaaaaguggcagcgcacugaacaccuaccuucauggcgagggggagggggcgcggggaggaagucgccacccgagcgagcgcagccgaggaauccgagcggagcgaccggguuaagccuggggggacggucaggagcagggcugcggaguccuccggcgcgcguccggcgggcgcagugaaccggagcugaagcgggcacuggcgcccgggccuggacucccgaguuggggcagagcugggaugcgcccaggaauggagggggcgcggacgcgcgcgagccggcagcaagggcagggccuggucggggcgcaacuagggagccgccgguccggcgagggcgcgcaggcaacuguuccacggagaggcgcuccguuuccaacguccaucagcgacggcgguaauuagggcuuuccaaccccaaaugugggcgugauugugcaaaagaccuuacgacaaauaauaauaaaaagaaauucuucacaagagggugaaaaaaauguaccacuacucaacuguggcccggggcgggggaaggggggcgaucugugcgcccaggugcccccaguucauucacaccacagauucugcaaacucuuggcggcucacgccuccugaucuccagcuccuccucucugggucuguagccgaaacgucugcuuccagacgcugauccugcagccgcgaguuaguguggacgucucuguacacacacagacacacaccccaacacacacacccccgcugcagcuuuggggccacagaacaaucaggcgcgcauggcuuuuucuccgggagaugccgcugaaaacgcacaagucgccaucugagcugcaagagucagccccaaauuguguccuuucauuuuaggguucggcaaaaacggggagcaaaauaggugaaagucgccccggaacuuauugcugugcggugagcuggaggggugcgacuaacccaggggagacgcgggcuccccccccccaccacguaucccguucuuucucucuucggguugaucucucuuuuccccguuuuuccagggcgaagggcgaagagcagcgagugcaccgcggg

SEQ ID NO: 20843 - RNA, 817 nt, Homo sapiens
aagagccgcgcggcuuucgccuuugcuggucccgcgccaccgcuggggcgggcugcgaaaggguugggaagagcaaaggguuuuuuuguuuuguuuugagacgcagaagcccuuuaaaaagcccggcgaggagagguccagaaguagagaaagcagacggaggcaagcugugcccgcggggcaaagggacaguagaaggggcgggcgcccggguuccccggaaaacccucggccccaaggaaucuccuggggcgggagagcgcgguucuaaaaccgagaggauaggaaggggaagggggaguuguguuucaauuucggauucaccaggauucaucucuagucacauuuuucuucucaaauuuuuaaaucgaaaagauaaaagccaaaagaacuuucauccccagagcuuuuuauugggggaaaggaauguaacucggggugguuguccuucacuucccuacucgaaucuucuccuaaugccgaaauguguuuacagguagccucaguuuaccaaguauguaucuuuuggggguuuaaccucucacaaagccuucaacucacaaaccgcgauccuuggaaaccauccuccaaagcagugcuuggaggccucuaaggcccccggaccaacucccgcuggaagaagccugcagggacucgggaaucacgggaaccuuucccgucgguuccgggccuggagggccaggaagagccgcgcguccgccuuucgucccgccaggaacuccccauaggacacgacaccgcaggaacaagcguccugggagccccugggaucuuggcugucgucucuagggacccu

SEQ ID NO: 20844 - RNA, 817 nt, Homo sapiens
agggucccuagagacgacagccaagaucccaggggcucccaggacgcuuguuccugcggugucguguccuauggggaguuccuggcgggacgaaaggcggacgcgcggcucuuccuggcccuccaggcccggaaccgacgggaaagguucccgugauucccgagucccugcaggcuucuuccagcgggaguugguccgggggccuuagaggccuccaagcacugcuuuggaggaugguuuccaaggaucgcgguuugugaguugaaggcuuugugagagguuaaacccccaaaagauacauacuugguaaacugaggcuaccuguaaacacauuucggcauuaggagaagauucgaguagggaagugaaggacaaccaccccgaguuacauuccuuucccccaauaaaaagcucuggggaugaaaguucuuuuggcuuuuaucuuuucgauuuaaaaauuugagaagaaaaaugugacuagagaugaauccuggugaauccgaaauugaaacacaacucccccuuccccuuccuauccucucgguuuuagaaccgcgcucucccgccccaggagauuccuuggggccgaggguuuuccggggaacccgggcgcccgccccuucuacugucccuuugccccgcgggcacagcuugccuccgucugcuuucucuacuucuggaccucuccucgccgggcuuuuuaaagggcuucugcgucucaaaacaaaacaaaaaaacccuuugcucuucccaacccuuucgcagcccgccccagcgguggcgcgggaccagcaaaggcgaaagccgcgcggcucuu

SEQ ID NO: 20845 - RNA, 896 nt, Homo sapiens
gcgaaaauaaacaaaaaucuccagcuuagaggcuguuuaaacacauaugcgacagcuuuaaaauacaguuguauauguguuuaaacagccucuaaacuggagauuggagauuuuuuguuuaaucguacuaccuugcaaaauucugaacuacagugcuauagagaaucguaaaaucauaucagauguacccuugagaaauauggaaauguucuuacauguagagcucucacccaauuagaaaugccugacacaucauacaauaaaguagcacauuccaacauaaaaagccaguaacacacagaaagcaccagggccgagauccuuccaggggcuccuuugcccuuaccauugcaaaauggcuaaaauucucaaaauagacuauuuucacuuuugcuccuggauccaccuuuaaaaggaaaagaggaaaaccaaaacccaaaacuaagagauucucuccacaaccggccuagguaugcacucugcauagaaggcaugggcccuucaaucuaacuuucaaagcucuuuuccucucgaagcaggguccagaacggggaaaagaaauaacuuuugaaaaauccacgccucacuaugacugcucacgagguggccucuggagaacucauaccuagaagcugaccgcggucgcgcggcgaguuccggcagccggucggcgaccgcaccuccgggcgcgagugccugggucccgcguuccugcccggcagccccgcagccccgcagccccgcagccccgcagccccgcaggccuggcgcccgaggucccgcuccacugcccgcgccccccgcgcagccuuauaucuaacggucaauucgugcaaucugucgcuucucccucccccacgccuuguuuuuuuuuucuuccaagaagcccaucuacc

SEQ ID NO: 20846 - RNA, 896 nt, Homo sapiens
gguagaugggcuucuuggaagaaaaaaaaaacaaggcgugggggagggagaagcgacagauugcacgaauugaccguuagauauaaggcugcgcggggggcgcgggcaguggagcgggaccucgggcgccaggccugcggggcugcggggcugcggggcugcggggcugcggggcugccgggcaggaacgcgggacccaggcacucgcgcccggaggugcggucgccgaccggcugccggaacucgccgcgcgaccgcggucagcuucuagguaugaguucuccagaggccaccucgugagcagucauagugaggcguggauuuuucaaaaguuauuucuuuuccccguucuggacccugcuucgagaggaaaagagcuuugaaaguuagauugaagggcccaugccuucuaugcagagugcauaccuaggccgguuguggagagaaucucuuaguuuuggguuuugguuuuccucuuuuccuuuuaaagguggauccaggagcaaaagugaaaauagucuauuuugagaauuuuagccauuuugcaaugguaagggcaaaggagccccuggaaggaucucggcccuggugcuuucuguguguuacuggcuuuuuauguuggaaugugcuacuuuauuguaugaugugucaggcauuucuaauugggugagagcucuacauguaagaacauuuccauauuucucaaggguacaucugauaugauuuuacgauucucuauagcacuguaguucagaauuuugcaagguaguacgauuaaacaaaaaaucuccaaucuccaguuuagaggcuguuuaaacacauauacaacuguauuuuaaagcugucgcauauguguuuaaacagccucuaagcuggagauuuuuguuuauuuucgc

SEQ ID NO: 20847 - RNA, 857 nt, Homo sapiens
augggggaggggagugguaccgcagugacaggaauaaugccacuguccugcugagugggaaaggagagggcagaacccggacucgaaggcccaccuguggagugggucugagauucccagccugugugucucggucagcuugucuauuguuaucagaugugggcugugccgcagcaucugugacuucaucccgugguggcuggagucugggauaaaagucaugguugucccaaaggugcaggcaaacuccaccccggggagcuguugugcuugcauugcugggcugcugauagacugauugagugguggcguguacuuuugucacaagaaccauaaccacaaugacagccacacagcauggaccuagcgugugcucagcucuggacaagacauggauguaggcagacaugcuuccugccugcugggcuuagugcaccaaugcuaaggacagacaugaagggcuugggaaaggcaugaagaugcagggagucuaggagagaggauaagaaaaacaagcauuuugugguggguugaauugcguugucguuuuuagaggcauuucgugauccaugguugcgcucccgugaagagcgagucuagagaaggaauccgaaggugggugagaguugagggaauuugaauuccauaauuacgacucgaauuucugcaaucagcucgcggcuguguugccugcuccugccacaaaaacgccaugcagcgccgagccaagucggauggaaguggguuaggguauuauauaagcccuugcgggagggaagauggucuuuuauguguguuucuuuugcagcggcggcggcgagcgcggcucagguugauuuagaauacgggugacagug

SEQ ID NO: 20848 - RNA, 857 nt, Homo sapiens
cacugucacccguauucuaaaucaaccugagccgcgcucgccgccgccgcugcaaaagaaacacacauaaaagaccaucuucccucccgcaagggcuuauauaauacccuaacccacuuccauccgacuuggcucggcgcugcauggcguuuuuguggcaggagcaggcaacacagccgcgagcugauugcagaaauucgagucguaauuauggaauucaaauucccucaacucucacccaccuucggauuccuucucuagacucgcucuucacgggagcgcaaccauggaucacgaaaugccucuaaaaacgacaacgcaauucaacccaccacaaaaugcuuguuuuucuuauccucucuccuagacucccugcaucuucaugccuuucccaagcccuucaugucuguccuuagcauuggugcacuaagcccagcaggcaggaagcaugucugccuacauccaugucuuguccagagcugagcacacgcuagguccaugcuguguggcugucauugugguuaugguucuugugacaaaaguacacgccaccacucaaucagucuaucagcagcccagcaaugcaagcacaacagcuccccgggguggaguuugccugcaccuuugggacaaccaugacuuuuaucccagacuccagccaccacgggaugaagucacagaugcugcggcacagcccacaucugauaacaauagacaagcugaccgagacacacaggcugggaaucucagacccacuccacaggugggccuucgaguccggguucugcccucuccuuucccacucagcaggacaguggcauuauuccugucacugcgguaccacuccccucccccau

SEQ ID NO: 20849 - RNA, 545 nt, Homo sapiens
ccggcucugucuaaaaagaaccccggcgugguggccuaccaaggaggcggggaagagauggccagcccggacgagguggacgacaccuaucuacaggaguucugggacaugcucucccagaccgaggagcagggacccgagccccaggagggcgcggcuaagguggcagcugcgcuggaaaccaagguggugcccgagacccccaaagacaccagguguguggaagcggccaaggacgcguccucggucaagcgcaggaggcucaaccggauucccaucgagccccauccuaaggaggagcccaagcacccggagaaggagcagcaggaaggcguccccaacagcgacgagggcuacugggacuccaccacgccaggcccagaggaagacagcucgagcagcgggaagaaggcgggcaucccccgggauagcuacagcggggacgcgcucuaugaucucuaugcugacccggacggaaguccagcaacccuuccuggagggaaggacaacgaggagacguccucccugucccgguuaaagcccgu

SEQ ID NO: 20850 - RNA, 545 nt, Homo sapiens
acgggcuuuaaccgggacagggaggacgucuccucguuguccuucccuccaggaaggguugcuggacuuccguccgggucagcauagagaucauagagcgcguccccgcuguagcuaucccgggggaugcccgccuucuucccgcugcucgagcugucuuccucugggccuggcgugguggagucccaguagcccucgucgcuguuggggacgccuuccugcugcuccuucuccgggugcuugggcuccuccuuaggauggggcucgaugggaauccgguugagccuccugcgcuugaccgaggacgcguccuuggccgcuuccacacaccuggugucuuugggggucucgggcaccaccuugguuuccagcgcagcugccaccuuagccgcgcccuccuggggcucgggucccugcuccucggucugggagagcaugucccagaacuccuguagauaggugucguccaccucguccgggcuggccaucucuuccccgccuccuugguaggccaccacgccgggguucuuuuuagacagagccgg

SEQ ID NO: 20851 - RNA, 709 nt, Homo sapiens
gcccagacgcccgcccaggcggggugggggaggcugcaccggcgcucaggucgccgcagcggcccggcagccgccgcagugaugucaaccgcauccgccgcaguccccggcagcccuaaaacgcgccgcggcccgcggaaaccccagcccggcuccucccgccagggccgaggaggagaggacgcgcggguccccggagucccccacuccgucugccuaagccguggagaccgggaguggacgcacggcggugccuggacccccggggagguggaagaagaggagagggaagggagcuguggagucaggugucgauuugacgcccgcggccgccgaggggacucugcccggcacuggugccgccuggggggcguucagggagcguggggcgccgaccgcugcagaugcggcggcgcgcgugggcucgggcaggcgcccccuuuucccgggauagaaacggauaaacggaagcgcgugugagugugggggugcgaaucgccaccuccggccuuggcuuucccgcucuuccgagcucucccacuucucacuuuccccaaauccgcauuuuccuuggcacagcucuccccgagcacgaaggagagggagguacccgggggcagugagaaugacgugugcuggugcagagggggugggggucugcgggccuggaucuguggacgggcuccuaauccucuuguuuucggaaccg

SEQ ID NO: 20852 - RNA, 709 nt, Homo sapiens
cgguuccgaaaacaagaggauuaggagcccguccacagauccaggcccgcagacccccacccccucugcaccagcacacgucauucucacugcccccggguaccucccucuccuucgugcucggggagagcugugccaaggaaaaugcggauuuggggaaagugagaagugggagagcucggaagagcgggaaagccaaggccggagguggcgauucgcacccccacacucacacgcgcuuccguuuauccguuucuaucccgggaaaagggggcgccugcccgagcccacgcgcgccgccgcaucugcagcggucggcgccccacgcucccugaacgccccccaggcggcaccagugccgggcagaguccccucggcggccgcgggcgucaaaucgacaccugacuccacagcucccuucccucuccucuucuuccaccuccccggggguccaggcaccgccgugcguccacucccggucuccacggcuuaggcagacggagugggggacuccggggacccgcgcguccucuccuccucggcccuggcgggaggagccgggcugggguuuccgcgggccgcggcgcguuuuagggcugccggggacugcggcggaugcgguugacaucacugcggcggcugccgggccgcugcggcgaccugagcgccggugcagccucccccaccccgccugggcgggcgucugggc

SEQ ID NO: 20853 - RNA, 7169 nt, Homo sapiens
ccauuucagagcuccucgagaucuucaauuaucuagcgaguuccgcgauccaucccagcacgcggccacgcagcgaaccgcacuugcauucggggugcgcccuacucacugccgcgcgcagcgcggagcccccagcacagccuccuaggaaugaagucgcauucucucccugggugagaccccgcucagugaccuacggugcccucugacgcccgcgugcaccaaacagcuuccaaagcgcuuuucucacaugcaauuccaugcggaacaaacaaaaagcuuaucacccacugagcgauccagucccugugccaggcaaaggagcugcaaggacaagcgagucagaaucccugccucaggagcgcauaggucgggggaaaggaaacccauccccauaggagacucaggacccagugaauuccauaagcagaugugaucauccucaucuuacaccugcagaugcugaaggaaagcaagcguuuauugaacaccuacugcgugccagauacuuucaccuaagcugucuuauccguaaggcaagcaaagcucugaggaauaaauauccccauuuuaccaguaagggagcugaaauucagaggaauaacauucccauuuaacuggcuaggaaaccgagguucagaggaguaacaacaaaugccagagaccuuauuaguaaaugccagccucuaaccugggucugcggacaccaaaguuucuccuucgagugaggacaacagaaacgaccgaacuugcccggguucagauccacggaaaguggacaucacggguugugaggguuucugggcauuuaguccagcgaccccuacgcggcgaggccagcauugcccuauaaacguugcucuaagcacuuaccgcgcggggugacugucugaacgcagugacccccaagcccugugacccccaucugcucuccuuugggagaaaagaguaaguggaaguugugucccccuucgagggugguauggagcugcccggccaggagagcgaucucuguuuucccagcuggcucugagguuuuccgugggugccaugucccgugcgcccuggacccacuggcgccccgaaaugauugcccggcucgcggcaggugaggggguggggguggaagguuccgugagccagaaauggaauuucuaggccuugggcuguguuuggagagaucccaugauuagaaguccaguuugcaccgucaaagacuucuugaaauccgugcacucuaugcaagugacuuuccuggauuuucucucuugccaccugagugaggugugccaguguagguggaggugaucgugauggugugcgagugcguguguguguuggaggaggagguugccuagugcuaaauggaaugaaauucuagauggugccauauuugcagcugacccccgccgccaaagucucccccauccucaaauccgggaggcgggagucgcggugacuaguauauuaugaggaagaaaguuggaucugaaagccaaggguguuugugggggccuggaggaaaaggcagccggguuggggguggguaggcagcagugagcgggagacuuuugucaccccucccuuauccgaggagggccccgggcgcgcggggcgcugcuugcgugcggggccgagugagcgcuugugcauguggguacgucaguguacgugugaaauguggcggcgccggccgcagcagaguaugcgcucgguaaaaauaugaauaaucaacacaucgcucacaccuccgccgcgauccgggaaggagcugggaggucccucgggcuuuccccugccggcuggcgggcaccaccaggaaaaggggggcauuucagaguagcucuucgguuaucacugagcuaagaagccggaaaaaaagaaaaaagaaaaaugucauauuuaacuuuuucuuucugaaggccuucuguugcacccuauuguugaguauuagaaguggaagaucggggaggauccuuauuccccauuuagcagcugggaugccacuugucaucucccacccucauuuuguucaucuguaaaaugggggcaaacaaaucaauaaauuccacuggaaguguugcugugaaguuuaagggcgagaaagggccugggcaaguccugccucugaucguuaguaccuuccucuuggucuuccguuucacggagaccagcaugauuaggccuuuuaaugcgggucaacuugcccugaucgcugcaccguaaauagugaugacagaugccaccgccuucgugcacaguucccugaaaggggcuguaaucggccagccgauuuaccccagcaaggcccccagcaggggcuucacgugaaagucaccccucccaccugggaaaucggguccccagguucgcguggaagcuaucaaucacuucccuauacagacagccuguuccgcagcacacacaccucccgggccucuauuuccgcguggucacccgcgcuccccaagcugcugcugcgagaauuuguucucuugaccuuuccgcuuugcuuccucgcucguucugcacccggaauaaggagaugggaaagagggauauuucugaaggagaauaccagggggaggaggagcagaggagaggaagacgaggaggaagacuuucuggaguugccaaguguuaggguagcggugaaucuggcuccuccagucuauuuuggguaaacuuacugcagugccccgacuggccuggauacaaccgacaucaagugucucuaaaacguuccuccacgacucaguauuucugcagcuguugccgcugaaucuccuucacuaugcgaaaacaaaagaagcgaauccacuucuuacccaaauuguccuauaagggagcuguuugguauugacggcggagucccccugagauauuugucgugcauuuaugauuaguuucuuuucucccacccucucuagggaauuugcauuuauagaacauacaaaucuaguuuccggaagaaaaugccaaaguugcaauuuggugugagaguuaauggaguucgauauuuaaaaaaagcauuucauaaagaauugugaguuaaauauucggcaggucucugauaugccaaguaaagcuauuucuuuguagucggacaaagaguaaaaguuccagcuuaaaaaauaaaaaacccaaaauuguaaaauucacguucgaagacaggccagggggacagccacuuuuuccauuuauaaaacccagacuggcucucccugugaaucgaauuccccggcuacugucuggcucugugcuucggcgcagggggugugugucuggaagagggggugaaggucguauuuagggguguguucugacaucucugaauucaccccaguguccugccggacaggaacacagccaggagagcaguuucuaaguaaaauuuccgaaccucugaucgggaggagagacuuggcgcccagaugacuggaccggacgagauugagcaaaggggcuuaaaaccaauuaaaaggaaaucgaacauaccgcacuggguugcagacgugaaacagaaacaugaaaaaaacgggggugagggucauuugggaaggguaaaugaagaaggggacaggguaaaagacagacacccccaguuuuguauaaauagauugugaauaauuuuaaucauaguguucauuuuggauuuuucuugacccgggcuagaggcagaaccgagcuaguuggccggagccugaggagcgcgugggcuccgcagucccgcgggauugggcuucccggggccgcagcugcgcuugccaggcccccgcacagcucggggcagguuuuguguugcacgagaucgaaaaggagguuuguuuggggguagcuggaggcgacagaggugggagcaacccuccaggcgcagccgccgcugcucauucccccaaccaacgcauguuucgcgcggguggcggacuccgcgagcauuccuacccaaaaccuauacagacgcaauuaaccccaacuggguuggccgaaacgccgccacgcugggcccaaggcaguccuuguccccucacgcucgcgcaggcacuucagccuggccaacagggaacuucaacgcccgcagcgagccacacagccaucccuggagcucccagcagcacugccgcggggggcgcccuuagcgcagccggcaaguaguggggaagccccacucugucaaaguucgggaccacggcucccccaaauugccucccagcggggcaccgaggccccugagcgcgucucgggggguuggcugggaggaggggcgcccgccgagcgcggccccgucuguuuuggggcgggcagcagggagcugggagaaaggaacaauucauucgcuuccugagggggcauaauuuggguggcagcuguuaccgccgagaaaagcuggugcccucgacccugacuuugcccuuuaaccccagccaaccugagccugagggguaaacuguuggggcuuggcccaggcccacugcugaccagaggccucuccgggugcccugcgcaccuuuccggggcaacguggagguacagcugaucaaagcccccuugaaaaaaaaaucaccgggcucauaggcaugucuugaagggcucacggcuguuccacacucucugccaaggaacucaaggcuuuggccccgcugggcgcagaccccagacgaagggggugggggggaguugcuugagguucggagagauuuauaaagagagaccguagaagacuccaggugaucaguuuuugcugggaccgaaauucuccguaaaaccugcauguaacagagaauugccgaguugaaacagggcagugaaucucaucccuacaaauuucccucccuacccccuucuuccuuuggacacuccugucuuacuuggcuuuuacuagccacccgauccauuucccaaucgcccuguauggcucucccgccccuuccaguccaacagggaggaccaagccagagcucuggggucgggguaccacagucaacacaacccagaggcgggggguuuaccuucucuaccuucccccaaaucaaugaccccagucccuggaucccggggccugugcagagacgguccgugcacccgccccgcaaacucccuaacccccuauccguuuucaagcgaaucuccgcaguucggaccagcacuuccuagucgcaaucccgcgcacgcagcguggugccgcgguuugucccuuggggagguggaggcgcgcaccggucccuuucucgagagagccgaguuuucuugaagugcaagcuuccugucagccuaggcaaaccaguugcaaggcgcuguguccucuagcggcaaacucuagcaguucauuugcgagcgcucaccuacaccuaagggaucuggucucucaaaucugagacccaagaggggagaaagugcccugaacgcaguccaggcgcucgcaaaugcccuccccguaaugagaccgggagacuggggcgcaaucgcucgaacuacgaacagcugauugucuccuccacggcagauggucuuugagcacagauuugcauucauugucuucaaaucuguuuucgcgcugguguucuagauuucagcagcagcagaucuaugcgcagaucagaauacaaaaggagaagcaagaaaaugacacccagccaggaggauguuuaauaggcaccgcgagcagccccgcgcaguuaaaaaaccgucuaggguuucagcuguucggugaggcugcugccaccgccugccggccaccagcccgcggccagcaccgcggcgaccgcgcgcggugggcgaaguuuccacgacucccccgucccuccccgcccacuaccgggggcuucgggaacggagagguggggagggaaccggaggacccgcgggaauacuccccggccgcucgcgcacucagcccgccucgaucugucagcaaccucuccuccacacgggugcgacugccgcucgcgcccgcccgcccgcggguguuuuccuuagguccuggaccguuuuccccagcacuguauuugagcagcacuugccccucgcuuguccgccccaccccaucccccgccuucuuucauauguucuccacucucagcaacgugcaagccgcacacaacaucugauaucaccauggaacuccaggagaccuggggagccauucagggagcugggugcucugggggacguuugcgcaaaacauaagcacauguggccacgcucacaagcaugcacacagauccgaaccccgggaacgaacgugccucccggcaggcuacaaaagccuacaucuagaggcaggauccagggaggcuucccgcagccaggccgaaccccugcguccccagcccgcagagaccugcuacccuaagucagugcagggugugggggccccccaauccugcgcaagcacacgggguucgugcuaggacucgacgcccgcagcuuucuguccccuuucaccucccggagucccggcaacgcagagcguggcgcgcgccgccggaggacgucggcccggcuugccaggcgccggccaaucccgcgcguccaugcaaaugaggcuccuuaucgggccgcagcuccgccucccgcagccagggccguaguaacccauucauggggcccgcgcgcggcugcagccgggcuccguggcgcucgcagccaccgccuccucucggcuccaggucuuccccuucuuuuuacaacugauccuguuggggauuuuuuuuuuuucuaaauuggaacgguggggaggagcagggaggggggaccuggaggaaggggagagauuaggcagccaucaauuuccuccaguuucucccagaacaggugaugcuucuaaauugugaucacuuucaggaggcagcacugcagcuggaaggaugcgagcgaccuaggguggaguggcugaggcggcagaucugaacuugcggaggauaagaacccaaacuuugacuacaucaguccgcaccucgccagugaagcaaaggacggguuaucuuuuuuuuuuuucuaagacucaaacuugggcacuugaucccuuuucuuggauugcuuuggaggagacgauuugcuggcaacguugggaacagucaggacuguguuguaacucuuacuuuuaaagcgacaguagaggaucagacuuuuuaaauguuuggaauucaagauacuuuaggaagaggacc

SEQ ID NO: 20854 - RNA, 7169 nt, Homo sapiens
gguccucuuccuaaaguaucuugaauuccaaacauuuaaaaagucugauccucuacugucgcuuuaaaaguaagaguuacaacacaguccugacuguucccaacguugccagcaaaucgucuccuccaaagcaauccaagaaaagggaucaagugcccaaguuugagucuuagaaaaaaaaaaaagauaacccguccuuugcuucacuggcgaggugcggacugauguagucaaaguuuggguucuuauccuccgcaaguucagaucugccgccucagccacuccacccuaggucgcucgcauccuuccagcugcagugcugccuccugaaagugaucacaauuuagaagcaucaccuguucugggagaaacuggaggaaauugauggcugccuaaucucuccccuuccuccagguccccccucccugcuccuccccaccguuccaauuuagaaaaaaaaaaaauccccaacaggaucaguuguaaaaagaaggggaagaccuggagccgagaggaggcgguggcugcgagcgccacggagcccggcugcagccgcgcgcgggccccaugaauggguuacuacggcccuggcugcgggaggcggagcugcggcccgauaaggagccucauuugcauggacgcgcgggauuggccggcgccuggcaagccgggccgacguccuccggcggcgcgcgccacgcucugcguugccgggacuccgggaggugaaaggggacagaaagcugcgggcgucgaguccuagcacgaaccccgugugcuugcgcaggauuggggggcccccacacccugcacugacuuaggguagcaggucucugcgggcuggggacgcagggguucggccuggcugcgggaagccucccuggauccugccucuagauguaggcuuuuguagccugccgggaggcacguucguucccgggguucggaucugugugcaugcuugugagcguggccacaugugcuuauguuuugcgcaaacgucccccagagcacccagcucccugaauggcuccccaggucuccuggaguuccauggugauaucagauguugugugcggcuugcacguugcugagaguggagaacauaugaaagaaggcgggggaugggguggggcggacaagcgaggggcaagugcugcucaaauacagugcuggggaaaacgguccaggaccuaaggaaaacacccgcgggcgggcgggcgcgagcggcagucgcacccguguggaggagagguugcugacagaucgaggcgggcugagugcgcgagcggccggggaguauucccgcggguccuccgguucccuccccaccucuccguucccgaagcccccgguagugggcggggagggacgggggagucguggaaacuucgcccaccgcgcgcggucgccgcggugcuggccgcgggcugguggccggcaggcgguggcagcagccucaccgaacagcugaaacccuagacgguuuuuuaacugcgcggggcugcucgcggugccuauuaaacauccuccuggcugggugucauuuucuugcuucuccuuuuguauucugaucugcgcauagaucugcugcugcugaaaucuagaacaccagcgcgaaaacagauuugaagacaaugaaugcaaaucugugcucaaagaccaucugccguggaggagacaaucagcuguucguaguucgagcgauugcgccccagucucccggucucauuacggggagggcauuugcgagcgccuggacugcguucagggcacuuucuccccucuugggucucagauuugagagaccagaucccuuagguguaggugagcgcucgcaaaugaacugcuagaguuugccgcuagaggacacagcgccuugcaacugguuugccuaggcugacaggaagcuugcacuucaagaaaacucggcucucucgagaaagggaccggugcgcgccuccaccuccccaagggacaaaccgcggcaccacgcugcgugcgcgggauugcgacuaggaagugcugguccgaacugcggagauucgcuugaaaacggauaggggguuagggaguuugcggggcgggugcacggaccgucucugcacaggccccgggauccagggacuggggucauugauuugggggaagguagagaagguaaaccccccgccucuggguuguguugacugugguaccccgaccccagagcucuggcuugguccucccuguuggacuggaaggggcgggagagccauacagggcgauugggaaauggaucggguggcuaguaaaagccaaguaagacaggaguguccaaaggaagaaggggguagggagggaaauuuguagggaugagauucacugcccuguuucaacucggcaauucucuguuacaugcagguuuuacggagaauuucggucccagcaaaaacugaucaccuggagucuucuacggucucucuuuauaaaucucuccgaaccucaagcaacucccccccacccccuucgucuggggucugcgcccagcggggccaaagccuugaguuccuuggcagagaguguggaacagccgugagcccuucaagacaugccuaugagcccggugauuuuuuuuucaagggggcuuugaucagcuguaccuccacguugccccggaaaggugcgcagggcacccggagaggccucuggucagcagugggccugggccaagccccaacaguuuaccccucaggcucagguuggcugggguuaaagggcaaagucagggucgagggcaccagcuuuucucggcgguaacagcugccacccaaauuaugcccccucaggaagcgaaugaauuguuccuuucucccagcucccugcugcccgccccaaaacagacggggccgcgcucggcgggcgccccuccucccagccaaccccccgagacgcgcucaggggccucggugccccgcugggaggcaauuugggggagccguggucccgaacuuugacagaguggggcuuccccacuacuugccggcugcgcuaagggcgccccccgcggcagugcugcugggagcuccagggauggcuguguggcucgcugcgggcguugaaguucccuguuggccaggcugaagugccugcgcgagcgugaggggacaaggacugccuugggcccagcguggcggcguuucggccaacccaguugggguuaauugcgucuguauagguuuuggguaggaaugcucgcggaguccgccacccgcgcgaaacaugcguugguugggggaaugagcagcggcggcugcgccuggaggguugcucccaccucugucgccuccagcuacccccaaacaaaccuccuuuucgaucucgugcaacacaaaaccugccccgagcugugcgggggccuggcaagcgcagcugcggccccgggaagcccaaucccgcgggacugcggagcccacgcgcuccucaggcuccggccaacuagcucgguucugccucuagcccgggucaagaaaaauccaaaaugaacacuaugauuaaaauuauucacaaucuauuuauacaaaacugggggugucugucuuuuacccuguccccuucuucauuuacccuucccaaaugacccucacccccguuuuuuucauguuucuguuucacgucugcaacccagugcgguauguucgauuuccuuuuaauugguuuuaagccccuuugcucaaucucguccgguccagucaucugggcgccaagucucuccucccgaucagagguucggaaauuuuacuuagaaacugcucuccuggcuguguuccuguccggcaggacacuggggugaauucagagaugucagaacacaccccuaaauacgaccuucacccccucuuccagacacacacccccugcgccgaagcacagagccagacaguagccggggaauucgauucacagggagagccagucuggguuuuauaaauggaaaaaguggcugucccccuggccugucuucgaacgugaauuuuacaauuuuggguuuuuuauuuuuuaagcuggaacuuuuacucuuuguccgacuacaaagaaauagcuuuacuuggcauaucagagaccugccgaauauuuaacucacaauucuuuaugaaaugcuuuuuuuaaauaucgaacuccauuaacucucacaccaaauugcaacuuuggcauuuucuuccggaaacuagauuuguauguucuauaaaugcaaauucccuagagagggugggagaaaagaaacuaaucauaaaugcacgacaaauaucucagggggacuccgccgucaauaccaaacagcucccuuauaggacaauuuggguaagaaguggauucgcuucuuuuguuuucgcauagugaaggagauucagcggcaacagcugcagaaauacugagucguggaggaacguuuuagagacacuugaugucgguuguauccaggccagucggggcacugcaguaaguuuacccaaaauagacuggaggagccagauucaccgcuacccuaacacuuggcaacuccagaaagucuuccuccucgucuuccucuccucugcuccuccucccccugguauucuccuucagaaauaucccucuuucccaucuccuuauuccgggugcagaacgagcgaggaagcaaagcggaaaggucaagagaacaaauucucgcagcagcagcuuggggagcgcgggugaccacgcggaaauagaggcccgggaggugugugugcugcggaacaggcugucuguauagggaagugauugauagcuuccacgcgaaccuggggacccgauuucccaggugggaggggugacuuucacgugaagccccugcugggggccuugcugggguaaaucggcuggccgauuacagccccuuucagggaacugugcacgaaggcgguggcaucugucaucacuauuuacggugcagcgaucagggcaaguugacccgcauuaaaaggccuaaucaugcuggucuccgugaaacggaagaccaagaggaagguacuaacgaucagaggcaggacuugcccaggcccuuucucgcccuuaaacuucacagcaacacuuccaguggaauuuauugauuuguuugcccccauuuuacagaugaacaaaaugagggugggagaugacaaguggcaucccagcugcuaaauggggaauaaggauccuccccgaucuuccacuucuaauacucaacaauagggugcaacagaaggccuucagaaagaaaaaguuaaauaugacauuuuucuuuuuucuuuuuuuccggcuucuuagcucagugauaaccgaagagcuacucugaaaugccccccuuuuccugguggugcccgccagccggcaggggaaagcccgagggaccucccagcuccuucccggaucgcggcggaggugugagcgauguguugauuauucauauuuuuaccgagcgcauacucugcugcggccggcgccgccacauuucacacguacacugacguacccacaugcacaagcgcucacucggccccgcacgcaagcagcgccccgcgcgcccggggcccuccucggauaagggaggggugacaaaagucucccgcucacugcugccuacccacccccaacccggcugccuuuuccuccaggcccccacaaacacccuuggcuuucagauccaacuuucuuccucauaauauacuagucaccgcgacucccgccucccggauuugaggaugggggagacuuuggcggcgggggucagcugcaaauauggcaccaucuagaauuucauuccauuuagcacuaggcaaccuccuccuccaacacacacacgcacucgcacaccaucacgaucaccuccaccuacacuggcacaccucacucagguggcaagagagaaaauccaggaaagucacuugcauagagugcacggauuucaagaagucuuugacggugcaaacuggacuucuaaucaugggaucucuccaaacacagcccaaggccuagaaauuccauuucuggcucacggaaccuuccacccccacccccucaccugccgcgagccgggcaaucauuucggggcgccaguggguccagggcgcacgggacauggcacccacggaaaaccucagagccagcugggaaaacagagaucgcucuccuggccgggcagcuccauaccacccucgaagggggacacaacuuccacuuacucuuuucucccaaaggagagcagaugggggucacagggcuugggggucacugcguucagacagucaccccgcgcgguaagugcuuagagcaacguuuauagggcaaugcuggccucgccgcguaggggucgcuggacuaaaugcccagaaacccucacaacccgugauguccacuuuccguggaucugaacccgggcaaguucggucguuucuguuguccucacucgaaggagaaacuuugguguccgcagacccagguuagaggcuggcauuuacuaauaaggucucuggcauuuguuguuacuccucugaaccucgguuuccuagccaguuaaaugggaauguuauuccucugaauuucagcucccuuacugguaaaauggggauauuuauuccucagagcuuugcuugccuuacggauaagacagcuuaggugaaaguaucuggcacgcaguagguguucaauaaacgcuugcuuuccuucagcaucugcagguguaagaugaggaugaucacaucugcuuauggaauucacuggguccugagucuccuauggggauggguuuccuuucccccgaccuaugcgcuccugaggcagggauucugacucgcuuguccuugcagcuccuuugccuggcacagggacuggaucgcucagugggugauaagcuuuuuguuuguuccgcauggaauugcaugugagaaaagcgcuuuggaagcuguuuggugcacgcgggcgucagagggcaccguaggucacugagcggggucucacccagggagagaaugcgacuucauuccuaggaggcugugcugggggcuccgcgcugcgcgcggcagugaguagggcgcaccccgaaugcaagugcgguucgcugcguggccgcgugcugggauggaucgcggaacucgcuagauaauugaagaucucgaggagcucugaaaugg

SEQ ID NO: 20855 - RNA, 3932 nt, Homo sapiens
gggauccucucuucuuccuugucaacacucccacuccccccgagaaaugcacguucccccaaccccgacuccccaggaggggacgagggauucaccgcgcccacgcggccaccgaggagggaauccucccccgccaagccgaugugauuuggggucgcacccccaugcucccgcccucuccucccccucgcccgcgggccggcugcgcgcgccucgggagcaggccccagggagcacagcagccgcccccgggaucugcugccgcuccgggaggugaaagcgcuccgggucggcacacaggccgcccuugacugcggagcgccggcaggcagcaauggggacagcccuguggaaggcgagggggagggcagagacuaggggaggcccccaguggcucagagacuguggguucggcguccuccuucuggaacucuggcgggcccuucgcaggcagcaguagacagcgacugcgcccgggccugcugggcccuccugccauccuguggccacagaggcugcuuggaaccguuagggaauuuacuggggauucagugcacguguuuaucuaucccuucaacuucauucuuuccucuucaccacgaaaaccgcacauccucgaccccauauggauggggcucuugucuuuggcgcaacugcuggggugcuccgaaucuccucgccacugcgcucagccuagagucagcgccgggucaggggcccagggaggggcaggggcggcgaaucagagugaaguuggcacaaaaguucuugggauauuggaccaaggaauucugacaaguugaaacacccccccaacccugcgcgcaccccuccuuccccccacaaagggaagcacucccuuucucuuaaucucggauaggaucccgaacgcuggagccgcugagguagcaggggcgcaacgcacgccuuccggguuccccagcaguucccgggcugcaaagggauuucgccagauguuuucaacucucuuucuaacugcugggguguuggagaccacuugcaaacaaccccaccccaccgcccaccucuccccaaugcgcucuccuaacgcaaaccucaaauaaacacacacaaugaguuacugguguuucgacuccacgcuacgcgcuuugcgcuuugcaugcagcuguauccuucuuuccucucucuucucgcauucuucuuguuucuucuccccuucucuuuuuuucaagagccgcgagcggugcgggcgccgcacguuggcugcggcccgcuuccugcuuucuaauguuccauugugaggagcuuccauugugacgucgcgccccuucggcugggcuuugucuguccauauaugggcagcuacgucacggagcuuucccggggcucagauaaauaggcugguggaguucccuggcugggagcuuuugggcagcagugagcuugcuaggaagcggcggggcuggugguggugguagcagcggcggcagcggcggcagaggcggcggcggcggcggcggcggcggcggcgguggcgguggcgguggcgguggcagaucggggggcgggggggcggcgggcgcgugucuguuugugagaucaauacugaggccgcguccgacccccuugagccgagauccccccccagcccagcccccaccccaccccccgcacacgccccaccccccccacgacccagccucauaccgcaccagcugaggcacccaagaggauuacccccuggggcccucucccgccccccaaaaaagagaagauccccucuccuggcccaucccuucccuucuucccuccccccuccccccgaacuuucccucucgcaugcuuuuccccugcaccacggaucgccucucggaugccgcuugccuggaagcugcguuaggagcgagcggcggcgguggcggcgguggcggcggcggcggcagcucgggagugcuaugaccggcaaacucgccgagaagcugccggugaccaugagcaguuugcuaaaccaacugccugacaaucuguaccccgaggagauccccagcgcgcucaaccucuucuccggcagcagcgacucgguaguccauuacaaucagauggcuacagguaagggcggcggggaggcggcgaggcagcgaggaaggaaggggagaggaagaggaggaggggacgaccuggugauggauggauggauggauggauggauggauggauggauggguggauggguggauagauaaauggauggagagaugggggcgcgcugggaauuuugcggggggcgaguugcuuuucccacccacuccucccgcccuccucgaucgagaaggcuagguuggcgacgccacgguagaggcuucgguucucccgggugggggcagccgccgaccggagggagguaggugcgagcggcucugggguucucccucaccacgcagggggcccgaucgccgggcuacgcgcaaggcguggugcugucgcccucuucccgggaggagcccggcgucuuuuucacccgcgcucuccccccuuacucccucagccucccacccgggauggagccaugugcggcguggaguccccgcggugggagagguacugcgacgcugccuuuccggggcguucagcaaagccguggggguguggggacggcggggagaaggaggggguucacccgcggggcgagggccugccacggggaacgaucccggggccggggagcuggggaagggcggccucucccgccauggagacaccggccgguuuuccgccgcucuccacccucccuagcuggggcuaggauuuuccccuccagcaagagccuaaagcuccuucaugcccgaggaggcuggggccgggguaggugaagggagagcucccuuugagggcgacacccuucuacgcuccgaggacaaagcgucggagcgcucugggucggcgacccgggagcagcgcgcguggggggcaucgccggggagggaaaggcgcggcguccuggagcggacagggccaagggaagaggccgaguugugugcgguggagagcgagagcccagcgcgcuccgggucugaaacuaccuguagcugcagcuaccugcccgccccaccucgggaagaacaacaaugcuucucgcgcgcgcgcgcgugugugugugguacgugagugugugcgcggcuugugcgcugugugugcagcagccacuccacaccccgauccguaguauuuugcuauauccagguugcgcccgggagcgcggcaccgcccgcuuugcgcggggcucagcguuccucuuaccccaugcgcuacgcacuccacccggccgcacccuccgcaccugggcaaggaccugggcgccgcggcccggagccggaucggcuucacucaccccuccccucucucccccgcucuccgcagagaauguaauggacaucggucugaccaacgagaagcccaacccggaacucucuuacuccggcuccuuccagccagcccccggcaacaagaccgugaccuacuugggaaaguucgccuucgacuccccuuccaacuggugccaggacaacaucauuagccucaugagcgccggcaucuugggggugcccccggcuucaggggcgcucagcacgcagacguccacggccagcauggugcagccaccgcagggugacguggaggccauguaucccgcgcuaccccccuacuccaacugcggcgaccucuacucagagcccgugucuuuccacgacccccagggcaaucccgggcucgccuauuccccccaggauuaccaaucggccaagccggcguuggacagcaaucucuuccccaugauuccugacuacaaccucuaccaccaccccaacgacaugggcuccauuccggagcacaagcccuuccagggcauggaccccauccgggucaacccgcccccuauuaccccucuggag

SEQ ID NO: 20856 - RNA, 3932 nt, Homo sapiens
cuccagagggguaauagggggcggguugacccggaugggguccaugcccuggaagggcuugugcuccggaauggagcccaugucguugggguggugguagagguuguagucaggaaucauggggaagagauugcuguccaacgccggcuuggccgauugguaauccuggggggaauaggcgagcccgggauugcccugggggucguggaaagacacgggcucugaguagaggucgccgcaguuggaguagggggguagcgcgggauacauggccuccacgucacccugcgguggcugcaccaugcuggccguggacgucugcgugcugagcgccccugaagccgggggcacccccaagaugccggcgcucaugaggcuaaugauguuguccuggcaccaguuggaaggggagucgaaggcgaacuuucccaaguaggucacggucuuguugccgggggcuggcuggaaggagccggaguaagagaguuccggguugggcuucucguuggucagaccgauguccauuacauucucugcggagagcgggggagagaggggaggggugagugaagccgauccggcuccgggccgcggcgcccagguccuugcccaggugcggagggugcggccggguggagugcguagcgcaugggguaagaggaacgcugagccccgcgcaaagcgggcggugccgcgcucccgggcgcaaccuggauauagcaaaauacuacggaucgggguguggaguggcugcugcacacacagcgcacaagccgcgcacacacucacguaccacacacacacgcgcgcgcgcgcgagaagcauuguuguucuucccgagguggggcgggcagguagcugcagcuacagguaguuucagacccggagcgcgcugggcucucgcucuccaccgcacacaacucggccucuucccuuggcccuguccgcuccaggacgccgcgccuuucccuccccggcgaugccccccacgcgcgcugcucccgggucgccgacccagagcgcuccgacgcuuuguccucggagcguagaagggugucgcccucaaagggagcucucccuucaccuaccccggccccagccuccucgggcaugaaggagcuuuaggcucuugcuggaggggaaaauccuagccccagcuagggaggguggagagcggcggaaaaccggccggugucuccauggcgggagaggccgcccuuccccagcuccccggccccgggaucguuccccguggcaggcccucgccccgcgggugaacccccuccuucuccccgccguccccacacccccacggcuuugcugaacgccccggaaaggcagcgucgcaguaccucucccaccgcggggacuccacgccgcacauggcuccaucccgggugggaggcugagggaguaaggggggagagcgcgggugaaaaagacgccgggcuccucccgggaagagggcgacagcaccacgccuugcgcguagcccggcgaucgggcccccugcguggugagggagaaccccagagccgcucgcaccuaccucccuccggucggcggcugcccccacccgggagaaccgaagccucuaccguggcgucgccaaccuagccuucucgaucgaggagggcgggaggagugggugggaaaagcaacucgccccccgcaaaauucccagcgcgcccccaucucuccauccauuuaucuauccacccauccacccauccauccauccauccauccauccauccauccauccaucaccaggucguccccuccuccucuuccucuccccuuccuuccucgcugccucgccgccuccccgccgcccuuaccuguagccaucugauuguaauggacuaccgagucgcugcugccggagaagagguugagcgcgcuggggaucuccucgggguacagauugucaggcaguugguuuagcaaacugcucauggucaccggcagcuucucggcgaguuugccggucauagcacucccgagcugccgccgccgccgccaccgccgccaccgccgccgcucgcuccuaacgcagcuuccaggcaagcggcauccgagaggcgauccguggugcaggggaaaagcaugcgagagggaaaguucggggggaggggggagggaagaagggaagggaugggccaggagaggggaucuucucuuuuuuggggggcgggagagggccccaggggguaauccucuugggugccucagcuggugcgguaugaggcugggucgugggggggguggggcgugugcgggggguggggugggggcugggcuggggggggaucucggcucaagggggucggacgcggccucaguauugaucucacaaacagacacgcgcccgccgcccccccgccccccgaucugccaccgccaccgccaccgccaccgccgccgccgccgccgccgccgccgccgccucugccgccgcugccgccgcugcuaccaccaccaccagccccgccgcuuccuagcaagcucacugcugcccaaaagcucccagccagggaacuccaccagccuauuuaucugagccccgggaaagcuccgugacguagcugcccauauauggacagacaaagcccagccgaaggggcgcgacgucacaauggaagcuccucacaauggaacauuagaaagcaggaagcgggccgcagccaacgugcggcgcccgcaccgcucgcggcucuugaaaaaaagagaaggggagaagaaacaagaagaaugcgagaagagagaggaaagaaggauacagcugcaugcaaagcgcaaagcgcguagcguggagucgaaacaccaguaacucauuguguguguuuauuugagguuugcguuaggagagcgcauuggggagaggugggcgguggggugggguuguuugcaaguggucuccaacaccccagcaguuagaaagagaguugaaaacaucuggcgaaaucccuuugcagcccgggaacugcuggggaacccggaaggcgugcguugcgccccugcuaccucagcggcuccagcguucgggauccuauccgagauuaagagaaagggagugcuucccuuuguggggggaaggaggggugcgcgcaggguuggggggguguuucaacuugucagaauuccuugguccaauaucccaagaacuuuugugccaacuucacucugauucgccgccccugccccucccugggccccugacccggcgcugacucuaggcugagcgcaguggcgaggagauucggagcaccccagcaguugcgccaaagacaagagccccauccauauggggucgaggaugugcgguuuucguggugaagaggaaagaaugaaguugaagggauagauaaacacgugcacugaauccccaguaaauucccuaacgguuccaagcagccucuguggccacaggauggcaggagggcccagcaggcccgggcgcagucgcugucuacugcugccugcgaagggcccgccagaguuccagaaggaggacgccgaacccacagucucugagccacugggggccuccccuagucucugcccucccccucgccuuccacagggcuguccccauugcugccugccggcgcuccgcagucaagggcggccugugugccgacccggagcgcuuucaccucccggagcggcagcagaucccgggggcggcugcugugcucccuggggccugcucccgaggcgcgcgcagccggcccgcgggcgagggggaggagagggcgggagcaugggggugcgaccccaaaucacaucggcuuggcgggggaggauucccuccucgguggccgcgugggcgcggugaaucccucguccccuccuggggagucgggguugggggaacgugcauuucucggggggagugggaguguugacaaggaagaagagaggauccc

SEQ ID NO: 20857 - RNA, 4378 nt, Homo sapiens
gcggcccaggucccggucgcgggcggccaccguggccagguaggcgccuggcggguuguucucgcgcaccgacaccucauagaccggccgcgugaagagcggcgcguugucguucucgucgcccacacgcaccguguagggccgcacugugcgcagcgggggcgcgccgcgauccucggccaccagcgucaaguuguacucggcgaugcguucgcgguccagcgacgccgcggucaccaccagguagcugcccgcguaggccggcugcagccggaagugcucgugcccauagagggcgcagcgcacuugcccguuggcgcccgagucccuguccgaggugcugaccagggccaccaggcucucgcgcgccgcccccuccggcaccagcgaaguggcaccagccuccggcgucccggcucccgccggcgagcuagcguccgcucccccgagugcagcggcggcggcggcagcggcgaagggugagguugccggcgcgccuggggcggccagcggggugauggcgaugucgggugcguugucauugacgucucggaugcgcacgaugaccuugcagguggcagcgcggggcccggguccgcgguccugcgcccgcacguccagcucguagguguccugacgcucguaguccacgggcccggccagggugaggcggccugaucgcgggucaagccgaaagaggcggcgcgccuccggcggggugcgggcgccaaaugcgaacaccacgucgccguuaggucccucgucggggucggcugcguccaggucgagaagcagggagcccacgggcgcgucuuccgccagcuccacuucggccacggcgcccugcgggaaggccgggcuguggucauucgcauccaggacgcgcacgcugagggcagccguggcggagcgcggcgggcggccgccguccugggccaccagcuccaggcuguaggcggccuggcucucgcgguccagcuccugcagcagcaccaggucugcgcacugagcgccguccgcucgcgucugcagcuccacgcgaaaggggcugugcggcucggccaggcgcacggucugcagcccguuggcgcccacguccucguccaccggcaccuccaaggggaugcgcgugcccacugccgcacccucggacaccucuaccgggaucugggcccuggggaagcgcggcgcguggucguugacgucccucaccucuaccuccacgugcaccagccggaacugcuccugcgagaagcugaccacaucgaaggccagcacgcacugcggggccuggccacacagccgcucgcgguccaggccggcguccccgacggucagcugcccgucgccuucgcgcacccggagcagagagcuguugaauugcuucaucaggcggaagcuugugucacccgauacuuucauaugcagguccucggccagggucccgaugaccgugccgggggcauccuccucgaaggugcuguaucggacuguuuugcucugggccacugagagcacccagcagaggcugaagagcugcaaggggaaaaggcaggggcugccccaacgccucacaggacucaugccuccagccucaagugcgauccgaaaggcuaaggaagucuucucugguuuccaggucgggcgucagucucaggcucucggaaucacgcucuuugcgagcccugugcgggagaagucugcggguagcagcuccgagccuccagcgggcucugaggacgcgcggacccgcccucacucugcgccucuccgucucuuacagaagcugcgccgccucgcgccgccuuugccuuuauagccgccgauaugcuaaucacccgagccggguagccaauggccgccucccccucgcgucgccccuccgccugccucugacaaucccuuuaauguggaaaggcuuagaggggaaaacaagaaaggaaaauuagggaaucuuucuuuuguuuaacuccuuuugcuuuuucccccuuuucuugucagcacccugcauguagaggaguuggcacagggcuccaggaguaaaaggagcggaugguuuuguuaauugucgccugccucccuccgugccgcggcuagaacuaagugcgaacacgcugggguuucaccccaguggcuccugauuccgccuucccccagccccugccaacacacacacucugcauuuugcaccucugacgcuuccaaacccuugcagcccccuacccacagacuugcucugcugaaugaggcucugcuuuccuucucuccuagcuacggugccuggaauagccucucgauuaagaagccugaaggauaagggaaaauugauuuuauucaaauuuguguacucaauuguguuuugcucgugugagccccagugaucagagcugccacuucccuuucagaaaagagccccgcgauauguuaguaugcacgucacuguccaaguggccuucuuaagcccugggagcuagcaggcaaggaaaaaaaaguuccaaauaggauuuagcauaagcuugaggagauuuggaaagguuucaaagaucagacuguaucaaaggcuuaugaagcccucguuagcaguggaaauagaaugguguggcaggcgaucccauuggaggccccaaugucuguauuauuucacugugacaagcuaaggggagagaaaguugaacaguuuccacagcggaguuggacuaacuugaauauaaugagcaaacgccacauguauccauuauguuccucuauucauccccaaucacugccauaacucuccggcuaaacggugaugggcgcugaauuccacacaauacccggcucguauuaaagugcauuuagagaacuuuuuccuccugaugccuuguuccgccuauuuagaggauuuucuuucuguucuaauagggccacucugggaagcaacacucguccgguuccagaagaacaaaaucacagcgugacguugaaaccuggcaggaacguggggggaacuuaaccaucugcuuaggaaaguguggagcuucggcacugccaaaaucugggcugggcggauccuggggcuggccgggcgcugcgcugccccacagauagcccccucccaucccugacggccagggagauggagcucggaucugcaacaagacggauucuuaaugauucuuacugaagggcuuuauugagcaggcuaugcaaauacacacgaaggaggaaagguaaaaaacaaaagccacucacuggaagaaauuuuucuuuuuaggcgauagguuugguaaguagauugaauucaguaaacauucuucagaaucccgauuuugguccugcugucagcguccuauccauguuuuccuuucccucaaacucgagggaguguguuuuggguuuuuuuucagaagagggucaggaguuuccuuggaguagggagaccaagcagggagcuggguggcagggaugagaggugcuuggaauugucagagagcggaacaugcagcuccagccauccauaaauacaagcucuuauaagacuggggagggggaugaugaguggcuggagacuuccucagaggggugugucucuggguucccuucuccaccucuuccaccuuguagucuugggaaugcuaaaagcaauaaggccaggcaucugcagccgcguggggacguggaaggaggagcgcccccuacaggagcccaaaucgcagcccuuucuuccgcugucuuccaucucccaagugcgauuuaguauguagcccucccaccguccccgcccaagagauauuccuugggggguacacgcagucgaaggaacuuucuauuuuccuuccgagccccgcaacacucccaccccaaccuggggcuggcuggugaccuuuagcgccccuaggcuaacgucaucucuccucaccccucuucccccggagacccagacgggaacagguucagaacuuggcugguggacagcggccucagcgcuuccgcuggcguacccagggcaaggucaggcccgccuggcgcugcugcugccgggcggaggacccggaagguggggaaaguggguggaaauggggccggagucccaaaggaagggauuucagcgguuuccgcgagcacagcccggccgcgaauggcugggacccggaccucgcgccagcgcccccugcgcaucugcaccccgcaguucugggcuggacucgggagccccgccacgcgcuaaguuuggguuuuucgcuuggccagagauucggaacuacuugcaauuucuacucaaagugcuuccgcgucagcaugcucauucucaaggcugaaauaaaccaaggcgugcuugaaagugggaaaaggaaaggggaguaggggcaggcaaaagccaggaggcgggaggaggggu

SEQ ID NO: 20858 - RNA, 4378 nt, Homo sapiens
accccuccucccgccuccuggcuuuugccugccccuacuccccuuuccuuuucccacuuucaagcacgccuugguuuauuucagccuugagaaugagcaugcugacgcggaagcacuuugaguagaaauugcaaguaguuccgaaucucuggccaagcgaaaaacccaaacuuagcgcguggcggggcucccgaguccagcccagaacugcggggugcagaugcgcagggggcgcuggcgcgagguccgggucccagccauucgcggccgggcugugcucgcggaaaccgcugaaaucccuuccuuugggacuccggccccauuuccacccacuuuccccaccuuccggguccuccgcccggcagcagcagcgccaggcgggccugaccuugcccuggguacgccagcggaagcgcugaggccgcuguccaccagccaaguucugaaccuguucccgucugggucuccgggggaagaggggugaggagagaugacguuagccuaggggcgcuaaaggucaccagccagccccagguuggggugggaguguugcggggcucggaaggaaaauagaaaguuccuucgacugcguguaccccccaaggaauaucucuugggcggggacggugggagggcuacauacuaaaucgcacuugggagauggaagacagcggaagaaagggcugcgauuugggcuccuguagggggcgcuccuccuuccacguccccacgcggcugcagaugccuggccuuauugcuuuuagcauucccaagacuacaagguggaagagguggagaagggaacccagagacacaccccucugaggaagucuccagccacucaucaucccccuccccagucuuauaagagcuuguauuuauggauggcuggagcugcauguuccgcucucugacaauuccaagcaccucucaucccugccacccagcucccugcuuggucucccuacuccaaggaaacuccugacccucuucugaaaaaaaacccaaaacacacucccucgaguuugagggaaaggaaaacauggauaggacgcugacagcaggaccaaaaucgggauucugaagaauguuuacugaauucaaucuacuuaccaaaccuaucgccuaaaaagaaaaauuucuuccagugaguggcuuuuguuuuuuaccuuuccuccuucguguguauuugcauagccugcucaauaaagcccuucaguaagaaucauuaagaauccgucuuguugcagauccgagcuccaucucccuggccgucagggaugggagggggcuaucuguggggcagcgcagcgcccggccagccccaggauccgcccagcccagauuuuggcagugccgaagcuccacacuuuccuaagcagaugguuaaguuccccccacguuccugccagguuucaacgucacgcugugauuuuguucuucuggaaccggacgaguguugcuucccagaguggcccuauuagaacagaaagaaaauccucuaaauaggcggaacaaggcaucaggaggaaaaaguucucuaaaugcacuuuaauacgagccggguauuguguggaauucagcgcccaucaccguuuagccggagaguuauggcagugauuggggaugaauagaggaacauaauggauacauguggcguuugcucauuauauucaaguuaguccaacuccgcuguggaaacuguucaacuuucucuccccuuagcuugucacagugaaauaauacagacauuggggccuccaaugggaucgccugccacaccauucuauuuccacugcuaacgagggcuucauaagccuuugauacagucugaucuuugaaaccuuuccaaaucuccucaagcuuaugcuaaauccuauuuggaacuuuuuuuuccuugccugcuagcucccagggcuuaagaaggccacuuggacagugacgugcauacuaacauaucgcggggcucuuuucugaaagggaaguggcagcucugaucacuggggcucacacgagcaaaacacaauugaguacacaaauuugaauaaaaucaauuuucccuuauccuucaggcuucuuaaucgagaggcuauuccaggcaccguagcuaggagagaaggaaagcagagccucauucagcagagcaagucuguggguagggggcugcaaggguuuggaagcgucagaggugcaaaaugcagaguguguguguuggcaggggcugggggaaggcggaaucaggagccacuggggugaaaccccagcguguucgcacuuaguucuagccgcggcacggagggaggcaggcgacaauuaacaaaaccauccgcuccuuuuacuccuggagcccugugccaacuccucuacaugcagggugcugacaagaaaagggggaaaaagcaaaaggaguuaaacaaaagaaagauucccuaauuuuccuuucuuguuuuccccucuaagccuuuccacauuaaagggauugucagaggcaggcggaggggcgacgcgagggggaggcggccauuggcuacccggcucgggugauuagcauaucggcggcuauaaaggcaaaggcggcgcgaggcggcgcagcuucuguaagagacggagaggcgcagagugagggcggguccgcgcguccucagagcccgcuggaggcucggagcugcuacccgcagacuucucccgcacagggcucgcaaagagcgugauuccgagagccugagacugacgcccgaccuggaaaccagagaagacuuccuuagccuuucggaucgcacuugaggcuggaggcaugaguccugugaggcguuggggcagccccugccuuuuccccuugcagcucuucagccucugcugggugcucucaguggcccagagcaaaacaguccgauacagcaccuucgaggaggaugcccccggcacggucaucgggacccuggccgaggaccugcauaugaaaguaucgggugacacaagcuuccgccugaugaagcaauucaacagcucucugcuccgggugcgcgaaggcgacgggcagcugaccgucggggacgccggccuggaccgcgagcggcuguguggccaggccccgcagugcgugcuggccuucgauguggucagcuucucgcaggagcaguuccggcuggugcacguggagguagaggugagggacgucaacgaccacgcgccgcgcuuccccagggcccagaucccgguagagguguccgagggugcggcagugggcacgcgcauccccuuggaggugccgguggacgaggacgugggcgccaacgggcugcagaccgugcgccuggccgagccgcacagccccuuucgcguggagcugcagacgcgagcggacggcgcucagugcgcagaccuggugcugcugcaggagcuggaccgcgagagccaggccgccuacagccuggagcugguggcccaggacggcggccgcccgccgcgcuccgccacggcugcccucagcgugcgcguccuggaugcgaaugaccacagcccggccuucccgcagggcgccguggccgaaguggagcuggcggaagacgcgcccgugggcucccugcuucucgaccuggacgcagccgaccccgacgagggaccuaacggcgacgugguguucgcauuuggcgcccgcaccccgccggaggcgcgccgccucuuucggcuugacccgcgaucaggccgccucacccuggccgggcccguggacuacgagcgucaggacaccuacgagcuggacgugcgggcgcaggaccgcggacccgggccccgcgcugccaccugcaaggucaucgugcgcauccgagacgucaaugacaacgcacccgacaucgccaucaccccgcuggccgccccaggcgcgccggcaaccucacccuucgccgcugccgccgccgccgcugcacucgggggagcggacgcuagcucgccggcgggagccgggacgccggaggcuggugccacuucgcuggugccggagggggcggcgcgcgagagccugguggcccuggucagcaccucggacagggacucgggcgccaacgggcaagugcgcugcgcccucuaugggcacgagcacuuccggcugcagccggccuacgcgggcagcuaccugguggugaccgcggcgucgcuggaccgcgaacgcaucgccgaguacaacuugacgcugguggccgaggaucgcggcgcgcccccgcugcgcacagugcggcccuacacggugcgugugggcgacgagaacgacaacgcgccgcucuucacgcggccggucuaugaggugucggugcgcgagaacaacccgccaggcgccuaccuggccacgguggccgcccgcgaccgggaccugggccgc

SEQ ID NO: 20859 - RNA, 948 nt, Homo sapiens
cugccuucauagacccuuccauuuacuucucuugaauaucuuguucccaaaguguuuucaaggcaggucuguuaccaagccacuccaucagcagcaccuagcacugugccucccgcagcaaggcaggcaggauggauggacggaugcaggcaugcauggguagguggaugaagggcagaugaagaacuaucgagaaaggaaucgcggugucagggguaaagcccuggccugcgagagccgggcucggauuucagugcccucacagcuagccauauggccuuggacaaguuacugaaccccuccgugccuagguuuccagaauguagagggccacuuccacucaaguggcuggagaagaagguaagcgccccggacggacgcuauugcagagucgcccggggauuccucucuccaccugugcuugagcuccucccgcuucuacgcuagggaccaggugggagagauacacggauucccagaaaaauggcucucucaggugggagucaaggguuacgagaggagagguaggggaagcaaugaacuccuccacacgauguguugggagagaggaaagagggauucaagugggaauuuuccacucaacaaacauuccaccaucauuugagaaaaaggcgcugggauggugaauuucaaacagucugagaaaugggcgacucggcacugugcggccuguaaggaaugaaucauuuaguuuucacccaccagguaggcaggccgggggcgaggacccuccgagcgccguccgagcgcaggugguagcccagccaagcaaacgcugggcagaggcggcaccgaggaggggaacgggcugcugcacucccggucgcguccagccgggaugggcugcgaaguugucggauucuuucccgcacagcacggggcucgcccgucggaaaagccaccgagggcggcgcagcggcagggcgc

SEQ ID NO: 20860 - RNA, 948 nt, Homo sapiens
gcgcccugccgcugcgccgcccucgguggcuuuuccgacgggcgagccccgugcugugcgggaaagaauccgacaacuucgcagcccaucccggcuggacgcgaccgggagugcagcagcccguuccccuccucggugccgccucugcccagcguuugcuuggcugggcuaccaccugcgcucggacggcgcucggaggguccucgcccccggccugccuaccuggugggugaaaacuaaaugauucauuccuuacaggccgcacagugccgagucgcccauuucucagacuguuugaaauucaccaucccagcgccuuuuucucaaaugaugguggaauguuuguugaguggaaaauucccacuugaaucccucuuuccucucucccaacacaucguguggaggaguucauugcuuccccuaccucuccucucguaacccuugacucccaccugagagagccauuuuucugggaauccguguaucucucccaccuggucccuagcguagaagcgggaggagcucaagcacagguggagagaggaauccccgggcgacucugcaauagcguccguccggggcgcuuaccuucuucuccagccacuugaguggaaguggcccucuacauucuggaaaccuaggcacggagggguucaguaacuuguccaaggccauauggcuagcugugagggcacugaaauccgagcccggcucucgcaggccagggcuuuaccccugacaccgcgauuccuuucucgauaguucuucaucugcccuucauccaccuacccaugcaugccugcauccguccauccauccugccugccuugcugcgggaggcacagugcuaggugcugcugauggaguggcuugguaacagaccugccuugaaaacacuuugggaacaagauauucaagagaaguaaauggaagggucuaugaaggcag

SEQ ID NO: 20861 - RNA, 838 nt, Homo sapiens
cgagcaccugaccuuccuggucccucggcgcaaggucagggaacaaggaccaaggucccagugcagauggcuccaucgcggaccuggugugcccggcuggcccgggcgucaccuacaccccgccuuccucagccccgcgccagcccccucccccugggccacgcagguuugcgcuggaaucgcagcggugccgaggucacagugucccagcucacggacccucugucagcgcacugagagcaggaaagugaaacuuguugcucccaaaggcgagggaaugguucaacuucuggaggugucacaaagcuuggaaagcauccccaaagcguccucggggcuuuguuugcuaaaccagguaccuaaauaaagggacugucuuucccaaaacguucccgguaggucccccggguacgacacacgcuccccuccaaccugagugcucaaagauccaaccgcuccuucucuggagcgcucgaggcacugugcugggguuccgcgacuccaagaaagguccugccucggagacccaguccucccacuggccauagccacagcagcgguggagaccggagggaagcggcucuggagaaguccgugaccagaggagcaucgcgggaguccgccgcgcggcggggcgggucaaaauggaacuggaccuucugugccuacugcagccaagucauuugcaaugugaacgggcuacacugggcgggagaauucugacaauuaagucccgcacauuuaaauacauugaaaauguguuaaaauggucuuucauuugacuaggcguccguguccacaaauuucuuuuagucucagaccgacgcccucuuucggc

SEQ ID NO: 20862 - RNA, 838 nt, Homo sapiens
gccgaaagagggcgucggucugagacuaaaagaaauuuguggacacggacgccuagucaaaugaaagaccauuuuaacacauuuucaauguauuuaaaugugcgggacuuaauugucagaauucucccgcccaguguagcccguucacauugcaaaugacuuggcugcaguaggcacagaagguccaguuccauuuugacccgccccgccgcgcggcggacucccgcgaugcuccucuggucacggacuucuccagagccgcuucccuccggucuccaccgcugcuguggcuauggccagugggaggacugggucuccgaggcaggaccuuucuuggagucgcggaaccccagcacagugccucgagcgcuccagagaaggagcgguuggaucuuugagcacucagguuggaggggagcgugugucguacccgggggaccuaccgggaacguuuugggaaagacagucccuuuauuuagguaccugguuuagcaaacaaagccccgaggacgcuuuggggaugcuuuccaagcuuugugacaccuccagaaguugaaccauucccucgccuuugggagcaacaaguuucacuuuccugcucucagugcgcugacagaggguccgugagcugggacacugugaccucggcaccgcugcgauuccagcgcaaaccugcguggcccagggggagggggcuggcgcggggcugaggaaggcgggguguaggugacgcccgggccagccgggcacaccagguccgcgauggagccaucugcacugggaccuugguccuuguucccugaccuugcgccgagggaccaggaaggucaggugcucg

SEQ ID NO: 20863 - RNA, 4021 nt, Homo sapiens
ugggccggggggcaggggccugcgcugcgcgcccccuccuccuccaccuccuccuccgcguuuccugucccuggccuucaucccggccucccggggcguaaacuugcagcgguugggguucaggcagccgcugcucgcgcgccccucgucaguuagccauuucccugagagcguccuuggugucgcaaguccagagccgcgaggacagcagaugaccgggucagcggaaauuucagagccagccagcagcucagguccccggggccgcggcaggaauggaacggcuccgcggagacagccucgggggcacagccgggccacugcagacuccgggacuucccucuccgcacacccgaaacccacaacucgcccgugggccgcguggccuuucugcgccgagggcugcugggggcgggcggcgagccuggcgggugaccugcucuugggugggccccgcaaugccugcgcccuagacgccggccgggacgaggggcuggcugggucugagccuggagaaacacaagggucagcccccagugggcgcagagguggcccaggagggcccgcggacggugcugcgcugcgcucagccuccgggccgcuccccgcguucggcgcgcaccugcccaucgaggcggcagggccagcaggcggccuaggcgcggccgggccacgcggcaucccccaaagcuggagcucgccgacucuucccuaccuuuucaagagaccguagucgugcccagaacgccggcguggcccagacuccauuuuggaacuucgcaggcuggcguggacgaaguaaacacauuuauggaaaaaccccgggguuaggagguuugcggaaagagggagcagcucgugggguuggaaauucugccuaccccucgggaaaaccaaacgguucugcacccaacguacacauacuuaagggcgggaaaggugugaagcccgcugcuggggaguugccuccccuuugaugaaaaggaagugcgaagcguaggaacgcucuucaggucaccaccccgugagugggaggcuuggggagucugaaggaagagaaagcucccuccaaaucucccaaacugagaaaagcugcaggaggaaugaggcaguuggagagagaggaccgcaggcaucccgcagcugaggcucaggacugagcucuaaaaugaaagcaccccuaugggacccaccaggcaaaacguuaaaaaaaaaaaaaaucugaaugcuuaggcauucugcugcuuccauucugugugucaaaucuacuuugaagcaguuaaguacugcaggauauuaaacacucgaaucuccguuucaagcucacuuuuuaaucuuugcgaacuuaaaauuggaaagacagaaaaaaaaucugcgaccccuguuauguuuuaccaaaggaacgaaaaauucucuccaccucggcauaaauaaaauagaaagaauuuuaucuuaauaaaauaauaucugggagcuucugcuugacuccccaauuacugcuuaaccuuuugacaguuuuuagccucugcuuguauuuaucuacuuccccgcacgauugagauuuuuugaauuguccuuuggggcgucucauucaaaaccaucuuucgacggaacacuuuugaauuguacagccucuugguugaagaucuacguccucaaagugcgggcuugccguggaguaacacagauccccucuggcaacucgucugggacgaagggcguuuuugcuuaguguugaucacgcaaaucacaucugaaaagaagcugcuuaaaauggguguguaucauucccuuccugucacucggucaccccuauuccagagagguugaagugcuuuuugcaguuacacucacacaagaccaaaccuuuagaaggaccugaaaaauguaucacugcacuuugaauucuauuaacuuuccuggagacugaacauugaacucaauuuuugcugggaaugaagauguaaauguuuugaaaaacuagaaucgcauuuuccuaaauuuuaaaaaugauuguucuucaccaauuccagauggauucuuuauucuuugccaauggguugcagaugcccacuguuuuaaccaaguugguuuacugcguaugaaaugaacauuugccgauuaaagcuuaaauauuggaagaaauuucuccuggggcauuccacgcgucuuugcaauaauuacuaaauuagucaauugccaccucuguaaacaaacuucguuuagaaaacagcaggcgaaagcagacuacacauguagucauaauugaccaaaaguauguacaaaacuguuuaaaauuggggaaagagugauuuaugcuggagaaugcagucuagaccugaauuauuuuacuuuacggugaagguaguuguauugaauguguuaagaugugcaaauuaagccggcgagcgaaccaaauaaaaauacuaaaugcccuuugggauucucuguggagucuuugagaggcagagaagcaguuguugaguuucuaaugguauaaggaaaaguggcaacgagaagaaaggggguggguauuguguuugugugugaguuuugaacugagucaccuacggcugcgucucuauaacagggaaaccucgagcaaaccugugccuuuaagacucaguugcuauccaaacagaaguaaacagaguggaccauuagcagacgccgggcgcggaggcggagccagggcgcugagggccccgcgcggcggcgggacgcccgcccgaaggggaggcggggccgcuacuaaagcccaagacucccggccuggggcagccuggggagggacgcgggcggggacggagcucggcgugcuugcugcuggagggugauggcccugcaaggcugugggcuccgaccucaccgggagucgacagcgagagguucgccgaagagcgagguucugggcgagcgcugaacgccggccccaagcaccccgggucuuuacacaguccgcguccacagacucugacgaagacguggaucugcucucgcuuuagcugcucgcgguccuccagaucauguccgcgacuccugcgacuccgcgcggaaaaaaaaguuugccaggcguggacucaaugaccuuuccaagcugugcgccucgcugccuggaccgggucugagcgcggcugcccagguugaccuuucugcgggaggugaguguucgcucugggaaggggcuguagcugcccuuuggaaggaaggguuuggggguguaagaggcguucagauucucggucuggugugccccaaauucagaugugaaaauagaucauggggaugcaaucccagggcacuguauuucucacuuccuugggucccuggcacgcgacucccagcuaacacccaaccacacacauuucuacauacuguuucuuaauuuuguuuugggauauuuaaucuaagcggucagcaagacuucuuauaaaagcuggucuacguacacugagaucaaaccccacaaucccaugguguuucugcuccugcccuagcaagccugggucgacuugucccggggcagccgcggcagcgcagcguggacgggcccggacacccggugccugcccagccagcgacgcugaaggcacauuucaagagggaaauaguucaguccucgguaauuugucaaccucgugcuggcuuuaaaauucuccucccaccuucuaguccugacugagggggcccaaaagcaaacuccccgggggcuuaaacgcucggauuccugagaaacggcaagugagaaaggaguugcaguuguacgaagaaggagcgaggaaaagguguuuguggagggagccccggaucugucuuccuaccuguuagccgagaacaaaagggggcuggcguuucccgaagcgaaagggcgcagacagccacuuucucugcuaaacaaacugcaguccugggcagaacaagaaaauuacucacgcagggggagcaaggggagcacagagaaacagaaccuagauuaugcggaaggcaucuuaauuuaauuaacuccuugggaaggcagagg

SEQ ID NO: 20864 - RNA, 4021 nt, Homo sapiens
ccucugccuucccaaggaguuaauuaaauuaagaugccuuccgcauaaucuagguucuguuucucugugcuccccuugcucccccugcgugaguaauuuucuuguucugcccaggacugcaguuuguuuagcagagaaaguggcugucugcgcccuuucgcuucgggaaacgccagcccccuuuuguucucggcuaacagguaggaagacagauccggggcucccuccacaaacaccuuuuccucgcuccuucuucguacaacugcaacuccuuucucacuugccguuucucaggaauccgagcguuuaagcccccggggaguuugcuuuugggcccccucagucaggacuagaaggugggaggagaauuuuaaagccagcacgagguugacaaauuaccgaggacugaacuauuucccucuugaaaugugccuucagcgucgcuggcugggcaggcaccggguguccgggcccguccacgcugcgcugccgcggcugccccgggacaagucgacccaggcuugcuagggcaggagcagaaacaccaugggauugugggguuugaucucaguguacguagaccagcuuuuauaagaagucuugcugaccgcuuagauuaaauaucccaaaacaaaauuaagaaacaguauguagaaaugugugugguuggguguuagcugggagucgcgugccagggacccaaggaagugagaaauacagugcccugggauugcauccccaugaucuauuuucacaucugaauuuggggcacaccagaccgagaaucugaacgccucuuacacccccaaacccuuccuuccaaagggcagcuacagccccuucccagagcgaacacucaccucccgcagaaaggucaaccugggcagccgcgcucagacccgguccaggcagcgaggcgcacagcuuggaaaggucauugaguccacgccuggcaaacuuuuuuuuccgcgcggagucgcaggagucgcggacaugaucuggaggaccgcgagcagcuaaagcgagagcagauccacgucuucgucagagucuguggacgcggacuguguaaagacccggggugcuuggggccggcguucagcgcucgcccagaaccucgcucuucggcgaaccucucgcugucgacucccggugaggucggagcccacagccuugcagggccaucacccuccagcagcaagcacgccgagcuccguccccgcccgcgucccuccccaggcugccccaggccgggagucuugggcuuuaguagcggccccgccuccccuucgggcgggcgucccgccgccgcgcggggcccucagcgcccuggcuccgccuccgcgcccggcgucugcuaaugguccacucuguuuacuucuguuuggauagcaacugagucuuaaaggcacagguuugcucgagguuucccuguuauagagacgcagccguaggugacucaguucaaaacucacacacaaacacaauacccacccccuuucuucucguugccacuuuuccuuauaccauuagaaacucaacaacugcuucucugccucucaaagacuccacagagaaucccaaagggcauuuaguauuuuuauuugguucgcucgccggcuuaauuugcacaucuuaacacauucaauacaacuaccuucaccguaaaguaaaauaauucaggucuagacugcauucuccagcauaaaucacucuuuccccaauuuuaaacaguuuuguacauacuuuuggucaauuaugacuacauguguagucugcuuucgccugcuguuuucuaaacgaaguuuguuuacagagguggcaauugacuaauuuaguaauuauugcaaagacgcguggaaugccccaggagaaauuucuuccaauauuuaagcuuuaaucggcaaauguucauuucauacgcaguaaaccaacuugguuaaaacagugggcaucugcaacccauuggcaaagaauaaagaauccaucuggaauuggugaagaacaaucauuuuuaaaauuuaggaaaaugcgauucuaguuuuucaaaacauuuacaucuucauucccagcaaaaauugaguucaauguucagucuccaggaaaguuaauagaauucaaagugcagugauacauuuuucagguccuucuaaagguuuggucuugugugaguguaacugcaaaaagcacuucaaccucucuggaauaggggugaccgagugacaggaagggaaugauacacacccauuuuaagcagcuucuuuucagaugugauuugcgugaucaacacuaagcaaaaacgcccuucgucccagacgaguugccagaggggaucuguguuacuccacggcaagcccgcacuuugaggacguagaucuucaaccaagaggcuguacaauucaaaaguguuccgucgaaagaugguuuugaaugagacgccccaaaggacaauucaaaaaaucucaaucgugcggggaaguagauaaauacaagcagaggcuaaaaacugucaaaagguuaagcaguaauuggggagucaagcagaagcucccagauauuauuuuauuaagauaaaauucuuucuauuuuauuuaugccgagguggagagaauuuuucguuccuuugguaaaacauaacaggggucgcagauuuuuuuucugucuuuccaauuuuaaguucgcaaagauuaaaaagugagcuugaaacggagauucgaguguuuaauauccugcaguacuuaacugcuucaaaguagauuugacacacagaauggaagcagcagaaugccuaagcauucagauuuuuuuuuuuuuuaacguuuugccuggugggucccauaggggugcuuucauuuuagagcucaguccugagccucagcugcgggaugccugcgguccucucucuccaacugccucauuccuccugcagcuuuucucaguuugggagauuuggagggagcuuucucuuccuucagacuccccaagccucccacucacgggguggugaccugaagagcguuccuacgcuucgcacuuccuuuucaucaaaggggaggcaacuccccagcagcgggcuucacaccuuucccgcccuuaaguauguguacguugggugcagaaccguuugguuuucccgagggguaggcagaauuuccaaccccacgagcugcucccucuuuccgcaaaccuccuaaccccgggguuuuuccauaaauguguuuacuucguccacgccagccugcgaaguuccaaaauggagucugggccacgccggcguucugggcacgacuacggucucuugaaaagguagggaagagucggcgagcuccagcuuugggggaugccgcguggcccggccgcgccuaggccgccugcuggcccugccgccucgaugggcaggugcgcgccgaacgcggggagcggcccggaggcugagcgcagcgcagcaccguccgcgggcccuccugggccaccucugcgcccacugggggcugacccuuguguuucuccaggcucagacccagccagccccucgucccggccggcgucuagggcgcaggcauugcggggcccacccaagagcaggucacccgccaggcucgccgcccgcccccagcagcccucggcgcagaaaggccacgcggcccacgggcgaguuguggguuucgggugugcggagagggaagucccggagucugcaguggcccggcugugcccccgaggcugucuccgcggagccguuccauuccugccgcggccccggggaccugagcugcuggcuggcucugaaauuuccgcugacccggucaucugcuguccucgcggcucuggacuugcgacaccaaggacgcucucagggaaauggcuaacugacgaggggcgcgcgagcagcggcugccugaaccccaaccgcugcaaguuuacgccccgggaggccgggaugaaggccagggacaggaaacgcggaggaggagguggaggaggagggggcgcgcagcgcaggccccugccccccggccca

SEQ ID NO: 20865 - RNA, 1827 nt, Homo sapiens
aaauggacacauggaacaaaccaaaccuuguuuuaucauguaauuuucagaaaauaugugauccauaaagauuaaaagaaaguuguauuaagucuggcagcuuuaguauuaacuugaaauaaaauauggcaagcuuuccacguccuccuuuauuuccacaauccauauguacgagcuagauuccagucagaacuuccacaaauacuucacucuuugguagcagcgguuauaaauuacgccuuugcuaauuugcguuguucccaaccaggagaaacauuaccacaaaaaaagucaguuucauccugcaguguucccgcagcaaccauauuaagcuggaagaauaaagcuccuuuguaguaguagcgucuauugaauuacaauguaaauguugaugccugccuggaaacgucaaaugacaacagguuuacagaacgaauucagugguuguuugcagcucuggaaucccaggcugcagaguugagaucgaagaggugcgucuggccaucuuagcguucauucaaccaaaucuccucacuccaucaaaaccacgccacuccccaccugcccagcucguaaaaggaugcucaccuguuugaaaaucuguaauauaucugaugucuuuuacacagcaggacacgaaaaaguguuuguuguggauaagaguguuaaaaauucaauuacgcaacagaccaaacuuugugcuucuuucccccucucagcacaaaguaacuuuagucccguccucuucugccacugucaaacagcccuguuacugugggcauuaaaugccuuguggcguacugcgcauuugauucugguugacuugggauaccugagcucggcucucauuagcucuuccgcucgacccacaaucccuaguguuugcagguguugcauucccccaaccccuuucuucucuucaaccaguagccuccaccuucccaucccugcuuuggagaaggaggaaaacgcagcuugagaucuacucgaagaacugacccucagcucucacaggcugccgccgagcugcaagcaugccgccgcuccacucggguaaacuucggagugaguuaccugcacucggagaagggccuuaccugagcgcgccucugccaauggcagcucaccugagggagcuccccagccaaucaucgcgcagcucgucccucgggcuuguacccuuuagugaaagaauucagcuccuugcgagaaaguuaccuguggccgcccaaguccgccacuuucugcucugugucugcccauugccacgauccaggaggacuccgcgccgcccggccgccuccgagcucgggccccaugugaggggcccccccuuaucccaccuuuccggcuaggugagggcgcgagcgggcgagcgagcgagaguggugaggggggacggaaaagcagaauuaccuguagcucuuguucugccaucucgggcgcucucacacaccuucaccugcacagacuugaaaguccaguuucaccagaggcugaggcuccaggaaaagcggagcaaguucauuggaucaaacaugucacaagagucggacaaguaaguggaucacacgcgccggcugcugcuacuacuaccacuuugggcugauggcaacugguuuguuauguuuuuguuuuuaaguugcuauuguugguauuuuucuuucuuuuuucuuuuucuuuuugguggauccagacuuuuccgcauuauguuucuacccugauuaaggggagaaacccuacaacaaugugaauauuuaauauccccuuugggccuugauaguaaaaguggguuuuccuuuuccuucuucccuuaggaauggucuc

SEQ ID NO: 20866 - RNA, 1827 nt, Homo sapiens
gagaccauuccuaagggaagaaggaaaaggaaaacccacuuuuacuaucaaggcccaaaggggauauuaaauauucacauuguuguaggguuucuccccuuaaucaggguagaaacauaaugcggaaaagucuggauccaccaaaaagaaaaagaaaaaagaaagaaaaauaccaacaauagcaacuuaaaaacaaaaacauaacaaaccaguugccaucagcccaaagugguaguaguagcagcagccggcgcgugugauccacuuacuuguccgacucuugugacauguuugauccaaugaacuugcuccgcuuuuccuggagccucagccucuggugaaacuggacuuucaagucugugcaggugaaggugugugagagcgcccgagauggcagaacaagagcuacagguaauucugcuuuuccguccccccucaccacucucgcucgcucgcccgcucgcgcccucaccuagccggaaaggugggauaagggggggccccucacauggggcccgagcucggaggcggccgggcggcgcggaguccuccuggaucguggcaaugggcagacacagagcagaaaguggcggacuugggcggccacagguaacuuucucgcaaggagcugaauucuuucacuaaaggguacaagcccgagggacgagcugcgcgaugauuggcuggggagcucccucaggugagcugccauuggcagaggcgcgcucagguaaggcccuucuccgagugcagguaacucacuccgaaguuuacccgaguggagcggcggcaugcuugcagcucggcggcagccugugagagcugagggucaguucuucgaguagaucucaagcugcguuuuccuccuucuccaaagcagggaugggaagguggaggcuacugguugaagagaagaaagggguugggggaaugcaacaccugcaaacacuagggauugugggucgagcggaagagcuaaugagagccgagcucagguaucccaagucaaccagaaucaaaugcgcaguacgccacaaggcauuuaaugcccacaguaacagggcuguuugacaguggcagaagaggacgggacuaaaguuacuuugugcugagagggggaaagaagcacaaaguuuggucuguugcguaauugaauuuuuaacacucuuauccacaacaaacacuuuuucguguccugcuguguaaaagacaucagauauauuacagauuuucaaacaggugagcauccuuuuacgagcugggcagguggggaguggcgugguuuugauggagugaggagauuugguugaaugaacgcuaagauggccagacgcaccucuucgaucucaacucugcagccugggauuccagagcugcaaacaaccacugaauucguucuguaaaccuguugucauuugacguuuccaggcaggcaucaacauuuacauuguaauucaauagacgcuacuacuacaaaggagcuuuauucuuccagcuuaauaugguugcugcgggaacacugcaggaugaaacugacuuuuuuugugguaauguuucuccugguugggaacaacgcaaauuagcaaaggcguaauuuauaaccgcugcuaccaaagagugaaguauuuguggaaguucugacuggaaucuagcucguacauauggauuguggaaauaaaggaggacguggaaagcuugccauauuuuauuucaaguuaauacuaaagcugccagacuuaauacaacuuucuuuuaaucuuuauggaucacauauuuucugaaaauuacaugauaaaacaagguuugguuuguuccauguguccauuu

SEQ ID NO: 20867 - RNA, 1135 nt, Homo sapiens
cgggaaccggcucugaaaggcgaugccggggccccgcggcgccgcgcaggccaggaacgcugcugucuggcucuaggccuggggcagguucccggguguggggcgcuggcggaccgggcaucaguguguguuggggcgcggguaauucguaauccggggccuacagccuuccucccgcaaggggacugccuucgcccuucccccgggacagauuugcgcacuuuccuuucgacggcagcacuacacccuccuagccagugaaaacugcaauguugcuccuccacuggaggaauccuaaaagucucccucuaguuggccuuacgaaaaucgagaaaacuacauacccagaagacugccacaaaaacugacucuucagagucuuuuacaaguuuaagaacucuuugggucuuaaggaauuucccagggccuuaguuuucuuguacuuaauaagcuuuccaacaggggcccuuagauuguaugcuuauauuaauccuuuauaauuuacuccgaaucaccagcuuuccuuuuuuccuccaucuuacucuugccauucccucuuuuuaacccugucuuccauacagcaccaaccuccuagcaucgguuuccuagaggugcagcuuccuuagcaaaugauauauuccaugcuaaggcagguggaagaguaucucguuaggacagaauuuuccguuguuuuuccaguguuuguuaccuggggugaaaaucuuaacucugcacuuugacuccacauuugaguuuaugacaaauguugcugauacacccuccuuuuguuuuuacaguaauugacccaggacucauuuucaggaaagccugaaaaugaguaaaauagugaaaugaggaauuugaacauuuuaucuuuggauggggaucuucugaggaugcaaagagugauucauccaagccaugugguaaaaucaggaauuugaagaaaauggaaauguuuacauuuuuguugacguguauuuuucuaccccuccuaagagggcacagucucuucaccugugaaccaauuacuguucccagauguaugaaaauggccuacaacaugacguuuuucccuaaucugaugggucauuaugaccagaguauugccgcgguggaaauggaggugaguagu

SEQ ID NO: 20868 - RNA, 1135 nt, Homo sapiens
acuacucaccuccauuuccaccgcggcaauacucuggucauaaugacccaucagauuagggaaaaacgucauguuguaggccauuuucauacaucugggaacaguaauugguucacaggugaagagacugugcccucuuaggagggguagaaaaauacacgucaacaaaaauguaaacauuuccauuuucuucaaauuccugauuuuaccacauggcuuggaugaaucacucuuugcauccucagaagauccccauccaaagauaaaauguucaaauuccucauuucacuauuuuacucauuuucaggcuuuccugaaaaugaguccugggucaauuacuguaaaaacaaaaggaggguguaucagcaacauuugucauaaacucaaauguggagucaaagugcagaguuaagauuuucaccccagguaacaaacacuggaaaaacaacggaaaauucuguccuaacgagauacucuuccaccugccuuagcauggaauauaucauuugcuaaggaagcugcaccucuaggaaaccgaugcuaggagguuggugcuguauggaagacaggguuaaaaagagggaauggcaagaguaagauggaggaaaaaaggaaagcuggugauucggaguaaauuauaaaggauuaauauaagcauacaaucuaagggccccuguuggaaagcuuauuaaguacaagaaaacuaaggcccugggaaauuccuuaagacccaaagaguucuuaaacuuguaaaagacucugaagagucaguuuuuguggcagucuucuggguauguaguuuucucgauuuucguaaggccaacuagagggagacuuuuaggauuccuccaguggaggagcaacauugcaguuuucacuggcuaggaggguguagugcugccgucgaaaggaaagugcgcaaaucugucccgggggaagggcgaaggcaguccccuugcgggaggaaggcuguaggccccggauuacgaauuacccgcgccccaacacacacugaugcccgguccgccagcgccccacacccgggaaccugccccaggccuagagccagacagcagcguuccuggccugcgcggcgccgcggggccccggcaucgccuuucagagccgguucccg

SEQ ID NO: 20869 - RNA, 598 nt, Homo sapiens
ccucagcccccccggcucgcccugcagcccgcagcccccgccugccgcuccgggggccggcggaggcuccgggagcgcgccggggcccagccgcaucgccgacuaccugcugcugccccuagccgagcgcgagcaugugucccgggcgcugugcauccacacuggacgcgagcugcgcugcaagguaggcgcucccgggccaggacccggcuggggucgggggcgcgggacggggugguaggcaaaggugcuugggguccggccaacgcuugggcugggcacagggcggaucaguagauugggucagauaagacgccauuugaccagguucacguuuuuguggaucgagggguuucccauggagugauauaaugggggcgccuagaggaagugcaguguucaguggcuuucucuaucuguuccuuuccucagcgcccaguguagcgcguggcguuccauauaaguuguggaauugaaauggauuccagggccaugccauuccccuucucucauucuccucgcucuccacccccccucccccgccaauguccuggaaggacgcccuuuagugggugccuccuaggagcuuggagcagcu

SEQ ID NO: 20870 - RNA, 598 nt, Homo sapiens
agcugcuccaagcuccuaggaggcacccacuaaagggcguccuuccaggacauuggcgggggaggggggguggagagcgaggagaaugagagaaggggaauggcauggcccuggaauccauuucaauuccacaacuuauauggaacgccacgcgcuacacugggcgcugaggaaaggaacagauagagaaagccacugaacacugcacuuccucuaggcgcccccauuauaucacuccaugggaaaccccucgauccacaaaaacgugaaccuggucaaauggcgucuuaucugacccaaucuacugauccgcccugugcccagcccaagcguuggccggaccccaagcaccuuugccuaccaccccgucccgcgcccccgaccccagccggguccuggcccgggagcgccuaccuugcagcgcagcucgcguccaguguggaugcacagcgcccgggacacaugcucgcgcucggcuaggggcagcagcagguagucggcgaugcggcugggccccggcgcgcucccggagccuccgccggcccccggagcggcaggcgggggcugcgggcugcagggcgagccgggggggcugagg

SEQ ID NO: 20871 - RNA, 838 nt, Homo sapiens
ggcgggcacuuugcacuggaacuuacaacacccgagcaaggacgcgacucucccgacgcggggaggcuauucugcccauuuggggacacuuccccgccgcugccaggacccgcuucucugaaaggcucuccuugcagcugcuuagacgcuggauuuuuuucggguaguggaaaaccagguaagcaccgaaguccacuugccuuuuaauuuauuuuuuuaucacuuuaaugcugagaugagucgaaugccuaaauagggugucuuuucucccauuccugcgcuauugacacuuuucucagaguaguuaugguaacuggggcuggggugggggguaauccagaacuggaucgggguaaagugacuugucaagaugggagaggagaaggcagagggaaaacgggaaugguuuuuaagacuacccuuucgagauuucugccuuaugaauauauucacgcugacucccggccggucggacauuccugcuuuauuguguuaauugcucucuggguuuuggggggcuggggguugcuuugcggugggcagaaagccccuugcauccugagcuccuuggaguagggaccgcauaucgccugugugagccagaucgcuccgcagccgcugacuuguccccgucuccgggagggcauuuaaauuucggcucaccgcauuucugacagccggagacggacacugcggcgcgucccgcccgccuguccccgcggcgauuccaacccgcccugauccuuuuaagaaguuggcauuuggcuuuuuaaaaagcaauaauacaauuuaaaaccugggucucuagagguguuaggacgugguguuggguaggcgc

SEQ ID NO: 20872 - RNA, 838 nt, Homo sapiens
gcgccuacccaacaccacguccuaacaccucuagagacccagguuuuaaauuguauuauugcuuuuuaaaaagccaaaugccaacuucuuaaaaggaucagggcggguuggaaucgccgcggggacaggcgggcgggacgcgccgcaguguccgucuccggcugucagaaaugcggugagccgaaauuuaaaugcccucccggagacggggacaagucagcggcugcggagcgaucuggcucacacaggcgauaugcggucccuacuccaaggagcucaggaugcaaggggcuuucugcccaccgcaaagcaacccccagccccccaaaacccagagagcaauuaacacaauaaagcaggaauguccgaccggccgggagucagcgugaauauauucauaaggcagaaaucucgaaaggguagucuuaaaaaccauucccguuuucccucugccuucuccucucccaucuugacaagucacuuuaccccgauccaguucuggauuaccccccaccccagccccaguuaccauaacuacucugagaaaagugucaauagcgcaggaaugggagaaaagacacccuauuuaggcauucgacucaucucagcauuaaagugauaaaaaaauaaauuaaaaggcaaguggacuucggugcuuaccugguuuuccacuacccgaaaaaaauccagcgucuaagcagcugcaaggagagccuuucagagaagcggguccuggcagcggcggggaaguguccccaaaugggcagaauagccuccccgcgucgggagagucgcguccuugcucggguguuguaaguuccagugcaaagugcccgcc

SEQ ID NO: 20873 - RNA, 2033 nt, Homo sapiens
guguguuggccagaggaucagagaaguggccaccugugugggggcccaggagcccuggaucugucccccucagcuggagucaaaaggccuaacucaaagguagagcccaguugugcccagcagggacugguugagguggggaggaguguagggggcaugugaaccuagggaccuggucucucugcaucugccguucuucccuggcccacccaagccgguuggaccccuguccugcaaacacaccucccagcagguggcugcgcuccuggcggacucagcaauuggccuggcacauaguaggugcucaaugaacggucagugaaugauuaaugccugaaggaggggucuugggggcaaccaccccacccccgcccauggaaccauuacagccgccgggcucugccgugggggucggggagggguggggagaaagucugcgcggccggccccgcgcagcgucccugaucuaggggccuaugggguggguagggcgaggggauaccugauucucaguaacucuagaggcggcggcagcuucgcaugcagugcgcauuauugcucuauagucggcuucggacuaccuaagagggagggggagcgggcagccccggguaggaucgggaggagggguggggcugcaugcagugacgucacaaaggcggcggccaauggggcgggcccuuggggcggggucgccgccgaggcuuuggcauagacgggcgaaaguuggcaaccgagugggggcggggccugggucucaggggcggggccugggucucaggggaggggccugccucggagaggcggggccugaggcucccuagaggcucccagcuaggggcgggccucggggcguggaaaguaaucccggacaucccaggcccccggcgucggcgggcaagauggggguucagcgcccccucccugacccgagugcaauccguucauaaauaaaacguacaaauacagaaaaagaaacccgacgcguccgcaacccccccagggggcuuuacccgcaaagcgaagacagagguguguagagggcagcgcccaggccugccugccggccccgggaauccguccuccaacacgaaugccugggguacgggggggggggugggggcccggggcagggcggaagcggggucugaggaggucggauaaguccaugcgauucgauaugugucauuauuauucgauauggaggacagagcccgggaagcugggcuggaagaauucggauuuggcagaggaugcgaggcgaggguaggagggcggcuccgacugaggccccagaagcaacccgagggagggggugccgccguccgccccucuccccgacccacaacgcgucuaacacugccgggaguuccgcgaaggcugcuaggcaggggcgucccugcaggcccgcccgcuccugcuccgccccggccugcugccggggaggggccggcucccuggacgucugggccgcaggcccugcgcuagaaggcuugggaagggguggggaagaccugagucccugcgacgcgauccaggggcgcagaggcgggagaaggagggcgcucccuaccucaccucacccccgucuucagagacccaacucggagaugagguucgguucuaggucucgucgacccuauugcugggagaaagccgggggcacccuggaggggaggggagggggcucggggugggucuccccucgggacccuauugcuugaaggggccggcaaggccccuggcgggcggggcggggugggaccgggccccccucccccuauugcugugaggaggggcccgcccuccggccccuccacccggacgccagcgaagacuucccuggggggccguauugcugagagccgaccuggcugggggaggccccgccgcccuaggccugcacagggcugagcuguggcggcgcaggagccgcggggccuccggcgccgcccuugaagcaggccgacucguagugcuuguugagauaggacuugagcgcgaagcucuucuugcagcgcuugcacuggaag

SEQ ID NO: 20874 - RNA, 2033 nt, Homo sapiens
cuuccagugcaagcgcugcaagaagagcuucgcgcucaaguccuaucucaacaagcacuacgagucggccugcuucaagggcggcgccggaggccccgcggcuccugcgccgccacagcucagcccugugcaggccuagggcggcggggccucccccagccaggucggcucucagcaauacggccccccagggaagucuucgcuggcguccggguggaggggccggagggcgggccccuccucacagcaauagggggaggggggcccggucccaccccgccccgcccgccaggggccuugccggccccuucaagcaauagggucccgaggggagacccaccccgagcccccuccccuccccuccagggugcccccggcuuucucccagcaauagggucgacgagaccuagaaccgaaccucaucuccgaguugggucucugaagacgggggugaggugagguagggagcgcccuccuucucccgccucugcgccccuggaucgcgucgcagggacucaggucuuccccaccccuucccaagccuucuagcgcagggccugcggcccagacguccagggagccggccccuccccggcagcaggccggggcggagcaggagcgggcgggccugcagggacgccccugccuagcagccuucgcggaacucccggcaguguuagacgcguugugggucggggagaggggcggacggcggcacccccucccucggguugcuucuggggccucagucggagccgcccuccuacccucgccucgcauccucugccaaauccgaauucuuccagcccagcuucccgggcucuguccuccauaucgaauaauaaugacacauaucgaaucgcauggacuuauccgaccuccucagaccccgcuuccgcccugccccgggcccccacccccccccccguaccccaggcauucguguuggaggacggauucccggggccggcaggcaggccugggcgcugcccucuacacaccucugucuucgcuuugcggguaaagcccccuggggggguugcggacgcgucggguuucuuuuucuguauuuguacguuuuauuuaugaacggauugcacucgggucagggagggggcgcugaacccccaucuugcccgccgacgccgggggccugggauguccgggauuacuuuccacgccccgaggcccgccccuagcugggagccucuagggagccucaggccccgccucuccgaggcaggccccuccccugagacccaggccccgccccugagacccaggccccgcccccacucgguugccaacuuucgcccgucuaugccaaagccucggcggcgaccccgccccaagggcccgccccauuggccgccgccuuugugacgucacugcaugcagccccaccccuccucccgauccuacccggggcugcccgcucccccucccucuuagguaguccgaagccgacuauagagcaauaaugcgcacugcaugcgaagcugccgccgccucuagaguuacugagaaucagguauccccucgcccuacccaccccauaggccccuagaucagggacgcugcgcggggccggccgcgcagacuuucuccccaccccuccccgacccccacggcagagcccggcggcuguaaugguuccaugggcggggguggggugguugcccccaagaccccuccuucaggcauuaaucauucacugaccguucauugagcaccuacuaugugccaggccaauugcugaguccgccaggagcgcagccaccugcugggagguguguuugcaggacagggguccaaccggcuugggugggccagggaagaacggcagaugcagagagaccaggucccuagguucacaugcccccuacacuccuccccaccucaaccagucccugcugggcacaacugggcucuaccuuugaguuaggccuuuugacuccagcugagggggacagauccagggcuccugggcccccacacagguggccacuucucugauccucuggccaacacac

SEQ ID NO: 20875 - RNA, 982 nt, Homo sapiens
gagccauucugccacagccaggggagcacauucccucaugacuccugggcucccagagcuccccaacaccccccacagacacagaugccggcccgcaaaugcagccugccuuuucaauggcacagagaagcccccucuauccccagaagcaaagaaaauacuucucccauuggccaugccugaaauuccaccauuaaagaccauuccaucaugccuuuuugaguucugguucaaaggcacacccugugggaguggggacccacguaaagcugagacggaucuugacacuugaaaaaggacucccccaggaguguauggugcacagaggaggggacagacagaacucggagaucaaagagcgcaggaaaggugccaaguccaccggcugugaccgggaggucccaggcccagccggcccuggcagccacauccaaccuucugcucuaauguggacccaggaagugggagagaaccccaagagacaaaacucugaccccggugugggcaacgcggaccgccaaggcgcagugguggguggggaggaggcaggcuggugggcauacccagccggcccacucuacugaugcggagaccgagccccagggcagcagagcccuagcuucgcgcuacacggcugugggcgcugcgccccagggcacggccggcccaggucguggcccacucgggacccgcggcucaccggugcgguugacgcggcacgggaagcgguaggugcucagcaccuccuccucguccugcucgucgaugacccggcacuggcgcagauacggcgugagcuuggccggguucagggcgcgagccagccgaugccggacgcccucgauucgcucccacagcgcguccuccuccgccucagaccccgagccggccccggccuccuccucggccucccccgccuccgcccggcccggcauggccguguccucagggucugcgggcaagaggcgcacgggggucgacc

SEQ ID NO: 20876 - RNA, 982 nt, Homo sapiens
ggucgacccccgugcgccucuugcccgcagacccugaggacacggccaugccgggccgggcggaggcgggggaggccgaggaggaggccggggccggcucggggucugaggcggaggaggacgcgcugugggagcgaaucgagggcguccggcaucggcuggcucgcgcccugaacccggccaagcucacgccguaucugcgccagugccgggucaucgacgagcaggacgaggaggaggugcugagcaccuaccgcuucccgugccgcgucaaccgcaccggugagccgcgggucccgagugggccacgaccugggccggccgugcccuggggcgcagcgcccacagccguguagcgcgaagcuagggcucugcugcccuggggcucggucuccgcaucaguagagugggccggcuggguaugcccaccagccugccuccuccccacccaccacugcgccuuggcgguccgcguugcccacaccggggucagaguuuugucucuugggguucucucccacuuccuggguccacauuagagcagaagguuggauguggcugccagggccggcugggccugggaccucccggucacagccgguggacuuggcaccuuuccugcgcucuuugaucuccgaguucugucuguccccuccucugugcaccauacacuccugggggaguccuuuuucaagugucaagauccgucucagcuuuacguggguccccacucccacagggugugccuuugaaccagaacucaaaaaggcaugauggaauggucuuuaaugguggaauuucaggcauggccaaugggagaaguauuuucuuugcuucuggggauagagggggcuucucugugccauugaaaaggcaggcugcauuugcgggccggcaucugugucugugggggguguuggggagcucugggagcccaggagucaugagggaaugugcuccccuggcuguggcagaauggcuc

SEQ ID NO: 20877 - RNA, 3275 nt, Homo sapiens
auguagccagcaacccuugucuucccaguccucuccaucaccauacauacaguggacauccgcaccauuucccauccuuucugagccuaggccucagagacuuagccacuccaggcuggguucaccucaauaccaucuugguuguaggcucggcucucucccccaaugacaugcacugguugacacauaccacagugugacacgccauaggaugccacgagguacaaagggcaacagaaugacgcauacacacauauuuaaucuucccaugcacaugcucauccacccacuccacacacaguccagacacucugcaucccucaaucaugcuucugagucuccugucgacaguugccaccuccuuccugacacacugccccaggcggugacugugacaaggugacuccaugaccuuuucugacuugagcuaaauuccaaaauucuuuggaaaguuuccuaacauccuucgucagaacaaggaguuucugcacguaccaacacacaggaggaugcacccucagaacacagcacauucucacucccacccauauucacguuguuccacuucacacacacacacacacacacacacacacacagccacuugugcgcuucuucuggcgcacaugagcaaacugccuguugcuuuagguuucucuccaccgcuaggcuccuuuugguuagcucacccccacaacucauccccgggauuucccugaccacagccgcacucacgcccccgucuccccuuuuuccuucucuguccagccaucggggguuccugggcgguuaagcaucuccccggagucgcugcccagaaccacagcuuuccuuccgacacucaggaugggggagagaggggacgucggaggggcccggggugacgucgaggggacaaccccaccgcgggcggcgaggcgggcugggccccuggcgggcucuccccgcagcacacucucgccgcgcccccuggcggaugcuaguccucgacgggcuccggacgcucagcugagugaggcgggcgcgcgugggagggugucccaaggggagggguccgcggccagugcaggcccggaggcgggggccaccgggcagggggcgggggugagccccgacggccaacccgucagcucucggcucagacgggcgggaaccacagccccgcucgcugcccauugucugcgccccuaaccggugcgcccuggugccacagugcggcccggaggggcagccuccucccgucacuucagccagcgccgcaacuauaagaggcggugccgcccgccguggccgccucagcccaccagccgggaccgcgagccaugcuguccgccgcccgcccccaggguuguuaaagccagacugcgaacucucgccacugccgccaccgccgcgucccgucccaccgucgcgggcaacaaccaaagucgccgcaacugcagcacagagcgggcaaagccaggcaggccauggggcucugggcgcuguugccuggcuggguuucugcuacgcugcugcuggcgcuggccgcucugcccgcagcccuggcugccaacagcaguggccgauggugguaagugagcuggugcggggucgccacuugucccgcggcacagagccaggggccaacccuacccagcucccacgcucugggauccgucugccgacaggcucccuccccgcucugacuucccuccgcgacaccgaagggcgaucuggcaugaaacugccccagacuccagcucuguacaaguggggcgaaugauccgcccgcggaggccuaagauaccccaggcagggagcccacucucaucuagcaccgcccuuccccuuugagcgccaacuccagccucacggcgguggcucaccacagguuuccccaccucgggaagugaagggccaggaguucgccuagaaaggaggggagaagagggugggacuccuaagcauuucacgccuugggugggcaagaacugcaggccaugauuaucucgcucaggcugaccggaagaggcucggagauccaagguagacacucggucuccggguaccuccucuguccagucuccggaccuagggcucaggcgagcagcccugggacuacugggcacacacaagucuggacgcccaguucuuucaaauuagugagccugggagagcggguauuauuaaucucccgccauucucuccagccacauacccccaggaagaggaccggguggcacaguuuuuaugguuagggugcggauccccuuccugagccugagcuaucauacgucccaccagggguauugugaacguagccuccuccacgaaccugcuuacagacuccaagagucugcaacugguacucgagcccagucugcagcuguugagccgcaaacagcggcgucugauacgccaaaauccggggauccugcacagcgugaguggggggcugcagagugccgugcgcgagugcaaguggcaguuccggaaucgccgcuggaacugucccacugcuccagggccccaccucuucggcaagaucgucaaccgaggugggugcccaggaaggcgacgcuuccgggagcaggggaaacgcggggucacccccagggcaugggcgggcgaguucagagaaggugucccaggcgccuggagggucacacaaucaaccuugccaagugccucgugcccagcgccagcucggggccagacuucuaccaggcguuuuccagccgugcacccuggaaacgaagcuuaacuuuucugagcuacugccccagauaaagaaaguuucgggucgcggacgccggcugaccgccgcuuucccccagccucucucaaaagcgccugggaagcugcucucugcaggcgugugucuggccucucgcccagcaaggcuugcaccgccaaaaugggccgaaaguuuugggcugcgaagaagucuuggggauguaugguucuuccgcuccccucucuucgguuugucucucuggggcugcuccacuuccgcuaucgagccaaaaugcgcccuagaaucucccaguaaggugugauuacgcccguggacguggcugcgugcccacgcaccugcuuucucuacuagcccuagagaccagcuuuccagcacugccggcccuggcucucaggacucaaagugcggagucgggggugggauuccggucccaagcccuucaugagggugcuggccgcgccccgcguacccccucgcugauccccgcucccuucucccacaggcugucgagaaacggcguuuaucuucgcuauca

SEQ ID NO: 20878 - RNA, 3275 nt, Homo sapiens
ugauagcgaagauaaacgccguuucucgacagccugugggagaagggagcggggaucagcgaggggguacgcggggcgcggccagcacccucaugaagggcuugggaccggaaucccacccccgacuccgcacuuugaguccugagagccagggccggcagugcuggaaagcuggucucuagggcuaguagagaaagcaggugcgugggcacgcagccacguccacgggcguaaucacaccuuacugggagauucuagggcgcauuuuggcucgauagcggaaguggagcagccccagagagacaaaccgaagagaggggagcggaagaaccauacauccccaagacuucuucgcagcccaaaacuuucggcccauuuuggcggugcaagccuugcugggcgagaggccagacacacgccugcagagagcagcuucccaggcgcuuuugagagaggcugggggaaagcggcggucagccggcguccgcgacccgaaacuuucuuuaucuggggcaguagcucagaaaaguuaagcuucguuuccagggugcacggcuggaaaacgccugguagaagucuggccccgagcuggcgcugggcacgaggcacuuggcaagguugauugugugacccuccaggcgccugggacaccuucucugaacucgcccgcccaugcccugggggugaccccgcguuuccccugcucccggaagcgucgccuuccugggcacccaccucgguugacgaucuugccgaagagguggggcccuggagcagugggacaguuccagcggcgauuccggaacugccacuugcacucgcgcacggcacucugcagccccccacucacgcugugcaggauccccggauuuuggcguaucagacgccgcuguuugcggcucaacagcugcagacugggcucgaguaccaguugcagacucuuggagucuguaagcagguucguggaggaggcuacguucacaauaccccuggugggacguaugauagcucaggcucaggaaggggauccgcacccuaaccauaaaaacugugccacccgguccucuuccuggggguauguggcuggagagaauggcgggagauuaauaauacccgcucucccaggcucacuaauuugaaagaacugggcguccagacuugugugugcccaguagucccagggcugcucgccugagcccuagguccggagacuggacagaggagguacccggagaccgagugucuaccuuggaucuccgagccucuuccggucagccugagcgagauaaucauggccugcaguucuugcccacccaaggcgugaaaugcuuaggagucccacccucuucuccccuccuuucuaggcgaacuccuggcccuucacuucccgagguggggaaaccuguggugagccaccgccgugaggcuggaguuggcgcucaaaggggaagggcggugcuagaugagagugggcucccugccugggguaucuuaggccuccgcgggcggaucauucgccccacuuguacagagcuggagucuggggcaguuucaugccagaucgcccuucggugucgcggagggaagucagagcggggagggagccugucggcagacggaucccagagcgugggagcuggguaggguuggccccuggcucugugccgcgggacaaguggcgaccccgcaccagcucacuuaccaccaucggccacugcuguuggcagccagggcugcgggcagagcggccagcgccagcagcagcguagcagaaacccagccaggcaacagcgcccagagccccauggccugccuggcuuugcccgcucugugcugcaguugcggcgacuuugguuguugcccgcgacggugggacgggacgcggcgguggcggcaguggcgagaguucgcagucuggcuuuaacaacccugggggcgggcggcggacagcauggcucgcggucccggcuggugggcugaggcggccacggcgggcggcaccgccucuuauaguugcggcgcuggcugaagugacgggaggaggcugccccuccgggccgcacuguggcaccagggcgcaccgguuaggggcgcagacaaugggcagcgagcggggcugugguucccgcccgucugagccgagagcugacggguuggccgucggggcucacccccgcccccugcccgguggcccccgccuccgggccugcacuggccgcggaccccuccccuugggacacccucccacgcgcgcccgccucacucagcugagcguccggagcccgucgaggacuagcauccgccagggggcgcggcgagagugugcugcggggagagcccgccaggggcccagcccgccucgccgcccgcggugggguuguccccucgacgucaccccgggccccuccgacguccccucucucccccauccugagugucggaaggaaagcugugguucugggcagcgacuccggggagaugcuuaaccgcccaggaacccccgauggcuggacagagaaggaaaaaggggagacgggggcgugagugcggcuguggucagggaaaucccggggaugaguugugggggugagcuaaccaaaaggagccuagcgguggagagaaaccuaaagcaacaggcaguuugcucaugugcgccagaagaagcgcacaaguggcugugugugugugugugugugugugugugugugaaguggaacaacgugaauaugggugggagugagaaugugcuguguucugagggugcauccuccuguguguugguacgugcagaaacuccuuguucugacgaaggauguuaggaaacuuuccaaagaauuuuggaauuuagcucaagucagaaaaggucauggagucaccuugucacagucaccgccuggggcagugugucaggaaggagguggcaacugucgacaggagacucagaagcaugauugagggaugcagagugucuggacuguguguggaguggguggaugagcaugugcaugggaagauuaaauauguguguaugcgucauucuguugcccuuuguaccucguggcauccuauggcgugucacacugugguaugugucaaccagugcaugucauugggggagagagccgagccuacaaccaagaugguauugaggugaacccagccuggaguggcuaagucucugaggccuaggcucagaaaggaugggaaauggugcggauguccacuguauguauggugauggagaggacugggaagacaaggguugcuggcuacau

SEQ ID NO: 20879 - RNA, 719 nt, Homo sapiens
gccccccacaagcccaaagcuacaaggaugggaucugaguggucaaggcugcguguuggcucacauaugugcacguguauaugugucacaugcaggugggagcagggauaagagcaggugagugcuugccaugugggucaggcccccgggauacguggacaucuguugcgggggggugugguugugaaugguguggugugacucuggucgguaugugugucugucuccauaugggcuaagugcuugaauuagucaagugugacucggagcguguguguguauguguguguguacgcgcgugugugccaccagaggaagcagcagcaagaggcaggagcaucgauccgaaggagacagcgcggggagagggacgcuaggggcagacacccucccuccugcgcgcacacacgcgcgcgcgcacacacaccacacacagagucauacacacaagccauagggccucgcaggcagggagacggcuccgggacuggagagaggcagcgccgccgaaagcggccgcgaggaggggcgaggcggcgcggggagcccugggucccgcucccggauccggggccccgcgcgcacaccagcccagagacagccucgcagacacucguaggcgcgcacgcgcacccucuccccucccccuccccucccgccgccucccggccggacgauggaucccugcagaucccagggcugagagcaccgcgcaccgc

SEQ ID NO: 20880 - RNA, 719 nt, Homo sapiens
gcggugcgcggugcucucagcccugggaucugcagggauccaucguccggccgggaggcggcgggaggggagggggaggggagagggugcgcgugcgcgccuacgagugucugcgaggcugucucugggcuggugugcgcgcggggccccggauccgggagcgggacccagggcuccccgcgccgccucgccccuccucgcggccgcuuucggcggcgcugccucucuccagucccggagccgucucccugccugcgaggcccuauggcuuguguguaugacucuguguguggugugugugcgcgcgcgcgugugugcgcgcaggagggagggugucugccccuagcgucccucuccccgcgcugucuccuucggaucgaugcuccugccucuugcugcugcuuccucugguggcacacacgcgcguacacacacacauacacacacacgcuccgagucacacuugacuaauucaagcacuuagcccauauggagacagacacacauaccgaccagagucacaccacaccauucacaaccacacccccccgcaacagauguccacguaucccgggggccugacccacauggcaagcacucaccugcucuuaucccugcucccaccugcaugugacacauauacacgugcacauaugugagccaacacgcagccuugaccacucagaucccauccuuguagcuuugggcuuguggggggc

SEQ ID NO: 20881 - RNA, 491 nt, Homo sapiens
uccucuugugauccacacacaccaucucuucucaguucccuuucagcccccgucuucucacuccccaccgggucccugcaugccccucgucguccuacacauacacacuaaguggauugcacucccguccuccccuucuuccgcuccuccccacccuccagucccuccagccagcuguacagcucccaaauuccgggccgagauucccgggaacaaagcaagaaaaaucagagcaauuugggaaguaaacagaaacuggaaagggagagggaaagaagaguggggaggacccagguugggggggcccucuccagucccacccaguuuagggaaugccccugcccucucccccaccccccuucaccuggcucuuaaagggcccggccccuggccggcggcuacuuaagacagaggggcggcggcgggcagcagcugcgcugcgacugcucuggaaggagaggacggggcacaaacccugaccaugacccccc

SEQ ID NO: 20882 - RNA, 491 nt, Homo sapiens
ggggggucauggucaggguuugugccccguccucuccuuccagagcagucgcagcgcagcugcugcccgccgccgccccucugucuuaaguagccgccggccaggggccgggcccuuuaagagccaggugaaggggggugggggagagggcaggggcauucccuaaacugggugggacuggagagggcccccccaaccuggguccuccccacucuucuuucccucucccuuuccaguuucuguuuacuucccaaauugcucugauuuuucuugcuuuguucccgggaaucucggcccggaauuugggagcuguacagcuggcuggagggacuggaggguggggaggagcggaagaaggggaggacgggagugcaauccacuuaguguguauguguaggacgacgaggggcaugcagggacccgguggggagugagaagacgggggcugaaagggaacugagaagagaugguguguguggaucacaagagga

SEQ ID NO: 20883 - RNA, 6277 nt, Homo sapiens
cccugaguauaaaugcaaugcgacugcaaaaaaggcaaagaccucagacucuccuuccaagggaccugugguucgugcugcgaagaugcuuccacuuaaagcaugagaaauggggugccgggaugugggguguggugugugcccucauagaugggggugggaguguggcuggugugugugucaagcccucacucacccacgcacucacacacagcauucuguucuccaugcaaaguuaagaucgaauccauccgcuuguaggggaaaaaaaggaaaaaaauuaaccagagagggucuguaaucucgcagagcacaggcagaaucguuccuuccuugcugcauuuccuccuuagacuaauagacguuuuggaaaguucggcuaguguucguguguuugucguagcacccagagccuccaccaaacccucuccaugucuuuaccucccagucgcucuaagaaucugcuugaagucucguauuuguacugcuuucugcuuuucucccaccccuccuagcacccccacaucccccaucuaguaacaucucagaaauuucauccagaggaacaaaaaaauuaaaaauagaacauagcaaagcaaagacagaaugcccccccccccaaauauuguccugucccugucugggaguuguguuauuuaaagauauucuguauguuguaucuuuugcauguagcuuccuuaauggagaaaaaaaaaccuaauaaauuuccagaaucauaauccucaaauggaugguuuuuuguuuuuagugauuuuuagcaacaccccucccccgaagaggcugaguguguggauguguguguuuuguguuugacucaucuccuagagccuuucuagaacgucucuuggcggguuuaauguaagugagagaccauaacguugauuuaaauauuauccaggugaccacaauaagucaaggucauaaaacaguaaugucaggacggucuuggugcgcgcgagagguggauuuuaugaucugcaaauauaauguggugcugcaguaaaagaugcauuuaaaggugacuggaggagggaaagaggcagagagcaagcugcaaucuugaggagcagacggaucugauugccuggggugcugggcugggcgcaccccacugcugcugggggucaccccaagagccccccacccauccaaggaaaggaauaaacuuaaccgcuggaggggcaugaggagcucagcccccccaaccucgacagcagcuaacagaaacgccaggagcagcaggaggaggaggcagcgacaagguaagagaagcgguuucuuguucuucucuuggcggcggaguggggaugagcgguguccccagguguccggcgugcagcggacagagccuggaggaagguguuuagggcauccgugcuugccgagaacccaggcuuuccuaguggccgcuggcagcggagggcagcgacugggagcucccucuccuucccucccgggcccauugccauggggguuccacaguuaaagggauaaauugaugguuuuuggcuucuuuaucuuuucgggcacuuugggucuccucgaagucgacacucuggucuagguguugcucagucuggucgucuguuggugggggaggaggaguacagaggguugaagcuugaagcuuagguuuuccugcuuuucgcugguuuggaugugagccucguccagccucuuguucccugugcucccuggcuguaacguuuugccaggcaaguggccugauuggaaguggcuccagagcacagggcuaugauucagcuacccacauucgcugagaagccuaaaccgagcugagagggagaggaucagagggagucuagcaggagagugcaggagagccagauggacaagacaggggacccagcuccagaguggaaggaagauccagcuucccccagggccagggccagaugcaggggaauagcuccacugcggugcuggggguggggcagguauuuggccgccaguggucccauuucaccagauuuuuccugagcaauuugcuuagaccagaaacuaaugaaggcagucagaccccuuacccacccagcaacccaaagucuacucucuaguccuuagggagguugugggggcggaaagggggacggggcugaauuucuuccuuccccaacccccuucccuucuccuccagauagaugcaaagcugaaucucccgcccugcucgcucagcugaucuguggcuuagguaguuucauguuguugggauugaguuuugaacucggcaacaagaaacugccugaguuacaucagucgguuuucgucgagggccccaacccaccucucccacuccuacccuccccagugggacugccccacugcccccucccagauagggcaaagugggugcagaccaaggaggacaagcugugagugggguugcagaacaagucuggagaacccugcuuuaugccguccucucaaccuaucccaaucccugugauuaagggagaggagucuuuccugcagcuauugucuccugggcccagcugauggagacagacaaagaggguccagccaauuccaaggaaauucaggaguuugaguaagagguggccuggcgggccagcucaguugggcagcaggguggggcagaauuauuagcagaaagaggagcacagaaagagaagacggucucuggaaugguuagccucucccaccuaccaccuccagucgacuggggcucaagauucuccuuagaaaagugggguaccuggagguuccaagaguuggggaacucugagcgccagcccagcccuuuccccuuccccuucuauagcuccaucuccaggggaaggacauguuugggguguugguagguuagaggaaagccaucaaaguccaaguagaaccccucacacacgcacacgcacgcaacugggaaacaucagggcaaaaaccugacucuggucucuguuuagucgucuguggccugaaggccucaguuucuguggcugugacugucaggcagcugccugucuuugcacuauguggaaacaucugggugaacagaggcugcccgugcccaccauugcuauguugguggaaagguuguuggcugaugccagggggaggaggggaggagaaugggguagaggaaaaucugagcagugugaaacuuugcaaagcuuccucucauccuuucccccuugguucuucaauucuggcccugguugcuacagagaaaguucucaaaagagguuucuuugccugccugcgggcggaguugggggggggggaauaaaugggggagggguuauggagacugaggagauacaccccuguucucagagauacuggggaagagaagccaaaagaaggucagguucuugguucucuuacuuugaaauuauuaugauuauuaaaacauuauaaacgucuagacagggaaacaaaauuaugucccuguaacaaaauauauacagaguucuauauucucacagucaucugcugggagggauauaugugaccuuguaugaguguagggcucuguuucugucuccccuaggcucucuuaaauacccuguauguauuuauacgcauacacauuuauuuuuccccucucuuaugcgaacauauuuguuuugacucccaaggaagcuggaggagaaaaugggaauagaauuuccugucucccuagcuggauuguuggucugucugucccccaucccuuugugagagaaaaaauuucuucucuuggagagaaguauucaaaccucucuauggcucccagggaaauggggaaguuuccagagagucaggccagcuggugggaagcaggcaagggauuccccuaguuugggagcuccuagcagccuuugagucuucaggcugccccaggcacacagucaguuggggcaaagcgugucccaggcagggacugggugcucaggagcauuuggcuuggagauagagucccugaugggccgaaauucacuaaugaacgacuucugugcuuugggucucugugcccccauuuccguuucagagcuguugggcuuaugugugggaggucagagagccagggguugaggugucuccuccccaaaugcagagaaauggagcgaggucucauagggccaaggugaggaccagucugguggucagaguccacccccggcacaaggccguggaucauggcuaaggcgaugguaauuauuuauucccuucgccggaagggagucuucagaaggaacagcgugaagagaagagaaaaaauuaucucucucgucuguggauauuaagauggauuuuuauuucuuaaaggacccuccccgccgagagcgcauaagcguaaacuuaauauaugcuccgcagcccaacuccagaaaucgcaauaaaaguuaaaaccuccccuacuguuuuuuuuuuaauuaugauaugggaaagaggagcaggauuuauagagcugaacucucaguguaugaauguuugagacuugcgggaggaagaaaaggcaagagcucgccaaggcgagccuuggucucugagaucucucgucggcugcuggggcuccggcucagccuggcagauccgcuguggccucucugggaccucgccccggcccacggccugacuucggcucggagaugcagcccuucccgagaacaggugaagaagacggcggcagcggggacugggggcuucgggugggaacgccagggcucagggcuuugugugggucgugcagggggcgagguucgaaguccugggcuggaccgcagcacgaguguggcccggacggcugcguggccagaagggguguucgggcagggugcgagagcaccggcaagguggauuguguauggacuuuggccgcagacagagcagagcgggcucccgggcuguggccggcggcgaggcgggcaaccgcauguugagucuauagaaaggaccuugaggucugcuggguguuugggcugcccugggggcggcggcccagaguguggagcaagcggcgcgcggggcgcggcggucagcgugggagaggcugcaggcccugcacgccucugcagcugccgggccguguccgggacgucugaacugaggccgaccaauggucacagcaugaaaaauaaaugcaauggaaggucuuucugucuuuucuuuuccgcguaaaagguccuuucuuuuuucucucuuucggauauaccuggauuugguccagaccagguugcccgcgggagggccccgcgagcggcagcgcgcgagggagggagagagagggagggcgagaaggagggagggagggaaggagggcgggcggcggcggccgugguggccggggcuucccuccccaggcgggagccgccuguccuguaucuauggccguggggagcgaaggaccagguaacgaaggcgcuuccgaagcgggauuggaccaaaccagagggacagagucuucugggucucucugccugaggcccuggagggagagaagguagggagaucggcgcccgccgggccuggcaaagaggccucgggaaauguugaaccuguaugugaucucaggcucacacucauguugugggucugucugccucaggagaugcgguuugccuuucugucugagacgccccaaacccugagcucuccuucccaaggcuggaaaaaaaaucgggaaaaacggcggaauuugcacuuucauucauuggguuaucugcaacugagaggggcugguuaaggcguccccaaguuggaagggcgcuuugcuucuguuuucuggaugcagaguccucugacucccucugccacgggcugaguuuccggcuccagguucgcgugucgcccugagguuugaggccagacagcucgcagucgggcagggagggcgggggagagacgagcggcucuggccccuuaauuguacuucgggcucguauugucucuccuuucgccaccuccgcuuccucagucugggcuccaaagucacugcaaauuuccuugcgacacauacaucacacaaaagaucagguaacaaggcgcucagggccacuggggcuccgggcagggcagggagcggcucuagcucuggggcggcucccccuccagccacucccaggcuggaaaaccagaccgcguugggggagccggaaauagccccgcuugcugcggagcgucagggcgggggcgccggcgggaaugcaggcccggcaggccguggcuuugagagagccacguucacaggcccuggggauuucacuccugcugggccucgggaccugacuccugg

SEQ ID NO: 20884 - RNA, 6277 nt, Homo sapiens
ccaggagucaggucccgaggcccagcaggagugaaauccccagggccugugaacguggcucucucaaagccacggccugccgggccugcauucccgccggcgcccccgcccugacgcuccgcagcaagcggggcuauuuccggcucccccaacgcggucugguuuuccagccugggaguggcuggagggggagccgccccagagcuagagccgcucccugcccugcccggagccccaguggcccugagcgccuuguuaccugaucuuuugugugauguaugugucgcaaggaaauuugcagugacuuuggagcccagacugaggaagcggagguggcgaaaggagagacaauacgagcccgaaguacaauuaaggggccagagccgcucgucucucccccgcccucccugcccgacugcgagcugucuggccucaaaccucagggcgacacgcgaaccuggagccggaaacucagcccguggcagagggagucagaggacucugcauccagaaaacagaagcaaagcgcccuuccaacuuggggacgccuuaaccagccccucucaguugcagauaacccaaugaaugaaagugcaaauuccgccguuuuucccgauuuuuuuuccagccuugggaaggagagcucaggguuuggggcgucucagacagaaaggcaaaccgcaucuccugaggcagacagacccacaacaugagugugagccugagaucacauacagguucaacauuucccgaggccucuuugccaggcccggcgggcgccgaucucccuaccuucucucccuccagggccucaggcagagagacccagaagacucugucccucugguuugguccaaucccgcuucggaagcgccuucguuaccugguccuucgcuccccacggccauagauacaggacaggcggcucccgccuggggagggaagccccggccaccacggccgccgccgcccgcccuccuucccucccucccuccuucucgcccucccucucucucccucccucgcgcgcugccgcucgcggggcccucccgcgggcaaccuggucuggaccaaauccagguauauccgaaagagagaaaaaagaaaggaccuuuuacgcggaaaagaaaagacagaaagaccuuccauugcauuuauuuuucaugcugugaccauuggucggccucaguucagacgucccggacacggcccggcagcugcagaggcgugcagggccugcagccucucccacgcugaccgccgcgccccgcgcgccgcuugcuccacacucugggccgccgcccccagggcagcccaaacacccagcagaccucaagguccuuucuauagacucaacaugcgguugcccgccucgccgccggccacagcccgggagcccgcucugcucugucugcggccaaaguccauacacaauccaccuugccggugcucucgcacccugcccgaacaccccuucuggccacgcagccguccgggccacacucgugcugcgguccagcccaggacuucgaaccucgcccccugcacgacccacacaaagcccugagcccuggcguucccacccgaagcccccaguccccgcugccgccgucuucuucaccuguucucgggaagggcugcaucuccgagccgaagucaggccgugggccggggcgaggucccagagaggccacagcggaucugccaggcugagccggagccccagcagccgacgagagaucucagagaccaaggcucgccuuggcgagcucuugccuuuucuuccucccgcaagucucaaacauucauacacugagaguucagcucuauaaauccugcuccucuuucccauaucauaauuaaaaaaaaaacaguaggggagguuuuaacuuuuauugcgauuucuggaguugggcugcggagcauauauuaaguuuacgcuuaugcgcucucggcggggaggguccuuuaagaaauaaaaauccaucuuaauauccacagacgagagagauaauuuuuucucuucucuucacgcuguuccuucugaagacucccuuccggcgaagggaauaaauaauuaccaucgccuuagccaugauccacggccuugugccggggguggacucugaccaccagacugguccucaccuuggcccuaugagaccucgcuccauuucucugcauuuggggaggagacaccucaaccccuggcucucugaccucccacacauaagcccaacagcucugaaacggaaaugggggcacagagacccaaagcacagaagucguucauuagugaauuucggcccaucagggacucuaucuccaagccaaaugcuccugagcacccagucccugccugggacacgcuuugccccaacugacugugugccuggggcagccugaagacucaaaggcugcuaggagcucccaaacuaggggaaucccuugccugcuucccaccagcuggccugacucucuggaaacuuccccauuucccugggagccauagagagguuugaauacuucucuccaagagaagaaauuuuuucucucacaaagggaugggggacagacagaccaacaauccagcuagggagacaggaaauucuauucccauuuucuccuccagcuuccuugggagucaaaacaaauauguucgcauaagagaggggaaaaauaaauguguaugcguauaaauacauacaggguauuuaagagagccuaggggagacagaaacagagcccuacacucauacaaggucacauauaucccucccagcagaugacugugagaauauagaacucuguauauauuuuguuacagggacauaauuuuguuucccugucuagacguuuauaauguuuuaauaaucauaauaauuucaaaguaagagaaccaagaaccugaccuucuuuuggcuucucuuccccaguaucucugagaacagggguguaucuccucagucuccauaaccccucccccauuuauucccccccccccaacuccgcccgcaggcaggcaaagaaaccucuuuugagaacuuucucuguagcaaccagggccagaauugaagaaccaagggggaaaggaugagaggaagcuuugcaaaguuucacacugcucagauuuuccucuaccccauucuccuccccuccucccccuggcaucagccaacaaccuuuccaccaacauagcaauggugggcacgggcagccucuguucacccagauguuuccacauagugcaaagacaggcagcugccugacagucacagccacagaaacugaggccuucaggccacagacgacuaaacagagaccagagucagguuuuugcccugauguuucccaguugcgugcgugugcgugugugagggguucuacuuggacuuugauggcuuuccucuaaccuaccaacaccccaaacauguccuuccccuggagauggagcuauagaaggggaaggggaaagggcugggcuggcgcucagaguuccccaacucuuggaaccuccagguaccccacuuuucuaaggagaaucuugagccccagucgacuggaggugguaggugggagaggcuaaccauuccagagaccgucuucucuuucugugcuccucuuucugcuaauaauucugccccacccugcugcccaacugagcuggcccgccaggccaccucuuacucaaacuccugaauuuccuuggaauuggcuggacccucuuugucugucuccaucagcugggcccaggagacaauagcugcaggaaagacuccucucccuuaaucacagggauugggauagguugagaggacggcauaaagcaggguucuccagacuuguucugcaaccccacucacagcuuguccuccuuggucugcacccacuuugcccuaucugggagggggcaguggggcagucccacuggggaggguaggagugggagagguggguuggggcccucgacgaaaaccgacugauguaacucaggcaguuucuuguugccgaguucaaaacucaaucccaacaacaugaaacuaccuaagccacagaucagcugagcgagcagggcgggagauucagcuuugcaucuaucuggaggagaagggaaggggguuggggaaggaagaaauucagccccgucccccuuuccgcccccacaaccucccuaaggacuagagaguagacuuuggguugcuggguggguaaggggucugacugccuucauuaguuucuggucuaagcaaauugcucaggaaaaaucuggugaaaugggaccacuggcggccaaauaccugccccacccccagcaccgcaguggagcuauuccccugcaucuggcccuggcccugggggaagcuggaucuuccuuccacucuggagcuggguccccugucuuguccaucuggcucuccugcacucuccugcuagacucccucugauccucucccucucagcucgguuuaggcuucucagcgaauguggguagcugaaucauagcccugugcucuggagccacuuccaaucaggccacuugccuggcaaaacguuacagccagggagcacagggaacaagaggcuggacgaggcucacauccaaaccagcgaaaagcaggaaaaccuaagcuucaagcuucaacccucuguacuccuccucccccaccaacagacgaccagacugagcaacaccuagaccagagugucgacuucgaggagacccaaagugcccgaaaagauaaagaagccaaaaaccaucaauuuaucccuuuaacuguggaacccccauggcaaugggcccgggagggaaggagagggagcucccagucgcugcccuccgcugccagcggccacuaggaaagccuggguucucggcaagcacggaugcccuaaacaccuuccuccaggcucuguccgcugcacgccggacaccuggggacaccgcucauccccacuccgccgccaagagaagaacaagaaaccgcuucucuuaccuugucgcugccuccuccuccugcugcuccuggcguuucuguuagcugcugucgagguugggggggcugagcuccucaugccccuccagcgguuaaguuuauuccuuuccuuggauggguggggggcucuuggggugacccccagcagcaguggggugcgcccagcccagcaccccaggcaaucagauccgucugcuccucaagauugcagcuugcucucugccucuuucccuccuccagucaccuuuaaaugcaucuuuuacugcagcaccacauuauauuugcagaucauaaaauccaccucucgcgcgcaccaagaccguccugacauuacuguuuuaugaccuugacuuauuguggucaccuggauaauauuuaaaucaacguuauggucucucacuuacauuaaacccgccaagagacguucuagaaaggcucuaggagaugagucaaacacaaaacacacacauccacacacucagccucuucgggggagggguguugcuaaaaaucacuaaaaacaaaaaaccauccauuugaggauuaugauucuggaaauuuauuagguuuuuuuuucuccauuaaggaagcuacaugcaaaagauacaacauacagaauaucuuuaaauaacacaacucccagacagggacaggacaauauuugggggggggggcauucugucuuugcuuugcuauguucuauuuuuaauuuuuuuguuccucuggaugaaauuucugagauguuacuagaugggggaugugggggugcuaggaggggugggagaaaagcagaaagcaguacaaauacgagacuucaagcagauucuuagagcgacugggagguaaagacauggagaggguuugguggaggcucugggugcuacgacaaacacacgaacacuagccgaacuuuccaaaacgucuauuagucuaaggaggaaaugcagcaaggaaggaacgauucugccugugcucugcgagauuacagacccucucugguuaauuuuuuuccuuuuuuuccccuacaagcggauggauucgaucuuaacuuugcauggagaacagaaugcugugugugagugcgugggugagugagggcuugacacacacaccagccacacucccacccccaucuaugagggcacacaccacaccccacaucccggcaccccauuucucaugcuuuaaguggaagcaucuucgcagcacgaaccacaggucccuuggaaggagagucugaggucuuugccuuuuuugcagucgcauugcauuuauacucaggg

SEQ ID NO: 20885 - RNA, 1606 nt, Homo sapiens
gagaauggggaucagggaugaggagugggcaucuccccagauuagagaauucuacacacacacacacacacacacacacucacucucacucacucacuccaaucagggagacaggcgccuucugaggauugcacaggagggcuaggguggggggcaggugggagcugcagggccagaaaaaggggaaagaaggagaaacagcaggggagggggugcagaccccugggugugaggaagugucugggggagucccaggagggggcugcaggaaaucuuuuccuccagccccauaaggggccagggccuaauuauacuccucugaaggcuucccucccugcccucagcuacucccauaaaccugaaauuggaggcuuggcuccugcagagccuguccuggggcuggcaggaggggggcacuggaggccaaacaggaaaacuaagauauaggggagccuguccccaaggccagcggcucucuggggagaggagaaagacuuuucccgucucagcaucacccugagaauucgccucagcaggguugaacuccaagcgggaggauggugcugcagaggguggugagggguuuagggauucucagggucaggaagcagaacugcuaaaauuucaggacuuggucgugggcugggaggaugggagggggcagaggaggagggagguggggaggagagagaccuugcuauaaaaauaaaaaacaagagagagaagcguuuaugggccuaugaaacgguugggaauuuggacuuuuuaugaggauauucucaaauuacuacucuugaagcugaggaccagacuagaggggcuuugauagcuuuggauuuccuacaguuuuaggugcuggaaacugaaaagggggaagcuggggaggggacagaaugcaaaacgaggaaggaggaaaauuccuaaagcaaaauguguccaaauucagguucaguuauugcauuuggggagccuggcuaagucuagggguagaguagcagaaguccugggcuggaaaggggcuccacugaccccugcuuguguuuggcccuccaggcaaccccguggccaacuggauucacgcccgcuccacgaggaagaagcgcugccccuacaccaaguaccagacgcuggaacuggagaaggaguuucucuucaauauguauuuaaccagggaccgucgguaugagguggcccggguucucaaucucaccgagcggcaggucaaaaucugguuucagaaucgaaggaugaagaugaaaaagaugaauaaagagaaaaccgacaaggagcaguccuaaacccuacccagccugcugccucagcacagccaagggaaaaacaaaaaccccacaaaauaccccaacacaggcgggggagagacgaaaaagaaaaggaaagagcaagauagacaaaagccaaucagcuuaaaaagaaaaacaaggaaggggaaaagaaaacucuugcgauuugggaggguucaguguugagauauugguguuuuagaguuaguucuacccagcgaggaggaggcggggagagaaacugcguucucuuuccccagcgcaaccgaaauaaaugacacauacaaaugugauuuuuuuccucc

SEQ ID NO: 20886 - RNA, 1606 nt, Homo sapiens
ggaggaaaaaaaucacauuuguaugugucauuuauuucgguugcgcuggggaaagagaacgcaguuucucuccccgccuccuccucgcuggguagaacuaacucuaaaacaccaauaucucaacacugaacccucccaaaucgcaagaguuuucuuuuccccuuccuuguuuuucuuuuuaagcugauuggcuuuugucuaucuugcucuuuccuuuucuuuuucgucucucccccgccuguguugggguauuuugugggguuuuuguuuuucccuuggcugugcugaggcagcaggcuggguaggguuuaggacugcuccuugucgguuuucucuuuauucaucuuuuucaucuucauccuucgauucugaaaccagauuuugaccugccgcucggugagauugagaacccgggccaccucauaccgacggucccugguuaaauacauauugaagagaaacuccuucuccaguuccagcgucugguacuugguguaggggcagcgcuucuuccucguggagcgggcgugaauccaguuggccacgggguugccuggagggccaaacacaagcaggggucaguggagccccuuuccagcccaggacuucugcuacucuaccccuagacuuagccaggcuccccaaaugcaauaacugaaccugaauuuggacacauuuugcuuuaggaauuuuccuccuuccucguuuugcauucuguccccuccccagcuucccccuuuucaguuuccagcaccuaaaacuguaggaaauccaaagcuaucaaagccccucuagucugguccucagcuucaagaguaguaauuugagaauauccucauaaaaaguccaaauucccaaccguuucauaggcccauaaacgcuucucucucuuguuuuuuauuuuuauagcaaggucucucuccuccccaccucccuccuccucugcccccucccauccucccagcccacgaccaaguccugaaauuuuagcaguucugcuuccugacccugagaaucccuaaaccccucaccacccucugcagcaccauccucccgcuuggaguucaacccugcugaggcgaauucucagggugaugcugagacgggaaaagucuuucuccucuccccagagagccgcuggccuuggggacaggcuccccuauaucuuaguuuuccuguuuggccuccagugccccccuccugccagccccaggacaggcucugcaggagccaagccuccaauuucagguuuaugggaguagcugagggcagggagggaagccuucagaggaguauaauuaggcccuggccccuuauggggcuggaggaaaagauuuccugcagcccccuccugggacucccccagacacuuccucacacccaggggucugcacccccuccccugcuguuucuccuucuuuccccuuuuucuggcccugcagcucccaccugccccccacccuagcccuccugugcaauccucagaaggcgccugucucccugauuggagugagugagugagagugaguguguguguguguguguguguguguagaauucucuaaucuggggagaugcccacuccucaucccugauccccauucuc

SEQ ID NO: 20887 - RNA, 1281 nt, Homo sapiens
cgggaaggucuaugccuuggacgagacguggcacccggaccuaggggagccauucggggugaugcgcugcgugcugugcgccugcgaggcggugagugcaccccgcggccggcccgggcccuggcggguggggagcgccgggucgcgcgggcgucggaguggacucggagcugcugagaaggagcccagucggcagauguuggggauauuuuucugguggaggaaggggaaucagccccuccaauucuuaggugcuguuacugaucgcccacucugugugaggcucugugccaacuccguuucguucccugcucaucuaacucucauggcagccuugcuagauagagaguauuauuauccccauuuuccagacagggaccuugaggcccagagagaugaaguagcuugucuagggucacgcagcuuguaaguggcagagcuggcugacucugcgggacauccuugccugggggggucucaucaguuggcaucuugcacucacuuggguuucccgccuuuuccgggagcagccucaguggggucgccguaccaggggcccuggcagggucagcugcaagaacaucaaaccagagugcccaaccccggccugugggcagccgcgccagcugccgggacacugcugccagaccugcccccaggguaagucuugcuccgcccugcggggagggaggcagggccacgauacuaggucccgggccacuuggauggggcgucggacuggccuuucccauggccagcugaagcccguguucuuacccccccgcccgcagagcgcagcaguucggagcggcagccgagcggccuguccuucgaguauccgcgggacccggagcaucgcaguuauagcgaccgcggggagccaggcgcugaggagcgggcccguggugacggccacacggguagggggcuggcgaacagcgggguugugguugaggcugggccaccaaagcggcguuugacagugcucaggccaucuuccucccgucccagacuucguggcgcugcugacagggccgaggucgcaggcgguggcacgagcccgagucucgcugcugcgcucuagccuccgcuucucuaucuccuacaggcggugagaaaggggaaggagcaaggaggggucagcugccggggcccgggagggaaacugggagagcugggaggggcugcuuuuggcucaguccggccucacccgaccucucauucccaggcuggaccgcccuaccaggauccgcuucucagacuccaauggcaguguccugu

SEQ ID NO: 20888 - RNA, 1281 nt, Homo sapiens
acaggacacugccauuggagucugagaagcggauccugguagggcgguccagccugggaaugagaggucgggugaggccggacugagccaaaagcagccccucccagcucucccaguuucccucccgggccccggcagcugaccccuccuugcuccuuccccuuucucaccgccuguaggagauagagaagcggaggcuagagcgcagcagcgagacucgggcucgugccaccgccugcgaccucggcccugucagcagcgccacgaagucugggacgggaggaagauggccugagcacugucaaacgccgcuuugguggcccagccucaaccacaaccccgcuguucgccagcccccuacccguguggccgucaccacgggcccgcuccucagcgccuggcuccccgcggucgcuauaacugcgaugcuccgggucccgcggauacucgaaggacaggccgcucggcugccgcuccgaacugcugcgcucugcgggcggggggguaagaacacgggcuucagcuggccaugggaaaggccaguccgacgccccauccaaguggcccgggaccuaguaucguggcccugccucccuccccgcagggcggagcaagacuuacccugggggcaggucuggcagcagugucccggcagcuggcgcggcugcccacaggccgggguugggcacucugguuugauguucuugcagcugacccugccagggccccugguacggcgaccccacugaggcugcucccggaaaaggcgggaaacccaagugagugcaagaugccaacugaugagacccccccaggcaaggaugucccgcagagucagccagcucugccacuuacaagcugcgugacccuagacaagcuacuucaucucucugggccucaaggucccugucuggaaaauggggauaauaauacucucuaucuagcaaggcugccaugagaguuagaugagcagggaacgaaacggaguuggcacagagccucacacagagugggcgaucaguaacagcaccuaagaauuggaggggcugauuccccuuccuccaccagaaaaauauccccaacaucugccgacugggcuccuucucagcagcuccgaguccacuccgacgcccgcgcgacccggcgcuccccacccgccagggcccgggccggccgcggggugcacucaccgccucgcaggcgcacagcacgcagcgcaucaccccgaauggcuccccuagguccgggugccacgucucguccaaggcauagaccuucccg

SEQ ID NO: 20889 - RNA, 539 nt, Homo sapiens
augcucugaagaaagauguaaguggggaaaugcugcucgcucuuuuaauuaaaaaacaaacacuuucucagcuacuaagagugaaaccccccgcccugcggggucuggcacucgcugguacugcguucucccaggcgggagggcccggccuuauucgcugggguccagagauaaugcuugcgcuccguggccgggaggagggacccccagcacucugaagcagcugacacggggcucacuuuccuuucuugccuacucuaugcagagcucgcggcauuccaagcuggagaaggcggacauucuggaaaugacagugaagcaccuccggaaccugcagcgggcgcagaugacgggugagggcggcucgccgcgucccccugugcgggcgucccgcucgccucgcggugauuucuuccagacuuccgcccgugguugugagaggcauucagcuacauuuuacugccuuggcucacucuugcguucccacggucuggggcuuauuuauagccacaacuccaaguuguuacuguuccggaaag

SEQ ID NO: 20890 - RNA, 539 nt, Homo sapiens
cuuuccggaacaguaacaacuuggaguuguggcuauaaauaagccccagaccgugggaacgcaagagugagccaaggcaguaaaauguagcugaaugccucucacaaccacgggcggaagucuggaagaaaucaccgcgaggcgagcgggacgcccgcacagggggacgcggcgagccgcccucacccgucaucugcgcccgcugcagguuccggaggugcuucacugucauuuccagaauguccgccuucuccagcuuggaaugccgcgagcucugcauagaguaggcaagaaaggaaagugagccccgugucagcugcuucagagugcugggggucccuccucccggccacggagcgcaagcauuaucucuggaccccagcgaauaaggccgggcccucccgccugggagaacgcaguaccagcgagugccagaccccgcagggcgggggguuucacucuuaguagcugagaaaguguuuguuuuuuaauuaaaagagcgagcagcauuuccccacuuacaucuuucuucagagcau

SEQ ID NO: 20891 - RNA, 286 nt, Homo sapiens
cucccuguucccggcagagccgcuucccccuccucccugugcugucugcaccgaggagagcggccugccgggugaguagguccggugccucugggcccucgggguccccucuccugcaggcucgaggugggcggggagaagggggacgggcgcggacccgggucccagggccaggccucccuugugaguagacuaugcaaagaaaguaaguuucuccuguguuucuuauucuuuguaacucuuacugcuguuaccacuauuauuugauccuaaaaaguaauucaca

SEQ ID NO: 20892 - RNA, 286 nt, Homo sapiens
ugugaauuacuuuuuaggaucaaauaauagugguaacagcaguaagaguuacaaagaauaagaaacacaggagaaacuuacuuucuuugcauagucuacucacaagggaggccuggcccugggacccggguccgcgcccgucccccuucuccccgcccaccucgagccugcaggagaggggaccccgagggcccagaggcaccggaccuacucacccggcaggccgcucuccucggugcagacagcacagggaggagggggaagcggcucugccgggaacagggag

SEQ ID NO: 20893 - RNA, 873 nt, Homo sapiens
aggggccccgaggcuccgccagaagccccggcagcgucucugcccccucccaggcggacgcgcagccccgggaagggagccgggcgggagccucgguggcgcacugagacuaacgcggcucggcccacggcgagggcggggugucgcggcuuuuguucccgcggaccuucugccucucagacagagcuuagggugcgagcgaacucccgggacguccagacuuggggaaggcgcgggguggcuaugggucuccgaccccucccauuucucgcaaguuacacaaaagggagacgcggacaugcacaaaguuugccuguggaaggcggugcgcgaccccgacgccggcucgggcuagggucgcacccaggcugccgccgccagcagccgcgaaaagagguuggagcaaggaagggggaugggggugagagaggaaggugaaacgaggcggagaacgcagggaaaagcgaggggcuccuagcuuccugggcugucccgacuccuccuccuccuccccagggcccaagagaaaggaaagggcaacgauucaagagcgaaggacuggcuuuagggacgcugcguuuucgguuuuccccacgugcuccuucccccuuccccccugucugaaugucucucgccucccccgacccccgcuuccaaggcagggacuaagucggggucugggcucagggucgcccccuacccuucucgccccgggcuggcgcggaaccagggagaccagcgccucgcccgcucccucucagcgggccggagcgcgacucccuggggcagggcugggccgaaagcggggaugcgcuggacguccgcaagcgggggcggagaggagaggggucccauugacggacccccggcuuc

SEQ ID NO: 20894 - RNA, 873 nt, Homo sapiens
gaagccggggguccgucaaugggaccccucuccucuccgcccccgcuugcggacguccagcgcauccccgcuuucggcccagcccugccccagggagucgcgcuccggcccgcugagagggagcgggcgaggcgcuggucucccugguuccgcgccagcccggggcgagaaggguagggggcgacccugagcccagaccccgacuuagucccugccuuggaagcgggggucgggggaggcgagagacauucagacaggggggaagggggaaggagcacguggggaaaaccgaaaacgcagcgucccuaaagccaguccuucgcucuugaaucguugcccuuuccuuucucuugggcccuggggaggaggaggaggagucgggacagcccaggaagcuaggagccccucgcuuuucccugcguucuccgccucguuucaccuuccucucucacccccaucccccuuccuugcuccaaccucuuuucgcggcugcuggcggcggcagccugggugcgacccuagcccgagccggcgucggggucgcgcaccgccuuccacaggcaaacuuugugcauguccgcgucucccuuuuguguaacuugcgagaaaugggaggggucggagacccauagccaccccgcgccuuccccaagucuggacgucccgggaguucgcucgcacccuaagcucugucugagaggcagaagguccgcgggaacaaaagccgcgacaccccgcccucgccgugggccgagccgcguuagucucagugcgccaccgaggcucccgcccggcucccuucccggggcugcgcguccgccugggagggggcagagacgcugccggggcuucuggcggagccucggggccccu

SEQ ID NO: 20895 - RNA, 1687 nt, Homo sapiens
cuuccaggcaugauugauuauuuggaacagagccuuccacuccggacugagacccaaccccugcagaaaguccuaaacugggcugcgaccacuuugcucccaggagcagaggagcaggggaaaaggggagaauucuuuaaaaaaugacacgcgagagaguuaaagaaggaaaaaggcaccaaagugaugaaacaaaaagaacuggagaauaagcacugcacagagagaaggccguagcaggaaggaccggcagugacuuucaacagugcuugagagcagaauuauggccgcgagagggagugcaaacugggaggcggggcaaacccgggaaagaccucccaagcagguucugcgaaggggccccaccgccuucagcccgccugggucagccuuauaagggggaaaggggacagaagucugcagaacagagauccuagcguagccgcucaggguaccuucccaggucaccauugcuccucugcccucuccacauccgcccucccgugagcgcaggaugcacgcacaggcagcgguuacaaaacucagcgcaacguugcaacccgcacaaaaggcgcacacaaaaucauuaaaaagaaauacacagaguggaaagaacucgcacaagcuccaacucgcuaaagguggaaggagucagguuacaaacucucccuccccggccuaaaugcuuugcuuuaguuugcagaaaaucguuugucaguuuuuuucuugguuauucauuauucgggcaaaugcaaguauguuuucuagcugaguucaccaauccaaaccucaaaccacauuccuccacuccaggccuccguucuguccgcggacuuaugauccugccugccagcaggagucuacccugaagucgcgugggauagauaaagugaggagaggaggaugaauggacagacaaacgagagcaauucuucuaccugugggcuguccuacgccuugcagugccggguccugcggcgaccacugagccccuucguccucgcccucagucccuucguccucgucuucggucuccgcuuucccagucggccggggcucgucguccacgaccccgcacgugccgccgacgucgcccugccgauuccgccgcaggagguggaacuguaguggugccggcggcuucuccccuggggcggcgguggcgaggcgcucgcuggcggcgggcagcggcuggaugaaauacgccucccccagcagguagaaggcgccgcgcacgcccucgcagaggcugagggcggcagccgagcugggaucgccauucacggugccggaguagaagcagugcgccaggucgguuuccggaagcggcgucucggacccggauuugcgccccacguucuggagcgugaagccgggcgccaaaaagcugcugucgggccgcagcuccagauccagcugcuggucaaaggcgugcaggcggaggcgcguggucccgugucccggggcgcgcuccagcuccggcaccacuagcuccucguccuccucggaggggcgcccgagugcguccgacacggccaguagcgccgcggcgagcagcagcagcguggguacuggcccaaagcuccgagaccccggagcccgcuccgcguuccccaugucgcugcccagcuugcgccuuccgaaccccucgggcacagcucgcugcauuggagccccaggagacacc

SEQ ID NO: 20896 - RNA, 1687 nt, Homo sapiens
ggugucuccuggggcuccaaugcagcgagcugugcccgagggguucggaaggcgcaagcugggcagcgacauggggaacgcggagcgggcuccggggucucggagcuuugggccaguacccacgcugcugcugcucgccgcggcgcuacuggccgugucggacgcacucgggcgccccuccgaggaggacgaggagcuaguggugccggagcuggagcgcgccccgggacacgggaccacgcgccuccgccugcacgccuuugaccagcagcuggaucuggagcugcggcccgacagcagcuuuuuggcgcccggcuucacgcuccagaacguggggcgcaaauccggguccgagacgccgcuuccggaaaccgaccuggcgcacugcuucuacuccggcaccgugaauggcgaucccagcucggcugccgcccucagccucugcgagggcgugcgcggcgccuucuaccugcugggggaggcguauuucauccagccgcugcccgccgccagcgagcgccucgccaccgccgccccaggggagaagccgccggcaccacuacaguuccaccuccugcggcggaaucggcagggcgacgucggcggcacgugcggggucguggacgacgagccccggccgacugggaaagcggagaccgaagacgaggacgaagggacugagggcgaggacgaaggggcucaguggucgccgcaggacccggcacugcaaggcguaggacagcccacagguagaagaauugcucucguuugucuguccauucauccuccucuccucacuuuaucuaucccacgcgacuucaggguagacuccugcuggcaggcaggaucauaaguccgcggacagaacggaggccuggaguggaggaaugugguuugagguuuggauuggugaacucagcuagaaaacauacuugcauuugcccgaauaaugaauaaccaagaaaaaaacugacaaacgauuuucugcaaacuaaagcaaagcauuuaggccggggagggagaguuuguaaccugacuccuuccaccuuuagcgaguuggagcuugugcgaguucuuuccacucuguguauuucuuuuuaaugauuuugugugcgccuuuugugcggguugcaacguugcgcugaguuuuguaaccgcugccugugcgugcauccugcgcucacgggagggcggauguggagagggcagaggagcaauggugaccugggaagguacccugagcggcuacgcuaggaucucuguucugcagacuucuguccccuuucccccuuauaaggcugacccaggcgggcugaaggcgguggggccccuucgcagaaccugcuugggaggucuuucccggguuugccccgccucccaguuugcacucccucucgcggccauaauucugcucucaagcacuguugaaagucacugccgguccuuccugcuacggccuucucucugugcagugcuuauucuccaguucuuuuuguuucaucacuuuggugccuuuuuccuucuuuaacucucucgcgugucauuuuuuaaagaauucuccccuuuuccccugcuccucugcuccugggagcaaaguggucgcagcccaguuuaggacuuucugcagggguugggucucaguccggaguggaaggcucuguuccaaauaaucaaucaugccuggaag

SEQ ID NO: 20897 - RNA, 5221 nt, Homo sapiens
uggcaggaucuugggcaaaugcccacagcucucugagagucaguuuuccugucuguaaaaugggagucauaccuuccuccuauggccggugagagacuaaauuaaacuaugucugucaagacaccugaaacuccuggcacaauuuagguugccuucaaguggucacaguugucauuagguggaagucaacaccccaaucauuguaaaggugcccauauaccccaagauccagauuacagcucucacaguuuauuauauacagcgaaaaaacacauaacacaccuuugcccacauuuacauguauuuuacggaccauguuucacaucaguccgcaugcacaucugcacgugugugcauucggcaguauuuaccaagcaccugccaagugccagggccuguccuccgcacccggcgugaacuguccuggaccagucccgggagccgcgguucugaccagccgugcugacccuggacgacuccaugagcuguuuugugagaaagacacgccauuuguuugcagaguucugacuucugaggggucauguagcacauguuugguagccaaacgcugucauucacgaccaggagcgauggcugcaaugccuuuuucuuugcuuugcuuuccggugccgggagccuugccucccgccgccaccccuggucagcucugcgcaagaacgucguucuguuuggcagccaggccgagacgcagccugaaugugagcaggaacucggagaagggaagggagagaaucagaaagaaggcccgggagggacccgggaagcagugggaggucugcgcccuggagccccgcgagagcccgccgguuuggcacgggcuccucccgggccgcccggcgguccaacaaaggccggccccgacacgcacccggucuuuugugggagagaaacacaaagaagagggaaaaacacggaggaggccaacagcaccaggacgcgggggccaaccaggaacucccggagccggggcccauuagccucugcaaaugagcacuccauuccccaggaaggggccccagcugcgcgcgcuggugggaaccgcagugccugggacccgcccaggucgcccaccccgggcgccgggcgcaggacccggacaaguccuggggacgccuccaggacgcaccagggcaagcuugggcaccgggaucuaauuucuaguuauuccugggacgggguggggaggcauaggagacacaccgagagguacucagcauccgauuggcaccagggccaagggagcccaggggcgacacagaccuccccgaccucccaagcuacuccggcgacgggaggauguugagggaagccugccaggugaagaaggggccagcagcagcacagagcuuccgacuuugccuuccaggcucuagacucgcgccaugccaagacgggccccucgacuuucaccccugacucccaacuccagccacuggaccgagcgcgcaaagaaccugagaccgcuugcucucaccgccgcaagucggucgcaggacagacaccagugggcagcaacaaaaaaagaaaccggguuccgggacacgugccggcggcuggacuaaccucagcggcugcaaccaaggagcgcgcacguugcgccugcugguguuuauuagcuacacuggcaggcgcacaacuccgcgccccgacugguggccccacagcgcgcaccacacauggccucgcugcuguuggcgggguaggcccgaaggaggcaucuacaaaugcccgagcccuuucugauccccacccccccgcucccugcgucguccgagugacagauucuacuaauugaacgguuaugggucauccuuguaaccguuggacgacauaacaccacgcuucaguucuucauguuuuaaauacauauuuaacggauggcugcagagccagcugggaaacacgcggauugaaaaauaaugcuccagaaggcacgagacuggggcgaaggcgagagcgggcugggcuucuagcggagaccgcagagggagacauaucucagaacuaggggcaauaacguggguuucucuuuguauuuguuuauuuuguaacuuugcuacuugaagaccaauuauuuacuaugcuaauuuguuugcuuguuuuuaaaaccguacuugcacaguaaaaguuccccaacaacggaaguaacccgacguuccucacacucccuaggagacugugugcgugugugcccgcgcgugcgcucacagugucaagugcuagcauccgagaucugcagaaacaaaugucugaauucgaaauguaugggugugagaaauucagcucggggaagagauuagggacugggggagacagguggcugccuguacuauaaggaaccgccaacgccagcaucuguaguccaagcagggcugcucuguaaaggcuuagcaauuuuuucuguaggcuugcugcacacggucucuggcuuuucccaucuguaaaaugggugaaugcauccguaccucagcuaccuccgugaggugcuucuccaguucgggcuuaauuccucaucgucaagaguuuucagguuucagagccagccugcaaucgguaaaacaugucccaacgcggucgcgagugguuccaucucgcugucuggcccacagcguggagaagccuugcccaggccugaaacuucucuuugcaguuccagaaagcaggcgacugggacggaaggcucuuugcuaaccuuuuacagcggagcccugcuuggacuacagaugccagcguugccccugccccaaggcguguggugaucacaaagacgacacugaaaauacuuacuaucauccggcuccccugcuaauaaauggagggguguuuaacuacaggcacgacccugcccuugugcuagcgcgguuaccgugcggaaauaacucgucccuguacccacaccauccucaaccuaaaggagaguugugaauucuuucaaaacacucuucuggaguccguccccucccuccuugcccgcccucuaccccucaagucccugcccccagcugggggcgcuaccggcugccgucggagcugcagccacggccaucuccuagacgcgcgaguagagcaccaagauaguggggacuuugugccugggcaucguuuacauuuggggcgccaaaugcccacguguugaugaaaccagugagaugggaacaggcggcgggaaaccagacagaggaagagcuagggaggagaccccagccccggauccugggucgccaggguuuuccgcgcgcaucccaaaaggugcggcugcguggggcaucagguuaguuuguuagacucugcagagucuccaaaccaucccaucccccaaccugacucugugguggccguauuuuuuacagaaauuugaccacguucccuuucucccuuggucccaagcgcgcucagcccucccuccaucccccuugagccgcccuucuccucccccucgccuccucgggucccuccuccagucccuccccaagaaucucccggccacgggcgcccauugguugugcgcagggaggaggcgugugcccggccuggcgaguuucauugagcggaauuagcccggaugacaucagcuucccagccccccggcgggcccagcucauuggcgaggcagccccuccaggacacgcacauuguuccccgcccccgcccccgccaccgcugccgccgucgccgcugccaccgggcuauaaaaaccggccgagccccuaaaggugcggaugcuuauuauagaucgacgcgacaccagcgcccggugccagguucuccccugaggcuuuucggagcgagcuccucaaaucgcauccagaguaaguguccccgccccacagcagccgcagccuagaucccagggacagacucuccucaacucggcugugacccagaaugcuccgauacagggggucuggaucccuacucugcgggccauuucuccagagcgacuuugcucuucuguccuccccacacucaccgcugcaucucccucaccaaaagcgagaagucggagcgacaacagcucuuucugcccaagccccagucagcuggugagcuccccguggucuccagaugcagcacauggacucugggccccgcgccggcucugggugcaugugcgugugcguguguuugcugcguggugucgauggagauaagguggauccguuugaggaaccaaaucauuaguucucuaucuagaucuccauucuccccaaagaaaggcccucacuucccacucguuuauuccagcccgggggcucaguuuucccacaccuaacugaaagcccgaagccucuagaaugccacccgcaccccgagggucaccaacgcucccugaaauaaccuguugcaugagagcagaggggagauagagagagcuuaauuauagguacccgcgugcagcuaaaaggagggccagagauaguagcgagggggacgaggagccacgggccaccugugccgggaccccgcgcugugguacugcggugcaggcgggagcagcuuuucugucucucacugacucacucucucucucucucccucucucucucucucauucucucucuuuucuccuccucuccuggaaguuuucggguccgagggaaggaggacccugcgaaagcugcgacgacuaucuuccccuggggccauggacucggacgccagccugguguccagccgcccgucgucgccagagcccgaugaccuuuuucugccggcccggaguaagggcagcagcggcagcgccuucacugggggcaccguguccucguccaccccgagugacugcccgccggagcugagcgccgagcugcgcggcgcuaugggcucugcgggcgcgcauccuggggacaagcuaggaggcaguggcuucaagucauccucguccagcaccucgucgucuacgucgucggcggcugcgucguccaccaagaaggacaagaagcaaaugacagagccggagcugcagcagcugcgucucaagaucaacagccgcgagcgcaagcgcaugcacgaccucaacaucgccauggauggccuccgcgaggucaugccguacgcacacggcccuucggugcgcaagcuuuccaagaucgccacgcugcugcuggcgcgcaacuacauccucaugcucaccaacucgcuggaggagaugaagcgacuggugagcgagaucuacgggggccaccacgcuggcuuccac

SEQ ID NO: 20898 - RNA, 5221 nt, Homo sapiens
guggaagccagcgugguggcccccguagaucucgcucaccagucgcuucaucuccuccagcgaguuggugagcaugaggauguaguugcgcgccagcagcagcguggcgaucuuggaaagcuugcgcaccgaagggccgugugcguacggcaugaccucgcggaggccauccauggcgauguugaggucgugcaugcgcuugcgcucgcggcuguugaucuugagacgcagcugcugcagcuccggcucugucauuugcuucuuguccuucuugguggacgacgcagccgccgacgacguagacgacgaggugcuggacgaggaugacuugaagccacugccuccuagcuuguccccaggaugcgcgcccgcagagcccauagcgccgcgcagcucggcgcucagcuccggcgggcagucacucgggguggacgaggacacggugcccccagugaaggcgcugccgcugcugcccuuacuccgggccggcagaaaaaggucaucgggcucuggcgacgacgggcggcuggacaccaggcuggcguccgaguccauggccccaggggaagauagucgucgcagcuuucgcaggguccuccuucccucggacccgaaaacuuccaggagaggaggagaaaagagagagaaugagagagagagagagggagagagagagagagugagucagugagagacagaaaagcugcucccgccugcaccgcaguaccacagcgcggggucccggcacagguggcccguggcuccucgucccccucgcuacuaucucuggcccuccuuuuagcugcacgcggguaccuauaauuaagcucucucuaucuccccucugcucucaugcaacagguuauuucagggagcguuggugacccucggggugcggguggcauucuagaggcuucgggcuuucaguuaggugugggaaaacugagcccccgggcuggaauaaacgagugggaagugagggccuuucuuuggggagaauggagaucuagauagagaacuaaugauuugguuccucaaacggauccaccuuaucuccaucgacaccacgcagcaaacacacgcacacgcacaugcacccagagccggcgcggggcccagaguccaugugcugcaucuggagaccacggggagcucaccagcugacuggggcuugggcagaaagagcuguugucgcuccgacuucucgcuuuuggugagggagaugcagcggugaguguggggaggacagaagagcaaagucgcucuggagaaauggcccgcagaguagggauccagacccccuguaucggagcauucugggucacagccgaguugaggagagucugucccugggaucuaggcugcggcugcuguggggcggggacacuuacucuggaugcgauuugaggagcucgcuccgaaaagccucaggggagaaccuggcaccgggcgcuggugucgcgucgaucuauaauaagcauccgcaccuuuaggggcucggccgguuuuuauagcccgguggcagcggcgacggcggcagcgguggcgggggcgggggcggggaacaaugugcguguccuggaggggcugccucgccaaugagcugggcccgccggggggcugggaagcugaugucauccgggcuaauuccgcucaaugaaacucgccaggccgggcacacgccuccucccugcgcacaaccaaugggcgcccguggccgggagauucuuggggagggacuggaggagggacccgaggaggcgagggggaggagaagggcggcucaagggggauggagggagggcugagcgcgcuugggaccaagggagaaagggaacguggucaaauuucuguaaaaaauacggccaccacagagucagguugggggaugggaugguuuggagacucugcagagucuaacaaacuaaccugaugccccacgcagccgcaccuuuugggaugcgcgcggaaaacccuggcgacccaggauccggggcuggggucuccucccuagcucuuccucugucugguuucccgccgccuguucccaucucacugguuucaucaacacgugggcauuuggcgccccaaauguaaacgaugcccaggcacaaaguccccacuaucuuggugcucuacucgcgcgucuaggagauggccguggcugcagcuccgacggcagccgguagcgcccccagcugggggcagggacuugagggguagagggcgggcaaggagggaggggacggacuccagaagaguguuuugaaagaauucacaacucuccuuuagguugaggaugguguggguacagggacgaguuauuuccgcacgguaaccgcgcuagcacaagggcagggucgugccuguaguuaaacaccccuccauuuauuagcaggggagccggaugauaguaaguauuuucagugucgucuuugugaucaccacacgccuuggggcaggggcaacgcuggcaucuguaguccaagcagggcuccgcuguaaaagguuagcaaagagccuuccgucccagucgccugcuuucuggaacugcaaagagaaguuucaggccugggcaaggcuucuccacgcugugggccagacagcgagauggaaccacucgcgaccgcguugggacauguuuuaccgauugcaggcuggcucugaaaccugaaaacucuugacgaugaggaauuaagcccgaacuggagaagcaccucacggagguagcugagguacggaugcauucacccauuuuacagaugggaaaagccagagaccgugugcagcaagccuacagaaaaaauugcuaagccuuuacagagcagcccugcuuggacuacagaugcuggcguuggcgguuccuuauaguacaggcagccaccugucucccccagucccuaaucucuuccccgagcugaauuucucacacccauacauuucgaauucagacauuuguuucugcagaucucggaugcuagcacuugacacugugagcgcacgcgcgggcacacacgcacacagucuccuagggagugugaggaacgucggguuacuuccguuguuggggaacuuuuacugugcaaguacgguuuuaaaaacaagcaaacaaauuagcauaguaaauaauuggucuucaaguagcaaaguuacaaaauaaacaaauacaaagagaaacccacguuauugccccuaguucugagauaugucucccucugcggucuccgcuagaagcccagcccgcucucgccuucgccccagucucgugccuucuggagcauuauuuuucaauccgcguguuucccagcuggcucugcagccauccguuaaauauguauuuaaaacaugaagaacugaagcgugguguuaugucguccaacgguuacaaggaugacccauaaccguucaauuaguagaaucugucacucggacgacgcagggagcggggggguggggaucagaaagggcucgggcauuuguagaugccuccuucgggccuaccccgccaacagcagcgaggccauguguggugcgcgcuguggggccaccagucggggcgcggaguugugcgccugccaguguagcuaauaaacaccagcaggcgcaacgugcgcgcuccuugguugcagccgcugagguuaguccagccgccggcacgugucccggaacccgguuucuuuuuuuguugcugcccacuggugucuguccugcgaccgacuugcggcggugagagcaagcggucucagguucuuugcgcgcucgguccaguggcuggaguugggagucaggggugaaagucgaggggcccgucuuggcauggcgcgagucuagagccuggaaggcaaagucggaagcucugugcugcugcuggccccuucuucaccuggcaggcuucccucaacauccucccgucgccggaguagcuugggaggucggggaggucugugucgccccugggcucccuuggcccuggugccaaucggaugcugaguaccucucggugugucuccuaugccuccccaccccgucccaggaauaacuagaaauuagaucccggugcccaagcuugcccuggugcguccuggaggcguccccaggacuuguccggguccugcgcccggcgcccggggugggcgaccugggcgggucccaggcacugcgguucccaccagcgcgcgcagcuggggccccuuccuggggaauggagugcucauuugcagaggcuaaugggccccggcuccgggaguuccugguuggcccccgcguccuggugcuguuggccuccuccguguuuuucccucuucuuuguguuucucucccacaaaagaccgggugcgugucggggccggccuuuguuggaccgccgggcggcccgggaggagcccgugccaaaccggcgggcucucgcggggcuccagggcgcagaccucccacugcuucccgggucccucccgggccuucuuucugauucucucccuucccuucuccgaguuccugcucacauucaggcugcgucucggccuggcugccaaacagaacgacguucuugcgcagagcugaccagggguggcggcgggaggcaaggcucccggcaccggaaagcaaagcaaagaaaaaggcauugcagccaucgcuccuggucgugaaugacagcguuuggcuaccaaacaugugcuacaugaccccucagaagucagaacucugcaaacaaauggcgugucuuucucacaaaacagcucauggagucguccagggucagcacggcuggucagaaccgcggcucccgggacugguccaggacaguucacgccgggugcggaggacaggcccuggcacuuggcaggugcuugguaaauacugccgaaugcacacacgugcagaugugcaugcggacugaugugaaacaugguccguaaaauacauguaaaugugggcaaagguguguuauguguuuuuucgcuguauauaauaaacugugagagcuguaaucuggaucuugggguauaugggcaccuuuacaaugauugggguguugacuuccaccuaaugacaacugugaccacuugaaggcaaccuaaauugugccaggaguuucaggugucuugacagacauaguuuaauuuagucucucaccggccauaggaggaagguaugacucccauuuuacagacaggaaaacugacucucagagagcugugggcauuugcccaagauccugcca

SEQ ID NO: 20899 - RNA, 1692 nt, Homo sapiens
gccgcccuccuccuccuccuccuccaccuccuccaccuccuccacuuccuccuccuccacgacggccccccuccuccccaaggcugcgcgcgagaagccggaggcgccggccgagccuccaggccccgggcccgggucaggcgcgcacccgggcggcagcgcccggccggacgccaaggaggagcagcagcagcagcugcggcgcaagaucaacagccgcgagcggaagcgcaugcaggaccugaaccuggccauggacgcccugcgcgaggucauccugcccuacucagcggcgcacugccagggcgcgcccggccgcaagcucuccaagauagccacgcugcugcucgcccgcaacuacauccuacugcugggcagcucgcugcaggagcugcgccgcgcgcugggcgagggcgccgggcccgccgcgccgcgccugcugcuggccgggcugccccugcucgccgccgcgcccggcuccgugcugcuggcgcccggcgccguaggaccccccgacgcgcugcgccccgccaaguaccugucgcuggcgcuggacgagccgccgugcggccaguucgcucuccccggcggcggcgcaggcggccccggccucugcaccugcgccgugugcaaguucccgcaccuggucccggccagccugggccuggccgccgugcaggcgcaauucuccaagugagggcgggccugggccuggggcgcgaccucggcccggccucccuucgcucagcuucuccgcgccccugcucccugcgucugggagagcgaggccgagcaaggaaagcauuucgaaccuuccaguccagaggaagggacugucgggcacccccuuccccgcccccaccccugggacguuaaagugaccagagcggauguucgauggcgccucggggcaguuugggguucugggucgguuccagcggcuuuaggcagaaagugcucgcucucacccagcacaucucucuccuugucccuggaguugcgcgcuucgcggggccgauguagaacuuagggcgccuugccgugguuggcgcgccccgggugcagcgagaggccauccccgagcgcuaccuccccggagcggagcacgccggcucccaguacuaggggcugcgcucgagcaguggcgggggcggaggggugguucuuuuccuucuccuccgccagaggccacgggcgcccuuguucccgccggccagguccuaucaaaggaggcugccggaacucaagaggcagaaaaagaccaguuaggcggugcagacggucugggacguggcagacggacggacccucggcggacagguggucggcgucggggugcgguggguaggggcgaggacaacgcagggugcgcuggguugggacguggguccacuuuuguagaccagcuguuuggagagcuguauuuaagacucgcguauccaguguuuugucgcagagaguuuucgcucuuaaauccuggggguuucuuagaaagcaacuuagaacucgagauucaccuuucguuucccuuuccccaaaaguagcguaaccaacauuuaagcuugcuuaaaaacgaaaaccaaccgccuugcauccaguguucccgauuuacuaaaauagguaaccaggcgucucacagucgccguccugucaagagcgcuaaugaacguucucauuaacacgcaggaguac

SEQ ID NO: 20900 - RNA, 1692 nt, Homo sapiens
guacuccugcguguuaaugagaacguucauuagcgcucuugacaggacggcgacugugagacgccugguuaccuauuuuaguaaaucgggaacacuggaugcaaggcgguugguuuucguuuuuaagcaagcuuaaauguugguuacgcuacuuuuggggaaagggaaacgaaaggugaaucucgaguucuaaguugcuuucuaagaaacccccaggauuuaagagcgaaaacucucugcgacaaaacacuggauacgcgagucuuaaauacagcucuccaaacagcuggucuacaaaaguggacccacgucccaacccagcgcacccugcguuguccucgccccuacccaccgcaccccgacgccgaccaccuguccgccgaggguccguccgucugccacgucccagaccgucugcaccgccuaacuggucuuuuucugccucuugaguuccggcagccuccuuugauaggaccuggccggcgggaacaagggcgcccguggccucuggcggaggagaaggaaaagaaccaccccuccgcccccgccacugcucgagcgcagccccuaguacugggagccggcgugcuccgcuccggggagguagcgcucggggauggccucucgcugcacccggggcgcgccaaccacggcaaggcgcccuaaguucuacaucggccccgcgaagcgcgcaacuccagggacaaggagagagaugugcugggugagagcgagcacuuucugccuaaagccgcuggaaccgacccagaaccccaaacugccccgaggcgccaucgaacauccgcucuggucacuuuaacgucccaggggugggggcggggaagggggugcccgacagucccuuccucuggacuggaagguucgaaaugcuuuccuugcucggccucgcucucccagacgcagggagcaggggcgcggagaagcugagcgaagggaggccgggccgaggucgcgccccaggcccaggcccgcccucacuuggagaauugcgccugcacggcggccaggcccaggcuggccgggaccaggugcgggaacuugcacacggcgcaggugcagaggccggggccgccugcgccgccgccggggagagcgaacuggccgcacggcggcucguccagcgccagcgacagguacuuggcggggcgcagcgcgucgggggguccuacggcgccgggcgccagcagcacggagccgggcgcggcggcgagcaggggcagcccggccagcagcaggcgcggcgcggcgggcccggcgcccucgcccagcgcgcggcgcagcuccugcagcgagcugcccagcaguaggauguaguugcgggcgagcagcagcguggcuaucuuggagagcuugcggccgggcgcgcccuggcagugcgccgcugaguagggcaggaugaccucgcgcagggcguccauggccagguucagguccugcaugcgcuuccgcucgcggcuguugaucuugcgccgcagcugcugcugcugcuccuccuuggcguccggccgggcgcugccgcccgggugcgcgccugacccgggcccggggccuggaggcucggccggcgccuccggcuucucgcgcgcagccuuggggaggaggggggccgucguggaggaggaggaaguggaggagguggaggagguggaggaggaggaggaggagggcggc

SEQ ID NO: 20901 - RNA, 2677 nt, Homo sapiens
acacgaagcgguaggaguacuugagguccgugcggccgcugcugugcagguccugggaccacuccucgcccaccgucaggugccucuggguggccaggcggcugaugagucuuucuggguuuucuacggggagaagaugcuccugguugguucugaacgagaacccugugacucgggacagagcgggggugggccgagacauucagcacgggaaggaggcccaagcugcuccacccugaacuuucuggggcacgugcagaaugaaagcuguccggguuuggcugggggaugggugggcaaaguccaaugcuauuaacuggggaaagcaguuuugggguuuggguuuuguuuuuaccuguugcgaggucaucaggagaaucuguguggagagcuucaauaaucagagagaaggugcccugggagagaggggagaagacguuagacaacccagaaagguaacgaaaagaaaacggcaaaaagcagucauuccuaacagccaggucagcaacagaggccugaaggcugcaggucuggggcagcgugucuggagagggucuccacgcaccuccugccugcucucaccuucccuaaggaaauggaagaacuuuuuaaagagugguuuccugacguguuuuuucagccuguacuacaggauauuacguuguuuuuuuaauuagagagagagagagaaugcaggcaggaugggguggaagaggcccgagggcccuugucauuuuucuugggggaugggcacgcuccgggugguagcggucgcgcugcgcggguaaucgcgccaccaacgcgucuaggagucgggaaaccagaaccuucccacgugaaggggcgccucugacuggagaccuggcacagaggccggauacggaaaucucccgggcgcgcucggccucuccuccucgccccagcgcgguccccuccugcaggccgcggggccccggggcgagguguccgcgcugcugggcuggaguccuggggccgccgcuaggcagaucgcagcgcccaccugcgccucgcgggguccccgaggucccgccaccgagcgcccaaggcgggaucccagcgcguccugcagcccgcccagcuucagggccggcccggcgcgcgcaggugcggcacucaccggccaggugaagccgaaggggaagcggaugggguugcugaacgcggagucggcgcccccgccgucgggcagacugaaggagucgacgcccagcacgggggugacggcgcugccguaggugcagggcggcucgggggacacgcuggccugguagugcuugaggcacacgcggaagaagguccggcaggcgcacggcgguggccccgcgcccccgcggcagcaguugcgguuccccagcagccccuucuuguugacgaacuccugcagcuucaguucgaacaccccagagcuccagaccugcacgggggagggcgggggcgugaggacgcgggucccgcccgagcuagggggcgugaggccuggguggggggugugcggagagccuggaagggcucaggggccgagcgcgcucgcugcacggccggcgcuggggucgucgcccccgggauucaucuuccgggccguggcuggcgcggcccgugccgcuguccgccccuccccgcgcgcuccugccccgcgccccggcuacccgugagaccccgcggggccgcggcgcccccaccugcccgccuaccugacacagcaaggccgagagcaccgccagggccagcgcgcaccgacugcccaugcugcuucgcuccacgcgcgagccuggggggcccccacuucucuccuuagaacagcggcggacgcgcgggggaucgaugggccacggggagcgugggcagaaaagcgcccuugccucgccccagaccgcaggacccaggacuucuuucuuuaaaagccggucuccgccucuucccaaggccgcgguucuuuauauccgcccugcgaggucccgcggcagccccagggaugcccgaggaaaggcagcucucgggggacagcgcggcggcggcgacuuucguuuuccuccuuccucccagcccccgaggaggugagggucgccggcuuccugguuuugucuugagcuucuucgcaggagagggagggggagaaagagaaagagagagaguccagagauugagcuuaauucccaagagagcugcagagcuuccucccgagccgauuagaaagccgcggucuggaaaucccacgggcaaggcgauaauccggggccagcggcgcgcgcugaggggacggucggcggcggcgggugugcgcggcggccccugcggaucgcggcccggugucacucggcggcggcggucguuccgggagcacuccgggcuccgaucuccggugucacagcaaagauccgcgucuuuccgaugaauccagccaaugccauccaguacacacgcgcaggaccggaggggccgggccgugggaggaggcucugcgccgcggcugcccggguuccccugcgcucugcccucggccgggucgggucuccgcgggugcgcgcagaggaucuggcucucgccggcgccugccgcccuuauauucagccggccgcccgcauggcuaaugagaugcaaaucagcagccccccaaucuggcgagagcugucacaaaggagccacuuuuccaaacccu

SEQ ID NO: 20902 - RNA, 2677 nt, Homo sapiens
aggguuuggaaaaguggcuccuuugugacagcucucgccagauuggggggcugcugauuugcaucucauuagccaugcgggcggccggcugaauauaagggcggcaggcgccggcgagagccagauccucugcgcgcacccgcggagacccgacccggccgagggcagagcgcaggggaacccgggcagccgcggcgcagagccuccucccacggcccggccccuccgguccugcgcguguguacuggauggcauuggcuggauucaucggaaagacgcggaucuuugcugugacaccggagaucggagcccggagugcucccggaacgaccgccgccgccgagugacaccgggccgcgauccgcaggggccgccgcgcacacccgccgccgccgaccguccccucagcgcgcgccgcuggccccggauuaucgccuugcccgugggauuuccagaccgcggcuuucuaaucggcucgggaggaagcucugcagcucucuugggaauuaagcucaaucucuggacucucucucuuucucuuucucccccucccucuccugcgaagaagcucaagacaaaaccaggaagccggcgacccucaccuccucgggggcugggaggaaggaggaaaacgaaagucgccgccgccgcgcugucccccgagagcugccuuuccucgggcaucccuggggcugccgcgggaccucgcagggcggauauaaagaaccgcggccuugggaagaggcggagaccggcuuuuaaagaaagaaguccuggguccugcggucuggggcgaggcaagggcgcuuuucugcccacgcuccccguggcccaucgaucccccgcgcguccgccgcuguucuaaggagagaagugggggccccccaggcucgcgcguggagcgaagcagcaugggcagucggugcgcgcuggcccuggcggugcucucggccuugcugugucagguaggcgggcaggugggggcgccgcggccccgcggggucucacggguagccggggcgcggggcaggagcgcgcggggaggggcggacagcggcacgggccgcgccagccacggcccggaagaugaaucccgggggcgacgaccccagcgccggccgugcagcgagcgcgcucggccccugagcccuuccaggcucuccgcacaccccccacccaggccucacgcccccuagcucgggcgggacccgcguccucacgcccccgcccucccccgugcaggucuggagcucugggguguucgaacugaagcugcaggaguucgucaacaagaaggggcugcuggggaaccgcaacugcugccgcgggggcgcggggccaccgccgugcgccugccggaccuucuuccgcgugugccucaagcacuaccaggccagcgugucccccgagccgcccugcaccuacggcagcgccgucacccccgugcugggcgucgacuccuucagucugcccgacggcgggggcgccgacuccgcguucagcaaccccauccgcuuccccuucggcuucaccuggccggugagugccgcaccugcgcgcgccgggccggcccugaagcugggcgggcugcaggacgcgcugggaucccgccuugggcgcucgguggcgggaccucggggaccccgcgaggcgcaggugggcgcugcgaucugccuagcggcggccccaggacuccagcccagcagcgcggacaccucgccccggggccccgcggccugcaggaggggaccgcgcuggggcgaggaggagaggccgagcgcgcccgggagauuuccguauccggccucugugccaggucuccagucagaggcgccccuucacgugggaagguucugguuucccgacuccuagacgcguugguggcgcgauuacccgcgcagcgcgaccgcuaccacccggagcgugcccaucccccaagaaaaaugacaagggcccucgggccucuuccaccccauccugccugcauucucucucucucucuaauuaaaaaaacaacguaauauccuguaguacaggcugaaaaaacacgucaggaaaccacucuuuaaaaaguucuuccauuuccuuagggaaggugagagcaggcaggaggugcguggagacccucuccagacacgcugccccagaccugcagccuucaggccucuguugcugaccuggcuguuaggaaugacugcuuuuugccguuuucuuuucguuaccuuucuggguugucuaacgucuucuccccucucucccagggcaccuucucucugauuauugaagcucuccacacagauucuccugaugaccucgcaacagguaaaaacaaaacccaaaccccaaaacugcuuuccccaguuaauagcauuggacuuugcccacccaucccccagccaaacccggacagcuuucauucugcacgugccccagaaaguucaggguggagcagcuugggccuccuucccgugcugaaugucucggcccacccccgcucugucccgagucacaggguucucguucagaaccaaccaggagcaucuucuccccguagaaaacccagaaagacucaucagccgccuggccacccagaggcaccugacggugggcgaggaguggucccaggaccugcacagcagcggccgcacggaccucaaguacuccuaccgcuucgugu

SEQ ID NO: 20903 - RNA, 814 nt, Homo sapiens
gcauguucuaaagccccuccagccccggcccccaacccacaaccuuuacacaaccgucaccuuauuagguuuuuacacguccaucagacacuagaacuuuuguuuucauuuuuuaaagggaaaugaguuuauugggagggccgagaacacacguaugacacaaugaauuaucuaaauugcccuccuaggcacgauggagaaguaaguuggggcagagacuccuacucuggcaccuagcuuugcacuucucccucucuuuaccaucccgcccguggaucccugcccacccccaacaccuccguagcuucauuaggguuccaggugaguguuggagugcccccuuugauuguagcucagccccaaggaagcagccuggccacaguguccucacuguagguguguuagagcugccuuauuggugagaacagggcaccgucaagguagaacgagacuuucaucccggcaaaugucuugaucaaagugucuaagcagagggaaagucuucaaacaccaaggacaaccacugcagccagaaaucugaaggucacguggugaagucguccagggcaggcccuccggcugcuacgcagcuggaauugcuacucugcggcuccucuucaagugacccagccuguguccugcuaccuuguuucccaaauaccuguaaaguuuuaggaucaacagagauguccacuuuagguuuuccacuguugccucauggaauagcgaagaguuaaccacaagaaacaagcauaugauguuuagugccaggugagaaaggcaggcugggaucaccgugaacccccuacuguuu

SEQ ID NO: 20904 - RNA, 814 nt, Homo sapiens
aaacaguaggggguucacggugaucccagccugccuuucucaccuggcacuaaacaucauaugcuuguuucuugugguuaacucuucgcuauuccaugaggcaacaguggaaaaccuaaaguggacaucucuguugauccuaaaacuuuacagguauuugggaaacaagguagcaggacacaggcugggucacuugaagaggagccgcagaguagcaauuccagcugcguagcagccggagggccugcccuggacgacuucaccacgugaccuucagauuucuggcugcagugguuguccuugguguuugaagacuuucccucugcuuagacacuuugaucaagacauuugccgggaugaaagucucguucuaccuugacggugcccuguucucaccaauaaggcagcucuaacacaccuacagugaggacacuguggccaggcugcuuccuuggggcugagcuacaaucaaagggggcacuccaacacucaccuggaacccuaaugaagcuacggagguguugggggugggcagggauccacgggcgggaugguaaagagagggagaagugcaaagcuaggugccagaguaggagucucugccccaacuuacuucuccaucgugccuaggagggcaauuuagauaauucauugugucauacguguguucucggcccucccaauaaacucauuucccuuuaaaaaaugaaaacaaaaguucuagugucugauggacguguaaaaaccuaauaaggugacgguuguguaaagguuguggguugggggccggggcuggaggggcuuuagaacaugc

SEQ ID NO: 20905 - RNA, 824 nt, Homo sapiens
gccugcguguggccaccaccuccgcgagcucugcgcccuccaggcccccgcucgcaguccgagaccaggggcggccaaggucccgaaccccgcccccggggcgccggcacucaccgccacagcuugcccagcgucuugcugagcucggcguugugcaggugcggguacuggucggccagcuugcggcgcgccgccugcgcccacaccaugaaugcguucaugggccgcuucacaugcggcuuggcuuugagcgcgccgccgccgccgccgcgcaccggcaugggcaccagacuccagucguagcccuugagcaccugcgacacggcgucgcggaugcaggccgggaagcgcucguccgccgccuccgccgggucgccccgggcgccccccaccgcgacccccgcgcggcccaggcccucggagccggcgggagacggcggcgcguccgaguccgaguccuccacgugcgacauggagcuggcggugccggacgggcugcagggcggcugggagcgggccucgcucauguccagcaucggggccgcgcgcggaggggcgcgcacaggagacgcgcaccggggccggcgcccggggcugcccugcggucgcuccgggacccgaggucgccgcgcgguggccccgacccucgccccugccgccgccgccgccgccgccgaggcucgggucccgcugcgggacccgcaacaaguuucuuuaagcggcggccccgcggccccgccccgcgcccggcuacccauuggcggagcgcgccccgaucccccggaggcggagcccggccgcccccgcccccccacccauaaaga

SEQ ID NO: 20906 - RNA, 824 nt, Homo sapiens
ucuuuaugggugggggggcgggggcggccgggcuccgccuccgggggaucggggcgcgcuccgccaauggguagccgggcgcggggcggggccgcggggccgccgcuuaaagaaacuuguugcgggucccgcagcgggacccgagccucggcggcggcggcggcggcggcaggggcgagggucggggccaccgcgcggcgaccucgggucccggagcgaccgcagggcagccccgggcgccggccccggugcgcgucuccugugcgcgccccuccgcgcgcggccccgaugcuggacaugagcgaggcccgcucccagccgcccugcagcccguccggcaccgccagcuccaugucgcacguggaggacucggacucggacgcgccgccgucucccgccggcuccgagggccugggccgcgcgggggucgcgguggggggcgcccggggcgacccggcggaggcggcggacgagcgcuucccggccugcauccgcgacgccgugucgcaggugcucaagggcuacgacuggagucuggugcccaugccggugcgcggcggcggcggcggcgcgcucaaagccaagccgcaugugaagcggcccaugaacgcauucauggugugggcgcaggcggcgcgccgcaagcuggccgaccaguacccgcaccugcacaacgccgagcucagcaagacgcugggcaagcuguggcggugagugccggcgccccgggggcgggguucgggaccuuggccgccccuggucucggacugcgagcgggggccuggagggcgcagagcucgcggaggugguggccacacgcaggc

SEQ ID NO: 20907 - RNA, 1253 nt, Homo sapiens
uggagcgcccagcuggcugcggcucacucugccaagugcacugggagccaccgacacgucucacucagcauuuguagaaagucaggcuggcucaaggcgcuggagaacaaaacgggaggucucugcccucggggcaguucacacccuggugagggagacagacggugacuuaaaauuucaggcugcaaaaaaaaaaaaaauaaauaaaaaaauaaaaaaauaaaaauaaaaccaggugaugcucuggggugaacugaauuagggcuaguuugguuugagaaguuaaaugaacagaggccgaggccucacugcuagggacggucuuaucucaaaauuaaggaaucaagaaacagaaggccagggaguguugguuuggugaucggaggcuccagccuggccgcagcaggguuugcgcaguguccaagaagcugcgggugggcaggcggccucggaaccugccuugcuggcuuccucgaauugguagcgaucaguucuagccgccgugcccgcccgaauuuguucccaggccucugcuccucaacaaaccuaugaauucucucccggcuggcagcggcccuucgcccagcgcuucgcccagcgccugcggccucccgggaaucgcccgggcuccugccuugggcuggggggucucccagaaggccccuuucugcagcggggccggccucccuccccgauccugggauggccugcgggaugaucccgcacucaucucguccacucccuugugcccgcgguagcgcagcauuuccuaacuuuuccacgagggaaccucuccgcccuggccgcgccggcaaguugugcugaaaaaauaaagugaagucagauuccugaggguccgcaguaucccauuuuaaaaucaaggcccucgaucccagacuccacuuuccuggcgcaaagaaagaaaggcaccagaaacccgggucgugggugggcugcagaaagaagguccaggacccuccuccgauuguacgcaaaagcugucuggugagcaacauuucaauuucuguuuagcgguucucaucagaucuuuaaaaagauucguaaauccaaaggagauuuaaaaacagagauuaucugcuugucucucuguucugucuaccauaaaccgauuucucaacuuccuaccagacccaggagcagagccgaagccgcccggggcuuuguuaggccggggggaaacguuuuuuggucucuugcuucugauccuuucaauccggcauuuccucugaacc

SEQ ID NO: 20908 - RNA, 1253 nt, Homo sapiens
gguucagaggaaaugccggauugaaaggaucagaagcaagagaccaaaaaacguuuccccccggccuaacaaagccccgggcggcuucggcucugcuccugggucugguaggaaguugagaaaucgguuuaugguagacagaacagagagacaagcagauaaucucuguuuuuaaaucuccuuuggauuuacgaaucuuuuuaaagaucugaugagaaccgcuaaacagaaauugaaauguugcucaccagacagcuuuugcguacaaucggaggaggguccuggaccuucuuucugcagcccacccacgacccggguuucuggugccuuucuuucuuugcgccaggaaaguggagucugggaucgagggccuugauuuuaaaaugggauacugcggacccucaggaaucugacuucacuuuauuuuuucagcacaacuugccggcgcggccagggcggagagguucccucguggaaaaguuaggaaaugcugcgcuaccgcgggcacaagggaguggacgagaugagugcgggaucaucccgcaggccaucccaggaucggggagggaggccggccccgcugcagaaaggggccuucugggagaccccccagcccaaggcaggagcccgggcgauucccgggaggccgcaggcgcugggcgaagcgcugggcgaagggccgcugccagccgggagagaauucauagguuuguugaggagcagaggccugggaacaaauucgggcgggcacggcggcuagaacugaucgcuaccaauucgaggaagccagcaaggcagguuccgaggccgccugcccacccgcagcuucuuggacacugcgcaaacccugcugcggccaggcuggagccuccgaucaccaaaccaacacucccuggccuucuguuucuugauuccuuaauuuugagauaagaccgucccuagcagugaggccucggccucuguucauuuaacuucucaaaccaaacuagcccuaauucaguucaccccagagcaucaccugguuuuauuuuuauuuuuuuauuuuuuuauuuauuuuuuuuuuuuuugcagccugaaauuuuaagucaccgucugucucccucaccagggugugaacugccccgagggcagagaccucccguuuuguucuccagcgccuugagccagccugacuuucuacaaaugcugagugagacgugucgguggcucccagugcacuuggcagagugagccgcagccagcugggcgcucca

SEQ ID NO: 20909 - RNA, 2157 nt, Homo sapiens
gucccuuuaccgacgcgaucuugguuuugagggguggggaccuggagcgaaaccccaaacccggggcccugcuugcaaacucagcauauucugucucuacuccgccuuuuucagaggagaaaagaccuggcccacgccucccagaggcuuuaccuggugaagaggaggagcagccacugcagcgcgguggacaggguguccuggcuggcgccgaagaugucagugauaguggccgguacguucuccaaauccagccgcgcgccaccaccgugcgaguccccggccgccuucuuuuccgcagagaggauaaaggcguccaucaugucgcggggggcggccccgggccgaaggcuuucgcagugccucaagaacuuguccaggaugaaguugcugaaguugcgguugagcugcucgaauucgcggaaaacggugcgcaccggguuggggaaguacugcagccagggcaucacguccaccaggcugcccgcgcccaccgugcgcccgaacucuucguuguggcugagcagcucacggaacucggggucgucguggcuguagcggcagccgaaacacacggcacucaugacguuggccacggccacgacggucagcggccucgggucgaggaaggcgccguccgcgcugccgcgcaccagcagcgccaccagcucgcgcgccucgcucagcacguggcccucgaggacuuggcggcugcgcggcuggcgcgugaagaaguugcgcaucaugcugugggcugcgcgccgcugcaccuuccagugcuccgaguaguggccgaaagccaugcugcggccgccggacaccacacggaaggaggcgaaggccggccggucggcgaaggccgagcccugcugcaccagggccugguggauggcgcgcucgccauucagcaccacuauggggcagcugcccaggcggaucuggaaaacgucgccguagcgccgcgccaggcgagcgaacgagaggugagccgccuggcccaccgccgccgcguuuccgaucaguggccacgcaaacgggcccgggggcgcggaccggagcugccgccuccguugccucagcagccgcuggcccacaugcacaguggccagcaccgacaggaguagcaggagcguggucugcuggauggacagcggguuuagcggccaagggucguucgggcugaggcuggugcccaugcuggggacagagaggagaaggcgugacacucaggggugcagagacaggagcgggcgccccacgccccuaccccagccucuggggacugagugccguuggguggagaggucggagcugacucucuggagaaauggccgaagacgccccuucccauccccaacccacucucccuuggagaagagaaggggcguguuuccaccucgcuguaacccagcgccaaacccuuccccuccccgcaaggcgcguaacgguuccugcaaucuggggacaacgcugcgggcaucgaggcgguggcgcuugauuuccuuuaaaguaccuaccacgccacccgcuaccuguaauaauccaucugaagaggucgccgggcagcgccucggcagacagacugaccugcggggaggugcgguuuccaguggcgcgggacagccggcuccgagaaggaacugggaccuuugccuagggcaagacgucaacaggaacccgcagcccggccuggacaccugcugcccucacuggaagcuuuaacucccacucgagucucuuggcgucgucagugccaggagcgcuuggauugggauggggacggagaagggugccucgcucgccgagccccgcugcccuuggggaccuggcaaagucgagguuuccucacagcguugagauugagacugggggucggugaguggcgucaauucccaugcccuugcggcucucacaacuggagucgcagaagcgcucgcucccacucccacuccagagucaaagcgcgccaucccgcuccuccggguuuuaaggacuggguagaaggagggcagcgcgaccuggcagggcggggccugcggggggcggggcgcgccgcacaccaggccgcuuugacccggacucccguccaggcgcaccggccggccucggagcucuaccagcaggcuuucaugggagcggaggugcccacguuuccau

SEQ ID NO: 20910 - RNA, 2157 nt, Homo sapiens
auggaaacgugggcaccuccgcucccaugaaagccugcugguagagcuccgaggccggccggugcgccuggacgggaguccgggucaaagcggccuggugugcggcgcgccccgccccccgcaggccccgcccugccaggucgcgcugcccuccuucuacccaguccuuaaaacccggaggagcgggauggcgcgcuuugacucuggagugggagugggagcgagcgcuucugcgacuccaguugugagagccgcaagggcaugggaauugacgccacucaccgacccccagucucaaucucaacgcugugaggaaaccucgacuuugccagguccccaagggcagcggggcucggcgagcgaggcacccuucuccguccccaucccaauccaagcgcuccuggcacugacgacgccaagagacucgagugggaguuaaagcuuccagugagggcagcagguguccaggccgggcugcggguuccuguugacgucuugcccuaggcaaaggucccaguuccuucucggagccggcugucccgcgccacuggaaaccgcaccuccccgcaggucagucugucugccgaggcgcugcccggcgaccucuucagauggauuauuacagguagcggguggcgugguagguacuuuaaaggaaaucaagcgccaccgccucgaugcccgcagcguuguccccagauugcaggaaccguuacgcgccuugcggggaggggaaggguuuggcgcuggguuacagcgagguggaaacacgccccuucucuucuccaagggagaguggguuggggaugggaaggggcgucuucggccauuucuccagagagucagcuccgaccucuccacccaacggcacucaguccccagaggcugggguaggggcguggggcgcccgcuccugucucugcaccccugagugucacgccuucuccucucuguccccagcaugggcaccagccucagcccgaacgacccuuggccgcuaaacccgcuguccauccagcagaccacgcuccugcuacuccugucggugcuggccacugugcaugugggccagcggcugcugaggcaacggaggcggcagcuccgguccgcgcccccgggcccguuugcguggccacugaucggaaacgcggcggcggugggccaggcggcucaccucucguucgcucgccuggcgcggcgcuacggcgacguuuuccagauccgccugggcagcugccccauaguggugcugaauggcgagcgcgccauccaccaggcccuggugcagcagggcucggccuucgccgaccggccggccuucgccuccuuccgugugguguccggcggccgcagcauggcuuucggccacuacucggagcacuggaaggugcagcggcgcgcagcccacagcaugaugcgcaacuucuucacgcgccagccgcgcagccgccaaguccucgagggccacgugcugagcgaggcgcgcgagcugguggcgcugcuggugcgcggcagcgcggacggcgccuuccucgacccgaggccgcugaccgucguggccguggccaacgucaugagugccguguguuucggcugccgcuacagccacgacgaccccgaguuccgugagcugcucagccacaacgaagaguucgggcgcacggugggcgcgggcagccugguggacgugaugcccuggcugcaguacuuccccaacccggugcgcaccguuuuccgcgaauucgagcagcucaaccgcaacuucagcaacuucauccuggacaaguucuugaggcacugcgaaagccuucggcccggggccgccccccgcgacaugauggacgccuuuauccucucugcggaaaagaaggcggccggggacucgcacggugguggcgcgcggcuggauuuggagaacguaccggccacuaucacugacaucuucggcgccagccaggacacccuguccaccgcgcugcaguggcugcuccuccucuucaccagguaaagccucugggaggcgugggccaggucuuuucuccucugaaaaaggcggaguagagacagaauaugcugaguuugcaagcagggccccggguuugggguuucgcuccagguccccaccccucaaaaccaagaucgcgucgguaaagggac

SEQ ID NO: 20911 - RNA, 1436 nt, Homo sapiens
acagcuguggaggcgcugcccgcggcucaggcuucccaacagguuagcuauacugggauccacccggcauuucgcaggaagggguggggggaagacagagcgagagggggagagaggcucacaagaggacagagggagggagggaaagagagauaggagccagagagcgcaccgcgcggcuuaaaaggagagacuuacuaaugaauauuuauccgccgcugcuccgugcucccggcuucccuuaccuuucggcagguaagauccucccugugccccagccccgggggcccuccuagcuccccagucggggagccuguggcugggcgggagggcucuccguuggugggggugggagggcggcucuacucugcguucacuuugggugcccaggcaugcgacccugcacgacuaggaaccgcgugcgugggcuccauguguggaaugagugugagcauguaagaguguguuugugugugugcgagagagagacagagagacuaugcgcccgcaagcgcgcgcgcgcgccuguuuguggcgcgcucuggaaacauuuuccgacuuuucacucggacgcccuggauuucucgccuuugccuuucucugcuuccccucccucuucucucgcccuccccucccccacccaggucuaccccacccuaccccacuccuaccccggcugcugaggcgcucuucugccggcuauuguacggcuggcgcgggcucccccuggccacaucccgggccucucacacaagaagaauaguucuguuuccgccguaaacccccacacaaaggcugcccggccaccggguccccugucccccuucccggggacuucggcuuuugaggugcugcugcgcguucuuucucccucccccucucagggcgccagggcccagaccaaggagcuaagagugaucgggacuuggggguaccggguggaacuccuugggggccgcccgccaggcuuccugggcugcaacucggagcccagagacccccaggggaagggcgccucuucccccaccaccaccccagccgucgccugcgggaggagcacggggaacccggcccagccaaagggggaagagggaggggaaaaggaagaaggucggggaggggcugaccauauaaccagaauucuuuaaacggacuuacccggccaccuguugagaauccauguggggucggcuggcuccggaguugcgcaagguggacacacaaaaccaaaagccggaguugggaaaagaaaauucuuucucugaccaugccagacgcggccggucaggcucgcagcuccgcgcuaggaucgggcggcuguacaaccaagaucgacuuugcccugucccccaacgccccccucaucccacggcuccacggcugggaggcuccggacucagagcucgcggacucggcgcucagggucagcaccagca

SEQ ID NO: 20912 - RNA, 1436 nt, Homo sapiens
ugcuggugcugacccugagcgccgaguccgcgagcucugaguccggagccucccagccguggagccgugggaugaggggggcguugggggacagggcaaagucgaucuugguuguacagccgcccgauccuagcgcggagcugcgagccugaccggccgcgucuggcauggucagagaaagaauuuucuuuucccaacuccggcuuuugguuuuguguguccaccuugcgcaacuccggagccagccgaccccacauggauucucaacagguggccggguaaguccguuuaaagaauucugguuauauggucagccccuccccgaccuucuuccuuuuccccucccucuucccccuuuggcugggccggguuccccgugcuccucccgcaggcgacggcuggggugguggugggggaagaggcgcccuuccccugggggucucugggcuccgaguugcagcccaggaagccuggcgggcggcccccaaggaguuccacccgguacccccaagucccgaucacucuuagcuccuuggucugggcccuggcgcccugagagggggagggagaaagaacgcgcagcagcaccucaaaagccgaaguccccgggaagggggacaggggacccgguggccgggcagccuuuguguggggguuuacggcggaaacagaacuauucuucuugugugagaggcccgggauguggccagggggagcccgcgccagccguacaauagccggcagaagagcgccucagcagccgggguaggagugggguagggugggguagaccugggugggggaggggagggcgagagaagagggaggggaagcagagaaaggcaaaggcgagaaauccagggcguccgagugaaaagucggaaaauguuuccagagcgcgccacaaacaggcgcgcgcgcgcgcuugcgggcgcauagucucucugucucucucucgcacacacacaaacacacucuuacaugcucacacucauuccacacauggagcccacgcacgcgguuccuagucgugcagggucgcaugccugggcacccaaagugaacgcagaguagagccgcccucccacccccaccaacggagagcccucccgcccagccacaggcuccccgacuggggagcuaggagggcccccggggcuggggcacagggaggaucuuaccugccgaaagguaagggaagccgggagcacggagcagcggcggauaaauauucauuaguaagucucuccuuuuaagccgcgcggugcgcucucuggcuccuaucucucuuucccucccucccucuguccucuugugagccucucucccccucucgcucugucuuccccccaccccuuccugcgaaaugccggguggaucccaguauagcuaaccuguugggaagccugagccgcgggcagcgccuccacagcugu

SEQ ID NO: 20913 - RNA, 2101 nt, Homo sapiens
gcaacuuccgcgaccucuaccacauccuugagaaccacaaguucaccaaggagucucacggcaagcugcaggccauguggcucgaggcgcacuaccaggaggccgagaagcugcgcggccgcccacucggcccgguggacaaguaccgcgugcgcaagaaguucccgcugccacgcaccaucugggacggcgagcagaagacgcauugcuucaaggagcggacucggagccuguugcgggagugguaccuacaggaccccuaccccaaccccagcaagaaacgcgaacuggcgcaggccaccggccucacucccacacaaguaggcaacugguuuaagaaccggcggcagcgcgaccgcgccgcggcggccaagaacagguuaguggcggggcccgcggccuggcuacagccucagaggccugggaaggggagagggguugagauggggcuagcggagcggccgcugagagccagggaagccgugacuccuggccagucggagaaaguuuccgcuuguccgggacgcgcggaagagggggccgggcuggcuguggguguauugauugcuuugaccaagaggggcuuucgucagggcagagagugugugcuugcgacccgaguacccgcagccccugggagacuuagcccugcgcugcacccgugccugccuccucagcccugccgccagcucggcgauccucuggagccuagagacagggagggaaggaaagcacucuuugccaucugguucuuauuucugugcguugcaaaaccccgagagaaauccacuagcgucagagagaggaaagugaaccugggucccuaucacaaggggaaaaggccagaggccacugcgcagcgggccuguuuccccgcaacgcugcacguugccugaccgggagcaggagagccgggcugggaguggagaggccuagcgugugcgugugcgugugugugugcacgcccgugugcauguacucgcccuccuguuucagccgaggagaaucccuuugguccucuaagcugggaagcgggcacgagcagccucguugccggcaaguuggccacaaagucacaaaauuguauagggcuugaccaacaucacaggagcugggccugggggaaggagaaaaagaaccagagggaaagaaguggauaggcgaaaggaguggggagagaagggagaaagaaaagaggaaguugggugaaagcccugauguggagccugugucuuucucuauccagccaggaaggcccagggccugguguacuucagggagcaggacccccagcugcugacagcugcccgugggugggggcugggugugaguuucuggagguguguucgaguuuaggcggccgggaccugagcccauggcccucucaccccugccguggagcccacuuuucgucugaugaggggagcgcccagggucaagccaaggccuccuuguggagagaauuccagacaccagguccaggcagaagguucccggugggggaaagggcagcuggagacugcucugugcgccucucuugccuucuccuuugccccuuuucugucucccugcucuuuccccacuuuuccaccgccagcuuuccuauuuucucuacccucgguccugcgcucugcgcuggcauccagagagcaaaguaugcaguucuacccggagacuggccgggcgguggggaacccgcagcucccgguguguguuugagggagcagggacgggguuacuaggggaacucgaccggucgcggggcagccggcucaguuugaagagccccagggacugcggagggaagaagcgcccggcuccucuccgacuucugcuucuccagggcuuggcguacuuugucgcuugcacccaggccuccccaagcggccgggcucggguucugccucuccuccgaggccagccucuaucugagaagacuugggaugcucccgaaagcggaauggggagcggcggcgcgggggagccggguggcgggccucugugucagggcgggcgcggaucucuuucucccgcaggcuccagcaccaggccauuggaccgagcggcaugcgcucgcuggccgagcccggcugccccacgc

SEQ ID NO: 20914 - RNA, 2101 nt, Homo sapiens
gcguggggcagccgggcucggccagcgagcgcaugccgcucgguccaauggccuggugcuggagccugcgggagaaagagauccgcgcccgcccugacacagaggcccgccacccggcucccccgcgccgccgcuccccauuccgcuuucgggagcaucccaagucuucucagauagaggcuggccucggaggagaggcagaacccgagcccggccgcuuggggaggccugggugcaagcgacaaaguacgccaagcccuggagaagcagaagucggagaggagccgggcgcuucuucccuccgcagucccuggggcucuucaaacugagccggcugccccgcgaccggucgaguuccccuaguaaccccgucccugcucccucaaacacacaccgggagcugcggguuccccaccgcccggccagucuccggguagaacugcauacuuugcucucuggaugccagcgcagagcgcaggaccgaggguagagaaaauaggaaagcuggcgguggaaaaguggggaaagagcagggagacagaaaaggggcaaaggagaaggcaagagaggcgcacagagcagucuccagcugcccuuucccccaccgggaaccuucugccuggaccuggugucuggaauucucuccacaaggaggccuuggcuugacccugggcgcuccccucaucagacgaaaagugggcuccacggcaggggugagagggccaugggcucaggucccggccgccuaaacucgaacacaccuccagaaacucacacccagcccccacccacgggcagcugucagcagcuggggguccugcucccugaaguacaccaggcccugggccuuccuggcuggauagagaaagacacaggcuccacaucagggcuuucacccaacuuccucuuuucuuucucccuucucuccccacuccuuucgccuauccacuucuuucccucugguucuuuuucuccuucccccaggcccagcuccugugauguuggucaagcccuauacaauuuugugacuuuguggccaacuugccggcaacgaggcugcucgugcccgcuucccagcuuagaggaccaaagggauucuccucggcugaaacaggagggcgaguacaugcacacgggcgugcacacacacacgcacacgcacacgcuaggccucuccacucccagcccggcucuccugcucccggucaggcaacgugcagcguugcggggaaacaggcccgcugcgcaguggccucuggccuuuuccccuugugauagggacccagguucacuuuccucucucugacgcuaguggauuucucucgggguuuugcaacgcacagaaauaagaaccagauggcaaagagugcuuuccuucccucccugucucuaggcuccagaggaucgccgagcuggcggcagggcugaggaggcaggcacgggugcagcgcagggcuaagucucccaggggcugcggguacucgggucgcaagcacacacucucugcccugacgaaagccccucuuggucaaagcaaucaauacacccacagccagcccggcccccucuuccgcgcgucccggacaagcggaaacuuucuccgacuggccaggagucacggcuucccuggcucucagcggccgcuccgcuagccccaucucaaccccucuccccuucccaggccucugaggcuguagccaggccgcgggccccgccacuaaccuguucuuggccgccgcggcgcggucgcgcugccgccgguucuuaaaccaguugccuacuugugugggagugaggccgguggccugcgccaguucgcguuucuugcugggguugggguagggguccuguagguaccacucccgcaacaggcuccgaguccgcuccuugaagcaaugcgucuucugcucgccgucccagauggugcguggcagcgggaacuucuugcgcacgcgguacuuguccaccgggccgagugggcggccgcgcagcuucucggccuccugguagugcgccucgagccacauggccugcagcuugccgugagacuccuuggugaacuugugguucucaaggaugugguagaggucgcggaaguugc

SEQ ID NO: 20915 - RNA, 1668 nt, Homo sapiens
cuucgggaggguuuuucuuucugcuuuccugggagggagcuucccacagggcuggcagcugagaccucaccacuguggaaacuccaaccucagggucucagauaccuggaaguaucugagccugcagcacucccccuaagauguuucugguucagcacccucaccucugacccugaucauucaaacucaggguggaacacaccccauaucaccaaccccagguguccuguuuugcucuuaccccgggcuggauucuguucccauaauaaguuucucuccagguuugagguccugagggguuauagggcaggcaguggcaagggccuaaugaucaaccuuuaggcugguucaggaaguccugguuuaccugaggacauccaacucccagccccucugugccucucagcucaccgcagacauuccgaccuacccaucagagguagggccuaaggagagaggcaucaagggccuggagugccagggaagggcggcuaucucuagcaaggcagaaaacagggcaugcgucucuucucucccagaacugacacuuccucccuuucaccucuggauccuuucuaaggagauaaaggacccgcucucaacuccaugugacaacgaaaauucauggccuggcuuuuccccauccaggucauucuagggaaguuccagccccagucccgaccccaucacacuuuggccuggagcuaaggcuggggggaaaugccgggaagcaccaccagcaagaaaucugcaaauccccuuucaucugggcucaaaccccucuguccugaggaugaccagaccuacugugccugccucacaggggauacaggcccacaguucugcgcugccccgaagcucucugcuucuccacccuuuuccucuagcgaccgaguaguuaguugacaacuuccugaauugcucugcccgcuuuagacaaaucccugcucgccgggucuccggcauagaaaggccuaagcaucguccaagucaggccgggcugccgcugggcuguggccgggccugggggcccaguuuaggccucuccgggggaccggcagaagcccugcgaaccccucccuugggccccggggagcuggcgccgaagaaggucuacuuacucguaccuuuccuuggccucggccgcccggucgcgcugccgccgguucuugaaccaguugcugaccugugugguggugaggcccguggccuccgccagcucacgcuucucgcggggugaaggguagggguugugcgcguaccacucgcgcagcacgcugcgacucuuuuccuugaagcaguagcuggucuccucgccgucccagauggagcgcggcagcgggaauuugcggcgcacgcgguauuugcccacggcgcccaggggucggccgcgcagcuucuccgccucgauguagugugccuugagccacagcugcugcagcuuggcgugguugugcggcgagaacugguggcucuccaggaucuuguagagcucgcggaaguugccgcgguggaaggccaccacggccuuggccuugagcacgcuuucauucuugugaaggugcucgcaggcgggcagcgaccacaggaagcggcccagccgcucgauguugccgcccugcugcagcaccucgcacacgcacgccacuugcuccugcgugaagccga

SEQ ID NO: 20916 - RNA, 1668 nt, Homo sapiens
ucggcuucacgcaggagcaaguggcgugcgugugcgaggugcugcagcagggcggcaacaucgagcggcugggccgcuuccuguggucgcugcccgccugcgagcaccuucacaagaaugaaagcgugcucaaggccaaggccgugguggccuuccaccgcggcaacuuccgcgagcucuacaagauccuggagagccaccaguucucgccgcacaaccacgccaagcugcagcagcuguggcucaaggcacacuacaucgaggcggagaagcugcgcggccgaccccugggcgccgugggcaaauaccgcgugcgccgcaaauucccgcugccgcgcuccaucugggacggcgaggagaccagcuacugcuucaaggaaaagagucgcagcgugcugcgcgagugguacgcgcacaaccccuacccuucaccccgcgagaagcgugagcuggcggaggccacgggccucaccaccacacaggucagcaacugguucaagaaccggcggcagcgcgaccgggcggccgaggccaaggaaagguacgaguaaguagaccuucuucggcgccagcuccccggggcccaagggagggguucgcagggcuucugccggucccccggagaggccuaaacugggcccccaggcccggccacagcccagcggcagcccggccugacuuggacgaugcuuaggccuuucuaugccggagacccggcgagcagggauuugucuaaagcgggcagagcaauucaggaaguugucaacuaacuacucggucgcuagaggaaaaggguggagaagcagagagcuucggggcagcgcagaacugugggccuguauccccugugaggcaggcacaguaggucuggucauccucaggacagagggguuugagcccagaugaaaggggauuugcagauuucuugcugguggugcuucccggcauuuccccccagccuuagcuccaggccaaagugugauggggucgggacuggggcuggaacuucccuagaaugaccuggauggggaaaagccaggccaugaauuuucguugucacauggaguugagagcggguccuuuaucuccuuagaaaggauccagaggugaaagggaggaagugucaguucugggagagaagagacgcaugcccuguuuucugccuugcuagagauagccgcccuucccuggcacuccaggcccuugaugccucucuccuuaggcccuaccucugauggguaggucggaaugucugcggugagcugagaggcacagaggggcugggaguuggauguccucagguaaaccaggacuuccugaaccagccuaaagguugaucauuaggcccuugccacugccugcccuauaaccccucaggaccucaaaccuggagagaaacuuauuaugggaacagaauccagcccgggguaagagcaaaacaggacaccugggguuggugauaugggguguguuccacccugaguuugaaugaucagggucagaggugagggugcugaaccagaaacaucuuagggggagugcugcaggcucagauacuuccagguaucugagacccugagguuggaguuuccacaguggugaggucucagcugccagcccugugggaagcucccucccaggaaagcagaaagaaaaacccucccgaag

SEQ ID NO: 20917 - RNA, 1267 nt, Homo sapiens
ucucgauuagcuggagggaaguuagagcuccguuuugcaccuacagcccuggagcguauugcgggaagugcuagugcccaggagccucuuuucugaugucacugggcuucugggguccuaguugucucagucaaagccaggcacacauucaccuccggggcaagggcuggugaggcugcccucgccgcuggguauagggaugggggaaagcaaggaugggaugaguucagcccagguggccaacccgcgguggcccaagugcagaagaggaagcgcgcccaaagccaaggaucugcacgcagcaaaggagauggaacuuagaagaaucacaagcugggacacagggcaaagagagagaauggcuaccagauucucugauugaugauacuuugcuuccuaacauuaccgcaaauauaaguagcgaaagcggcgguuuaggugcaacugcaagcucagagcuucuggcagcccagaagauccccaaggugccaacacgaagcugccugcgcucucgccgaaggcccugugguccuagcgaacuuucgcccuuuuuaaagaacaaacuuagauuuccccccaccaagcuuaaagaaauagcgccauuuguccuuuuccccucuaaaugcggcuggccagagccggggcaguggcccaccuuagcaucuucuucgugugugugugugugugugcgcguguguguguguguguuuguguguugggggggucgcuagaagugcuuaaaauauauaccaaaacuauuauuuuaaagacuaaucacacccucaaauuucauaugugucaccucccaaauuacgcgauagcaaaccguugugcagggguacaauguaaaccauaaaggaaggccgguuuacauuuuugcgcaccaggaagauacaaaguaucauuggagcacguucugauguccucgguucucuuuuguuauauaacuugcuguugcagcgcuugcaucuugucuuuggcgcugcccuuguggugugaguucaguacaggcuucuggucuacagaccucgcuguaggagcuuaaagacagggguaaauccuaagguuucagccaucaauuuucagcuaacaaauuucaccacagaagcagaucuaauugauaauucauaggacaaaagagccaccuucucuuuuauggucucuaucagugguguuagucaccgggaauuguaaugaaauuagcucuaacauaccccugaaacauuuuuuggucagcugucccagguaaagcaauaggcaucauaca

SEQ ID NO: 20918 - RNA, 1267 nt, Homo sapiens
uguaugaugccuauugcuuuaccugggacagcugaccaaaaaauguuucagggguauguuagagcuaauuucauuacaauucccggugacuaacaccacugauagagaccauaaaagagaagguggcucuuuuguccuaugaauuaucaauuagaucugcuucuguggugaaauuuguuagcugaaaauugauggcugaaaccuuaggauuuaccccugucuuuaagcuccuacagcgaggucuguagaccagaagccuguacugaacucacaccacaagggcagcgccaaagacaagaugcaagcgcugcaacagcaaguuauauaacaaaagagaaccgaggacaucagaacgugcuccaaugauacuuuguaucuuccuggugcgcaaaaauguaaaccggccuuccuuuaugguuuacauuguaccccugcacaacgguuugcuaucgcguaauuugggaggugacacauaugaaauuugagggugugauuagucuuuaaaauaauaguuuugguauauauuuuaagcacuucuagcgacccccccaacacacaaacacacacacacacacgcgcacacacacacacacacacgaagaagaugcuaaggugggccacugccccggcucuggccagccgcauuuagaggggaaaaggacaaauggcgcuauuucuuuaagcuugguggggggaaaucuaaguuuguucuuuaaaaagggcgaaaguucgcuaggaccacagggccuucggcgagagcgcaggcagcuucguguuggcaccuuggggaucuucugggcugccagaagcucugagcuugcaguugcaccuaaaccgccgcuuucgcuacuuauauuugcgguaauguuaggaagcaaaguaucaucaaucagagaaucugguagccauucucucucuuugcccugugucccagcuugugauucuucuaaguuccaucuccuuugcugcgugcagauccuuggcuuugggcgcgcuuccucuucugcacuugggccaccgcggguuggccaccugggcugaacucaucccauccuugcuuucccccaucccuauacccagcggcgagggcagccucaccagcccuugccccggaggugaaugugugccuggcuuugacugagacaacuaggaccccagaagcccagugacaucagaaaagaggcuccugggcacuagcacuucccgcaauacgcuccagggcuguaggugcaaaacggagcucuaacuucccuccagcuaaucgaga

SEQ ID NO: 20919 - RNA, 1342 nt, Homo sapiens
aaagguagggcggcggcagcuccgcggggcucugggcggggggaacgggcuucggggcgcgcgggaggccacggaggugccucccgcgcgaaccuucccuugggcugcgggcccggggagucggggcugccagggcgccggguucgugcgcggacacugggggcgcacccggcucccgggucaggcgcggcuggagaccucgagguugggguuuugaagcgcgcaaguauuccccuccccaucgcgucuuugcaaguaguuugaagcccuaagucguuguuuacggauucccguuuccaacuuuuuaauugaaaaaaccugccgaggagaguggaggcaucgccaucccucccggucgcuuuuccacgccgcagcgcuccccacgcucgcccaguccucucuccucccgccucuagccguuucccggcccgagcgguccccgcgcuggcggccggguguuuucuccgggacuggggauguucuccgugcgcccucgccacaucuggcaaugauuaggugcccgaggaguucagcuggcucgggaagugcauuuggcaucuuucuccaucagauucaccgacuggaaaauaguugcccucgguuccgcgucccuuccacgugcccgccuuggggugugcccacugguguuuuggggugacacaccucagcugguuagucgcccccugcgcgguguccucugcaggccgguuuauggaagugucagauguuaucguacuuuagaaagaagcacgagaaggacugcagggcagccuucuguuuaguggaaacacggagauuugucagcggaauccugauuuauguaugagauaaguaaccgcagcggaggcaucaaagagucguucaggaaugggcccgcgugguguuuacacaaggcuucgugugagaguugcugguucugugcuaggauaacacagcccugcgugggugcgaaaugccaucugaccgcggucaccccgcuuccagccgccacagaccuggcgaugcaaucgcuuugacuucuaggguugccguccgagggaggcgcccgggaagccccaaggcgcuuggaaaguaacuuuuggcucuggaaaguuuuuuuucugaagggcagcucccgcggaacuaaccggagcgaugauauccuaccaauucacucccuuuccaagggcguuagguguccacgucgggagaccucgggaagggaggugacugauggccaggugaaaaguggucugccccagggaaaaagaaacaaaagacacgauacaacugccuaccuagagaauuucaaaaugcaguggcuugcuuuccuucugucuccaucucaguuucucuucccuca

SEQ ID NO: 20920 - RNA, 1342 nt, Homo sapiens
ugagggaagagaaacugagauggagacagaaggaaagcaagccacugcauuuugaaauucucuagguaggcaguuguaucgugucuuuuguuucuuuuucccuggggcagaccacuuuucaccuggccaucagucaccucccuucccgaggucucccgacguggacaccuaacgcccuuggaaagggagugaauugguaggauaucaucgcuccgguuaguuccgcgggagcugcccuucagaaaaaaaacuuuccagagccaaaaguuacuuuccaagcgccuuggggcuucccgggcgccucccucggacggcaacccuagaagucaaagcgauugcaucgccaggucuguggcggcuggaagcggggugaccgcggucagauggcauuucgcacccacgcagggcuguguuauccuagcacagaaccagcaacucucacacgaagccuuguguaaacaccacgcgggcccauuccugaacgacucuuugaugccuccgcugcgguuacuuaucucauacauaaaucaggauuccgcugacaaaucuccguguuuccacuaaacagaaggcugcccugcaguccuucucgugcuucuuucuaaaguacgauaacaucugacacuuccauaaaccggccugcagaggacaccgcgcagggggcgacuaaccagcugaggugugucaccccaaaacaccagugggcacaccccaaggcgggcacguggaagggacgcggaaccgagggcaacuauuuuccagucggugaaucugauggagaaagaugccaaaugcacuucccgagccagcugaacuccucgggcaccuaaucauugccagauguggcgagggcgcacggagaacauccccagucccggagaaaacacccggccgccagcgcggggaccgcucgggccgggaaacggcuagaggcgggaggagagaggacugggcgagcguggggagcgcugcggcguggaaaagcgaccgggagggauggcgaugccuccacucuccucggcagguuuuuucaauuaaaaaguuggaaacgggaauccguaaacaacgacuuagggcuucaaacuacuugcaaagacgcgauggggaggggaauacuugcgcgcuucaaaaccccaaccucgaggucuccagccgcgccugacccgggagccgggugcgcccccaguguccgcgcacgaacccggcgcccuggcagccccgacuccccgggcccgcagcccaagggaagguucgcgcgggaggcaccuccguggccucccgcgcgccccgaagcccguuccccccgcccagagccccgcggagcugccgccgcccuaccuuu

SEQ ID NO: 20921 - RNA, 867 nt, Homo sapiens
cccgcgcgcccgcagucccccucucacuuucucccagccucgcccucccacagacgugcccggugccgguaggcuccucucugcagggcagcuggcuuugggaccggaugagauuugaggcagcagcgagccugggacccgggcuugucgugacucuggcucgcgugcugccccggcagccuuugugacacggagcccuccggcugccugcuccucgcgccucgcauggcucugcaacauugugcaauuccagacgcuuuuauuguuugaaaacagauacgcacaauugcuuugccgugcaggaauuuaaaaauuucagcucaacucugcccacucaucucucugccuugucuucugcaaacucaguccucaaaaugaguuccugaugucuuucaagcaggcguuauuuauuaagaauuuuuccaacguaaauaaaggaaggaagaaaauggagggauuuuuaaaaaguaugagaaugguaggaaaacacguguguucaguuaauuuuuuauuugucuuuuaaaaaauaaagcgaaagaacugaaaccugguaguuuuccugugggaguggaaggaaccuucauuucuuuggggaccuggaguguuuguucucggguugaggaagcaaguuugugauuugccgucugauuguugacgagccuuaaggacguugauuagcagcuuuccccaacacguuuaaggaccacaugcuucacgcuauggagacccuguaguuugguuggaaugagaggaccaauguacaacugugaccgggagacagagucuguaagaaugagaaugccuaaagucucagaccucagagaauggugguuucuacccagcagagcuuccaccuucuuaauggcg

SEQ ID NO: 20922 - RNA, 867 nt, Homo sapiens
cgccauuaagaagguggaagcucugcuggguagaaaccaccauucucugaggucugagacuuuaggcauucucauucuuacagacucugucucccggucacaguuguacauugguccucucauuccaaccaaacuacagggucuccauagcgugaagcaugugguccuuaaacguguuggggaaagcugcuaaucaacguccuuaaggcucgucaacaaucagacggcaaaucacaaacuugcuuccucaacccgagaacaaacacuccagguccccaaagaaaugaagguuccuuccacucccacaggaaaacuaccagguuucaguucuuucgcuuuauuuuuuaaaagacaaauaaaaaauuaacugaacacacguguuuuccuaccauucucauacuuuuuaaaaaucccuccauuuucuuccuuccuuuauuuacguuggaaaaauucuuaauaaauaacgccugcuugaaagacaucaggaacucauuuugaggacugaguuugcagaagacaaggcagagagaugagugggcagaguugagcugaaauuuuuaaauuccugcacggcaaagcaauugugcguaucuguuuucaaacaauaaaagcgucuggaauugcacaauguugcagagccaugcgaggcgcgaggagcaggcagccggagggcuccgugucacaaaggcugccggggcagcacgcgagccagagucacgacaagcccgggucccaggcucgcugcugccucaaaucucauccggucccaaagccagcugcccugcagagaggagccuaccggcaccgggcacgucugugggagggcgaggcugggagaaagugagagggggacugcgggcgcgcggg

SEQ ID NO: 20923 - RNA, 1797 nt, Homo sapiens
guccuuuccuggcuccuucuauccccgcaguucuuuucuugaggaggacagauaggguuucuuagggaguuaggaugaagaaagccuaaguaugaugaauuccccauccagcacugugcccagcacauagcagacauccaauaaaggucuguuaaaugaaugacacggacccguuguuuaagauuuuaauaaagguggggcaaaggguugaauuggucgaaaaguccucaacguccugacgggacuccccugaagccaaggcaguuugaguccauucauuauucugucuuggaucuuaggcaaagccccgggccccuuggagcagcaccaggguucccgacacccccaccgacagggucgaacgugcacaggcugggaccacgccggaguucauugagcccucgugggggagggcaguuccagggaccaggaagggauucccguccagugucagguuauccaccucgggcagcucgucaggcugcggcgcccuguucagucuguugcagcugagaucgagcacucugagcuuggcuggcaguccuuuaggcaccuguuccagcccagcgaacgacagauugagggaguucagggcgcuggaccacaugcaucucggagcgcuaggguuuacgguggcgcgcagcgaguuguggcugaggucuaggcuguggggcugcacaccugccgccgccagugcggcgcacacgccugugggcgucuccauuccuguguugcgcagcgcuagauucuggauggccgggaacuuguggggacagagagccgccaucaguccgcguucgcccaguccaggauugucagacaggucuaggcugguaagggccgggaaggcgcgaaccuguucgcaggaaaaggcaggcgagugugcuugggcaaugcucaguaccuugaggccuggcuugagccacugcugcagcucggcgagccaagaacgcccugucgcccacgacacguugcguaggcgcaagcuggaaagugcaaguccuguggcuuccagaggcagcggaggcauggugccgguuaucuuuagguccucgagcgucaguuccuugaggcgggaguacgcuagcacacgcagggcgccuaccaguagcugagcaggaaccugugcggcucccacugugagccgccgcacgcggagagccuugaccgugucagcauacugccgcgggucggcguccgcaucgacgcgcuuuagaaacggcucuagguugagaccgccggcauggaucuccaccucuacugcagacacacacuggaaggcuucggaccagucgggcugagguucggagaaguugcagacgcagcggaaaucuucaucguccagcucacaagguucuggcguggucgcagagacgugcaccagcggcagcagcagcagcaacaagcaggacgcgcgcuccuggggagagagcagaggucuaggaggccccauccaaccccuguggcucccgaguggcacgcguucgaccccaagacccuacacucaccauggucgauaagucuuccgaaccucugagcuccggacaggcucuggaagugcuuuagcuucuuuccuacacagcggcacccgccggcuuccaggcuucacacuugugaacucuucggcugccucugacaguuuauguaauccugggaugucauucaguucccuccucugugaacccugaucaccuccccaccucucuuccuccgagccagcccccuuccuuuccuggaaauauugcaaugaaggauguuucagggagggggaccguaacaggaaggauucugcagggc

SEQ ID NO: 20924 - RNA, 1797 nt, Homo sapiens
gcccugcagaauccuuccuguuacggucccccucccugaaacauccuucauugcaauauuuccaggaaaggaagggggcuggcucggaggaagagagguggggaggugaucaggguucacagaggagggaacugaaugacaucccaggauuacauaaacugucagaggcagccgaagaguucacaagugugaagccuggaagccggcgggugccgcuguguaggaaagaagcuaaagcacuuccagagccuguccggagcucagagguucggaagacuuaucgaccauggugaguguagggucuuggggucgaacgcgugccacucgggagccacagggguuggauggggccuccuagaccucugcucucuccccaggagcgcgcguccugcuuguugcugcugcugcugccgcuggugcacgucucugcgaccacgccagaaccuugugagcuggacgaugaagauuuccgcugcgucugcaacuucuccgaaccucagcccgacugguccgaagccuuccagugugugucugcaguagagguggagauccaugccggcggucucaaccuagagccguuucuaaagcgcgucgaugcggacgccgacccgcggcaguaugcugacacggucaaggcucuccgcgugcggcggcucacagugggagccgcacagguuccugcucagcuacugguaggcgcccugcgugugcuagcguacucccgccucaaggaacugacgcucgaggaccuaaagauaaccggcaccaugccuccgcugccucuggaagccacaggacuugcacuuuccagcuugcgccuacgcaacgugucgugggcgacagggcguucuuggcucgccgagcugcagcaguggcucaagccaggccucaagguacugagcauugcccaagcacacucgccugccuuuuccugcgaacagguucgcgccuucccggcccuuaccagccuagaccugucugacaauccuggacugggcgaacgcggacugauggcggcucucuguccccacaaguucccggccauccagaaucuagcgcugcgcaacacaggaauggagacgcccacaggcgugugcgccgcacuggcggcggcaggugugcagccccacagccuagaccucagccacaacucgcugcgcgccaccguaaacccuagcgcuccgagaugcaugugguccagcgcccugaacucccucaaucugucguucgcugggcuggaacaggugccuaaaggacugccagccaagcucagagugcucgaucucagcugcaacagacugaacagggcgccgcagccugacgagcugcccgagguggauaaccugacacuggacgggaaucccuuccuggucccuggaacugcccucccccacgagggcucaaugaacuccggcguggucccagccugugcacguucgacccugucggugggggugucgggaacccuggugcugcuccaaggggcccggggcuuugccuaagauccaagacagaauaaugaauggacucaaacugccuuggcuucaggggagucccgucaggacguugaggacuuuucgaccaauucaacccuuugccccaccuuuauuaaaaucuuaaacaacggguccgugucauucauuuaacagaccuuuauuggaugucugcuaugugcugggcacagugcuggauggggaauucaucauacuuaggcuuucuucauccuaacucccuaagaaacccuaucuguccuccucaagaaaagaacugcggggauagaaggagccaggaaaggac

SEQ ID NO: 20925 - RNA, 2338 nt, Homo sapiens
ggacccagcgagaacccgagcgaacgaugggagggagcugcgcgcagaggcgccgggccggcccgcggcagguacuauuuccuuugcugcugccuuuguucuaccccacgcugugugagccgauccgcuacucgauuccggaggagcuggccaagggcucggugguggggaaccucgcuaaggaucuagggcuuaguguccuggaugugucggcucgcgagcugcgagugagcgcggagaagcugcacuucagcguagacgcgcagagcggggacuuacuugugaaggaccgaauagaccgugagcaaauaugcaaagagagaagaagaugugaguugcaauuggaagcugugguggaaaauccuuuaaauauuuuucaugucauuguggugauugaggauguuaaugaccacgccccucaauuccggaaagaugaaauaaacuuagaaaucagugaauccgucagccuggggaugggaacaauucuugagucugcagaagauccugauauuaguaugaauucgcugagcaaauaccaacuaaguccuaacgaguauuucucauugguggagaaagacaauccugaugguggcaaauauccagaauuaguauugcagaagacucuggaccgagaaacgcagagcgcucaccacuugguacugaccgccuuagaugguggggacccuccccgaagcgguacugcucagauaagaauccugguaauagaugccaaugacaaccccccaguguucagccaggacguguacaggguuagccuucgggaagacgugccuccaggcaccuccauccugagagugaaggccacugaccaggacgagggcaucaacucagagaucacuuauuccuucuuugguguggcugacaaagcucagcacguguucucucuggauuacacuacaggaaacauucuaacucagcagccuuuggauuuugaagaaguagaaagauauacgauaaacauagaagcaaaagaccgaggaucucucucaacacgguguaaaguaauuguagaaguuguagacgaaaacgacaacagcccagaaauaaucaucacgucacucucugaucagauuauggaggauuccccuccaggagugguuguugcccucuucaaaacacgggaccaagacucaggggaaaauggggaagucagguguagcuuaaguagagguguuccauuuaagauucauucuucuucuaauaauuacuacaagcuaguaacagaugaggcccuggaucgggagcagaccccagaguacaacgucaccaucgcagccacagacaggggcaagccuccguuauccuccagcaaaaccauaacccugcacauuacugacgucaaugacaacgcgccgguuuucggacagucagccuaccugguccacgugccagaaaacaaccagccgggugccuccauagcgcaagucagugccucugacccagacuucgggcucaacggccgugucuccuacucucucauugccagcgaccuggagucacgaacgcugucguccuacguguccgugagcgcgcagagcggggugguguucgcgcagcgcgccuucgaccacgagcagcugcgcaccuucgagcucacgcugcaggcccgcgaccagggcucgcccgcgcucagcgccaaugugagccugcgcguguuggugggcgaccguaacgacaacgcaccgcgggugcuguacccugcgcugggucccgacggcuccgcgcucuucgacacagugccgcgggccgcgcagccaggcuaccuggugaccaaggugguggccguggacgcggacucggggcacaaugccuggcuguccuaccacguggugcaggccagugagcccgggcucuucagccuggggcugcgaacaggcgaggugcgcauggugcgugcuuugggugacaaggacucgguccgccagcgccugcuagucgcuguaagagauggaggacagccaccccuuucagccacugccacgcugcaccugguguucgcagauagcuugcaagagguacugccggauuucagcgaccaucccacacccucugacucccaggcugagaugcaguuuuaccuggugguggccuuggccuugauuucugugcucuuucuccucgcggugauucuagcuauugcucuacgccugcgacagucuuucagcccuacugcaggagacugcuuugagucaguucucugcuccaaguccggaccuguggguccccccaacuacagugagggaacguugcccuaugccuauaauuuuugugugccuggggaucaaaugaauccagaauuuaauuuuuucacaucugu

SEQ ID NO: 20926 - RNA, 2338 nt, Homo sapiens
acagaugugaaaaaauuaaauucuggauucauuugauccccaggcacacaaaaauuauaggcauagggcaacguucccucacuguaguuggggggacccacagguccggacuuggagcagagaacugacucaaagcagucuccugcaguagggcugaaagacugucgcaggcguagagcaauagcuagaaucaccgcgaggagaaagagcacagaaaucaaggccaaggccaccaccagguaaaacugcaucucagccugggagucagagggugugggauggucgcugaaauccggcaguaccucuugcaagcuaucugcgaacaccaggugcagcguggcaguggcugaaagggguggcuguccuccaucucuuacagcgacuagcaggcgcuggcggaccgaguccuugucacccaaagcacgcaccaugcgcaccucgccuguucgcagccccaggcugaagagcccgggcucacuggccugcaccacgugguaggacagccaggcauugugccccgaguccgcguccacggccaccaccuuggucaccagguagccuggcugcgcggcccgcggcacugugucgaagagcgcggagccgucgggacccagcgcaggguacagcacccgcggugcguugucguuacggucgcccaccaacacgcgcaggcucacauuggcgcugagcgcgggcgagcccuggucgcgggccugcagcgugagcucgaaggugcgcagcugcucguggucgaaggcgcgcugcgcgaacaccaccccgcucugcgcgcucacggacacguaggacgacagcguucgugacuccaggucgcuggcaaugagagaguaggagacacggccguugagcccgaagucugggucagaggcacugacuugcgcuauggaggcacccggcugguuguuuucuggcacguggaccagguaggcugacuguccgaaaaccggcgcguugucauugacgucaguaaugugcaggguuaugguuuugcuggaggauaacggaggcuugccccugucuguggcugcgauggugacguuguacucuggggucugcucccgauccagggccucaucuguuacuagcuuguaguaauuauuagaagaagaaugaaucuuaaauggaacaccucuacuuaagcuacaccugacuuccccauuuuccccugagucuuggucccguguuuugaagagggcaacaaccacuccuggaggggaauccuccauaaucugaucagagagugacgugaugauuauuucugggcuguugucguuuucgucuacaacuucuacaauuacuuuacaccguguugagagagauccucggucuuuugcuucuauguuuaucguauaucuuucuacuucuucaaaauccaaaggcugcugaguuagaauguuuccuguaguguaauccagagagaacacgugcugagcuuugucagccacaccaaagaaggaauaagugaucucugaguugaugcccucguccuggucaguggccuucacucucaggauggaggugccuggaggcacgucuucccgaaggcuaacccuguacacguccuggcugaacacugggggguugucauuggcaucuauuaccaggauucuuaucugagcaguaccgcuucggggaggguccccaccaucuaaggcggucaguaccaaguggugagcgcucugcguuucucgguccagagucuucugcaauacuaauucuggauauuugccaccaucaggauugucuuucuccaccaaugagaaauacucguuaggacuuaguugguauuugcucagcgaauucauacuaauaucaggaucuucugcagacucaagaauuguucccauccccaggcugacggauucacugauuucuaaguuuauuucaucuuuccggaauugaggggcguggucauuaacauccucaaucaccacaaugacaugaaaaauauuuaaaggauuuuccaccacagcuuccaauugcaacucacaucuucuucucucuuugcauauuugcucacggucuauucgguccuucacaaguaaguccccgcucugcgcgucuacgcugaagugcagcuucuccgcgcucacucgcagcucgcgagccgacacauccaggacacuaagcccuagauccuuagcgagguuccccaccaccgagcccuuggccagcuccuccggaaucgaguagcggaucggcucacacagcgugggguagaacaaaggcagcagcaaaggaaauaguaccugccgcgggccggcccggcgccucugcgcgcagcucccucccaucguucgcucggguucucgcugggucc

SEQ ID NO: 20927 - RNA, 747 nt, Homo sapiens
gcgcacagagcggggugguggucgcgcagcgugccuucgaccacgagcagcugugcgccuucgagcucacgaugcaggcccacgaccagggcucgcccgcgcucagcgccaacaugagccggcgcauguuggugggcgaccucaaugacaaugugccgcgggugcuguaccccgcgcuggggcccgauggcuccgcacucuucgauauagugccacgcgccgcagaguccggcuaccuggugaccaaggugguggcgguggacgcagauucgggacacaacgcuuggcuguccuaccacgugcugcaggccaucgagcccgggcuuuucagccuggggcugcacacgggaaccugcugguugcugugcgugacggaggacagccgccgcucucugcgccgcuacgcuucaccuagucuucgcagacagccugcaggaggcacugccagacuucagugacaguccugugcccucugauucccaagcaaagcugcagauuuaccuggucguggccuuggccuugauuucuaugcucuucuuccucgcagugauuuuggcggucgccuugcaccugcgaugcucuuccagccccucugccugggguugcuuucacccuggucucuguucuaagacuagaccagggguuuuucccaacuacaaugagggaacuuugcuuuauuccugcaaucuguauguucccucggauucuagaaaaagaagauuuaauuuucucaccaugacaccagaa

SEQ ID NO: 20928 - RNA, 747 nt, Homo sapiens
uucuggugucauggugagaaaauuaaaucuucuuuuucuagaauccgagggaacauacagauugcaggaauaaagcaaaguucccucauuguaguugggaaaaaccccuggucuagucuuagaacagagaccagggugaaagcaaccccaggcagaggggcuggaagagcaucgcaggugcaaggcgaccgccaaaaucacugcgaggaagaagagcauagaaaucaaggccaaggccacgaccagguaaaucugcagcuuugcuugggaaucagagggcacaggacugucacugaagucuggcagugccuccugcaggcugucugcgaagacuaggugaagcguagcggcgcagagagcggcggcuguccuccgucacgcacagcaaccagcagguucccgugugcagccccaggcugaaaagcccgggcucgauggccugcagcacgugguaggacagccaagcguugugucccgaaucugcguccaccgccaccaccuuggucaccagguagccggacucugcggcgcguggcacuauaucgaagagugcggagccaucgggccccagcgcgggguacagcacccgcggcacauugucauugaggucgcccaccaacaugcgccggcucauguuggcgcugagcgcgggcgagcccuggucgugggccugcaucgugagcucgaaggcgcacagcugcucguggucgaaggcacgcugcgcgaccaccaccccgcucugugcgc

SEQ ID NO: 20929 - RNA, 605 nt, Homo sapiens
aaauauuaacucuccguccaggucagcaugcccaggaggucacgucccacuucccagcucuugucccacuuccuaacacuugucugcgcgaagcaguagcagucagaaccaggcaccagagcgcccccugaagguagaccggggagcggggccucagacauaucagcccguaccuggccagacaguuuuccuccgccgcgcaucucagguuguacauggacaucuucugcacguacguggacgccuggauguaguaggggucggccaccaggucugggagaccuaaacgucagcaggcgacgggcgcagcagugaaacaacccggcgccccccgcuccaacucccuaccccucuaggucccuuacuccucacccuucgcccaccgggacugcagaguggagcggaggacagcaagagaacuggggacgcccgggacugcaaagcaaugugaaaaggaagcaggaggggccagacgcgcgguuugcacuggauuccagggcugccacugcaggcgcgugggggagggaucggaucugcgaggaccggggcccgccgcgcccaggcagccacgucgagaagccacauagcuggggaccaggugcacg

SEQ ID NO: 20930 - RNA, 605 nt, Homo sapiens
cgugcaccugguccccagcuauguggcuucucgacguggcugccugggcgcggcgggccccgguccucgcagauccgaucccucccccacgcgccugcaguggcagcccuggaauccagugcaaaccgcgcgucuggccccuccugcuuccuuuucacauugcuuugcagucccgggcguccccaguucucuugcuguccuccgcuccacucugcagucccggugggcgaagggugaggaguaagggaccuagagggguagggaguuggagcggggggcgccggguuguuucacugcugcgcccgucgccugcugacguuuaggucucccagaccugguggccgaccccuacuacauccaggcguccacguacgugcagaagauguccauguacaaccugagaugcgcggcggaggaaaacugucuggccagguacgggcugauaugucugaggccccgcuccccggucuaccuucagggggcgcucuggugccugguucugacugcuacugcuucgcgcagacaaguguuaggaagugggacaagagcugggaagugggacgugaccuccugggcaugcugaccuggacggagaguuaauauuu

SEQ ID NO: 20931 - RNA, 679 nt, Homo sapiens
gggugcuggcggccgcgcugcugcuccgcgcgcacccggguguccucuccgagcgcugcaccgacgagaagagccggcgcauccuggccgcgcugguaggucccgccgccgcucugccccgcgccgcgcguccggggaggggggaucacacccgcucccgguccccagccuucccggggacuuggguggcgguggcacccgccggggacauggguucccgacaccugcguggagugccagaggcgcacgccccggucccccgaauggggacgcagccggcagugcucugugggcgcgcugggggugucucuccccuuuucgccagaauucgcccuuuguccccagacagccucuccguccuacccucgccaccccugagcccgagcuccggaagaaaguuugcgggucugauccgaguguccagggaggugccgcguccggugucaggccgccgggcucggggcgcaagccagugcgggguucgggauccggggugccacgccucugucucucggguccgcagcgcuccagcccagcccgcguucugugauuccacccugagcugccaggucacccccuaucucaccgagcccaugcggagggcuggucugaccccggccccccugcgcuccagagcccaggcucuccgcggucgcggucugugggaaccgacgcagug

SEQ ID NO: 20932 - RNA, 679 nt, Homo sapiens
cacugcgucgguucccacagaccgcgaccgcggagagccugggcucuggagcgcaggggggccggggucagaccagcccuccgcaugggcucggugagauagggggugaccuggcagcucaggguggaaucacagaacgcgggcugggcuggagcgcugcggacccgagagacagaggcguggcaccccggaucccgaaccccgcacuggcuugcgccccgagcccggcggccugacaccggacgcggcaccucccuggacacucggaucagacccgcaaacuuucuuccggagcucgggcucagggguggcgaggguaggacggagaggcugucuggggacaaagggcgaauucuggcgaaaaggggagagacacccccagcgcgcccacagagcacugccggcugcguccccauucgggggaccggggcgugcgccucuggcacuccacgcaggugucgggaacccauguccccggcgggugccaccgccacccaaguccccgggaaggcuggggaccgggagcgggugugauccccccuccccggacgcgcggcgcggggcagagcggcggcgggaccuaccagcgcggccaggaugcgccggcucuucucgucggugcagcgcucggagaggacacccgggugcgcgcggagcagcagcgcggccgccagcaccc

SEQ ID NO: 20933 - RNA, 1207 nt, Homo sapiens
uuucuuucccagacgaguuuccccucgcuuuucuggaccagccagccggggucagccucccaggccacccuacaucgcgcgcuccccagggaccuccugcccaucccuccauccucucucucgcgucccaagucuaggcugcucccgcccaggugacagccccuccugucccgcugccucccgugagucccuccuaccgccucgucuggucacuagaauaguuuugaacccuuggguucuacacgguuucccucccaagccaggcagcgcaucucucaagaauagggaaaggucuccaucaacuuugccgucacggagcagugaccgcgggcgggcgcggggcacacaccugccugcacgcgggcgcggguccccggguaggggagcacuugcggggcgcgggagccgcccucggccacggcgaaggcgcccuaaacuacagccggcagggacgcgcggcgcugggagggcaucagacgggaauuucgaauugagcuugggaagcggagaccagaaaauggugauucuaaacacacgcgagcgucgccacacacagcaguuccacccgaaaggcgcacacuuuugagaacagaccaucguggauagcaccgcaaagaaaccuccuccaaggcacguuccucguuggaacugacaaccccuuucgucuacugacuuccccgcacggucgaagacagcccggugcacucgaggauggggacucaggcgcuccuggaguccccagguccgucugcggagccccccggcaggugugggcccccaccuggccaagcaacaagcgggccauccgccuaagggccgggucccucucugcccuguacccgcacgggucaccucucccugccccccccccaggcagccagccgggccgaacgagcgccggggaaggagcaagccgagcgagccacucaccccaagcuuccugcugcggauuuucacguagcccugcuugacuaugucguuaaaguuggaggccauggccagcgcgaucgggcuccugcgccccgcgauccgcucuccggagucgagagccgccguccgccgccgggucugcgcgggucucgcauccagccggccgccgccagcagcagcgccgccgcccgcucuuccccgagcucccgccgguggggacgcggggucgccugcagggccgccgcggacggggaacggggcccggcgccgcgagccg

SEQ ID NO: 20934 - RNA, 1207 nt, Homo sapiens
cggcucgcggcgccgggccccguuccccguccgcggcggcccugcaggcgaccccgcguccccaccggcgggagcucggggaagagcgggcggcggcgcugcugcuggcggcggccggcuggaugcgagacccgcgcagacccggcggcggacggcggcucucgacuccggagagcggaucgcggggcgcaggagcccgaucgcgcuggccauggccuccaacuuuaacgacauagucaagcagggcuacgugaaaauccgcagcaggaagcuuggggugaguggcucgcucggcuugcuccuuccccggcgcucguucggcccggcuggcugccuggggggggggcagggagaggugacccgugcggguacagggcagagagggacccggcccuuaggcggauggcccgcuuguugcuuggccaggugggggcccacaccugccggggggcuccgcagacggaccuggggacuccaggagcgccugaguccccauccucgagugcaccgggcugucuucgaccgugcggggaagucaguagacgaaagggguugucaguuccaacgaggaacgugccuuggaggagguuucuuugcggugcuauccacgauggucuguucucaaaagugugcgccuuucggguggaacugcuguguguggcgacgcucgcguguguuuagaaucaccauuuucuggucuccgcuucccaagcucaauucgaaauucccgucugaugcccucccagcgccgcgcgucccugccggcuguaguuuagggcgccuucgccguggccgagggcggcucccgcgccccgcaagugcuccccuacccggggacccgcgcccgcgugcaggcaggugugugccccgcgcccgcccgcggucacugcuccgugacggcaaaguugauggagaccuuucccuauucuugagagaugcgcugccuggcuugggagggaaaccguguagaacccaaggguucaaaacuauucuagugaccagacgaggcgguaggagggacucacgggaggcagcgggacaggaggggcugucaccugggcgggagcagccuagacuugggacgcgagagagaggauggagggaugggcaggaggucccuggggagcgcgcgauguaggguggccugggaggcugaccccggcuggcugguccagaaaagcgaggggaaacucgucugggaaagaaa

SEQ ID NO: 20935 - RNA, 1608 nt, Homo sapiens
agucgacgcugucuaggcgucugccaaaaauaacuggguacaccagcuuccccgggccuggcccuccgcuguggggugggcucccugcagcugcuuuccaugcaauugugcccuccgcaaggugaaggaagugcguuucuagcagaggugagacccgaucccaccucugcuuuaagggcaagcggggcgcagcgggcgccugucccaccgucucggcucacugcgcgggacuagcagccggagcccaacgaaaauuugggggcccacgccccccaccggcccgacccucacuccgacccggccaccaguguugugggggaggaggaaggaccugugcgagcggcugaagcucugagcuuuuaacacaaaucucggccgaaacuccagcccgcuccccgccccccaaaguggcaucgcuccagugccuucucccgccucaugcgagucccgguuuucuggauuuacgacgucggagccgagggucgccugagcggugacacaccccgcugccuccucugugccgcgguucaggggguggggguaggcgguuccgcgcccccuggcccugggagcggcuccccuuccaccaugcagcccccgccccgaccagcgcucuuccgccggccccgcccccgccccccgagucccgggucgagagccgcgggcccacccagcccaggccgcggccgcauucagccccggcgcccacaccgcgccugccgccuggcuccgcggaccugcgcccgcccgcccgcccgcagccucgacgccgccgcgggugccccaggccggagggcgguuggagccucaccuggcacguagaucucgccgcgcuccucgucggggagcucgcuccaguuccucuugcacguggagacgcacggcuucuucaccaggaacgcgcggggcauuuucgaacccucgucgcuggacacgggccgcuuccguaacugaagccgggagccgucccaccuuugcggggccgggcugaacgccgggaacgggggcacaacagggaaggagucgcuaaggcgcccccacguuccggggaagguccgagcccggacggcgcgcggcgguuccaccuccgcggaaugucgccgucuucccugagaacgaggucccuugcggccaggugcaccgggcggcgcggggaagcggcagguaagcgucucccggcucgacuggcguccccgccgccgcucgggaagucuuaaagugcgagccggacggacggguucacgcuuuauuggcucgcggcgguguguguugguggcuggggcggggggggguggggguggggggcggugaucugaucuaauuagcuugggguggcccggggagcgacggcgcaugcguugggaaauaacggugacaacccaccuauuuguuaccugucgaaccgguuuccauuccgcugcgggugagguggccucgcggcccgggcggggcggccgggcggggcggggucggggggcgagcuucgggcacucagccccuggcugcccagccggcccggcccccgcgggaccuccuagccaggcguacuggcguuugcaaacaggaguuucggagcgagcggagccgggagggagggggcaacguuau

SEQ ID NO: 20936 - RNA, 1608 nt, Homo sapiens
auaacguugcccccucccucccggcuccgcucgcuccgaaacuccuguuugcaaacgccaguacgccuggcuaggaggucccgcgggggccgggccggcugggcagccaggggcugagugcccgaagcucgccccccgaccccgccccgcccggccgccccgcccgggccgcgaggccaccucacccgcagcggaauggaaaccgguucgacagguaacaaauagguggguugucaccguuauuucccaacgcaugcgccgucgcuccccgggccaccccaagcuaauuagaucagaucaccgccccccacccccacccccccccgccccagccaccaacacacaccgccgcgagccaauaaagcgugaacccguccguccggcucgcacuuuaagacuucccgagcggcggcggggacgccagucgagccgggagacgcuuaccugccgcuuccccgcgccgcccggugcaccuggccgcaagggaccucguucucagggaagacggcgacauuccgcggagguggaaccgccgcgcgccguccgggcucggaccuuccccggaacgugggggcgccuuagcgacuccuucccuguugugcccccguucccggcguucagcccggccccgcaaaggugggacggcucccggcuucaguuacggaagcggcccguguccagcgacgaggguucgaaaaugccccgcgcguuccuggugaagaagccgugcgucuccacgugcaagaggaacuggagcgagcuccccgacgaggagcgcggcgagaucuacgugccaggugaggcuccaaccgcccuccggccuggggcacccgcggcggcgucgaggcugcgggcgggcgggcgggcgcagguccgcggagccaggcggcaggcgcggugugggcgccggggcugaaugcggccgcggccugggcugggugggcccgcggcucucgacccgggacucggggggcgggggcggggccggcggaagagcgcuggucggggcgggggcugcaugguggaaggggagccgcucccagggccagggggcgcggaaccgccuacccccacccccugaaccgcggcacagaggaggcagcggggugugucaccgcucaggcgacccucggcuccgacgucguaaauccagaaaaccgggacucgcaugaggcgggagaaggcacuggagcgaugccacuuuggggggcggggagcgggcuggaguuucggccgagauuuguguuaaaagcucagagcuucagccgcucgcacagguccuuccuccucccccacaacacugguggccgggucggagugagggucgggccgguggggggcgugggcccccaaauuuucguugggcuccggcugcuagucccgcgcagugagccgagacggugggacaggcgcccgcugcgccccgcuugcccuuaaagcagaggugggaucgggucucaccucugcuagaaacgcacuuccuucaccuugcggagggcacaauugcauggaaagcagcugcagggagcccaccccacagcggagggccaggcccggggaagcugguguacccaguuauuuuuggcagacgccuagacagcgucgacu

SEQ ID NO: 20937 - RNA, 4202 nt, Homo sapiens
cagcgucacucucuguuggauucuucgcgggagguuuagcucugccagcuucugcucccaggaauaagggucagaaucgacuuccaauuuaccagcgaaugaggcuuuccuaaccuccuucguucccuccccccauaacuuauggauuuauauuaauuacaauagaaacucuuaccugaaaauuggcuuucauuaaucugauuguacaacauaguauaaacacagacaccaggaagguuauauuuauucagaccacuggagaauccacuuuucgggguuguucgucuauuuaaauaccuuccguuccagcaaaggcugagacucgccagcucugcccggccugaccagggcgcccucuccccgucgggugguuugggcgguuccgggcccggcgucucucaccccgcuggucuccccacgcccgccggguccccuaggagugcacuagcaccgagugcaaggagccgcccuugcuuucggccgagguaggggcugugggcuccagcagagaggcaacgggcgaggccgcggccgcggagcacacgguggauggcgccggaggcugcugcgaagccgcggggacagugagccccggcugcagcgcggacacgggcggcagcgcaggcgugggcuugaugggcaccggcauggcaggcaggcucuggcuugccgaguggcacagggacuugaccgggaccccgaaggccccauacuccgggccuacagggacuccggcugcggcugcggcggccgcggcggcggccaccgaauccaugacgccaacgugcggccacacggagcugacgacguugccaagcuggccgggcacgggguagcccagguggugcaugacggacgccaagggcagcccuccagccugcagcacgcccuuguagucccggccaauaauguucucaauggcaaaggggugcuugaagccugacguggacgccgcggccgcggcggcagcggcggcggccgagcccagcccguagggugggaacugagacaggcgucccacgcugcccaccgcggcugccgcggccgccgccgccgccgccgccacggccgccgccuccugcaucuugccggggugagacggcugcugaggcugcgacugcuggggcgguugcugcgggggcugugacgggaggugcggaggcggcugcggagcaguaggcgguugcugauggaaauaguguaccaugugcggcggcggcgggggcggcggcggcggcggcuggggugggugguggugauggugguggugugcggcagcguggugaugaugguggugguggggguggugguggugaugggggugaaggugcccucccggaccggcgcccggcgcgcucuuggugcuucccgcgugcaagugaguauggucggcgcgcagcaccuugaagcgcuugcgacgccgcaggaagcugccguucucgaacauguccccgcagucggggugcagcgcccagaagcuacccuugccaggcuggucgggccuccgcggaaucuugaugaagcagucguugaaggagagguuguggcgcaggcuguucugccagcgcugugugugcucgcgguaguaggggaagcgcuccaugaugaacuuguagaugucgcucagcggcagcaucuucucggccgagugcuggauugccauggcggucagcgagauguaagaguagggcgguuuuuggucgcuguacgagcucuuccccggccgcggcaucgcccccggcuccuccaccgcccuccggcccgcacuggaccacagaaucucuccgcacuccguuccuggggccuggcugcccccacuaauucccacucggccccuccagucccgccacuuugcccucucgcccuccaggcccucucugcuucucucuccugccuucuccgaauugccuggugucuccgaccuuggccuuucgggccuacucagcucucggaagcuggcaacuucuggccccgacgguugccgacuggcgcgcacagucgcgggcggagugcaccagguuuaccgccgccuucucugcgucuucccccggguggccaaagacugagugcuggagcuggcugcagaggagaguggcaaggggccguguuuccucccggccucuuugcuuuuucuagguccgagggaaacccagaccaagauggcugggaggaaggucugggcaguagagacucuggcccuuuaaaucugaguuugcgccugcuguccuggaggccagugacagcaggacuuccagugcccuggacgcaggccccuggccaggcacuuagccagaccgcgcuggaguucuccuuuuccuggagugaaaaaucaggguaaggagagagaagauuggcuucuagggcgccucucuuuucuccgaggcucgcagcgucgccgggguuagaagagacgcgcagcccuaggcugucgcugaggagaaaaaacuuuggugguuucugaagcggcagcgcccgcagguucugcugaggaguguggggcgcaggacucugggagcgagcggcgggcuggagagggcgucugcgaaugcugggugagugcuggccggggaggcucagccguccgcgccgcagcugccgccuuucucccgggcuugucuugaggaggagaggcgacggcaguggcagcgacgcgcucuccuggcugcguuuuguaaugguccccgagacgccgagacccccgcagcuagcgcuucgagacuaucacaugaccgaggcugagggacucagccgccgccgccgcgucuguagcugaagaaggggcaagaaggcgccgugccucgcccccgcccccuuuuccaccucguuucgggcgcucuccacccaucgcguucaccacucgcucggcagcccccagccaccucccggugcggcggguggcgcaggcuguucgccgggagggggcacagcuccgggugcauuucccgcagcugcgccccacccgggccaccaagcacgguggagggggaacaggacacugccuucuugcuucucuucucucuggcaucucccucuuccgcccccuuccuuuuacccuucccuguuuucaucuacucgcugugagcuucucucuccuuacaaacccuuuuuccugggcuagacacucugggucaaguucagaguaucguguccucaaggccucuucucugcaagaaaccccgaugauuagagggcuggagggaaaaacucauggggaagaaagcaugggguguuuucaccaaaugccaaauucaucucaguuuuauugcgcgccaacugcaugugaggcaccaggugcagggagacaggagacaguauccgagcuccaccaucgcgguauagagggugagacgaacaguaaccaagaaauuaauagaauaggcacuaaagggcuuggcgaauggaggcuccaccacacuuuccuggagcgagugaguuggacaagaugagguuucucugggauggcgaugucugagcuggggccagaaguaagaguuggggauucaggggucccaucaccugugugugcuggaaggaaaucuuugcuauucuuagcacggugguguggggccagggcgaggcaggagguggaauggaaauaauuaaauaggaagcaaaaauuaucaguccacaggauccuggugugaucugcgagggagagguggaugaacccaggagugagguccuucugcuuggagguuccugcucugcacucauccaaacacccagcaggaaaccccaguuuacugcagggagaaccugaaguuguauacucguuuuggcuaccuuugcccuucagcugggaggaaaagcagaguuuagaaacaaguauacucuccgucucugggacuguuucauuauuuguaaaauaggguggcugaaguuggaaauucacggguccuuucccguuaggcgauuugaggagaaaggagcauuuggacacuauggcucccucgguuuucccacgccuaaccuggaagaaagccaucggcccagcugcuuggggggcugcccccuaacuagcaaccuuggugacaccagaucggguguuuucagcuucuggcuuuuggugagcuggacggugggagcacgucuguccgugggguggcuuagccaggucgcaggagugccgugagcgggucaggcccguaauuuccaucuuuagucaggagcuagauuucuggcuagcucuauguggccaguuu

SEQ ID NO: 20938 - RNA, 4202 nt, Homo sapiens
aaacuggccacauagagcuagccagaaaucuagcuccugacuaaagauggaaauuacgggccugacccgcucacggcacuccugcgaccuggcuaagccaccccacggacagacgugcucccaccguccagcucaccaaaagccagaagcugaaaacacccgaucuggugucaccaagguugcuaguuagggggcagccccccaagcagcugggccgauggcuuucuuccagguuaggcgugggaaaaccgagggagccauaguguccaaaugcuccuuucuccucaaaucgccuaacgggaaaggacccgugaauuuccaacuucagccacccuauuuuacaaauaaugaaacagucccagagacggagaguauacuuguuucuaaacucugcuuuuccucccagcugaagggcaaagguagccaaaacgaguauacaacuucagguucucccugcaguaaacugggguuuccugcuggguguuuggaugagugcagagcaggaaccuccaagcagaaggaccucacuccuggguucauccaccucucccucgcagaucacaccaggauccuguggacugauaauuuuugcuuccuauuuaauuauuuccauuccaccuccugccucgcccuggccccacaccaccgugcuaagaauagcaaagauuuccuuccagcacacacaggugaugggaccccugaauccccaacucuuacuucuggccccagcucagacaucgccaucccagagaaaccucaucuuguccaacucacucgcuccaggaaagugugguggagccuccauucgccaagcccuuuagugccuauucuauuaauuucuugguuacuguucgucucacccucuauaccgcgaugguggagcucggauacugucuccugucucccugcaccuggugccucacaugcaguuggcgcgcaauaaaacugagaugaauuuggcauuuggugaaaacaccccaugcuuucuuccccaugaguuuuucccuccagcccucuaaucaucgggguuucuugcagagaagaggccuugaggacacgauacucugaacuugacccagagugucuagcccaggaaaaaggguuuguaaggagagagaagcucacagcgaguagaugaaaacagggaaggguaaaaggaagggggcggaagagggagaugccagagagaagagaagcaagaaggcaguguccuguucccccuccaccgugcuugguggcccggguggggcgcagcugcgggaaaugcacccggagcugugcccccucccggcgaacagccugcgccacccgccgcaccgggagguggcugggggcugccgagcgaguggugaacgcgauggguggagagcgcccgaaacgagguggaaaagggggcgggggcgaggcacggcgccuucuugccccuucuucagcuacagacgcggcggcggcggcugagucccucagccucggucaugugauagucucgaagcgcuagcugcgggggucucggcgucucggggaccauuacaaaacgcagccaggagagcgcgucgcugccacugccgucgccucuccuccucaagacaagcccgggagaaaggcggcagcugcggcgcggacggcugagccuccccggccagcacucacccagcauucgcagacgcccucuccagcccgccgcucgcucccagaguccugcgccccacacuccucagcagaaccugcgggcgcugccgcuucagaaaccaccaaaguuuuuucuccucagcgacagccuagggcugcgcgucucuucuaaccccggcgacgcugcgagccucggagaaaagagaggcgcccuagaagccaaucuucucucuccuuacccugauuuuucacuccaggaaaaggagaacuccagcgcggucuggcuaagugccuggccaggggccugcguccagggcacuggaaguccugcugucacuggccuccaggacagcaggcgcaaacucagauuuaaagggccagagucucuacugcccagaccuuccucccagccaucuuggucuggguuucccucggaccuagaaaaagcaaagaggccgggaggaaacacggccccuugccacucuccucugcagccagcuccagcacucagucuuuggccacccgggggaagacgcagagaaggcggcgguaaaccuggugcacuccgcccgcgacugugcgcgccagucggcaaccgucggggccagaaguugccagcuuccgagagcugaguaggcccgaaaggccaaggucggagacaccaggcaauucggagaaggcaggagagagaagcagagagggccuggagggcgagagggcaaaguggcgggacuggaggggccgagugggaauuagugggggcagccaggccccaggaacggagugcggagagauucugugguccagugcgggccggagggcgguggaggagccgggggcgaugccgcggccggggaagagcucguacagcgaccaaaaaccgcccuacucuuacaucucgcugaccgccauggcaauccagcacucggccgagaagaugcugccgcugagcgacaucuacaaguucaucauggagcgcuuccccuacuaccgcgagcacacacagcgcuggcagaacagccugcgccacaaccucuccuucaacgacugcuucaucaagauuccgcggaggcccgaccagccuggcaaggguagcuucugggcgcugcaccccgacugcggggacauguucgagaacggcagcuuccugcggcgucgcaagcgcuucaaggugcugcgcgccgaccauacucacuugcacgcgggaagcaccaagagcgcgccgggcgccgguccgggagggcaccuucacccccaucaccaccaccacccccaccaccaccaucaucaccacgcugccgcacaccaccaccaucaccaccacccaccccagccgccgccgccgccgcccccgccgccgccgcacaugguacacuauuuccaucagcaaccgccuacugcuccgcagccgccuccgcaccucccgucacagcccccgcagcaaccgccccagcagucgcagccucagcagccgucucaccccggcaagaugcaggaggcggcggccguggcggcggcggcggcggcggccgcggcagccgcggugggcagcgugggacgccugucucaguucccacccuacgggcugggcucggccgccgccgcugccgccgcggccgcggcguccacgucaggcuucaagcaccccuuugccauugagaacauuauuggccgggacuacaagggcgugcugcaggcuggagggcugcccuuggcguccgucaugcaccaccugggcuaccccgugcccggccagcuuggcaacgucgucagcuccguguggccgcacguuggcgucauggauucgguggccgccgccgcggccgccgcagccgcagccggagucccuguaggcccggaguauggggccuucggggucccggucaagucccugugccacucggcaagccagagccugccugccaugccggugcccaucaagcccacgccugcgcugccgcccguguccgcgcugcagccggggcucacuguccccgcggcuucgcagcagccuccggcgccauccaccgugugcuccgcggccgcggccucgcccguugccucucugcuggagcccacagccccuaccucggccgaaagcaagggcggcuccuugcacucggugcuagugcacuccuaggggacccggcgggcguggggagaccagcggggugagagacgccgggcccggaaccgcccaaaccacccgacggggagagggcgcccuggucaggccgggcagagcuggcgagucucagccuuugcuggaacggaagguauuuaaauagacgaacaaccccgaaaaguggauucuccaguggucugaauaaauauaaccuuccuggugucuguguuuauacuauguuguacaaucagauuaaugaaagccaauuuucagguaagaguuucuauuguaauuaauauaaauccauaaguuauggggggagggaacgaaggagguuaggaaagccucauucgcugguaaauuggaagucgauucugacccuuauuccugggagcagaagcuggcagagcuaaaccucccgcgaagaauccaacagagagugacgcug

SEQ ID NO: 20939 - RNA, 649 nt, Homo sapiens
gcugacaacaguuucagcaaaaaucagaaggcgaggccagucuggcaaaacugugagaaucacaauaagaaaaaugaaaaggacagcugaacgccaaagcugguuucuuugauaucuguaugaucccaucguccuccucaucaucccccuucucaauugaccucaagguucuccccagacaaauuuuuauggaagaguccacuacgaggugaaccguuguauugaaucauugagggacacggaggaagauaaggaccucagagaccucccaacuucucucuucuucccgauuaaacacuugcaaugaagauacuucagcggaauccugcaugcugaacacccauuugcagguggcgccgcaguguucucagggcggagauuucuccccccaccccccccaaccccccgcccccgcccaauucauagacgcucaaaggcuggacaguuuuagugugaaagggagcuuucaggacucaccauuuuugcaguaauucccggggcagcacauagcgugacgcaugcagcguuuucggcgcuuccugcaggcgagacagauuugcacgccugcguccccuccgcgggugggacuagcgcaguacucaucagugccgcacuccucguccucugcgcacggguacggcugugggaa

SEQ ID NO: 20940 - RNA, 649 nt, Homo sapiens
uucccacagccguacccgugcgcagaggacgaggagugcggcacugaugaguacugcgcuagucccacccgcggaggggacgcaggcgugcaaaucugucucgccugcaggaagcgccgaaaacgcugcaugcgucacgcuaugugcugccccgggaauuacugcaaaaauggugaguccugaaagcucccuuucacacuaaaacuguccagccuuugagcgucuaugaauugggcgggggcgggggguugggggggguggggggagaaaucuccgcccugagaacacugcggcgccaccugcaaauggguguucagcaugcaggauuccgcugaaguaucuucauugcaaguguuuaaucgggaagaagagagaaguugggaggucucugagguccuuaucuuccuccgugucccucaaugauucaauacaacgguucaccucguaguggacucuuccauaaaaauuugucuggggagaaccuugaggucaauugagaagggggaugaugaggaggacgaugggaucauacagauaucaaagaaaccagcuuuggcguucagcuguccuuuucauuuuucuuauugugauucucacaguuuugccagacuggccucgccuucugauuuuugcugaaacuguugucagc

SEQ ID NO: 20941 - RNA, 1448 nt, Homo sapiens
cgcagcguucccaguauuuugucccaguguguaaaguacggagcgaaguugcaguuaaagugagagugaugcaggucguggugcaccacacccccguaccacccgaagggcaccagucugugaguggaccaagggaaguuguagccggagugguccuccacggaaagccagauguugaccacguggaaggucaggguggugagcggguggcacccgagcagugugacguucaucaugucgaagaagcccaaagaaaacaguucccagacgcucauauacugcguugccagcgcgaacgaggacgaguucugguggugcaccuuguggaaggugcgguacagccagggcaccuuguggugcagcaggugccacacgaagaacuccaugucgaagaguagcaggcagaacaggauguggugcagcagcaggagcagcucgggagcuucguggggcaggagggccgggcugcgggcccaaugcagcagcgucacggggaacacaaacaucacaugcugguagagggucugccccaggcaagguagcagcugcugcgcggauggcgagaagucaggguggaucuuguagcgccgcagggcgggcacccaggagcacaggauauccaggaccacgaagggcaggcaaaagcccacguauguggugauggagaagaugaccgggaagaagggcgacuguaggagggccucccagcuccucagguggucccagaggggcugcaggaacagcugcccggagcugcaaaggaccugggggucggagcaguuguggcagcucauugcgaggcugugcaaggcagcugaggcugcugcucgagucccaucgacuuuucacaggacucacggccccgccccgagugaugucagcugccuuuccaucccuuucccggcgaugcgaagcuugaauaagcuagcaacccggcagaguggcccuucauugcuguaaaugugcucaucuauagccgcaucuuaccggcuuuuagauaugcguguaugcaguggcacuucguacuuuucauguaaguucugauuuuucaguugacguacaauuaacacgggacacaauguacagaucuaccguguggaguuucuaugaguuuggcaacucaguucacgugugucaucacgggucucaaacuagaccguuuacauugccaccagaaagcgcuccuuugcaaucaaugcagaauuguuuguguuuuuuaaugcauacguauaacugcauccaugugcuuucauaaagacgcaagcauaaucgcauuuuaaaaacuguuuaaagcuacaugcggucuguagcucggguguuuucugagaacccgguugcggucuauccagcggcgaucgagaaacgagcccuuugcacagggaaccgcugguccccgaacgccggcggugaccgucagcucaggaaaucagacgggaaggguggccgga

SEQ ID NO: 20942 - RNA, 1448 nt, Homo sapiens
uccggccacccuucccgucugauuuccugagcugacggucaccgccggcguucggggaccagcgguucccugugcaaagggcucguuucucgaucgccgcuggauagaccgcaaccggguucucagaaaacacccgagcuacagaccgcauguagcuuuaaacaguuuuuaaaaugcgauuaugcuugcgucuuuaugaaagcacauggaugcaguuauacguaugcauuaaaaaacacaaacaauucugcauugauugcaaaggagcgcuuucugguggcaauguaaacggucuaguuugagacccgugaugacacacgugaacugaguugccaaacucauagaaacuccacacgguagaucuguacauugugucccguguuaauuguacgucaacugaaaaaucagaacuuacaugaaaaguacgaagugccacugcauacacgcauaucuaaaagccgguaagaugcggcuauagaugagcacauuuacagcaaugaagggccacucugccggguugcuagcuuauucaagcuucgcaucgccgggaaagggauggaaaggcagcugacaucacucggggcggggccgugaguccugugaaaagucgaugggacucgagcagcagccucagcugccuugcacagccucgcaaugagcugccacaacugcuccgacccccagguccuuugcagcuccgggcagcuguuccugcagccccucugggaccaccugaggagcugggaggcccuccuacagucgcccuucuucccggucaucuucuccaucaccacauacgugggcuuuugccugcccuucgugguccuggauauccugugcuccugggugcccgcccugcggcgcuacaagauccacccugacuucucgccauccgcgcagcagcugcuaccuugccuggggcagacccucuaccagcaugugauguuuguguuccccgugacgcugcugcauugggcccgcagcccggcccuccugccccacgaagcucccgagcugcuccugcugcugcaccacauccuguucugccugcuacucuucgacauggaguucuucguguggcaccugcugcaccacaaggugcccuggcuguaccgcaccuuccacaaggugcaccaccagaacucguccucguucgcgcuggcaacgcaguauaugagcgucugggaacuguuuucuuugggcuucuucgacaugaugaacgucacacugcucgggugccacccgcucaccacccugaccuuccacguggucaacaucuggcuuuccguggaggaccacuccggcuacaacuucccuugguccacucacagacuggugcccuucgggugguacggggguguggugcaccacgaccugcaucacucucacuuuaacugcaacuucgcuccguacuuuacacacugggacaaaauacugggaacgcugcg

SEQ ID NO: 20943 - RNA, 1116 nt, Homo sapiens
aaugcaaagaagagcucuaccauggaacugaccucgaggaauugucaugugcauuuuucccacucuagcagcugggagguguagcacuagaauuuaggucuccucaucuaaggucagaagaaaaaaagacaaaaccaaacgggaacauaacuaauaguuaccguuuacugaacacucauaugugccaaguccuuaauuugaauccucaccaacaaaggggccauuuuuccccucauuuuuucaaagaggaaacugaagcucagagaggcugcgcaucuagcccaaggucauacauuucaccagugaaggaguugagauuggaacacagagcuuucuccugguuuccggguuaaucgcggauuccuccugguuuucggaagccugauggaagcaccaggguggagggucaguucagggcccccccguuuccaggugccucguggucaggcugaucuccucgccucucugcagggcuaccagauccccaagggcuggagcgugauguauagcauccgggacacgcacgagacggcugcgguguaccgcagcccucccgaaggcuucgauccagagcgcuucggcgcagcgcgcgaagauucccggggcgccuccagccgcuuccauuacaucccguucggcggcggugcgcgcagcugccucggccaggagcuggcgcaagccgugcuccagcugcuagcuguggagcuagugcgcaccgcgcgcugggaacuggccacacccgccuuccccgccaugcagacggugcccaucgugcacccaguggacgggcugcggcucuuuuuccacccccucacgccuucgguugcggggaaugggcuaugccucugacaugcuugcgcucuaggacacggcuuggccgguggcuauggcgcgcacgcagcgccacccaucugccgcuccccauuguagcgucgcgcgcccacucuuucacucguucaacaaucuuucaacaaauguucgccaaacgcggaugugugccggacucgaggaaggaggagggcgagccaccgcugccgcgccagagaagcaucuaagcccaugggaagaugccuucugcgcuccgcgcccagaggaaggaaaaugucgugggccaag

SEQ ID NO: 20944 - RNA, 1116 nt, Homo sapiens
cuuggcccacgacauuuuccuuccucugggcgcggagcgcagaaggcaucuucccaugggcuuagaugcuucucuggcgcggcagcgguggcucgcccuccuccuuccucgaguccggcacacauccgcguuuggcgaacauuuguugaaagauuguugaacgagugaaagagugggcgcgcgacgcuacaauggggagcggcagauggguggcgcugcgugcgcgccauagccaccggccaagccguguccuagagcgcaagcaugucagaggcauagcccauuccccgcaaccgaaggcgugaggggguggaaaaagagccgcagcccguccacugggugcacgaugggcaccgucugcauggcggggaaggcggguguggccaguucccagcgcgcggugcgcacuagcuccacagcuagcagcuggagcacggcuugcgccagcuccuggccgaggcagcugcgcgcaccgccgccgaacgggauguaauggaagcggcuggaggcgccccgggaaucuucgcgcgcugcgccgaagcgcucuggaucgaagccuucgggagggcugcgguacaccgcagccgucucgugcgugucccggaugcuauacaucacgcuccagcccuuggggaucugguagcccugcagagaggcgaggagaucagccugaccacgaggcaccuggaaacgggggggcccugaacugacccuccacccuggugcuuccaucaggcuuccgaaaaccaggaggaauccgcgauuaacccggaaaccaggagaaagcucuguguuccaaucucaacuccuucacuggugaaauguaugaccuugggcuagaugcgcagccucucugagcuucaguuuccucuuugaaaaaaugaggggaaaaauggccccuuuguuggugaggauucaaauuaaggacuuggcacauaugaguguucaguaaacgguaacuauuaguuauguucccguuugguuuugucuuuuuuucuucugaccuuagaugaggagaccuaaauucuagugcuacaccucccagcugcuagagugggaaaaaugcacaugacaauuccucgaggucaguuccaugguagagcucuucuuugcauu

SEQ ID NO: 20945 - RNA, 1428 nt, Homo sapiens
gacuaugggcuuccccuucuuuggggaaaccuugcagaugguacugcagguaagggaggguggggcgggacaggcugcuuccccggagcccggcgcggcucugggcuucugcugaagucgggguaggcgcccccgggaggcaugcuauugcggcuaggagcagggcuggcgggagcgcggcgcuccccggcgcccccucaugcccacuucucuccuccgccuuccucccacagcggaggaaguuccugcagaugaagcgcaggaaauacggcuucaucuacaagacgcaucuguucgggcggcccaccguacgggugaugggcgcggacaaugugcggcgcaucuugcucggagagcaccggcuggugucgguccacuggccagcgucggugcgcaccauucugggaucuggcugccucucuaaccugcacgacuccucgcacaagcagcgcaagaaggugggggcaggaggcgacggcuggacagggagggggaccccauuuaugagcggaauuccggcugauggaugcuaggcgcgggcuagcagcuugaggugggcuaggacccucugccagcuccagguuagcuuucccagcucggagagugccaugugucuggcaggacugggggugucuggaaggggacggcgguagacgagaggggcggauggaggcuuuuaacgcuguccccuccucgggacucaggugauuaugcgggccuucagccgcgaggcacucgaaugcuacgugccggugaucaccgaggaagugggcagcagccuggagcaguggcugagcugcggcgagcgcggccuccuggucuaccccgaggugaagcgccucauguuccgaaucgccaugcgcauccuacugggcugcgaaccccaacuggcgggcgacggggacuccgagcagcagcuuguggaggccuucgaggaaaugacccgcaaucucuucucgcugcccaucgacgugcccuucagcgggcuguaccggguaagggcggcaaacgggcugcggacuaggggcgcgggaccugggcgucugcucaccgccgcgcgcucucugcgcucagggcaugaaggcgcggaaccucauucacgcgcgcaucgagcagaacauucgcgccaagaucugcgggcugcgggcauccgaggcgggccagggcugcaaagacgcgcugcagcuguugaucgagcacucgugggagaggggagagcggcuggacaugcaggugaguagcagcuucagaccaggcacugcggaguuugguccccuggcuuuccaagcgcuguuccuggggcccccaaagcgcgcgccuggggcccagcuuucuggagugggcggccggcucagacuacagcuauggaaucccgaaggaaggcugagacacccggucaggagagcugcggaaggggcugcggcggaa

SEQ ID NO: 20946 - RNA, 1428 nt, Homo sapiens
uuccgccgcagccccuuccgcagcucuccugaccgggugucucagccuuccuucgggauuccauagcuguagucugagccggccgcccacuccagaaagcugggccccaggcgcgcgcuuugggggccccaggaacagcgcuuggaaagccaggggaccaaacuccgcagugccuggucugaagcugcuacucaccugcauguccagccgcucuccccucucccacgagugcucgaucaacagcugcagcgcgucuuugcagcccuggcccgccucggaugcccgcagcccgcagaucuuggcgcgaauguucugcucgaugcgcgcgugaaugagguuccgcgccuucaugcccugagcgcagagagcgcgcggcggugagcagacgcccaggucccgcgccccuaguccgcagcccguuugccgcccuuacccgguacagcccgcugaagggcacgucgaugggcagcgagaagagauugcgggucauuuccucgaaggccuccacaagcugcugcucggaguccccgucgcccgccaguugggguucgcagcccaguaggaugcgcauggcgauucggaacaugaggcgcuucaccucgggguagaccaggaggccgcgcucgccgcagcucagccacugcuccaggcugcugcccacuuccucggugaucaccggcacguagcauucgagugccucgcggcugaaggcccgcauaaucaccugagucccgaggaggggacagcguuaaaagccuccauccgccccucucgucuaccgccguccccuuccagacacccccaguccugccagacacauggcacucuccgagcugggaaagcuaaccuggagcuggcagaggguccuagcccaccucaagcugcuagcccgcgccuagcauccaucagccggaauuccgcucauaaauggggucccccucccuguccagccgucgccuccugcccccaccuucuugcgcugcuugugcgaggagucgugcagguuagagaggcagccagaucccagaauggugcgcaccgacgcuggccaguggaccgacaccagccggugcucuccgagcaagaugcgccgcacauuguccgcgcccaucacccguacggugggccgcccgaacagaugcgucuuguagaugaagccguauuuccugcgcuucaucugcaggaacuuccuccgcugugggaggaaggcggaggagagaagugggcaugagggggcgccggggagcgccgcgcucccgccagcccugcuccuagccgcaauagcaugccucccgggggcgccuaccccgacuucagcagaagcccagagccgcgccgggcuccggggaagcagccugucccgccccacccucccuuaccugcaguaccaucugcaagguuuccccaaagaaggggaagcccauaguc

SEQ ID NO: 20947 - RNA, 933 nt, Homo sapiens
ucuacaaguccucaacaucacuccccuccacaucugauuuucacagcuuaguggaaagggaagaggccacagccacagcacacugugccuggcucagaaucucagcaucagcaggccaggcacuugggaggcauccaccccuaugcacaguguucccuccguccuuggauagggcucucucggccucugugggagccccagauagucaagcugucucagggauucagcccaaagagacggaggaaaugcagagcuagguggaguggugaugugaaagacaggaggagaaagcauggagaaagcacacaccuuggcacaguggcugguggggaaaaugacaccugacaaaccgaaagguccuuuugagcuuaggccagguuucuugagcugagguuuggggaggggguagguagcugcucccaaucuuguuccccuaaccucagguggugcugcggguuccugacacuuccagaccuuuccgcaggccauucuuccuaaggguagguaccucuggagaagaaacccagcgauuuggcccgguaggcgccccauucccaagacagucccacagagcugacuacucacuuccuuucuggagaaaggaggcuacgccccaguacuucaucuugaacuuggcaggguccucggugucugugaaggugcccaccaugucugcgcacacgucccaguuacugcaaaagccaaggggauccucagccaagccgggcaaagggcuuccucccucccuccacccauucggugcucccuucccuucacaaugcccacguggcgaucagcaggcagggcccuuggggaacccuggagcgcaaagggcgcagcugccccggcggccacugacuucaaaagacggacucggcccuuggcuguggcgcucaucuggccggucucguccacggagaacuccgcgacgau

SEQ ID NO: 20948 - RNA, 933 nt, Homo sapiens
aucgucgcggaguucuccguggacgagaccggccagaugagcgccacagccaagggccgaguccgucuuuugaagucaguggccgccggggcagcugcgcccuuugcgcuccaggguuccccaagggcccugccugcugaucgccacgugggcauugugaagggaagggagcaccgaauggguggagggagggaggaagcccuuugcccggcuuggcugaggauccccuuggcuuuugcaguaacugggacgugugcgcagacauggugggcaccuucacagacaccgaggacccugccaaguucaagaugaaguacuggggcguagccuccuuucuccagaaaggaagugaguagucagcucugugggacugucuugggaauggggcgccuaccgggccaaaucgcuggguuucuucuccagagguaccuacccuuaggaagaauggccugcggaaaggucuggaagugucaggaacccgcagcaccaccugagguuaggggaacaagauugggagcagcuaccuacccccuccccaaaccucagcucaagaaaccuggccuaagcucaaaaggaccuuucgguuugucaggugucauuuuccccaccagccacugugccaaggugugugcuuucuccaugcuuucuccuccugucuuucacaucaccacuccaccuagcucugcauuuccuccgucucuuugggcugaaucccugagacagcuugacuaucuggggcucccacagaggccgagagagcccuauccaaggacggagggaacacugugcauagggguggaugccucccaagugccuggccugcugaugcugagauucugagccaggcacagugugcuguggcuguggccucuucccuuuccacuaagcugugaaaaucagauguggaggggagugauguugaggacuuguaga

SEQ ID NO: 20949 - RNA, 1319 nt, Homo sapiens
uggggaaacugaggcucagugaagucaagcaacuugccuaagggcuucucuucaggggcagagccuaaucugcucuuccuuccgcacugagccuuacccgaaugacucccagccaggggaacuggggaagaggguggagaucuuaggguuccagguacagaaaacggggacgcagaucauaguccagaacauucuuaguccccagucuuucuccacaucccuucccucaccucuccucucuucccaaggucccaacacggaguggggaugaugcuugcuuuggugccucgggauccaggugaaaggcauuguuuaacgaccccaggcauucuugggcugagaggggucauaaggcauuuaucaggacgucccaggauuggggggacggcauugggggauucucagcagcuugguuggauggguacugagaggggugccagggguuuccagggaacgagagccagagggaaggucuggagccgccgggaggcacuaugcugccacucccuggggaggugggaaggcgggaaggcugcgggggauaauuccggggacgcugggcugagcuaggacagcgugugugugugugugugggcggagggggggagcugcaccucuugggggguucgcagagcugugcuaggggagcugcagggccgucggagcgcgcggggacggcggcggcggcgcuaccuggaggcgcgguggcgggcaggugcccgaacugcacggcgaugcagaggucguuguccagggggaacuuguggcagugcagcaucucaggccaggggaagccguaggccuccaugagcggcgcgcagccggcgcgcacggccucgcacagcgagcggcacggguagaugggccggucgagacagacgggcgcaaagagcgagcacaggaagaccugcguauccgaguggcagcgcuuggccagcagcggcagccagcugcucgccugcugcuucacuucggccaggcucucgugcuccagcagguugggcagccgcaugcgcuuguagcccaccguguggcagagcggcaggucggcagggaugucaaggcacugcggcggcuuggaguaggagcggccgugcagcggcucggccugccagccauaguagucguacuccucgcagcgcgccggcgcccagugcagcgcccccagcagcagcgccagcgcggccguccgcacgcccccccccgccgccgccgcccgcauggcugcgcccucuccaggugcgcgccgcgcagccccccgacgcucggugcccggcggcccagguguuccggcgugcgcccccggcccugacucuacc

SEQ ID NO: 20950 - RNA, 1319 nt, Homo sapiens
gguagagucagggccgggggcgcacgccggaacaccugggccgccgggcaccgagcgucggggggcugcgcggcgcgcaccuggagagggcgcagccaugcgggcggcggcggcgggggggggcgugcggacggccgcgcuggcgcugcugcugggggcgcugcacugggcgccggcgcgcugcgaggaguacgacuacuauggcuggcaggccgagccgcugcacggccgcuccuacuccaagccgccgcagugccuugacaucccugccgaccugccgcucugccacacggugggcuacaagcgcaugcggcugcccaaccugcuggagcacgagagccuggccgaagugaagcagcaggcgagcagcuggcugccgcugcuggccaagcgcugccacucggauacgcaggucuuccugugcucgcucuuugcgcccgucugucucgaccggcccaucuacccgugccgcucgcugugcgaggccgugcgcgccggcugcgcgccgcucauggaggccuacggcuuccccuggccugagaugcugcacugccacaaguucccccuggacaacgaccucugcaucgccgugcaguucgggcaccugcccgccaccgcgccuccagguagcgccgccgccgccguccccgcgcgcuccgacggcccugcagcuccccuagcacagcucugcgaaccccccaagaggugcagcucccccccuccgcccacacacacacacacacgcuguccuagcucagcccagcguccccggaauuaucccccgcagccuucccgccuucccaccuccccagggaguggcagcauagugccucccggcggcuccagaccuucccucuggcucucguucccuggaaaccccuggcaccccucucaguacccauccaaccaagcugcugagaaucccccaaugccguccccccaauccugggacguccugauaaaugccuuaugaccccucucagcccaagaaugccuggggucguuaaacaaugccuuucaccuggaucccgaggcaccaaagcaagcaucauccccacuccguguugggaccuugggaagagaggagaggugagggaagggauguggagaaagacuggggacuaagaauguucuggacuaugaucugcguccccguuuucuguaccuggaacccuaagaucuccacccucuuccccaguuccccuggcugggagucauucggguaaggcucagugcggaaggaagagcagauuaggcucugccccugaagagaagcccuuaggcaaguugcuugacuucacugagccucaguuucccca

SEQ ID NO: 20951 - RNA, 2809 nt, Homo sapiens
ugcggcugcugccagggauacaagggcaaaagcaaccccgggacacugcccucauggagcuuacagucuaacuggggcgaccaggcaggcacauacagcuauagaauuaagugggaagugauaagugacaugcauguccuuugcuaacacaagcugcagguucagagccugaaagaggggacuuccggcuagacgaucuaggagcucuuccuuggagaacaguuuccacucguggaggcuaagugucagaaacauguuccaaguggagagaaagcuugagcaaaggcaacaaguugaaaaaggacaugucgcccacccauagauagauaaaacacugcaucuccucguggauccagcgcccaguauuuacccgccaggaaguuuuccugccccgcgcagcagcugaaaaaaacacacuccuggggcauccuucccuggcguugguucguggacagcaagccucccagaacuggccuaggucgggaaggugcagccacgcgggaaucaaugguucaggaaccggaucugugcagccucgcccgcagcgucucggacuucaggacucuauacuaguccuugucuauuucugguagagccgcaacaucccacucgcagagagcagggggcguggcccacaugagccagaaccuauagggagggagguuggggcgccagccccgcccccccaacgugacgcaaaucucccggacagaggcuuaggagcccgggccccagucccugcaguggcuguaacaaaacccagacccccaggucccggccaauggaggcgauuuagacuggagugggaccgcgucugucaaaagcccgacucggcagcagcggcggaguccaggaggagagcuggagccgccgcgcugccuccccgcccccgccgggauuuauuauuuggacuggacaauuaaguggcccugaugauguuaccaagcccggucaccuccaccccuuucucagucaaagacauuuugaaucuggagcagcagcaccagcacuuccauggugcgcacuugcaggcggacuuggagcaccacuuccacucugcgcccugcaugcuggccgccgcugaggggacgcaauuuucugacggaggggaggaggacgaggaagacgagggcgagaaauuguccuauuugaacucacuagccgcagcagacggccacggggauucagggcuguguccccagggcuauguccacacgguccugcgagacucgugcagcgagcccaaggaacaugaagaggagcccgaggucgugagggaccggagccaaagugaguagagggggaaagaaaacgcacccgcacaccuggagcaauggcagagcgcacacaaacagcccacagaccuugccagcgcagcugcccaucccuuuacccuuuggcuggggccaugccuccgcccuggucaccgacagcuccacaaagcgcagguaccugcaagggagccgggguggagagacaaggacgaggugacccugacaacuacuccccccaaaagggggaaaugagggaagggaaggugguuacugcugcccugaugcugagaggcgacgugggcucagcgccuggguccucauaacuggcaguauuuuugcucuuccccccgccccaaaaggcucuucccccaaaaagggcaggagccuggaccuuuuucguuuucccucuagggugagaugaguucucuuagcccagggcagccaccccuucuucuccgaaaagacagcccaagcagccugugucucucgcacccgcaggggcaggaacuuugguggaggccagcugggcgguuuccucccuucucugcuuggagcucagcguccuugaacccguggcacucgguagagagagaggagaugaucggaaagugcgugggaacaaugucuauuccgcgcgaccauagcucucacaucccuaaggcgccagccuuuuuugaaaauccguaacguuuugcuuugugucccaggcugcgggccuaauagaaaacgcgccgaacuugaguccgagaucuuggcugcucacaucggaugggaagugaauugauagggagaugggauaaucaaauaaaguccccaaggaaguguauuuaagaggacagaaucacagucuuuccccaagaggcgguuugauguggcagaggccaaggccuaugcucucauaguucccagagccgaaaaucggcaugaaacugucuauaacuagucaaucaaacuucauuuucaaagugcacacagaugucgucauaacauucgcuuguagucuuuuauaagccacacacacacacaagucccugagccaugcacaagcguuacacucagaacagauuuucgcgcaacccaugcccaccggcccacucauaccaacacgccucacaccuucaguuauccuugguggaguagaaugcaaacgaguuugcaaauacuguaguuauuauguaguugcaagccuucauccugaaaauagucauuagcacgucgagccgcauauuuaauacagaguaaucucuucucucgcagaugcucaagauccaaauaaacacgcacuaacuaccccucuccacgaaacgcgccuccgccugcuaagggcguucuuuggguacuggggcugucucagggucccacagcgccaggagccacaaacguucccaaaaguccagccauuuacuaccgcacgcucugcgcagccaccaaaaagggucacggugcuccaggacaggagccgcggugcggccgggaacagcuaaggacgcuguuguuugcuucuuccgcagaaagcugccagcugaagaagucuc

SEQ ID NO: 20952 - RNA, 2809 nt, Homo sapiens
gagacuucuucagcuggcagcuuucugcggaagaagcaaacaacagcguccuuagcuguucccggccgcaccgcggcuccuguccuggagcaccgugacccuuuuugguggcugcgcagagcgugcgguaguaaauggcuggacuuuugggaacguuuguggcuccuggcgcugugggacccugagacagccccaguacccaaagaacgcccuuagcaggcggaggcgcguuucguggagagggguaguuagugcguguuuauuuggaucuugagcaucugcgagagaagagauuacucuguauuaaauaugcggcucgacgugcuaaugacuauuuucaggaugaaggcuugcaacuacauaauaacuacaguauuugcaaacucguuugcauucuacuccaccaaggauaacugaaggugugaggcguguugguaugagugggccggugggcauggguugcgcgaaaaucuguucugaguguaacgcuugugcauggcucagggacuuguguguguguguggcuuauaaaagacuacaagcgaauguuaugacgacaucugugugcacuuugaaaaugaaguuugauugacuaguuauagacaguuucaugccgauuuucggcucugggaacuaugagagcauaggccuuggccucugccacaucaaaccgccucuuggggaaagacugugauucuguccucuuaaauacacuuccuuggggacuuuauuugauuaucccaucucccuaucaauucacuucccauccgaugugagcagccaagaucucggacucaaguucggcgcguuuucuauuaggcccgcagccugggacacaaagcaaaacguuacggauuuucaaaaaaggcuggcgccuuagggaugugagagcuauggucgcgcggaauagacauuguucccacgcacuuuccgaucaucuccucucucucuaccgagugccacggguucaaggacgcugagcuccaagcagagaagggaggaaaccgcccagcuggccuccaccaaaguuccugccccugcgggugcgagagacacaggcugcuugggcugucuuuucggagaagaagggguggcugcccugggcuaagagaacucaucucacccuagagggaaaacgaaaaagguccaggcuccugcccuuuuugggggaagagccuuuuggggcggggggaagagcaaaaauacugccaguuaugaggacccaggcgcugagcccacgucgccucucagcaucagggcagcaguaaccaccuucccuucccucauuucccccuuuuggggggaguaguugucagggucaccucguccuugucucuccaccccggcucccuugcagguaccugcgcuuuguggagcugucggugaccagggcggaggcauggccccagccaaaggguaaagggaugggcagcugcgcuggcaaggucugugggcuguuugugugcgcucugccauugcuccaggugugcgggugcguuuucuuucccccucuacucacuuuggcuccggucccucacgaccucgggcuccucuucauguuccuugggcucgcugcacgagucucgcaggaccguguggacauagcccuggggacacagcccugaauccccguggccgucugcugcggcuagugaguucaaauaggacaauuucucgcccucgucuuccucguccuccuccccuccgucagaaaauugcguccccucagcggcggccagcaugcagggcgcagaguggaaguggugcuccaaguccgccugcaagugcgcaccauggaagugcuggugcugcugcuccagauucaaaaugucuuugacugagaaagggguggaggugaccgggcuugguaacaucaucagggccacuuaauuguccaguccaaauaauaaaucccggcgggggcggggaggcagcgcggcggcuccagcucuccuccuggacuccgccgcugcugccgagucgggcuuuugacagacgcggucccacuccagucuaaaucgccuccauuggccgggaccugggggucuggguuuuguuacagccacugcagggacuggggcccgggcuccuaagccucuguccgggagauuugcgucacguugggggggcggggcuggcgccccaaccucccucccuauagguucuggcucaugugggccacgcccccugcucucugcgagugggauguugcggcucuaccagaaauagacaaggacuaguauagaguccugaaguccgagacgcugcgggcgaggcugcacagauccgguuccugaaccauugauucccgcguggcugcaccuucccgaccuaggccaguucugggaggcuugcuguccacgaaccaacgccagggaaggaugccccaggaguguguuuuuuucagcugcugcgcggggcaggaaaacuuccuggcggguaaauacugggcgcuggauccacgaggagaugcaguguuuuaucuaucuaugggugggcgacauguccuuuuucaacuuguugccuuugcucaagcuuucucuccacuuggaacauguuucugacacuuagccuccacgaguggaaacuguucuccaaggaagagcuccuagaucgucuagccggaaguccccucuuucaggcucugaaccugcagcuuguguuagcaaaggacaugcaugucacuuaucacuucccacuuaauucuauagcuguaugugccugccuggucgccccaguuagacuguaagcuccaugagggcagugucccgggguugcuuuugcccuuguaucccuggcagcagccgca

SEQ ID NO: 20953 - RNA, 1099 nt, Homo sapiens
uuuuagaaaucaaucaguccucagccucucugccggcaguagcucuccgcacuugccaccccacagggagccgggagcccugccccagccgccuggguuccccagggaauggagcagggagagcccccuuccaagcccaguuuccacguguaaauugacccauccgauuaaaguauuuaaggguucccagcaaccuccuuuuccaacugggagaguugaggggauuucucucccuucucuuucccacucuccuuuugugggcccuggcgacauauccucuuucaagcgcuugccuuaaaccuaggcccccucccccugaacccccugccuccaccugcagcuggggaggaguguaugaaggggggagguguaaagggagauuccuagauucauucauuugcugggcagggaagggggcaccuguggccaaguacuccccgaggccccuucccuagcccucucuuccccagcugacccucaagacaccuuucugccuuaacuccuucccuucugagcuggggacccugcaggcccccggccagugcaguugggacuggugguccaggcgccgcgcaucccacaagcuaccuucagcgcgccuuaccgaaggggucgccguccucugccauggcguugaugcgcuuguuggccaggaccugcacgugcuucccgcuggugcggcuguagaguugguagguccggaugaggcggcggcugagcugauccgucaccaggcucugcucccucacaugcuguguaaaauuaggugaggacugaacaguuaccuuuaggaaauugaaaaauacacaauacaccauuauaaugcuacuccgcccaggggcccgaguggccccaucacccugcgucccccucacugccccaagccgccagcaggugcuggggguucccccaacaugccagcccaggccaccaucccccacccacgcaagucgggcagacccagcccaggaugaacgagccccagggagaagcuggacccaccuguugggagacacccuggggcucccggccagcccggaacagggaagcgagcucccugcccagcgcagggccccugcccgggccuuccuagaggagc

SEQ ID NO: 20954 - RNA, 1099 nt, Homo sapiens
gcuccucuaggaaggcccgggcaggggcccugcgcugggcagggagcucgcuucccuguuccgggcuggccgggagccccagggugucucccaacagguggguccagcuucucccuggggcucguucauccugggcugggucugcccgacuugcgugggugggggaugguggccugggcuggcauguugggggaacccccagcaccugcuggcggcuuggggcagugagggggacgcagggugauggggccacucgggccccugggcggaguagcauuauaaugguguauuguguauuuuucaauuuccuaaagguaacuguucaguccucaccuaauuuuacacagcaugugagggagcagagccuggugacggaucagcucagccgccgccucauccggaccuaccaacucuacagccgcaccagcgggaagcacgugcagguccuggccaacaagcgcaucaacgccauggcagaggacggcgaccccuucgguaaggcgcgcugaagguagcuugugggaugcgcggcgccuggaccaccagucccaacugcacuggccgggggccugcaggguccccagcucagaagggaaggaguuaaggcagaaaggugucuugagggucagcuggggaagagagggcuagggaaggggccucggggaguacuuggccacaggugcccccuucccugcccagcaaaugaaugaaucuaggaaucucccuuuacaccuccccccuucauacacuccuccccagcugcagguggaggcaggggguucagggggagggggccuagguuuaaggcaagcgcuugaaagaggauaugucgccagggcccacaaaaggagagugggaaagagaagggagagaaauccccucaacucucccaguuggaaaaggagguugcugggaacccuuaaauacuuuaaucggaugggucaauuuacacguggaaacugggcuuggaagggggcucucccugcuccauucccuggggaacccaggcggcuggggcagggcucccggcucccugugggguggcaagugcggagagcuacugccggcagagaggcugaggacugauugauuucuaaaa

SEQ ID NO: 20955 - RNA, 1119 nt, Homo sapiens
guaaccaacaccgagacgaauagcgagggcucggggagaaaaaacggaggauggcaaacggcaaagccaagggcacgagguagcgcagcgcgcacccagaggcuccugggacggacaccaccccacgcucacggguccucuggcgguguccuuugagcugccgggacggcgcaagguggcugagcgaagcuuuuugcucggugcuuacagggaguaccugagaugguuugggaaaggaaacagggggucucagaccgcuugggugcagcgcucuccccaugcguuugagugcagaucugucgagacgccccagcccucgccaccccaccaagcucucagguagagaggccccgggacagggugagccccauaguccuuuggugggcauaacacagagggaggagcaauuguuuacacaugugcccaguacaagaagggaaacugauauuuaagacugaaguggggaaacgggagggaaaggagcccuuauccuggauguuagacgcuauuaaggaccaugcuauuuuguauuugugagaaugauauugaagguaaggagguccuuauccuugaagaugcaugcugaaguguacagaagugaaaugucacgaugucugcaguuuucaaaugaugcagcuaacauacgcacacauuaugagagagagaacagaaaggaagcaaguauugcaauauguuaacaguuguugcauccuguugggggugggggguaaacagacguucguuguaccguucuuucaacuugccuaaauauuugcaaaaugccauaaugaaaauuuuggaagaguucccuuauaaaauagugccugaaugcuaagaaaaugaacgcggcuucuuuuccuuucccugucccgggugggacaaaucugcgagcaagcagggcucaaggccagcggggucuggacgggaagagcaauggguagagccggccugcagcugccauagcccugggcaggccaggaggggccaucggagccucggggcagauaggcugccgggcgcaaaacuaugcggaggagcagccgagcgcguuggccccgggggcggugcgggguggggacuuccuggcggcucucagcaaccccugguccgaccagacuc

SEQ ID NO: 20956 - RNA, 1119 nt, Homo sapiens
gagucuggucggaccagggguugcugagagccgccaggaaguccccaccccgcaccgcccccggggccaacgcgcucggcugcuccuccgcauaguuuugcgcccggcagccuaucugccccgaggcuccgauggccccuccuggccugcccagggcuauggcagcugcaggccggcucuacccauugcucuucccguccagaccccgcuggccuugagcccugcuugcucgcagauuugucccacccgggacagggaaaggaaaagaagccgcguucauuuucuuagcauucaggcacuauuuuauaagggaacucuuccaaaauuuucauuauggcauuuugcaaauauuuaggcaaguugaaagaacgguacaacgaacgucuguuuaccccccacccccaacaggaugcaacaacuguuaacauauugcaauacuugcuuccuuucuguucucucucucauaaugugugcguauguuagcugcaucauuugaaaacugcagacaucgugacauuucacuucuguacacuucagcaugcaucuucaaggauaaggaccuccuuaccuucaauaucauucucacaaauacaaaauagcaugguccuuaauagcgucuaacauccaggauaagggcuccuuucccucccguuuccccacuucagucuuaaauaucaguuucccuucuuguacugggcacauguguaaacaauugcuccucccucuguguuaugcccaccaaaggacuauggggcucacccugucccggggccucucuaccugagagcuuggugggguggcgagggcuggggcgucucgacagaucugcacucaaacgcauggggagagcgcugcacccaagcggucugagacccccuguuuccuuucccaaaccaucucagguacucccuguaagcaccgagcaaaaagcuucgcucagccaccuugcgccgucccggcagcucaaaggacaccgccagaggacccgugagcguggggugguguccgucccaggagccucugggugcgcgcugcgcuaccucgugcccuuggcuuugccguuugccauccuccguuuuuucuccccgagcccucgcuauucgucucgguguugguuac

SEQ ID NO: 20957 - RNA, 2432 nt, Homo sapiens
ugcaauccauagggauuuuugacucaguuaaguuuguguaacaaagguuguaugguuccauaaacuacaucuuuauuuuaaagaaaggaaacaaaauccaacaauaaagccuuaacacagaagcaauacuuaccaguaccggaauuuugaaccuaauguaaaauaaugugcaaaaaaauucuuuugagguggaaguggucuguccaaacggaagaaugugugauguucuacacaugcuuuccacaaauuuuuacaugcucuguaauucaccauauuaaaucccaauaauguuucucuagauucaugcuguaauaaaugacaaaaugcagagaauaccaggaaaaugucaggaucuaaugcuccauuuaauuuacuuuugacagauaaauuauucuagccuuguaaacaugaacuuguuaaugauauagauagaaccuaugggaucuuuuaucuaggaucuuuuuugcuuauccaauaaaaaggcaaugaaguauaugcaaaagccugaaaaaucuggaccuaacucagucuuuuuuuuuuuuuuuuuuuuugagacacagucucacucugucauccaugcuggagugcaguggcacgaucuuggcucacugcaaccuccaccucauggguucaagugauucuugugccucagccucccgagcagcaggaauuaaaggcaugcaccaccacacccagcuaacuuuuucuauguuuaguagagacgggguuucaccaugguggccaggcuggucuugaacuccugaccucaagugaucuaccugccuuggccucacaaagugcugggauuauaucaugagcccccgugcuggccuuguucauucauauuauaacucuuaggaacuuuaaccuuagaucauaguuagaaaugaguucaaacuuuuaauauguaucuguuuucaacauuagcuaugacucuguuucaaaauauaauucuaggccauaaauuaaauguuaaaauauaucaucacaacuuuuaacaauauuccuaauuuaaaauaucugucuagauuguaaauaaagaacauucagcagcucugaacacuauuacauaauucaaaauuuaaaauuagcacuaaaauaauuuuccauuuucuugaaaacugguacaaauuucuaaauaaauaauuuccuuaaaguaaaccacauauagcaacauucacaucccauaauugcacagcucugauuuucacacaauaaauacaaccauguaaccuuuacccaguuccagaaauggaucauuacuaccaccacagaaguauccuuugucuccccuuucuaccagauuaccuucccaaaguuaaucacucuucugccuuuaucaccauagaauagucaugcuuguuuuugaacuuuauuguacauacauggaaucaaacauaugugucuuuaggucuggcuuuuguucagcauuauguuucugauauaaauucaacguuuaugaagcaguaauucacuaauuuccauaguacucuauuauaaugaauuuaacaguuaacuuauccacuuuacuguucacagacauuuuauauuucuaguuuggggauauaagaagaaugcagccaugcauauuccuguauguucucugguguacacauaugcacauuuuuguuguugggucauauguuguacacauaugcucagcuuugguagauaaugcccaacaguuuuccaaaauggguagaucaauauacaaucccucccaccaguagcauaugugccauauauucaccaaccacugguuuaucaaucucuuuccccuuacuauucuguuguguauguagagguagcacauuuugguuauaaucugaaccuccuuuauaauuauugagguucaauguuaauggccacguggauauccucauuugugaagugucuguucaauucacuggcauauauuucuaucaggaugcauauacaaccaaggauucuguguguauuauauaauggucuauacuauuucacucucuuagugauaucuuuugaugaacagaguuauuaauuuuaacauaguccaaaucaucaaucuuuuaaggguaugaagguuuccuucuauguccgguuaaagaaauucuugcccaucaaaaggucauuaagauauuuccugugacuaauacacaaauaaaugcccauguauaaaguauuaaacuaucauauuagaagggaauaugcuuaaaacaucacuucuugauugccagaaaauugucuuaauuaugguuaauaguuguuuuguuugcacuaacauauauaguucauauguuuuaccauaugccacaaacauuacacaaaauaacagaaaaugucucagcuacuaugaugcacugaagcuucucacugucagcaucuaagaugcauacauauucacccauuuugacacuugguauacuuuucaaaaagucuauaaguaauuucca

SEQ ID NO: 20958 - RNA, 2432 nt, Homo sapiens
uggaaauuacuuauagacuuuuugaaaaguauaccaagugucaaaaugggugaauauguaugcaucuuagaugcugacagugagaagcuucagugcaucauaguagcugagacauuuucuguuauuuuguguaauguuuguggcauaugguaaaacauaugaacuauauauguuagugcaaacaaaacaacuauuaaccauaauuaagacaauuuucuggcaaucaagaagugauguuuuaagcauauucccuucuaauaugauaguuuaauacuuuauacaugggcauuuauuuguguauuagucacaggaaauaucuuaaugaccuuuugaugggcaagaauuucuuuaaccggacauagaaggaaaccuucauacccuuaaaagauugaugauuuggacuauguuaaaauuaauaacucuguucaucaaaagauaucacuaagagagugaaauaguauagaccauuauauaauacacacagaauccuugguuguauaugcauccugauagaaauauaugccagugaauugaacagacacuucacaaaugaggauauccacguggccauuaacauugaaccucaauaauuauaaaggagguucagauuauaaccaaaaugugcuaccucuacauacacaacagaauaguaaggggaaagagauugauaaaccagugguuggugaauauauggcacauaugcuacuggugggagggauuguauauugaucuacccauuuuggaaaacuguugggcauuaucuaccaaagcugagcauauguguacaacauaugacccaacaacaaaaaugugcauauguguacaccagagaacauacaggaauaugcauggcugcauucuucuuauauccccaaacuagaaauauaaaaugucugugaacaguaaaguggauaaguuaacuguuaaauucauuauaauagaguacuauggaaauuagugaauuacugcuucauaaacguugaauuuauaucagaaacauaaugcugaacaaaagccagaccuaaagacacauauguuugauuccauguauguacaauaaaguucaaaaacaagcaugacuauucuauggugauaaaggcagaagagugauuaacuuugggaagguaaucugguagaaaggggagacaaaggauacuucuguggugguaguaaugauccauuucuggaacuggguaaagguuacaugguuguauuuauugugugaaaaucagagcugugcaauuaugggaugugaauguugcuauaugugguuuacuuuaaggaaauuauuuauuuagaaauuuguaccaguuuucaagaaaauggaaaauuauuuuagugcuaauuuuaaauuuugaauuauguaauaguguucagagcugcugaauguucuuuauuuacaaucuagacagauauuuuaaauuaggaauauuguuaaaaguugugaugauauauuuuaacauuuaauuuauggccuagaauuauauuuugaaacagagucauagcuaauguugaaaacagauacauauuaaaaguuugaacucauuucuaacuaugaucuaagguuaaaguuccuaagaguuauaauaugaaugaacaaggccagcacgggggcucaugauauaaucccagcacuuugugaggccaaggcagguagaucacuugaggucaggaguucaagaccagccuggccaccauggugaaaccccgucucuacuaaacauagaaaaaguuagcugggugugguggugcaugccuuuaauuccugcugcucgggaggcugaggcacaagaaucacuugaacccaugagguggagguugcagugagccaagaucgugccacugcacuccagcauggaugacagagugagacugugucucaaaaaaaaaaaaaaaaaaaaagacugaguuagguccagauuuuucaggcuuuugcauauacuucauugccuuuuuauuggauaagcaaaaaagauccuagauaaaagaucccauagguucuaucuauaucauuaacaaguucauguuuacaaggcuagaauaauuuaucugucaaaaguaaauuaaauggagcauuagauccugacauuuuccugguauucucugcauuuugucauuuauuacagcaugaaucuagagaaacauuauugggauuuaauauggugaauuacagagcauguaaaaauuuguggaaagcauguguagaacaucacacauucuuccguuuggacagaccacuuccaccucaaaagaauuuuuuugcacauuauuuuacauuagguucaaaauuccgguacugguaaguauugcuucuguguuaaggcuuuauuguuggauuuuguuuccuuucuuuaaaauaaagauguaguuuauggaaccauacaaccuuuguuacacaaacuuaacugagucaaaaaucccuauggauugca

SEQ ID NO: 20959 - RNA, 211 nt, Homo sapiens
uccuagugagccuggggccccaucuagugccauaccccacuuugaugguccuguuaaugcccucccacauuguaguuaggguuuagcugagaagugggguauaaggcagacccccugugcugaggauugauccacauugaucccucaggucuugggggccugggaggaagcagauuccuuuaccacaguacguaugcaaaaaauguuuucc

SEQ ID NO: 20960 - RNA, 211 nt, Homo sapiens
ggaaaacauuuuuugcauacguacugugguaaaggaaucugcuuccucccaggcccccaagaccugagggaucaauguggaucaauccucagcacagggggucugccuuauaccccacuucucagcuaaacccuaacuacaaugugggagggcauuaacaggaccaucaaagugggguauggcacuagauggggccccaggcucacuagga

SEQ ID NO: 20961 - RNA, 68 nt, Homo sapiens
ugacuagcacaguccucagaacauaguaaaaaucucagucaaaauuagcuuccaugaagaacaguugu

SEQ ID NO: 20962 - RNA, 68 nt, Homo sapiens
acaacuguucuucauggaagcuaauuuugacugagauuuuuacuauguucugaggacugugcuaguca

SEQ ID NO: 20963 - RNA, 132 nt, Homo sapiens
guugccaauccccuggcuagacggggaauucucgggccaggauugccuuguauucacuaaugcaggggacuaagcuccagcauguuggagcccagaaagcacuuuccagaaaaagauucuuuagaacaucca

SEQ ID NO: 20964 - RNA, 132 nt, Homo sapiens
uggauguucuaaagaaucuuuuucuggaaagugcuuucugggcuccaacaugcuggagcuuaguccccugcauuagugaauacaaggcaauccuggcccgagaauuccccgucuagccaggggauuggcaac

SEQ ID NO: 20965 - RNA, 185 nt, Homo sapiens
aacauucagauaucaaaugcacacuuggcuagcuaaucugucuuaacuaggaucaaauguaugaaacugucuucacacuggcagcugagccaaaaacgaauauuuggcaugcuuaaaacaaccguugccugcuuuuguuuuugaaggcuguauauuucagcagaaagagagcuggacuuggggca

SEQ ID NO: 20966 - RNA, 185 nt, Homo sapiens
ugccccaaguccagcucucuuucugcugaaauauacagccuucaaaaacaaaagcaggcaacgguuguuuuaagcaugccaaauauucguuuuuggcucagcugccagugugaagacaguuucauacauuugauccuaguuaagacagauuagcuagccaagugugcauuugauaucugaauguu

SEQ ID NO: 20967 - RNA, 4281 nt, Homo sapiens
caauaaucacuuuuucuauagaaacagucuuuguguugagacgugaagaaugaaauggaaauugacuaagcagagaaguaaaaggucagagcaugguaccugugagaaucugaacaaaagucucaguggcucaagugcagaggguuugaaaaauaagaggggagguggagaaguaggccuggggaauguuagucuuuauccuaagaguagcaggaaauaaugcuauggaggagaaugacaugacuggauuuguguuuucauaggauacaguacccuagcuucaguguacagaacaaauuuaacaaggauauggagggcuacuauugugcugcaagggggagauaauccuacucagacuaagacagcagagaauauggauuugaaaauuauuaaaggaugucaaauagacaggccuuaguacaguaagaauuugggaagugagggagaggggguauuaggaauuacuccuaagucuuuaacuuggaaaacuggaauaaaaaaggugaugcuauucacugacaugugggacaccagaggauggcaugcggcaucagcgaguaguaacugaggccauugggauagauauaauugcugggucguagaaugaaaagaaauggaagccuaggacugagcuuucacaaaaucugacaucucuggacaacaaagguggcuggggugagguggcucaugccuguaauccgaggcuuuggaaggcugagguaggaucguuugaggucaggaguucaagacuggccuaggcaauuuuuuuuuuuuuuuuuuaauuagccagguaugguugacacguaaaaauggaguuaguucccagacauucugaacagauucaauuccagcucaggaacuggcugguuuuaccugaucuuuaguuccuaaacugugucaaaugaacacaguuacuuaggaggccaaggcagguagaucacuuaagcccaggagugugagguugcagugagcuaugauugcgccacugcacuccagccuaggcagcagagcaagaucccaacucuuaaaaaacaaaaaacaaaacaaaacaaaaaacccaaaguagacaaagcaggaguuaccagagacaugagaagagaaccgagaaagcacgaccucacagcuuucagggaaaaaaagguuucacaaagaguuggugguugagagugucaaacaccacugagaggucaaauaagaacaggucugaaagaaugcuuauuagauuucaugaccugaaggucacugaugaucuuaagaauacuucccagaauagugaacuauuccauggcuuagacuggcaguagaaugcaacaagagcacauucuacucacucauuaaacuccuuucuuguuuucuuuuuuucugcccauccuuucuugcucugcacucucuccugacuucaauauggcuuccuuucucaucuuuuuuguucuaucuacucauuucuuucuucuccauacuuauugauuuucuccuuugccuuucccacccuuauuugaugacaauauggaacugaaaauacuucauuuuuuauugaauacuuccauucuuccuguucuuaauuuuaacacuuuauaauucagaaugguugaggauggugcugguggcaaaauuuaauugcuuuuacuuauaugaaagcuucagaauaacuuaucucaaagagugggucaaugguuugaacaggaaauaacguccuaaaaaaucaaacucuucuucuauaagaauauaguccccucuuaucuguggggggcacauuccaagacccccaacugaaacuggggcuaguauugaacccuauauaacacuauguuuuuccuauauauauauaccuaugauuaaguuuaauuuauaaauuaggcauaguaagauuaacaauaagaauaauaaaauagaaguuauaauaauaugucagcaucacuacucuugcaccuugggaccacuauaaguaaaauaaguguuaccugaacauagcacugcaauacaaugaucagccaaucugauaacauaggccgcuacugaaugacugacaggcagguaguguauacagcaugggauauacugaacaaaggaaagauucacguccucggcagaacagagugggaugccgugagauuucaucucacuacucagaacagcaugcaacuuaaaacuuauaaauuaugucuuggauuuuccguuuaauauuuuuggacagcaguugacugugggaagcugaaaccacagaaaaagaaacagcagauaaagggggacuacuguugucuucuaguauaagcuaaauauuuuguucuuagaucgcuaacugcuggauauaauguggcacaaaccaccaucucuguuauaaaaucuuaaguuauuaaauaagacucaucuaaaguacuuuuucuugaauauuuccagggcacaagauauucuuauacagaaaccucagaauggaaaauagcuaagacauaagcaguguuucacagaaccauccaucagucuuuuuuaggauguagcagucuuccauguaucacuuaaccaaucauuauucuuaccccaucuuuuugggcagggggugguagaauuuaaaauuuaccauuacuaagacagggugauaguaagcauagaauuuugggaugucuuuuuuuuccuugcccuaaaccuucagaguucugccaggugauucaaauguuaagaucccauaaucucgccugugugcucaagcgaacacuaacacuuuaaaaagugggaaugaaaaaucugaacuguugaauuagacacaguauuuggccccaucuucaauuucagaaagaacaaguagagauaucagggccauugcggccuucuguagucauacugaagaaugauguacauuuaaaguuuuaauacaguuuuuaaauaagccaaaaaaaaaaagucuucuguaagaaaacacuauuguucucaucauaguucuauuaucaauaauuauuacagccgggcacaguggcucacaccuguaaucccaacacuuugggagggcaagguggggggaucacuugacccaggaguucaagaucacucugggcaacauacugggacuccaucacuacaaagaaaacaaaaaccaaauccaggcaugauggugcaagccuguagucucagcuacugggggaaggcugagguggaaggacugcuugagccugggagcucaaaggugccgugagcugugaucgugcacuccaaccuggagugagagccugucucaaaaaaaaaaaaaaaaaaaaauacauuuauuugacuaaguaagauuagcagccccagaguucaucaguugcaauucauucacugcaaaucucaggacuaaaaguaguauguuucagaagaguaucuuucuaaaagacaacaaaaaagguggaaaacaagaaggagcuguaaaggaaaaugagaggguugucauuauuuuuagauggaaaugcugucauuaaugaaaggcaacaagcauuuucgcaagaacuggauuuacaagaaagcguaacuuuacuauaauucaugguuuguccagaaaacugaauauaugaacaaaugacaaccaaacuauuuuaacucccaacccuuucggaaacacagugagucuacaaagaaguaagucuacuaaucagcaaagacugaauuuuaacuguguuaaaauucagaguaauuuuggucuauauuuacuagggcaaaauauagacccaauacauagcaaaauucaucuaaaaacaaggacaauaaaauaacagaaauagguaacuaccuauuuaaaaugaaaccuuccucauagacccacauguucuauagaaauuugucagaaauaguaaauuccaggcaauacucaaaagaccuagaaggaaagaagaggaaaggaagauauuagauaaaggaauuaucugaaauaaccaagugaauuucuguuacuaguuuuauagucagauucuucauaguuucauucucuacucaggccuauuaaaauaaaaccccuuaaacuuuaccuaaagcaacagggugagaagcaacagauuaaaagcaaaacauuacaugcuagagauuagagcuuuaauaauuaagggaaaggagggguacguaacuaauaaaaguagucaaaaaguucugcauagaguaaccuucuuaaugugagcaaagaaacacacaaaaagaaaaucucaaccuuauuacucuucaacuauuauaaggaauaagaaaaccuaguuggggaaaaucguauuuuuaguuaguaacugguggucauucagaauaaaucaagaguuugcucuacaauuacua

SEQ ID NO: 20968 - RNA, 4281 nt, Homo sapiens
uaguaauuguagagcaaacucuugauuuauucugaaugaccaccaguuacuaacuaaaaauacgauuuuccccaacuagguuuucuuauuccuuauaauaguugaagaguaauaagguugagauuuucuuuuuguguguuucuuugcucacauuaagaagguuacucuaugcagaacuuuuugacuacuuuuauuaguuacguaccccuccuuucccuuaauuauuaaagcucuaaucucuagcauguaauguuuugcuuuuaaucuguugcuucucacccuguugcuuuagguaaaguuuaagggguuuuauuuuaauaggccugaguagagaaugaaacuaugaagaaucugacuauaaaacuaguaacagaaauucacuugguuauuucagauaauuccuuuaucuaauaucuuccuuuccucuucuuuccuucuaggucuuuugaguauugccuggaauuuacuauuucugacaaauuucuauagaacaugugggucuaugaggaagguuucauuuuaaauagguaguuaccuauuucuguuauuuuauuguccuuguuuuuagaugaauuuugcuauguauugggucuauauuuugcccuaguaaauauagaccaaaauuacucugaauuuuaacacaguuaaaauucagucuuugcugauuaguagacuuacuucuuuguagacucacuguguuuccgaaaggguugggaguuaaaauaguuugguugucauuuguucauauauucaguuuucuggacaaaccaugaauuauaguaaaguuacgcuuucuuguaaauccaguucuugcgaaaaugcuuguugccuuucauuaaugacagcauuuccaucuaaaaauaaugacaacccucucauuuuccuuuacagcuccuucuuguuuuccaccuuuuuuguugucuuuuagaaagauacucuucugaaacauacuacuuuuaguccugagauuugcagugaaugaauugcaacugaugaacucuggggcugcuaaucuuacuuagucaaauaaauguauuuuuuuuuuuuuuuuuuuuugagacaggcucucacuccagguuggagugcacgaucacagcucacggcaccuuugagcucccaggcucaagcaguccuuccaccucagccuucccccaguagcugagacuacaggcuugcaccaucaugccuggauuugguuuuuguuuucuuuguagugauggagucccaguauguugcccagagugaucuugaacuccugggucaagugauccccccaccuugcccucccaaaguguugggauuacaggugugagccacugugcccggcuguaauaauuauugauaauagaacuaugaugagaacaauaguguuuucuuacagaagacuuuuuuuuuuuggcuuauuuaaaaacuguauuaaaacuuuaaauguacaucauucuucaguaugacuacagaaggccgcaauggcccugauaucucuacuuguucuuucugaaauugaagauggggccaaauacugugucuaauucaacaguucagauuuuucauucccacuuuuuaaaguguuaguguucgcuugagcacacaggcgagauuaugggaucuuaacauuugaaucaccuggcagaacucugaagguuuagggcaaggaaaaaaaagacaucccaaaauucuaugcuuacuaucacccugucuuaguaaugguaaauuuuaaauucuaccacccccugcccaaaaagaugggguaagaauaaugauugguuaagugauacauggaagacugcuacauccuaaaaaagacugauggaugguucugugaaacacugcuuaugucuuagcuauuuuccauucugagguuucuguauaagaauaucuugugcccuggaaauauucaagaaaaaguacuuuagaugagucuuauuuaauaacuuaagauuuuauaacagagauggugguuugugccacauuauauccagcaguuagcgaucuaagaacaaaauauuuagcuuauacuagaagacaacaguagucccccuuuaucugcuguuucuuuuucugugguuucagcuucccacagucaacugcuguccaaaaauauuaaacggaaaauccaagacauaauuuauaaguuuuaaguugcaugcuguucugaguagugagaugaaaucucacggcaucccacucuguucugccgaggacgugaaucuuuccuuuguucaguauaucccaugcuguauacacuaccugccugucagucauucaguagcggccuauguuaucagauuggcugaucauuguauugcagugcuauguucagguaacacuuauuuuacuuauaguggucccaaggugcaagaguagugaugcugacauauuauuauaacuucuauuuuauuauucuuauuguuaaucuuacuaugccuaauuuauaaauuaaacuuaaucauagguauauauauauaggaaaaacauaguguuauauaggguucaauacuagccccaguuucaguugggggucuuggaaugugccccccacagauaagaggggacuauauucuuauagaagaagaguuugauuuuuuaggacguuauuuccuguucaaaccauugacccacucuuugagauaaguuauucugaagcuuucauauaaguaaaagcaauuaaauuuugccaccagcaccauccucaaccauucugaauuauaaaguguuaaaauuaagaacaggaagaauggaaguauucaauaaaaaaugaaguauuuucaguuccauauugucaucaaauaagggugggaaaggcaaaggagaaaaucaauaaguauggagaagaaagaaaugaguagauagaacaaaaaagaugagaaaggaagccauauugaagucaggagagagugcagagcaagaaaggaugggcagaaaaaaagaaaacaagaaaggaguuuaaugagugaguagaaugugcucuuguugcauucuacugccagucuaagccauggaauaguucacuauucugggaaguauucuuaagaucaucagugaccuucaggucaugaaaucuaauaagcauucuuucagaccuguucuuauuugaccucucagugguguuugacacucucaaccaccaacucuuugugaaaccuuuuuuucccugaaagcugugaggucgugcuuucucgguucucuucucaugucucugguaacuccugcuuugucuacuuuggguuuuuuguuuuguuuuguuuuuuguuuuuuaagaguugggaucuugcucugcugccuaggcuggagugcaguggcgcaaucauagcucacugcaaccucacacuccugggcuuaagugaucuaccugccuuggccuccuaaguaacuguguucauuugacacaguuuaggaacuaaagaucagguaaaaccagccaguuccugagcuggaauugaaucuguucagaaugucugggaacuaacuccauuuuuacgugucaaccauaccuggcuaauuaaaaaaaaaaaaaaaaaauugccuaggccagucuugaacuccugaccucaaacgauccuaccucagccuuccaaagccucggauuacaggcaugagccaccucaccccagccaccuuuguuguccagagaugucagauuuugugaaagcucaguccuaggcuuccauuucuuuucauucuacgacccagcaauuauaucuaucccaauggccucaguuacuacucgcugaugccgcaugccauccucuggugucccacaugucagugaauagcaucaccuuuuuuauuccaguuuuccaaguuaaagacuuaggaguaauuccuaauacccccucucccucacuucccaaauucuuacuguacuaaggccugucuauuugacauccuuuaauaauuuucaaauccauauucucugcugucuuagucugaguaggauuaucucccccuugcagcacaauaguagcccuccauauccuuguuaaauuuguucuguacacugaagcuaggguacuguauccuaugaaaacacaaauccagucaugucauucuccuccauagcauuauuuccugcuacucuuaggauaaagacuaacauuccccaggccuacuucuccaccuccccucuuauuuuucaaacccucugcacuugagccacugagacuuuuguucagauucucacagguaccaugcucugaccuuuuacuucucugcuuagucaauuuccauuucauucuucacgucucaacacaaagacuguuucuauagaaaaagugauuauug

SEQ ID NO: 20969 - RNA, 299 nt, Homo sapiens
augcuccugguucaggcucaauuauucaggaagaaaauaaaacacauuuauuuuaaacuauggcuuuuauaucuuugucaaacucuaauuucuuucacucuuacauuuugaaaucccuuauuuuucuaucuuaagcaauaugaagcugaugagaggggaaagaccacaaguucaaguucuuguccauacacuacucauaacgugguuauccuagcuuuucauacagaagccuaugagagcucccaguuacuuucccaacaacugccacacuucugccagacauaauaggcaaggcauaa

SEQ ID NO: 20970 - RNA, 299 nt, Homo sapiens
uuaugccuugccuauuaugucuggcagaaguguggcaguuguugggaaaguaacugggagcucucauaggcuucuguaugaaaagcuaggauaaccacguuaugaguaguguauggacaagaacuugaacuuguggucuuuccccucucaucagcuucauauugcuuaagauagaaaaauaagggauuucaaaauguaagagugaaagaaauuagaguuugacaaagauauaaaagccauaguuuaaaauaaauguguuuuauuuucuuccugaauaauugagccugaaccaggagcau

SEQ ID NO: 20971 - RNA, 1190 nt, Homo sapiens
uuuucgucucauuaaacuuccuauuuuucacaggaaguucucccucuccuagucgauaccacgucucccucucagucugcacccaucccaggccccaugcaguuugcuuaagccauuucuucuuaaaaaaaaugcacacacaaacacccaccacauuacucacguaauuaaguauaauuucucuagcaacaagcugacaacagcuauuaaaaguggaguuggagauugaaucuuggcgcggccugcaagugauaguguucuggaugacaggcaaugguuaugucaugauccgaacagagauaagagccccaaacgaugugcuggcuuuuauugcauggauuaguaccuucuccccaaaccaccuccaccuuccucugggcugauuccgcuacauucauccgggugcuauuuugauacuucaauguagcuugcuaaaauuggaauuaauuagcugggcuuggaagcgcaggcccauaaucccagcuacucaggaggcugaggcagaagaaucacuugaaccugggaggcagaguuugcagugagcagagaucacaccacugcaugccagccggggugacagggcaagacucggucucaaaaaaauaauaauaauaauuuaaaauuggaauuaaugagguucagaaaaauagggucuggaaaaaaaagcccaguggcuuugguaauucgaguuaaugccccuuuacuuauagauaaaaauauuuguuuuuauugauaauaaacauauggcagcuuucucgaugaagcucuaagucauuuauaaucucaugguuccugugggcuuauuccugaucuaguuaacuaaaacauaggagucuuacacaaaccuggguuggauuugaauucucaucuaccacucagcaucuaugggacccugaauaaguccugccaccucucugugcuucuuuucccggucggucaaaugaguauaaugauaccccgucuuucagguuguugagaggaacaaaaaaagauaauguccauaaaacacauacuucagugcccagacuuuauuaggugcuucauaaauauuagcuauugugucuguucacacuaguuauuagguggcuaugaugugacaagagcuuucauguggugucuuugugaauucucacaauacuguaugguugggauuauuauccccauguuccaaaugggaaaacucuuuaaga

SEQ ID NO: 20972 - RNA, 1190 nt, Homo sapiens
ucuuaaagaguuuucccauuuggaacauggggauaauaaucccaaccauacaguauugugagaauucacaaagacaccacaugaaagcucuugucacaucauagccaccuaauaacuagugugaacagacacaauagcuaauauuuaugaagcaccuaauaaagucugggcacugaaguauguguuuuauggacauuaucuuuuuuuguuccucucaacaaccugaaagacgggguaucauuauacucauuugaccgaccgggaaaagaagcacagagagguggcaggacuuauucagggucccauagaugcugagugguagaugagaauucaaauccaacccagguuuguguaagacuccuauguuuuaguuaacuagaucaggaauaagcccacaggaaccaugagauuauaaaugacuuagagcuucaucgagaaagcugccauauguuuauuaucaauaaaaacaaauauuuuuaucuauaaguaaaggggcauuaacucgaauuaccaaagccacugggcuuuuuuuuccagacccuauuuuucugaaccucauuaauuccaauuuuaaauuauuauuauuauuuuuuugagaccgagucuugcccugucaccccggcuggcaugcaguggugugaucucugcucacugcaaacucugccucccagguucaagugauucuucugccucagccuccugaguagcugggauuaugggccugcgcuuccaagcccagcuaauuaauuccaauuuuagcaagcuacauugaaguaucaaaauagcacccggaugaauguagcggaaucagcccagaggaagguggaggugguuuggggagaagguacuaauccaugcaauaaaagccagcacaucguuuggggcucuuaucucuguucggaucaugacauaaccauugccugucauccagaacacuaucacuugcaggccgcgccaagauucaaucuccaacuccacuuuuaauagcuguugucagcuuguugcuagagaaauuauacuuaauuacgugaguaaugugguggguguuugugugugcauuuuuuuuaagaagaaauggcuuaagcaaacugcauggggccugggaugggugcagacugagagggagacgugguaucgacuaggagagggagaacuuccugugaaaaauaggaaguuuaaugagacgaaaa

SEQ ID NO: 20973 - RNA, 103 nt, Homo sapiens
ugacuuuuacagcauaaagcuguaaaaacauuuuauaggagggaaaaccauagaacagcccuggaagcgacacuguguggacaaaagcucaacccagaugaau

SEQ ID NO: 20974 - RNA, 103 nt, Homo sapiens
auucaucuggguugagcuuuuguccacacagugucgcuuccagggcuguucuaugguuuucccuccuauaaaauguuuuuacagcuuuaugcuguaaaaguca

SEQ ID NO: 20975 - RNA, 2331 nt, Homo sapiens
uguguuuucucccaucugggaauacuggcacuucuugcuuaaguuagaaguuacaaguuaauagcuuaugccugugguguuaaauaucaucaaacuuuuguauaauuuauucuuucuuuccaauggagccaagacaauaucaagaucuuuguacuuacuuuuccugcugucuggagcucucuguucaaaugccacuucccugacccacuuucauaaaaaacgucauccucccccaacaccauacuugucauugucacuuccuguaccucccccugcuuuuacucuuuuccauggcacugacauccacaugacauauuagauauucauuucuuugguguugaucuguccuugaugaacuauaagugucauggaacagggcuucaucugucuuguucacuguauuucagauccuacaacagugccuggcacacaucugguccucaguaaauauuuguugaaugagaaaaauguaagcagagauugguuuuuauuuuucauuaaucuuccucuauaucuaauuuauguaaguuucucuucaaaaaauugauugaaaaaucuuuugaguuucccccauccccaagguaugaaauuaaaaugaaaaucuucaagaauucagcaacgauauccauuucagaggcacuuacaaggguuaaaaaaaaucaaucuuuaaagggauaagaaaaaaaccauagugcuauauuaaaaacugguuuaagugacucauuuuaagaaaaggaagcaauguuacuuuucaaagaaacauguaaguacucuuuaugucuaacauucaaaggaugaaugauuugauaagaauacaauucagcuuauuuguagcuagggcuucuaagccaucaucuauaaucaaauauaguaagaaccaaauucuucccuuacuacugauaucuguauucuucaacguucuuuauuuaaaaaaauaaaauaaacaacaacaaaaaacuaucuaaaaaaucuaaaagcaagucaaugucuguuuccaguagauggcacugcaaaucaagucuuuguagaucuacuaacuaucacuucuuugaucaugauaauaaugauuuauucuguacuaagaucaucuaaagcagcuuacacagugaaaacaaauaggauggcgaugcugaagcuacaugaaagcugagauaguccagcucccuaauacugguaucucuccucuuguauaccauagccgggcacuuauuaagguagugggugaauguaacaaauuguccacugugcuuauucauggaagugcuuuuucaugugggauuuuuggucgcuuguuuuaguuuguuuagucuauuuugcaguauaaauucaaugggacucuugaugcuuuuacauggugucaaauucaaccucauucaggccaguuaucauucacagaggaaauacugcucuagggucacagacccacaucucugaccugcacuguguuuaugguuguuuguugaggcaugaucuugcucugucacccaggcuggagugcaguggcaugaucauaguucacugcagucucuacugccugggcucaggcaauccucuugccucagccucccgaagaguuggggcuacaggugcaugccaccaugcccagcuaauuuuuauuuuuuguagagacagggucuggauauguuguucaggcuggucuccaccuccugggcucaagugauccuccugccucaaucucccaaagggcugggauuacaggugugagcuacugcacccaguugggguguguguguuuuugccaauagauacccucagucauaaagggguaaaauuagaaaguguaaaugguuccagacaacucaaguuccacaagaaaaaaccgagaugcaaccuguguuucaaugacagugacaguggaugaggacucagcuuuauguguaaagaaauauacauuuaaaacauauuuucaaaccauuuaaaagggauauuacacauaauacagacuaggaguuaugaaauguuaucauauauguaaaaaauaccuggaauagugucuggagcaaaguagauacuaaauaaauccucugucucauuuuugcugucuuuaaaagggccugagagccagucccugcucgguaacucuguccuuuaaaaggccucugucauuuaaucucucuggacugcagcucucaaaagggcuggaacugaggccacaaagucuaaaauauuaugccuaauacacaguaagauucacaaaugaagggcgugauaccaugcauccagauguacaagccagcagccacagaaguugggaaugaauuuugucaugauguucuucucaguggagaaagaagccauuagucaaaacug

SEQ ID NO: 20976 - RNA, 2331 nt, Homo sapiens
caguuuugacuaauggcuucuuucuccacugagaagaacaucaugacaaaauucauucccaacuucuguggcugcuggcuuguacaucuggaugcaugguaucacgcccuucauuugugaaucuuacuguguauuaggcauaauauuuuagacuuuguggccucaguuccagcccuuuugagagcugcaguccagagagauuaaaugacagaggccuuuuaaaggacagaguuaccgagcagggacuggcucucaggcccuuuuaaagacagcaaaaaugagacagaggauuuauuuaguaucuacuuugcuccagacacuauuccagguauuuuuuacauauaugauaacauuucauaacuccuagucuguauuauguguaauaucccuuuuaaaugguuugaaaauauguuuuaaauguauauuucuuuacacauaaagcugaguccucauccacugucacugucauugaaacacagguugcaucucgguuuuuucuuguggaacuugaguugucuggaaccauuuacacuuucuaauuuuaccccuuuaugacugaggguaucuauuggcaaaaacacacacaccccaacugggugcaguagcucacaccuguaaucccagcccuuugggagauugaggcaggaggaucacuugagcccaggagguggagaccagccugaacaacauauccagacccugucucuacaaaaaauaaaaauuagcugggcaugguggcaugcaccuguagccccaacucuucgggaggcugaggcaagaggauugccugagcccaggcaguagagacugcagugaacuaugaucaugccacugcacuccagccugggugacagagcaagaucaugccucaacaaacaaccauaaacacagugcaggucagagaugugggucugugacccuagagcaguauuuccucugugaaugauaacuggccugaaugagguugaauuugacaccauguaaaagcaucaagagucccauugaauuuauacugcaaaauagacuaaacaaacuaaaacaagcgaccaaaaaucccacaugaaaaagcacuuccaugaauaagcacaguggacaauuuguuacauucacccacuaccuuaauaagugcccggcuaugguauacaagaggagagauaccaguauuagggagcuggacuaucucagcuuucauguagcuucagcaucgccauccuauuuguuuucacuguguaagcugcuuuagaugaucuuaguacagaauaaaucauuauuaucaugaucaaagaagugauaguuaguagaucuacaaagacuugauuugcagugccaucuacuggaaacagacauugacuugcuuuuagauuuuuuagauaguuuuuuguuguuguuuauuuuauuuuuuuaaauaaagaacguugaagaauacagauaucaguaguaagggaagaauuugguucuuacuauauuugauuauagaugauggcuuagaagcccuagcuacaaauaagcugaauuguauucuuaucaaaucauucauccuuugaauguuagacauaaagaguacuuacauguuucuuugaaaaguaacauugcuuccuuuucuuaaaaugagucacuuaaaccaguuuuuaauauagcacuaugguuuuuuucuuaucccuuuaaagauugauuuuuuuuaacccuuguaagugccucugaaauggauaucguugcugaauucuugaagauuuucauuuuaauuucauaccuuggggaugggggaaacucaaaagauuuuucaaucaauuuuuugaagagaaacuuacauaaauuagauauagaggaagauuaaugaaaaauaaaaaccaaucucugcuuacauuuuucucauucaacaaauauuuacugaggaccagaugugugccaggcacuguuguaggaucugaaauacagugaacaagacagaugaagcccuguuccaugacacuuauaguucaucaaggacagaucaacaccaaagaaaugaauaucuaauaugucauguggaugucagugccauggaaaagaguaaaagcagggggagguacaggaagugacaaugacaaguaugguguugggggaggaugacguuuuuuaugaaagugggucagggaaguggcauuugaacagagagcuccagacagcaggaaaaguaaguacaaagaucuugauauugucuuggcuccauuggaaagaaagaauaaauuauacaaaaguuugaugauauuuaacaccacaggcauaagcuauuaacuuguaacuucuaacuuaagcaagaagugccaguauucccagaugggagaaaacaca

SEQ ID NO: 20977 - RNA, 1357 nt, Homo sapiens
aaacacacaucauuaagucaaguaauuucaacagcuuuagcuuugauuucucagcaaauuuuacagggguccuuaauaucguucuaaaauuuauagcccuacaaagauuaaaaacacugagaguuuaaccacagaauguuaugcuggccaaauauuuuuucuuccagcauauuagucacuauucagggcaauaagauacauucacaggaaaauacacaucuucauagcacucacucaacugcaaauacagcuuauugcgcaaauacagcuaacugccaagaacaauaccacuuuggcaucuggaacaaaguaauguaaaaccaauuaagaaaucuauuuacaccucucccucucccucucccucuccccacggucucccucucaugcggagccgaagcuggacuguacugcugccaucuuggcucacugcaaccucccugccugauucuccugccucagccugccgagugccugcgacugcaggcacgcgccgccacgccugacugguuuugguggagacgggguuucacuguguuggccgggcggucuccagccccuaaccgcgagugauccgccagccucggccucccgaggugagccccccugcccggccagccgccccguccgggagggagguggggggggggucagcccccugcccggccagccgccucguccgggaggugaggggcgccucugcccggccgccccuacugggaagugaggagccccucugcccggccaccaccccgucugggaggugugcccaacagcucauugagaacgggccaggaugacaauggcggcuuuguggaauagaaaggcgggaaagguggggaaaagauugagaaaucggaugguugcccugucuguguagaaagaaguagacaugggagacuuuucauuuuguucugcacuaagaaaaauucuucugccuugggauccuguugaucugugaccuuacccccaacccugugcucucugaaacaugugcuguguccacucaggguuaaauggauuaagggcagugcaagaugugcuuuguuaaacagaugcuugaaggcagcaugcuccuuaagagucaucaccacucccuaaucucaaguaaucagggacacaaacacugcggaaggccgcaggguccucugccuaggaaaaccagagaccuuuguucacuuguuuaucugcugaccuucccuccacuauugucccaugacccugccaaaucccccucugugagaaacacccaagaauuaucaauaaaaaaauaaauuuaaaaaaaaaaaaaaaaagaaaucuauuugcacuacuuaaaaauacaaaucgaaaguauuaaacauuauuauacgucuguguu

SEQ ID NO: 20978 - RNA, 1357 nt, Homo sapiens
aacacagacguauaauaauguuuaauacuuucgauuuguauuuuuaaguagugcaaauagauuucuuuuuuuuuuuuuuuuuaaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggaguggugaugacucuuaaggagcaugcugccuucaagcaucuguuuaacaaagcacaucuugcacugcccuuaauccauuuaacccugaguggacacagcacauguuucagagagcacaggguuggggguaaggucacagaucaacaggaucccaaggcagaagaauuuuucuuagugcagaacaaaaugaaaagucucccaugucuacuucuuucuacacagacagggcaaccauccgauuucucaaucuuuuccccaccuuucccgccuuucuauuccacaaagccgccauugucauccuggcccguucucaaugagcuguugggcacaccucccagacggggugguggccgggcagaggggcuccucacuucccaguaggggcggccgggcagaggcgccccucaccucccggacgaggcggcuggccgggcagggggcugaccccccccccaccucccucccggacggggcggcuggccgggcaggggggcucaccucgggaggccgaggcuggcggaucacucgcgguuaggggcuggagaccgcccggccaacacagugaaaccccgucuccaccaaaaccagucaggcguggcggcgcgugccugcagucgcaggcacucggcaggcugaggcaggagaaucaggcagggagguugcagugagccaagauggcagcaguacaguccagcuucggcuccgcaugagagggagaccguggggagagggagagggagagggagagguguaaauagauuucuuaauugguuuuacauuacuuuguuccagaugccaaagugguauuguucuuggcaguuagcuguauuugcgcaauaagcuguauuugcaguugagugagugcuaugaagauguguauuuuccugugaauguaucuuauugcccugaauagugacuaauaugcuggaagaaaaaauauuuggccagcauaacauucugugguuaaacucucaguguuuuuaaucuuuguagggcuauaaauuuuagaacgauauuaaggaccccuguaaaauuugcugagaaaucaaagcuaaagcuguugaaauuacuugacuuaaugauguguguuu

SEQ ID NO: 20979 - RNA, 323 nt, Homo sapiens
gguuuggauggcuuuagcuauacauuguuuaauuauuccauccuacccaagcauacagauguuaguggaucaaaugaggcacgugaaaaguaucucucuauaaauguaaaauaugcaaauguuuacauguugacagugauaggcucuacuacuugcuguauaagcgagaccaaaguccaggccaauggauaauaaugagguuguggaccuaacuagggggagccuaaaauaauguugggacuaccuagauggucagaaagaaugagccaauuaacuucuaaaaucauggacagcuucauugcuugguucuuccucagggcagg

SEQ ID NO: 20980 - RNA, 323 nt, Homo sapiens
ccugcccugaggaagaaccaagcaaugaagcuguccaugauuuuagaaguuaauuggcucauucuuucugaccaucuagguagucccaacauuauuuuaggcucccccuaguuagguccacaaccucauuauuauccauuggccuggacuuuggucucgcuuauacagcaaguaguagagccuaucacugucaacauguaaacauuugcauauuuuacauuuauagagagauacuuuucacgugccucauuugauccacuaacaucuguaugcuuggguaggauggaauaauuaaacaauguauagcuaaagccauccaaacc

SEQ ID NO: 20981 - RNA, 308 nt, Homo sapiens
ucauauuaagaucugagaaugaaagaucucagugucaagauucuaagcccagauaaagacaaguaugauauagucuaaguaguaacauaauggccaccauuuaucuuguacuuucuaugugcucaacacucuuccaaccacuuguccccaugaccuccuucauaugcacaccaauccacccagguggguaguaguaugaucauuaccauuuuggaguaaggaaacaaaaacagagagguuaaguacuuuugccugaagacaucgccccaucugauaaauggugacagugagauccaacucagguuuau

SEQ ID NO: 20982 - RNA, 308 nt, Homo sapiens
auaaaccugaguuggaucucacugucaccauuuaucagauggggcgaugucuucaggcaaaaguacuuaaccucucuguuuuuguuuccuuacuccaaaaugguaaugaucauacuacuacccaccuggguggauuggugugcauaugaaggaggucauggggacaagugguuggaagaguguugagcacauagaaaguacaagauaaaugguggccauuauguuacuacuuagacuauaucauacuugucuuuaucugggcuuagaaucuugacacugagaucuuucauucucagaucuuaauauga

SEQ ID NO: 20983 - RNA, 260 nt, Homo sapiens
gaaaaaguaaugcucuuaugcccucaccuguguuucucccauaggacaccaccagcugggcauggagggguccuggagugugaguucugguauuccugggggugaggguggggagcaggguccaucagagaauuccuggcccaucuuccaaucucccgacaaggugaauggcccuucuucaucugaggacugagagaacucuagaggagacaccacuuucccccugauguccccauauaaucuggcugugcuuagauuag

SEQ ID NO: 20984 - RNA, 260 nt, Homo sapiens
cuaaucuaagcacagccagauuauauggggacaucagggggaaaguggugucuccucuagaguucucucaguccucagaugaagaagggccauucaccuugucgggagauuggaagaugggccaggaauucucugauggacccugcuccccacccucacccccaggaauaccagaacucacacuccaggaccccuccaugcccagcuggugguguccuaugggagaaacacaggugagggcauaagagcauuacuuuuuc

SEQ ID NO: 20985 - RNA, 1529 nt, Homo sapiens
ccuucaaacauccaauagauuccuagccggccucggguuagcgcagcagugcgcacccagcccugcgcagggcaugagcguuagaggcgcacaggaucccagaagaccccuaaccuuuacuguuaagauccuagcucuaccgguuucugcagggacauguacaagaaacuugggaaauacugcacugauaguugccaggaguccuguauauacaggacguauuuaaugauuauuggccugcguccuucguugaccucgucggaaugccuuaaauguccuguauucaucuuuuuacacuaaauugcaauaauuagagcuauuuuucucccacaguaauuggugcuagaucacuuaaauuacaacacuggcugaaaauccuuccuacacuaaugaagauuuggacaaucccuauggugucuccuucagguuuggcugagggaagaccagaagggaguaggaauuuaaagugcucgucuuucauauucaagaaaggaaaauacuuuuuuagcucaaguccggagucgugaacaaauaaccaccauuauuuagagauaacuucucgucggugcagcagcucugaaaaucagccaaucagcgauagccucacuccgguaacuaugcuucuuaguaaaucaaugacaaccccacgcuucugaaagucagccaaucagugaccgcucuaagccuccgacaauagccaaucaacaagugccugacaccagcgaccaggcuuccgaaagucaguggguacucagcugccgcacuccacuucugauucggaaagacagccaaucccugaaggcgaauauuuccaaaaccauuuuuuuuucuuucccagacugagucucauucugucgcccaggcuggagugcaguggcgcgaucucggcucacugcaaccucugccucccgguucaagcgauucuccuaccucagccuaccgaguagcugggauuacaggcucccgccaccacgccuggcucauuuuuguauuuuuaguagagacggguuuugccauguuggccagacuggucucaaacuccugaccucaguugauccgccugccuuggccucccaaagugcugggauuacaggccugagccaucgcgcccggccuuuuuuuucuuuuucuccuuuuuuuuuggagacagagucgcacucuguugcucaggcuggagugcaguggcgugaucucagaucacugcaaccucugccuccugguucaagcgauucuugugccucagcuucccaaguagcugggauuacaggccugugccaccaagccuggcuaauuuuuuguauuuuuaguagagacagaguuucgccauguuggccaggcuggucuugaacuccuggccucaagugaaucgccagccuuggccucccaaagugcugguauuacaggcgugagccgcgcccggccuucaaaaccuuuuauaagaucagcucuggcuuuguucagagaggcuguaccuuacaaguaccgcucucccuugcaagcagagaagaaauucacuuuuuuuuugcauc

SEQ ID NO: 20986 - RNA, 1529 nt, Homo sapiens
gaugcaaaaaaaaagugaauuucuucucugcuugcaagggagagcgguacuuguaagguacagccucucugaacaaagccagagcugaucuuauaaaagguuuugaaggccgggcgcggcucacgccuguaauaccagcacuuugggaggccaaggcuggcgauucacuugaggccaggaguucaagaccagccuggccaacauggcgaaacucugucucuacuaaaaauacaaaaaauuagccaggcuugguggcacaggccuguaaucccagcuacuugggaagcugaggcacaagaaucgcuugaaccaggaggcagagguugcagugaucugagaucacgccacugcacuccagccugagcaacagagugcgacucugucuccaaaaaaaaaggagaaaaagaaaaaaaaggccgggcgcgauggcucaggccuguaaucccagcacuuugggaggccaaggcaggcggaucaacugaggucaggaguuugagaccagucuggccaacauggcaaaacccgucucuacuaaaaauacaaaaaugagccaggcgugguggcgggagccuguaaucccagcuacucgguaggcugagguaggagaaucgcuugaaccgggaggcagagguugcagugagccgagaucgcgccacugcacuccagccugggcgacagaaugagacucagucugggaaagaaaaaaaaaugguuuuggaaauauucgccuucagggauuggcugucuuuccgaaucagaaguggagugcggcagcugaguacccacugacuuucggaagccuggucgcuggugucaggcacuuguugauuggcuauugucggaggcuuagagcggucacugauuggcugacuuucagaagcgugggguugucauugauuuacuaagaagcauaguuaccggagugaggcuaucgcugauuggcugauuuucagagcugcugcaccgacgagaaguuaucucuaaauaauggugguuauuuguucacgacuccggacuugagcuaaaaaaguauuuuccuuucuugaauaugaaagacgagcacuuuaaauuccuacucccuucuggucuucccucagccaaaccugaaggagacaccauagggauuguccaaaucuucauuaguguaggaaggauuuucagccaguguuguaauuuaagugaucuagcaccaauuacugugggagaaaaauagcucuaauuauugcaauuuaguguaaaaagaugaauacaggacauuuaaggcauuccgacgaggucaacgaaggacgcaggccaauaaucauuaaauacguccuguauauacaggacuccuggcaacuaucagugcaguauuucccaaguuucuuguacaugucccugcagaaaccgguagagcuaggaucuuaacaguaaagguuaggggucuucugggauccugugcgccucuaacgcucaugcccugcgcagggcugggugcgcacugcugcgcuaacccgaggccggcuaggaaucuauuggauguuugaagg

SEQ ID NO: 20987 - RNA, 103 nt, Homo sapiens
caggucacagccaggugcagggucacagccaggugcagggucacugccagcagcaugguugggaggggcaaggcaguaacggagaggcgcggcagugcgcagg

SEQ ID NO: 20988 - RNA, 103 nt, Homo sapiens
ccugcgcacugccgcgccucuccguuacugccuugccccucccaaccaugcugcuggcagugacccugcaccuggcugugacccugcaccuggcugugaccug

SEQ ID NO: 20989 - RNA, 52 nt, Homo sapiens
gaagcccagaucuguggaggaggguuaaaggguggugguuccacgcggccca

SEQ ID NO: 20990 - RNA, 52 nt, Homo sapiens
ugggccgcguggaaccaccacccuuuaacccuccuccacagaucugggcuuc

SEQ ID NO: 20991 - RNA, 81 nt, Homo sapiens
gcaaggcagugacugacuuccguucuacaacccuaggugcaggggacaagagaagaggcaaguaccccugcuucucagguc

SEQ ID NO: 20992 - RNA, 81 nt, Homo sapiens
gaccugagaagcagggguacuugccucuucucuuguccccugcaccuaggguuguagaacggaagucagucacugccuugc

SEQ ID NO: 20993 - RNA, 1179 nt, Homo sapiens
gaggaaacaggcccagagaggucaaggggcacagcuacaaagugggagccaggauuugaacccaagccccuagcucuauaacccugagucaagacuguggaggaucccacagcacagcagaugcccacugccucacaguggaucccccaccaucagccacuccacucaccagcuugguggcauccauggcagcgagcacugcacgguucagcgauuccaaugcagccagcaccggccgguagacacccaggugcucugagaaguagucugcaggcagaagaggugcucaaggguuccuggacccccacccaucuacccacccugggauucuggcccccuggaauuccucagcagccaagcaggccuuauauccugagcccagcccaaccugucccaucaggagaccagcaacagucccuugccacacguacccuggggcccaggggccacaggagaaaagagcucccaugggccuacucaccacacaguuuuucuguuucuaaauugcugcagggaaaagagaaggcgcccuucagaccugggccugguaaacugggacuaauggggccaaugccccacaucccaccccaccaacucccagcuuagccuaacaaggccacuucugcuccaccccagauuaaguugcuccuguggacagaguccuugcaggguuggagaauggguucuacugcccccaccaaucacucuaagggcaaagauucagacccauucuuggcuaccaagaggaucucaggccaggggaagauggauguggacacaggccagugagaaguggucagagcugcgaaggggaagccaggugcaaggcaaugaaguccagggacggcaugggguauuuaguuguagguuagggaggguuuccuagaggaagagcugccuaagugaggcccugaaggacaaggaacuggguggggagucuggccaggaggggaggggaagcacugcagaugaagguuccagcccaagucucaggagccugagacugacccucaggaaaggggagaagggaaguagagggaguaacagcgguucaugcgugugcaccccugggagcaggcacgggaaggagcgugcacacuccugccaagacgcguagaugugggagcacacaagggguagaugguugcguguuuaugcacugcauucucggguggaagc

SEQ ID NO: 20994 - RNA, 1179 nt, Homo sapiens
gcuuccacccgagaaugcagugcauaaacacgcaaccaucuaccccuugugugcucccacaucuacgcgucuuggcaggagugugcacgcuccuucccgugccugcucccaggggugcacacgcaugaaccgcuguuacucccucuacuucccuucuccccuuuccugagggucagucucaggcuccugagacuugggcuggaaccuucaucugcagugcuuccccuccccuccuggccagacuccccacccaguuccuuguccuucagggccucacuuaggcagcucuuccucuaggaaacccucccuaaccuacaacuaaauaccccaugccgucccuggacuucauugccuugcaccuggcuuccccuucgcagcucugaccacuucucacuggccuguguccacauccaucuuccccuggccugagauccucuugguagccaagaaugggucugaaucuuugcccuuagagugauuggugggggcaguagaacccauucuccaacccugcaaggacucuguccacaggagcaacuuaaucugggguggagcagaaguggccuuguuaggcuaagcugggaguugguggggugggauguggggcauuggccccauuagucccaguuuaccaggcccaggucugaagggcgccuucucuuuucccugcagcaauuuagaaacagaaaaacuguguggugaguaggcccaugggagcucuuuucuccuguggccccugggccccaggguacguguggcaagggacuguugcuggucuccugaugggacagguugggcugggcucaggauauaaggccugcuuggcugcugaggaauuccagggggccagaaucccaggguggguagauggguggggguccaggaacccuugagcaccucuucugccugcagacuacuucucagagcaccugggugucuaccggccggugcuggcugcauuggaaucgcugaaccgugcagugcucgcugccauggaugccaccaagcuggugaguggaguggcugauggugggggauccacugugaggcagugggcaucugcugugcugugggauccuccacagucuugacucaggguuauagagcuaggggcuuggguucaaauccuggcucccacuuuguagcugugccccuugaccucucugggccuguuuccuc

SEQ ID NO: 20995 - RNA, 2261 nt, Homo sapiens
gaaaaaucuuacagggugaaaauaucuacaucuaaggccucugcuucauguauagccuaaacauaugcucuaaaucugagaaaaguuuuaagaucuuugcuuugccuuggaaacuauagcuggcaagaucuagcaaaacuuacagaauagaaauuccagcaggaccuacagaacagaucuggagcccuggcaaugcuuuucagggggcacuaauauaguuuggucaaugcagcgguccccaaaucauucuguaugcaggcagaucaaagauugacaugugcaaaugaagugauucugacaacauuaacaugcugauugcagcuaagugcacugcuuguucaacaguucuucaguagacuaaaaaauauuuaauugaaguaaugagaaaccaaaaacauuucuuauucaugauauuauacaaauauguuccgcacgccuucagcuaauaguucuguauuugugauucucaaauaucucugucucuagucauuaauucucauuuguacuucugucucaaauugaaaacugcuuacaggacauuucuaaucagaaguucugccaucaagucaguauuuacauuuucaaaacuaaguuaauauuaucuaagaaccccggcaaucuuuccccaaaucuuaguuucuguuauugaugacaucuguuauugauauuauagucgcugagacuucccaauuugagagcaaguuauagcagaaaaaaagucuggaauaaguguuaggauuugagaguuuaguuuaaauuuugcugcucauauuuucauaauuuugguuaauucacauaaccuuugggaucuguuuucugaugugcaaagugaagagccugagcuggcagcuggaugacuuauacauguauuuagcaaacuuguuuucugugucaguaggucguuuacagagccaggugugggaauucaguguuuacugggccugguuccgauccuaacaugguggaccuguucucugcuaaagcucuccugcaucaaucuuucacugaacuccacugauucugcuuuggcccuuccuucucucucccgcugcuggcccuucagucaagaauggggggcacugcagagccaccaucuggcuccagcuccacacugaguugugcugcacaggguacucucaucaggucgcuuuucucuucaaggaucugaugcuugcagcugggugcagugacuuauaccuauaaucccagcacuaagcucaggaguucaagacuggccugggcaacaugucuccaccaaaaauacaaaauauuacccaggccuaguggugcacaccuguggucccagcuacucgggagguagaggugcaagaaucacuugagcccuggagguggaggcugcagugagccaagauugcaccacugcacuccagccugggugagagugagaccccccacaacaaccaucucaauuaaaaaaaaaaaaaaucuggugcuuccuauugccccuuguaagugaugucccaguuuagacuguugucaaggguccucuguaaacuguccuugucuucaugucuuauuuuaucucuauuuugcucuaugaaaccccuccuuaguuggguaacucuccuuauucuuccccucaagucuaccugucugcacuuacugagucucccuccugagguacuuuccccccaccucaccuccugacuaaccccaaucaaugaaagccacagauuccugaggaagguuuccccagaacccacaggccaccauccucaccccugggccuaucgcauauuuugcauauuuuggacauuugauuacagaguauuauagcauccuuacauguuaaacaucuuguaacuuugauauguuucagaacucuuaggucuuucguagccuagcccaggcccagaaaccugagaguagagguuaagacugaacccccuaagucaggcuuccugaguccuuaacauggcuucaucuuuuccuagcugugugacuguggcaauuuacuuauccucucugaacuuccuuuuccuuacuugcacaauugagacaacaauauugccugccccaguuacucacuaguucacaugaauaguuauuaguuauuuaguuaauacgaguaaaguguuuaagacagauuuugguauguagugagugauuaagaaguguuaguuacugcuguuucauuggauuaguguaagaauuaaacaagauaauucauuaaaaaacccucaguguaguaccuggccuguaguaagaauucaauauuuuauuuaacaguugaugaggcu

SEQ ID NO: 20996 - RNA, 2261 nt, Homo sapiens
agccucaucaacuguuaaauaaaauauugaauucuuacuacaggccagguacuacacugaggguuuuuuaaugaauuaucuuguuuaauucuuacacuaauccaaugaaacagcaguaacuaacacuucuuaaucacucacuacauaccaaaaucugucuuaaacacuuuacucguauuaacuaaauaacuaauaacuauucaugugaacuagugaguaacuggggcaggcaauauuguugucucaauugugcaaguaaggaaaaggaaguucagagaggauaaguaaauugccacagucacacagcuaggaaaagaugaagccauguuaaggacucaggaagccugacuuaggggguucagucuuaaccucuacucucagguuucugggccugggcuaggcuacgaaagaccuaagaguucugaaacauaucaaaguuacaagauguuuaacauguaaggaugcuauaauacucuguaaucaaauguccaaaauaugcaaaauaugcgauaggcccaggggugaggaugguggccuguggguucuggggaaaccuuccucaggaaucuguggcuuucauugauugggguuagucaggaggugagguggggggaaaguaccucaggagggagacucaguaagugcagacagguagacuugaggggaagaauaaggagaguuacccaacuaaggagggguuucauagagcaaaauagagauaaaauaagacaugaagacaaggacaguuuacagaggacccuugacaacagucuaaacugggacaucacuuacaaggggcaauaggaagcaccagauuuuuuuuuuuuuuaauugagaugguuguuguggggggucucacucucacccaggcuggagugcaguggugcaaucuuggcucacugcagccuccaccuccagggcucaagugauucuugcaccucuaccucccgaguagcugggaccacaggugugcaccacuaggccuggguaauauuuuguauuuuugguggagacauguugcccaggccagucuugaacuccugagcuuagugcugggauuauagguauaagucacugcacccagcugcaagcaucagauccuugaagagaaaagcgaccugaugagaguacccugugcagcacaacucaguguggagcuggagccagaugguggcucugcagugccccccauucuugacugaagggccagcagcgggagagagaaggaagggccaaagcagaaucaguggaguucagugaaagauugaugcaggagagcuuuagcagagaacagguccaccauguuaggaucggaaccaggcccaguaaacacugaauucccacaccuggcucuguaaacgaccuacugacacagaaaacaaguuugcuaaauacauguauaagucauccagcugccagcucaggcucuucacuuugcacaucagaaaacagaucccaaagguuaugugaauuaaccaaaauuaugaaaauaugagcagcaaaauuuaaacuaaacucucaaauccuaacacuuauuccagacuuuuuuucugcuauaacuugcucucaaauugggaagucucagcgacuauaauaucaauaacagaugucaucaauaacagaaacuaagauuuggggaaagauugccgggguucuuagauaauauuaacuuaguuuugaaaauguaaauacugacuugauggcagaacuucugauuagaaauguccuguaagcaguuuucaauuugagacagaaguacaaaugagaauuaaugacuagagacagagauauuugagaaucacaaauacagaacuauuagcugaaggcgugcggaacauauuuguauaauaucaugaauaagaaauguuuuugguuucucauuacuucaauuaaauauuuuuuagucuacugaagaacuguugaacaagcagugcacuuagcugcaaucagcauguuaauguugucagaaucacuucauuugcacaugucaaucuuugaucugccugcauacagaaugauuuggggaccgcugcauugaccaaacuauauuagugcccccugaaaagcauugccagggcuccagaucuguucuguagguccugcuggaauuucuauucuguaaguuuugcuagaucuugccagcuauaguuuccaaggcaaagcaaagaucuuaaaacuuuucucagauuuagagcauauguuuaggcuauacaugaagcagaggccuuagauguagauauuuucacccuguaagauuuuuc

SEQ ID NO: 20997 - RNA, 345 nt, Homo sapiens
ggcuguuucuuaucccaagucucaaagaauaauucacaucucuaauaaucuauuucugaggccuugggguaggcagggaguuaauuccuaacacaacacaccccuccagggcuugggagucucucuagaugagaaggcagagacaagaguggaagcagcugcccagagggcccagccaggagcuccuugacgccuggaccccucacaccaggccugcuggucccuacacaagccccuccacacagugcccaaagccugggaguugccgaaugagugcccuccacaugccaagccaaucuucauaugaaauaggacuacggaaggcaccaacuuccaugugagggc

SEQ ID NO: 20998 - RNA, 345 nt, Homo sapiens
gcccucacauggaaguuggugccuuccguaguccuauuucauaugaagauuggcuuggcauguggagggcacucauucggcaacucccaggcuuugggcacuguguggaggggcuuguguagggaccagcaggccuggugugagggguccaggcgucaaggagcuccuggcugggcccucugggcagcugcuuccacucuugucucugccuucucaucuagagagacucccaagcccuggagggguguguuguguuaggaauuaacucccugccuaccccaaggccucagaaauagauuauuagagaugugaauuauucuuugagacuugggauaagaaacagcc

SEQ ID NO: 20999 - RNA, 390 nt, Homo sapiens
cauaugacucaaaccacagcaacuguuuaaaauaaaguauggguguuuaccuaaaagcagccagcuauaggcaagaauguggaggcuaauguucuauaaugaugcucuuauacugggcaauaaccaaccaacuccaccagacauauccuaguaucuaggggcuuaaugccaaacacgcugaaagagacaaagaguggcauggaaaccuggagaugugugcaaagaaucaaaaucaggagucuguagacacacacggagagaaggugcagcauuagaagaaaccugagaagaguaaaccuugagcagucacugagauacagaauugcuacuguauuuuuguuggucauacggucuaaucaugaaccuaacaagguucccuauaauccuuac

SEQ ID NO: 21000 - RNA, 390 nt, Homo sapiens
guaaggauuauagggaaccuuguuagguucaugauuagaccguaugaccaacaaaaauacaguagcaauucuguaucucagugacugcucaagguuuacucuucucagguuucuucuaaugcugcaccuucucuccgugugugucuacagacuccugauuuugauucuuugcacacaucuccagguuuccaugccacucuuugucucuuucagcguguuuggcauuaagccccuagauacuaggauaugucugguggaguugguugguuauugcccaguauaagagcaucauuauagaacauuagccuccacauucuugccuauagcuggcugcuuuuagguaaacacccauacuuuauuuuaaacaguugcugugguuugagucauaug

SEQ ID NO: 21001 - RNA, 186 nt, Homo sapiens
cuagggaacccugcuacucauccucuaucaccagaagcccugcuuuuuucucuuugucuuucuuagcauuugugcugagugauauggcccacucugugauuaaaguauuguguuuaguauuaccuuuagcccaauacgcacaggucccuggcugguuccuugggugaagugugagaagcagcuugu

SEQ ID NO: 21002 - RNA, 186 nt, Homo sapiens
acaagcugcuucucacacuucacccaaggaaccagccagggaccugugcguauugggcuaaagguaauacuaaacacaauacuuuaaucacagagugggccauaucacucagcacaaaugcuaagaaagacaaagagaaaaaagcagggcuucuggugauagaggaugaguagcaggguucccuag

SEQ ID NO: 21003 - RNA, 918 nt, Homo sapiens
gaggauggaagccauacaggcuugaagugucugaacagauaacugacugaccucuaaacuacacagacauaggggcaaccacuagaagcuaagauaaaaaauuaaaaaauuuuaaaaacucaacaaggacaucaguggcuacaagagagcaagagagaaagauuccauaguucaaaguccacacaaauuacuaaaacaauuuggaguugcuauaauacauuaucuaaaagguccaauuuucaaccaaaaauuaguagauauacaaagaaacaggaaugugugacucauacuugggggaaaaaaaaacauucaguaggaauuaacccugaguagacucagauguuagggacuuccaagcaauuauaaauaugaucaaaagaauuaaaaagaaaaauaugguaacaaguuaacaacagggaaucucaacagucagaaauggaaauuuaaaaaaaucaaauggaaauucuacaugugaaaguacaauaacaaauuuuaaaaagaugaaagaaaagagccucaguaacucacaggacaaugucaaacccuccaacuuauguguaacaggaguuucagaaagaaaggaaggagagagaaaggagcagaaaaauauuugaaaaaaauaaugccugaaaacuucccaaauuugaugaaaauuauuaacuugcagauuuaagaaacucaacaauccucagguagaauaaacacaaagagaacuauaccuagacacaacacaguuaaaggcugaaagccaaagaucaagaggaaauccugcaagauauaacucaagacacuguuuaggauacaaacauauguagaaaaaguauaaagacauacaggcaauaaacaccaaauucaggacagaaaauaagggaaaauaauaaaaccauagugugauauacaggaagcuugaauuauaau

SEQ ID NO: 21004 - RNA, 918 nt, Homo sapiens
auuauaauucaagcuuccuguauaucacacuaugguuuuauuauuuucccuuauuuucuguccugaauuugguguuuauugccuguaugucuuuauacuuuuucuacauauguuuguauccuaaacagugucuugaguuauaucuugcaggauuuccucuugaucuuuggcuuucagccuuuaacuguguugugucuagguauaguucucuuuguguuuauucuaccugaggauuguugaguuucuuaaaucugcaaguuaauaauuuucaucaaauuugggaaguuuucaggcauuauuuuuuucaaauauuuuucugcuccuuucucucuccuuccuuucuuucugaaacuccuguuacacauaaguuggaggguuugacauuguccugugaguuacugaggcucuuuucuuucaucuuuuuaaaauuuguuauuguacuuucacauguagaauuuccauuugauuuuuuuaaauuuccauuucugacuguugagauucccuguuguuaacuuguuaccauauuuuucuuuuuaauucuuuugaucauauuuauaauugcuuggaagucccuaacaucugagucuacucaggguuaauuccuacugaauguuuuuuuuucccccaaguaugagucacacauuccuguuucuuuguauaucuacuaauuuuugguugaaaauuggaccuuuuagauaauguauuauagcaacuccaaauuguuuuaguaauuuguguggacuuugaacuauggaaucuuucucucuugcucucuuguagccacugauguccuuguugaguuuuuaaaauuuuuuaauuuuuuaucuuagcuucuagugguugccccuaugucuguguaguuuagaggucagucaguuaucuguucagacacuucaagccuguauggcuuccauccuc

SEQ ID NO: 21005 - RNA, 3655 nt, Homo sapiens
gaaggaaacaacauuuugcagucugauaaaagaaugaaccuuaaacuuuuagagaucuaaauucauuguagguaacaauagaaaacagacuuaauguuuuuauuucaagcuucaauaggcgucugucugcaucuuaaauguaucauauaauuugauaaaauugacccacucaaggucaagcccagucaucugacugccagacuucuaugagcaaguguaauuagcaccaagaagaaacacauaugcauaaacacagaacagccagugcugcuguuuauugccauuucacacuaaccccucuuaacucuucauguugaugugauuaaauacaaaauccauuucucugauggagcauuauguauguguauuuuaaggcugaagauacugucguaauagaaauaauauuuuauaccuuuggucauugucauucuaguaugagaaauuagagaauaugguugcuugaaaugucaguuuuuguaaacaugaguuggaagaugucacauaaaugaauggcauuacagacuguuuaagcuguaugaguaacaaauagacauuuccuugaauuauuuucacacaauuuacugugaauuuuuuccuguagaugauauuucuagguuccuugugcaaacaauaaaaaacuuucuuuuaugucagugcuuauuauuuaacuuauagaguacugauguauucuagaauacuaauauuucuagauauaaaaugaaugugaagauacaugugucuccauauuagucauaucaaaaggauacaugaaaguuugagccucuuuguaagguuuguauaaaagaggaaaauauucauauauauuacaguguucaguccucgcuuuuaaaagaucuuuauauaaaucucaauugggugugugugcaugcauguguguguguguguuugugugggugugguuuagagcaaauaaaaggagguugagaggugaaaauuacaggaauuuguuggaguauaccagccugucuauaauagaggaagugggcuacaaagcauaggaaaucagguugguuggguauugugguaccacauuaugcuggcuuugaaagccaguagagggaaguacagauauacaacuauuagaaacaggauacaccuauugacaacugugaauuuuagaaaaugccagacagaaagauacccaaagguagaggaauuagaaccaacacauaagcaggguuaagaagcuuucgucgaaaauucaagacuccuugcaaugaggaggcagggucagacuauaauauauaugaggacaagacugacagguauagaagaagaguucaugacacugacaauaaugaaaguguuuugauggccaaaauauuuccaucagcacugggaaagagauagggcucucagcauauaauguuucugagccaaugagcccacggaagcugugagggagagaaaccagagacaagagccugucaggcugcugcucugcguagcccaggacgccucuaagauaccuuugugccuaagggagggcuuuaaaaacacugcugggaaaguacgcacuguggcacuaagcaaagaucucuagauguggagcaaggaggcaugaguccuaguauuauuuaucccgcuaacuagcugauucucuucagaaagucacucugacuaaacuucaugauucccaggagaagacuagauuaguaauaauaguguaugcuagguggcauucuaauccucuacaugcauuaaaucaguuaacucucacaagaaucucaucauuuuacagauaaggaaacugaggaaguuaaguaauuugcccaagauaacacagcuagaaauuaaaagagcugggauuucgcccuaaauaggcuguuucuagagcccaaguccuuagccacuauuuauuggaguaccuuuaagguacuuccagauguacaauuuuguaauuuuaaagaaauacaacagaaauuacagaugacauaacacuugcaagagaacaaaagccucuagaaaacagauauuacgaugaacauaaacagauaaagcucuacuuuucauuucagaaauaaucauacucuuauaccuugccgugcucucuacugcugacaaauagaagagagagaaaauuuauaguuggaugauuuauuccuuuaaaaagauucaggucaaauauaauaggauuuugagaaauauuuuauauaagauguccuuggcuguuccaaccagcggguaacauuguuuugcaguuuaauuauuuagcuuuuacauauuuuaagcagucuccuccauaaacauauaguaaacaguuauaaagccauuaaaaauaguguuuauuauuuaaugaaaugugaagauauuuaugaaauauuauuaagcauauuaaacaucacauaaaggauguuuacuagaacauuaaacaauggcuauuuugagguaaugggaguuggauuuauaguuacuuuuuuuuuuacauuuucugcauuauuggguuuguaaaaauuuugagcacgcauucuuuuucauaagucagaaaaacagguaguuuauuguuucagaaagaaaaaacucuacagcucaagcuugagggccuauagccaccaggugggaacaggugcuagaugcuggaugguaaggaccagugaccucuuaaaagacaacuuagauaaagagagaggucagaauaauaccccuugagcuuuucaguuuauaaacaaaauaauauucacuucuaaaaaauugagauuuaauacacaugaaaaauagauaugacaaaaaucucagaaauugcucuaccauuuuuuuagacaacaauaucagguauaacuauccuguccaauuaaaauugccuaauauuaauuauauacaauaacauaaaguguuuccuucccuuacugacuaucuguauuauggccaaggaauguucuucuuuucgaugaauuaaucauuucuuuuucccuauuaaauccuuucucaaauugcucaagaaucucauaaaaugaaucuucauucccagccagcaaaacccuuaaagugauuugcuuauauuucuauggcauauaaguaagugaaaaccauaauacaguaaauaauuauaaugagauugaacaaaaacuggcuuccggacagguaccauuagugaauugcuauuucaguguccuaaacagucaccugaguuaauucaauuuucauauucuuuaauuuuugucuuuaaaaucacuauucagagaauggaaaacuggcucaaugucucaacugugacugauggcagucucugaacauucuuacuuauuuuguuuugcuauuuagaaauagucuaauaccaugaccaagaaucuaacaagagcuaucuaacaaguauuauuuaucuuauuagauuuaugacauugguagaacuggaaaagaagguacuaagaaaaaauaccaaaauaacagaaacuuauuuuuuaauaugauguauuuuaauguguucuguuaucuuuuaaguuuuauaaaccacagacauauauuaauuuucagauaugaaugacgacuguuuugaaaaaaaaaaacuuauuugucauauauagaggacauaaagugccgcugcccucacucaugcacucauuugacucauggcgcaguccugaauaauuuuaaaccaaacaugacugcggcaaucaauuuucguccaauuuauugg

SEQ ID NO: 21006 - RNA, 3655 nt, Homo sapiens
ccaauaaauuggacgaaaauugauugccgcagucauguuugguuuaaaauuauucaggacugcgccaugagucaaaugagugcaugagugagggcagcggcacuuuauguccucuauauaugacaaauaaguuuuuuuuuuucaaaacagucgucauucauaucugaaaauuaauauaugucugugguuuauaaaacuuaaaagauaacagaacacauuaaaauacaucauauuaaaaaauaaguuucuguuauuuugguauuuuuucuuaguaccuucuuuuccaguucuaccaaugucauaaaucuaauaagauaaauaauacuuguuagauagcucuuguuagauucuuggucaugguauuagacuauuucuaaauagcaaaacaaaauaaguaagaauguucagagacugccaucagucacaguugagacauugagccaguuuuccauucucugaauagugauuuuaaagacaaaaauuaaagaauaugaaaauugaauuaacucaggugacuguuuaggacacugaaauagcaauucacuaaugguaccuguccggaagccaguuuuuguucaaucucauuauaauuauuuacuguauuaugguuuucacuuacuuauaugccauagaaauauaagcaaaucacuuuaaggguuuugcuggcugggaaugaagauucauuuuaugagauucuugagcaauuugagaaaggauuuaauagggaaaaagaaaugauuaauucaucgaaaagaagaacauuccuuggccauaauacagauagucaguaagggaaggaaacacuuuauguuauuguauauaauuaauauuaggcaauuuuaauuggacaggauaguuauaccugauauuguugucuaaaaaaaugguagagcaauuucugagauuuuugucauaucuauuuuucauguguauuaaaucucaauuuuuuagaagugaauauuauuuuguuuauaaacugaaaagcucaagggguauuauucugaccucucucuuuaucuaaguugucuuuuaagaggucacugguccuuaccauccagcaucuagcaccuguucccaccugguggcuauaggcccucaagcuugagcuguagaguuuuuucuuucugaaacaauaaacuaccuguuuuucugacuuaugaaaaagaaugcgugcucaaaauuuuuacaaacccaauaaugcagaaaauguaaaaaaaaaaguaacuauaaauccaacucccauuaccucaaaauagccauuguuuaauguucuaguaaacauccuuuaugugauguuuaauaugcuuaauaauauuucauaaauaucuucacauuucauuaaauaauaaacacuauuuuuaauggcuuuauaacuguuuacuauauguuuauggaggagacugcuuaaaauauguaaaagcuaaauaauuaaacugcaaaacaauguuacccgcugguuggaacagccaaggacaucuuauauaaaauauuucucaaaauccuauuauauuugaccugaaucuuuuuaaaggaauaaaucauccaacuauaaauuuucucucucuucuauuugucagcaguagagagcacggcaagguauaagaguaugauuauuucugaaaugaaaaguagagcuuuaucuguuuauguucaucguaauaucuguuuucuagaggcuuuuguucucuugcaaguguuaugucaucuguaauuucuguuguauuucuuuaaaauuacaaaauuguacaucuggaaguaccuuaaagguacuccaauaaauaguggcuaaggacuugggcucuagaaacagccuauuuagggcgaaaucccagcucuuuuaauuucuagcuguguuaucuugggcaaauuacuuaacuuccucaguuuccuuaucuguaaaaugaugagauucuugugagaguuaacugauuuaaugcauguagaggauuagaaugccaccuagcauacacuauuauuacuaaucuagucuucuccugggaaucaugaaguuuagucagagugacuuucugaagagaaucagcuaguuagcgggauaaauaauacuaggacucaugccuccuugcuccacaucuagagaucuuugcuuagugccacagugcguacuuucccagcaguguuuuuaaagcccucccuuaggcacaaagguaucuuagaggcguccugggcuacgcagagcagcagccugacaggcucuugucucugguuucucucccucacagcuuccgugggcucauuggcucagaaacauuauaugcugagagcccuaucucuuucccagugcugauggaaauauuuuggccaucaaaacacuuucauuauugucagugucaugaacucuucuucuauaccugucagucuuguccucauauauauuauagucugacccugccuccucauugcaaggagucuugaauuuucgacgaaagcuucuuaacccugcuuauguguugguucuaauuccucuaccuuuggguaucuuucugucuggcauuuucuaaaauucacaguugucaauagguguauccuguuucuaauaguuguauaucuguacuucccucuacuggcuuucaaagccagcauaaugugguaccacaauacccaaccaaccugauuuccuaugcuuuguagcccacuuccucuauuauagacaggcugguauacuccaacaaauuccuguaauuuucaccucucaaccuccuuuuauuugcucuaaaccacacccacacaaacacacacacacacaugcaugcacacacacccaauugagauuuauauaaagaucuuuuaaaagcgaggacugaacacuguaauauauaugaauauuuuccucuuuuauacaaaccuuacaaagaggcucaaacuuucauguauccuuuugauaugacuaauauggagacacauguaucuucacauucauuuuauaucuagaaauauuaguauucuagaauacaucaguacucuauaaguuaaauaauaagcacugacauaaaagaaaguuuuuuauuguuugcacaaggaaccuagaaauaucaucuacaggaaaaaauucacaguaaauugugugaaaauaauucaaggaaaugucuauuuguuacucauacagcuuaaacagucuguaaugccauucauuuaugugacaucuuccaacucauguuuacaaaaacugacauuucaagcaaccauauucucuaauuucucauacuagaaugacaaugaccaaagguauaaaauauuauuucuauuacgacaguaucuucagccuuaaaauacacauacauaaugcuccaucagagaaauggauuuuguauuuaaucacaucaacaugaagaguuaagagggguuagugugaaauggcaauaaacagcagcacuggcuguucuguguuuaugcauauguguuucuucuuggugcuaauuacacuugcucauagaagucuggcagucagaugacugggcuugaccuugagugggucaauuuuaucaaauuauaugauacauuuaagaugcagacagacgccuauugaagcuugaaauaaaaacauuaagucuguuuucuauuguuaccuacaaugaauuuagaucucuaaaaguuuaagguucauucuuuuaucagacugcaaaauguuguuuccuuc

SEQ ID NO: 21007 - RNA, 540 nt, Homo sapiens
gcuugcuucccacccaagucgagagaagcccuuugaagacuuccucccaucgcauuauaauuaucugcaguuugccuacuauaacaguaaggccuacuuuccuuccucuuucucugcuggcuaacuaagaagcuaaaggcaaggugggcagggauuacagccacuuacuuccucaagguguuuggcuuauuucaguagcuaugggaggcaccaugccaagugaucccuggguaguuuguuauaaacaacuggccuaggaagccaauaccagcaacccaaaaagcugggggagggagacuuaggaccucaucucuugucccuucuauaacuuguaaucuauuuuugcuuuugaauuaaaguuaauagcaaaauaaggguaugccacaguuuaaacuagcucagaggacauuugcuagcccucucccugguauagcacugaugcuuuuguggggcugccaauuaauacccagaaaaccaacucuuugcagagucccuacugugugcuaagcauuacaaacauauugaugaguguacaauauu

SEQ ID NO: 21008 - RNA, 540 nt, Homo sapiens
aauauuguacacucaucaauauguuuguaaugcuuagcacacaguagggacucugcaaagaguugguuuucuggguauuaauuggcagccccacaaaagcaucagugcuauaccagggagagggcuagcaaauguccucugagcuaguuuaaacuguggcauacccuuauuuugcuauuaacuuuaauucaaaagcaaaaauagauuacaaguuauagaagggacaagagaugagguccuaagucucccucccccagcuuuuuggguugcugguauuggcuuccuaggccaguuguuuauaacaaacuacccagggaucacuuggcauggugccucccauagcuacugaaauaagccaaacaccuugaggaaguaaguggcuguaaucccugcccaccuugccuuuagcuucuuaguuagccagcagagaaagaggaaggaaaguaggccuuacuguuauaguaggcaaacugcagauaauuauaaugcgaugggaggaagucuucaaagggcuucucucgacuugggugggaagcaagc

SEQ ID NO: 21009 - RNA, 355 nt, Homo sapiens
cacagagaaacaccaugagaacuguaagagagaaauguugaccuuugcccuauaguugcuuaaauuaacagugguuaauuaaacaagauuagcguaugaaaagaauuuguccagcauuccuuuguuuucagaccacuuucacuuuguuauuucucuugauucuuauaacugagaggugagucaugcagauugcaagauccuuauuuuaaaugaauaaugaugaugauaccaugguagccaaacuuuugaggacuuaccauaugccaaauauuguacuaagcuuuuaacuugccuuccuuguucuuaacauuauacuggcaucaaacauauaagguagaugcuguuugacagauga

SEQ ID NO: 21010 - RNA, 355 nt, Homo sapiens
ucaucugucaaacagcaucuaccuuauauguuugaugccaguauaauguuaagaacaaggaaggcaaguuaaaagcuuaguacaauauuuggcauaugguaaguccucaaaaguuuggcuaccaugguaucaucaucauuauucauuuaaaauaaggaucuugcaaucugcaugacucaccucucaguuauaagaaucaagagaaauaacaaagugaaaguggucugaaaacaaaggaaugcuggacaaauucuuuucauacgcuaaucuuguuuaauuaaccacuguuaauuuaagcaacuauagggcaaaggucaacauuucucucuuacaguucucaugguguuucucugug

SEQ ID NO: 21011 - RNA, 188 nt, Homo sapiens
gccccuuccucccgccccgacgggcccccucucacccccgugaccagucugagcccgggccccauuccaucuccgcuugcgcggcccgaccaccgccccccuuucggccgccccccuccccagcgcugcguuagggcuucgcaaggcugcgccccgccccguccccaccggucuccuucaauccuccu

SEQ ID NO: 21012 - RNA, 188 nt, Homo sapiens
aggaggauugaaggagaccgguggggacggggcggggcgcagccuugcgaagcccuaacgcagcgcuggggaggggggcggccgaaaggggggcgguggucgggccgcgcaagcggagauggaauggggcccgggcucagacuggucacgggggugagagggggcccgucggggcgggaggaaggggc

SEQ ID NO: 21013 - RNA, 4620 nt, Homo sapiens
auuucauacaugacccccaagggaagccauaucagguuccuagaguugggagaagagagacucagggggaaccuguacugaagugacuguggcagaggcagggugaggcugaagagcaccagaacaugagacauuuccccgcugucacuuaguaacaagggcccugugaugauuaauuuuaucugucaacuugagggaggcugaggcacaagaauugcuugagccugggagguagaaguugcagugagccaagaucgugccacugcacuccagccugggcaacaaagugagacuccaucucaaaaaauaaaauaaaaauacaauacaauacaauaaaauuggccgggcacaguggcuuacaccuguaaucccaguacuuugggaggccgagguggggggaucacuugaggucgggaguucgagaacagccuggccaacaugaugaaaucccgucucuacuaaaaacacaaaaauuagccgggcauagcggcacaugccuguagucccagcuacucagggggcugaggcaggagaaucgcuugaacucaggaggcggggguugcagugagccgagaucaugccacacugcacuccagccugggcgacagaguacaacuuuggcaaaaauaaaauaaaauaaauaaaauuuuaucugucaauuuggcugggccacaaugcccagauacuuggucaaacauuauucuggccccauccaauugauugaaggccugaauagaacaaaaggcugacacccacccacuccccaacccacacccgaagagggacuucugcagcaggcugccuuuggacuuugucugcaacaucaguucuucaggguucacuggcagacugccuuugaacuugagcugcaaugcuuuccugaggcuucccugguaagauuucaaacuugccaagccuucacaaucacaucagccaauuccuuaagacaaauauuuuuauauguauauacacacacauccuuuugguucuguuucucugggagcccugcuaauauaagcaguauuucuuucuccaggauuagccauuggaacagauuguaagugcagcucugaccucaccaaaaggagacaguaauccagggacaggagcuuucuggguaggagcugaggcuuuagugcagugacuuaguaaagacagccaauuaaagaguccugugagaaacgcucacaacgccuucaacuagauaagggguacugggaacucccacuucuaaguaugcucauggccgguguaucuuuggagaaauguggguuugcugaaauuccagagcacauaugaaaaaaagcucaucaucacuggucauuagagaaaugcaaaucaaaaccauaaugagauaccaucucaggccaguuagaauggcaaucauuaaaaagucaggaaacaacagaugcuggagaggauguggagaaauaggaacacuuuuacacuguugggaguguaaauuaguucaaccauugugaaagaccguguggcgauuccucaaggaucuagaaccagaaauaccauuugacccagcaaucccauuacuggguauauacccaaaggauuauaaaucauucuacuauaaagacacauguggcugggugcgguggcucacgccuguaaucccagcacuuugggaggccgaggcuggcagaucacgaggucaagaguuugagaccagccugaaacuaugagguuucaacauagugaaaccucaucucuacuaaaaauacaaaaauuagcugggcauaguggcaugagccuguaaucccaguuacuuaggaggcuggggcaggagaaucgcuugaaccugagaggcggagguugcagugagcugagaucacaccacugcauuccagccugggugacagggcgagacuccaucucaaaaaaaagaagacaaaugcacacguauguuuauugcagcacuauuuacaauaguaaagacuuggaaccaacccaaauccccaucaaugauagauuggguaaagaacauguggcacauauacagaaaaucuggcacauauacaccauggaauacuaugcagccauaaaaaagaaugaguucauguccuuugcagggacauggaugaagcuagaaacaucauucucagcaaacuaacacaggaacagaaaaccuaauacugcauauuaucacucaugggugggaguugaacaaugagaacacauggacacagggaggagaacaucauacaccagggccuguugggggguagggggcagggggagggauagcauuaggagaaauaccuaaugcaugcggggcuuaaaaccuagaugacggguugaugggugcagcaaaccaccauggcacauguauaccuauguaacaaaccugcacguucugcacauguaucccagaacuuaaaguauaauaauaauaauaauaauaauccagagcaauucccuccugcccugucugagauuugauguaaaaaaugcgucuuccaggcugggcacgguggcucacgccuguaauuccagcacuuugggaggccgaggcaggcggaucaugaggucaggagauugagaccauccuggcuaagauggugaaaccccgucucuacuaaaaauacaaaaaaauuagcugagugugguggcaggugccgguagucccagcuacucgggaggccgaggcaggagaauggcgugaacccgggaggcagagcuugcagugagccaagauggugccacuguacuccagccugggcgacagagcgagacuccaucucaaaaaaaccaaaaauaaauaaauaaaauaaugaaaauuuaaaaaugcuucuuccggccaggcgcgguggcucacgccuguaaucccaacacuuucggaggccgaggcaggcggaucaccugaggucaggaguucaagaccaaccuggccaacaugccaaaaccccaucucuacuaaaaauacaaaaauuagcagggcaugguggcgggcgccggcagucccagcuacuugggaggcugaggcaggagaauggugugaaccugggaagcagagcuugcagugagccuagaucaugccacugcacuccagccugggugacagaacaagacucugucucaaaaaaaaagaaagcuucuucuagggagguuuagucucaggcuggcucuccaggcccagaaggggucaucucaaauuucugcucuuuguggacagagcuaaucaaauacuuuuuggguagggacagcagacauugccauauucagcuucuugaagcuccuucagacaguggaagcuggaccuugaagcuccccuaacaaauaauguagcaauuguugagaguccucauggucaugggauaaugcuuggcagucaacaggggcucacauucugaaauaaguaacgccaacauggucaugcuuacugaaaacuguaaacuacuuugaagcauacagaaauguguauucugaaauaagagacaggcugauaaaagaggaaaagaaaaagggguuugcuugguucuuaagagacagggaugggaguucccuguaagcagaguugcacaagagaugguauggaggcagaaaagaggaagcagggagcaaggcaaggccaaagucaacugaaacaggaaaacuagccagaaagcacauugcuugcucuuugaagacauuuccuucaaguucugccuugccccaaaaccuaacccaggccaggguggugagcgcucucaccucugagccucugacacauggacugcauguacugcuauugcuccuuggcauauggcccaauuuucugaaaucauaagcauuucugugcaaccauccugucacuccaguuaaauuucaagacagauuuuuuuuuugaauaguauauccuuaguggaagaaauaggaaccauuuuauuuuauucauuuauuuuuuuugagacggagucuugcucugucacccaggcuguaguggaauggcgcgaucuuggcucacuguaacuucugccuccuggguucaagccauucuucugccucagccuccugaguagcugggauuacaggcgcccgcuaccacacccagcuaauuuuuuuuuguauauuuaguagagacgggguuuugccauauuggccagucuagucucgaacuccuaacuucaggugauccacccaccucagccuaccaaauugcagggauuacaggcgucagccaccgcgcccggcuccagacuggguuuuuuagcaaagaaggaauuaauacagggaaguuggugcucaugaaauaguugaaaguacugaaggaauaagcauguaggcuggggccuucuggaaugucuaccugaaugccacagaacugacccucauuucccucccuccagaagcuacaaccucagcccagauuagcaggcugaggggucaggaggcugucacuggagcuguugagcucaugaacacgccgaaguugcugcgcuccagaaauguggaaguuggaaugaagagccaccacugcugccaccaacaugaagcuugaccaagcaagccaagaaaagauggccaagagccucugccuuccuucugccuucugcaacgcaauggugagcugcacauccacaacuugaagggagucugggaaaugcagaguuaaacuuucuagccucu

SEQ ID NO: 21014 - RNA, 4620 nt, Homo sapiens
agaggcuagaaaguuuaacucugcauuucccagacucccuucaaguuguggaugugcagcucaccauugcguugcagaaggcagaaggaaggcagaggcucuuggccaucuuuucuuggcuugcuuggucaagcuucauguugguggcagcagugguggcucuucauuccaacuuccacauuucuggagcgcagcaacuucggcguguucaugagcucaacagcuccagugacagccuccugaccccucagccugcuaaucugggcugagguuguagcuucuggagggagggaaaugagggucaguucuguggcauucagguagacauuccagaaggccccagccuacaugcuuauuccuucaguacuuucaacuauuucaugagcaccaacuucccuguauuaauuccuucuuugcuaaaaaacccagucuggagccgggcgcgguggcugacgccuguaaucccugcaauuugguaggcugagguggguggaucaccugaaguuaggaguucgagacuagacuggccaauauggcaaaaccccgucucuacuaaauauacaaaaaaaaauuagcugggugugguagcgggcgccuguaaucccagcuacucaggaggcugaggcagaagaauggcuugaacccaggaggcagaaguuacagugagccaagaucgcgccauuccacuacagccugggugacagagcaagacuccgucucaaaaaaaauaaaugaauaaaauaaaaugguuccuauuucuuccacuaaggauauacuauucaaaaaaaaaaucugucuugaaauuuaacuggagugacaggaugguugcacagaaaugcuuaugauuucagaaaauugggccauaugccaaggagcaauagcaguacaugcaguccaugugucagaggcucagaggugagagcgcucaccacccuggccuggguuagguuuuggggcaaggcagaacuugaaggaaaugucuucaaagagcaagcaaugugcuuucuggcuaguuuuccuguuucaguugacuuuggccuugccuugcucccugcuuccucuuuucugccuccauaccaucucuugugcaacucugcuuacagggaacucccaucccugucucuuaagaaccaagcaaaccccuuuuucuuuuccucuuuuaucagccugucucuuauuucagaauacacauuucuguaugcuucaaaguaguuuacaguuuucaguaagcaugaccauguuggcguuacuuauuucagaaugugagccccuguugacugccaagcauuaucccaugaccaugaggacucucaacaauugcuacauuauuuguuaggggagcuucaagguccagcuuccacugucugaaggagcuucaagaagcugaauauggcaaugucugcugucccuacccaaaaaguauuugauuagcucuguccacaaagagcagaaauuugagaugaccccuucugggccuggagagccagccugagacuaaaccucccuagaagaagcuuucuuuuuuuuugagacagagucuuguucugucacccaggcuggagugcaguggcaugaucuaggcucacugcaagcucugcuucccagguucacaccauucuccugccucagccucccaaguagcugggacugccggcgcccgccaccaugcccugcuaauuuuuguauuuuuaguagagaugggguuuuggcauguuggccagguuggucuugaacuccugaccucaggugauccgccugccucggccuccgaaaguguugggauuacaggcgugagccaccgcgccuggccggaagaagcauuuuuaaauuuucauuauuuuauuuauuuauuuuugguuuuuuugagauggagucucgcucugucgcccaggcuggaguacaguggcaccaucuuggcucacugcaagcucugccucccggguucacgccauucuccugccucggccucccgaguagcugggacuaccggcaccugccaccacacucagcuaauuuuuuuguauuuuuaguagagacgggguuucaccaucuuagccaggauggucucaaucuccugaccucaugauccgccugccucggccucccaaagugcuggaauuacaggcgugagccaccgugcccagccuggaagacgcauuuuuuacaucaaaucucagacagggcaggagggaauugcucuggauuauuauuauuauuauuauuauacuuuaaguucugggauacaugugcagaacgugcagguuuguuacauagguauacaugugccauggugguuugcugcacccaucaacccgucaucuagguuuuaagccccgcaugcauuagguauuucuccuaaugcuaucccucccccugcccccuaccccccaacaggcccugguguaugauguucuccucccuguguccauguguucucauuguucaacucccacccaugagugauaauaugcaguauuagguuuucuguuccuguguuaguuugcugagaaugauguuucuagcuucauccaugucccugcaaaggacaugaacucauucuuuuuuauggcugcauaguauuccaugguguauaugugccagauuuucuguauaugugccacauguucuuuacccaaucuaucauugauggggauuuggguugguuccaagucuuuacuauuguaaauagugcugcaauaaacauacgugugcauuugucuucuuuuuuuugagauggagucucgcccugucacccaggcuggaaugcaguggugugaucucagcucacugcaaccuccgccucucagguucaagcgauucuccugccccagccuccuaaguaacugggauuacaggcucaugccacuaugcccagcuaauuuuuguauuuuuaguagagaugagguuucacuauguugaaaccucauaguuucaggcuggucucaaacucuugaccucgugaucugccagccucggccucccaaagugcugggauuacaggcgugagccaccgcacccagccacaugugucuuuauaguagaaugauuuauaauccuuuggguauauacccaguaaugggauugcugggucaaaugguauuucugguucuagauccuugaggaaucgccacacggucuuucacaaugguugaacuaauuuacacucccaacaguguaaaaguguuccuauuucuccacauccucuccagcaucuguuguuuccugacuuuuuaaugauugccauucuaacuggccugagaugguaucucauuaugguuuugauuugcauuucucuaaugaccagugaugaugagcuuuuuuucauaugugcucuggaauuucagcaaacccacauuucuccaaagauacaccggccaugagcauacuuagaagugggaguucccaguaccccuuaucuaguugaaggcguugugagcguuucucacaggacucuuuaauuggcugucuuuacuaagucacugcacuaaagccucagcuccuacccagaaagcuccugucccuggauuacugucuccuuuuggugaggucagagcugcacuuacaaucuguuccaauggcuaauccuggagaaagaaauacugcuuauauuagcagggcucccagagaaacagaaccaaaaggauguguguguauauacauauaaaaauauuugucuuaaggaauuggcugaugugauugugaaggcuuggcaaguuugaaaucuuaccagggaagccucaggaaagcauugcagcucaaguucaaaggcagucugccagugaacccugaagaacugauguugcagacaaaguccaaaggcagccugcugcagaagucccucuucggguguggguuggggagugggugggugucagccuuuuguucuauucaggccuucaaucaauuggauggggccagaauaauguuugaccaaguaucugggcauuguggcccagccaaauugacagauaaaauuuuauuuauuuuauuuuauuuuugccaaaguuguacucugucgcccaggcuggagugcaguguggcaugaucucggcucacugcaacccccgccuccugaguucaagcgauucuccugccucagcccccugaguagcugggacuacaggcaugugccgcuaugcccggcuaauuuuuguguuuuuaguagagacgggauuucaucauguuggccaggcuguucucgaacucccgaccucaagugauccccccaccucggccucccaaaguacugggauuacagguguaagccacugugcccggccaauuuuauuguauuguauuguauuuuuauuuuauuuuuugagauggagucucacuuuguugcccaggcuggagugcaguggcacgaucuuggcucacugcaacuucuaccucccaggcucaagcaauucuugugccucagccucccucaaguugacagauaaaauuaaucaucacagggcccuuguuacuaagugacagcggggaaaugucucauguucuggugcucuucagccucacccugccucugccacagucacuucaguacagguucccccugagucucucuucucccaacucuaggaaccugauauggcuucccuugggggucauguaugaaau

SEQ ID NO: 21015 - RNA, 321 nt, Homo sapiens
ugaggcacaagggcauccuaaugaacuaggucacugcaaaguggacuguccaauagaggaaggaaggggagaaaaggcugugaugagguaaaccuugaacucucagagcucuguuguagcccaggagauaauuaccagccugcuaggccuggcagggucgguggggcugagccuuccgaaguucuuucuagagcagucauggucaccagugacucgagccaguuuacuccccucuugcacccagccacucaaucagagugcaaacugcccgaugccagaccacagcuccuagcaaugugauaaucuggugcccaggaaugu

SEQ ID NO: 21016 - RNA, 321 nt, Homo sapiens
acauuccugggcaccagauuaucacauugcuaggagcuguggucuggcaucgggcaguuugcacucugauugaguggcugggugcaagaggggaguaaacuggcucgagucacuggugaccaugacugcucuagaaagaacuucggaaggcucagccccaccgacccugccaggccuagcaggcugguaauuaucuccugggcuacaacagagcucugagaguucaagguuuaccucaucacagccuuuucuccccuuccuuccucuauuggacaguccacuuugcagugaccuaguucauuaggaugcccuugugccuca

SEQ ID NO: 21017 - RNA, 3365 nt, Homo sapiens
auucaaaguuccuuucaguuagaaguuuaauuuuuccuuguucugccugcugaaugacaaagggaaaggguagaguaaccuggaugaaaauaaauuuuuaaaaauugcacugagauacauugcaucuuuuaaauuuuauuuagcaaaguuaaacauacauauauuuuaaaagagaaaaagaggaacucacccaacccucauauccaagagcuuaaaaucacaggaacucaagacccauccucaacuucaaaugccagucauuauuuuagagguaacucagauuucuaaguaaugcuucuguuucucgauuuaucaaauagacauuauuuauuuuguuuuccuacaugagaauugaguaguuaacagaauacccaucucuuaucaguaacaaagauuuacaaaauaacuuuuguuuuucauaauuacaaaagcaauacauuauuauugaagaacauguuuuaaaaaaagacaaaaaguaacaaaacucuccauuaucccaacaggcagaggaaguuauuaccauuuuaaugcauauccuuaacacauacauguaaaagauacauauacacauaaaaauauaaauguuuaacagaaauuacuuuguacacaauauuugauuaaacuaugaucugucuucuuucauuuucguuuuauuguaguaaaauuuacauaaaaugcauaaaucuuaaaucuauacauuuuuacauuacauagaaauguguaauuauauacuccaugcucccucccaaucagugcugccucaaaacgaacugcucuucuaauuuuagagcuuaacucuucucgucucuaucaccacagauuaguuguauuuuuaagcuucauguaaaauuuuccaugucaacuuugaaaacaugacaguuaaaaguucuaaggaaucuccaguucuccaacuggugugggaaucagauaacuugacuccagugugaauugugguuacugaugguaucacugagucuguuaugggccacccagucuuaagggccaagaauuuauggcccugcagggauugcagaaagaaaccaaaccgaaguucauaacucagccuaaaaggagaaaguucuauuacucaguaucucaagacuaaguggaucauaaauggugucacaaguuugcaguuuuuuuuuccuguggaagauaauaaucuuuuguauguuuaauucguuaucauugccuuauaaauuaucacaagcagcacagauaacuacuggagucaucagugcaacuuaaaacaacaaaacuagcauuucucacuugcuguuuuucagacaccucccaucaucugcaccugguccccaaaccagcuguccaugagcaaugacaaagaacuaaagcggggaugggggagaggggguguagggcccaagagcuggggagcauuauggcuugcugucagcuggcagucuaagauguacuugggaagauguuucauacccauuuucccugugaaauuaaaaaugugaugcuaccaaaccuuugcuuguccaccacccuuaaaagaauacucauucaguacaaagcccugcaaaaaggagugagccaauuugaauaaaagcggaaacuucguaggaauuaggagccugaaaggcugcgugagagaucgcaaacauauugaggcguucuugaaacaccugcucucugauuacaggugggaaaaggccauuccuaugccuucucccaugggcacggcgaaucaaaggcacuuuccauauuuaauacgacuaauacgucauugggcaaagagauacucaauacauccccauagcuuuuccuuacuuuuacuuaaccuuuaugucggacgcuuuaugccuaguacuguucuaagcgcuuugcaugcaucaucucaucaaccuaauauuuaauaagaggcucggauagauuaacuuuuaaaaucuggauacagcugguuaagguggcagaagaguuggaauucaaauaaaagccaguccuauagcagggccauuauugcuccugccuccccuagcuugaucacgaaaaaugaguaguucuuuccucugggcacacaggacaaugaacaggcgggcugcugccagaauuuaccgaagauggccgcugugcugggcucggagugagcugacggugucucagcgagaaaagucgggagcggcagcagacugcuuuuuuggagggcaagaggggagaaaaggguucaacggaaaacggggguaacauaagagcccgaauaagggaaaaggaaaccccugacuccccuagccacagaaagcgcugggcggaaaugaaccggccuaggacgcgcccugcguggaggcaggcccgcgcggcggaagugcguuucuggggcuccuccugaagaaugcggaggaggaacugagcuggcgcgcgggccagcuguccucucuucugaucccgaagacaggaucggauuauggguuguuaccggcuugugcggcccuggggguugccgguuccuggagacgagcugcaccccugcaguuuacugggcucuucugugacccgcuuuccgaccccgccugggguauucagaccggggcagacaaggcccuucugccccuccuagcggccgccucuccuaggcuggagggcggcgccccauaugacacagaaggcggcuagggauacgcccuguaccaugccggccagucuggauugcccuaacgccaggccccgacucgcucuggccagcgggcaugcggcgaguuugcccccgcagcgcagccgcccacaacucggucuuccagaggagcgaacguucggacugcuugguaguuuacuagggcaaaguaccaccccaccccgagcgagcaagcggaccucaggaaaggggcuccuucuguguaaagugaucggcaggccuugcaguggaucuucgguguccauaguuauauaccaaucacuauuuugucuacaucauuuggacugugcagaaugagaugccaauaauauaucacauacaguaaaagggcuauuuucacaaaaggucaaaacugggauauauaaccucuuucuuuugauuagucagacugacuucaaagggggcuuaggguugcuuauuaaagaaaaaugccuccccguggguuuucauuugagccacuuauaagugggcuaguuucuccaacaccaauugagcuggaaacuagaguaauuagaacacaacauauucccgaccugaacaggauacugaaauaaguuaaaagccucauuacuuaccagccuucucucagaacccuaacaccccuugcaagggauuucuaacuaggagucgguagauaaaauuuagaaugugugagcauuauguaauacacauguaaaacauucugagaugggauccacgggcuuuugggggc

SEQ ID NO: 21018 - RNA, 3365 nt, Homo sapiens
gcccccaaaagcccguggaucccaucucagaauguuuuacauguguauuacauaaugcucacacauucuaaauuuuaucuaccgacuccuaguuagaaaucccuugcaagggguguuaggguucugagagaaggcugguaaguaaugaggcuuuuaacuuauuucaguauccuguucaggucgggaauauguuguguucuaauuacucuaguuuccagcucaauugguguuggagaaacuagcccacuuauaaguggcucaaaugaaaacccacggggaggcauuuuucuuuaauaagcaacccuaagcccccuuugaagucagucugacuaaucaaaagaaagagguuauauaucccaguuuugaccuuuugugaaaauagcccuuuuacuguaugugauauauuauuggcaucucauucugcacaguccaaaugauguagacaaaauagugauugguauauaacuauggacaccgaagauccacugcaaggccugccgaucacuuuacacagaaggagccccuuuccugagguccgcuugcucgcucgggguggggugguacuuugcccuaguaaacuaccaagcaguccgaacguucgcuccucuggaagaccgaguugugggcggcugcgcugcgggggcaaacucgccgcaugcccgcuggccagagcgagucggggccuggcguuagggcaauccagacuggccggcaugguacagggcguaucccuagccgccuucugugucauauggggcgccgcccuccagccuaggagaggcggccgcuaggaggggcagaagggccuugucugccccggucugaauaccccaggcggggucggaaagcgggucacagaagagcccaguaaacugcaggggugcagcucgucuccaggaaccggcaacccccagggccgcacaagccgguaacaacccauaauccgauccugucuucgggaucagaagagaggacagcuggcccgcgcgccagcucaguuccuccuccgcauucuucaggaggagccccagaaacgcacuuccgccgcgcgggccugccuccacgcagggcgcguccuaggccgguucauuuccgcccagcgcuuucuguggcuaggggagucagggguuuccuuuucccuuauucgggcucuuauguuacccccguuuuccguugaacccuuuucuccccucuugcccuccaaaaaagcagucugcugccgcucccgacuuuucucgcugagacaccgucagcucacuccgagcccagcacagcggccaucuucgguaaauucuggcagcagcccgccuguucauuguccugugugcccagaggaaagaacuacucauuuuucgugaucaagcuaggggaggcaggagcaauaauggcccugcuauaggacuggcuuuuauuugaauuccaacucuucugccaccuuaaccagcuguauccagauuuuaaaaguuaaucuauccgagccucuuauuaaauauuagguugaugagaugaugcaugcaaagcgcuuagaacaguacuaggcauaaagcguccgacauaaagguuaaguaaaaguaaggaaaagcuauggggauguauugaguaucucuuugcccaaugacguauuagucguauuaaauauggaaagugccuuugauucgccgugcccaugggagaaggcauaggaauggccuuuucccaccuguaaucagagagcagguguuucaagaacgccucaauauguuugcgaucucucacgcagccuuucaggcuccuaauuccuacgaaguuuccgcuuuuauucaaauuggcucacuccuuuuugcagggcuuuguacugaaugaguauucuuuuaagggugguggacaagcaaagguuugguagcaucacauuuuuaauuucacagggaaaauggguaugaaacaucuucccaaguacaucuuagacugccagcugacagcaagccauaaugcuccccagcucuugggcccuacacccccucucccccauccccgcuuuaguucuuugucauugcucauggacagcugguuuggggaccaggugcagaugaugggaggugucugaaaaacagcaagugagaaaugcuaguuuuguuguuuuaaguugcacugaugacuccaguaguuaucugugcugcuugugauaauuuauaaggcaaugauaacgaauuaaacauacaaaagauuauuaucuuccacaggaaaaaaaaacugcaaacuugugacaccauuuaugauccacuuagucuugagauacugaguaauagaacuuucuccuuuuaggcugaguuaugaacuucgguuugguuucuuucugcaaucccugcagggccauaaauucuuggcccuuaagacuggguggcccauaacagacucagugauaccaucaguaaccacaauucacacuggagucaaguuaucugauucccacaccaguuggagaacuggagauuccuuagaacuuuuaacugucauguuuucaaaguugacauggaaaauuuuacaugaagcuuaaaaauacaacuaaucuguggugauagagacgagaagaguuaagcucuaaaauuagaagagcaguucguuuugaggcagcacugauugggagggagcauggaguauauaauuacacauuucuauguaauguaaaaauguauagauuuaagauuuaugcauuuuauguaaauuuuacuacaauaaaacgaaaaugaaagaagacagaucauaguuuaaucaaauauuguguacaaaguaauuucuguuaaacauuuauauuuuuauguguauauguaucuuuuacauguauguguuaaggauaugcauuaaaaugguaauaacuuccucugccuguugggauaauggagaguuuuguuacuuuuugucuuuuuuuaaaacauguucuucaauaauaauguauugcuuuuguaauuaugaaaaacaaaaguuauuuuguaaaucuuuguuacugauaagagauggguauucuguuaacuacucaauucucauguaggaaaacaaaauaaauaaugucuauuugauaaaucgagaaacagaagcauuacuuagaaaucugaguuaccucuaaaauaaugacuggcauuugaaguugaggaugggucuugaguuccugugauuuuaagcucuuggauaugaggguugggugaguuccucuuuuucucuuuuaaaauauauguauguuuaacuuugcuaaauaaaauuuaaaagaugcaauguaucucagugcaauuuuuaaaaauuuauuuucauccagguuacucuacccuuucccuuugucauucagcaggcagaacaaggaaaaauuaaacuucuaacugaaaggaacuuugaau

SEQ ID NO: 21019 - RNA, 2188 nt, Homo sapiens
agacgcaaagaggaaauggugauugugacaccuauuaccugaguguuuccaagcaccaggccugugcugagcgccuuacaaauauuaauuucacccauccagcaacgcuaaggguggugcuauuauugcccccauuuuucagaugaggaggcuggggcuuaguuaagguuaaguaguuuauccaaggcccugugccgcgaggaacagcgagaaguggaggccgaaagcgaaggagagauagugacugucagaaagagaaacggagguggacagagaguggaggagagauaggugagagacaugcgaacugacagaucaaagcguggcugcagcugagcugggacgcagaaagggagccugcgcuugcucugggcugcggacagcccgaggcagagacaguguguaaauuggagacaggaaaacacuaucccggcuggaacaauggaggguggagacggcagccucuauccacccccuucccagaacccgggcauccuguccccagugagcagggcugucucuugccacccauggggaccuugcgccucucaccucaggcuggcuggcuucccaucugaccccuagcuggaggacaucauuugguccccaggaagaggcugccucacccacccucuuucucuucucuccugcagcucccauggggugggagccagguguucuggcuccccucuccacccuucccagcgcccaaugccccccacauugccggcccccgaggggauuccuguacccucccuccuccacucuccacugccaggggcugugcaguuuuuccuaauccccccccuuccuccagugccuguccccucccccgaugauccgagccaagccagguguguucaccccucccauucauaccgccccccagaaucuccuccccucugccuucccauaaccaaauccagaugugaggccucggcgggagccugggaacccuagcaucccgaccuccagugcuuccugaucagggcacucguggggagggagguacugggaugggggccagggcuaugccccaggcacggagcgcucccuucaaggagggaaggacgggguguuuggucugaaagcagagaggggucuuggacagggaaugaaauugugggguagagaggcugauucugggacuuaggggaggaaacguggaggcugagacaagagguuccccucccacaccagcagccucugcucgugggggucaggaccagggcgcagcucucauuuuaacccuuucugagcugccgccccuucuccccguacauuuugaucucccucccuccuccagggaggccuagaucugggguaucccaagggagccccaugccuaccagauguugggggugggguuggcacuuagcagaagaggccagaaaucaggcgggugcagagggcagggcuugcuccccucuuggccccccaacuccucuagcucagagcuaagaggauccaccugccucgguucccagggaucuggucuuccugaccucccucccccaccccaggcacugacucugucucucugucugucucagagacccugcugaacacaaaauuggaaacugcugaucugaagugggugacauucccucagguggacgggcaggugagagcugcacccaggagcuggagcucuggagggaaacugagggaggagagggcgccugugccgccugcuuucugugugccacuccucuccccuguccccccagaugacagcagccccagcagugucgucugagcccuucucagaggcgcccuccucgcaguaccagcagccccccuuucucagucccucucacuuuauaggauucaccccaugcagcccucucccuggcggcuccccagcccccuugcugaccuccuucucugcacagugggaggaacugagcggccuggaugaggaacagcacagcgugcgcaccuacgaagugugugacgugcagcgugccccgggccaggcccacuggcuucgcacagguugggucccacggcggggcgccguccacguguacgccacgcugcgcuucaccaugcucgagugccugucccugccucgggcugggcgcuccugcaaggagaccuucaccgucuucuacuaugagagcgaugcggacacggccacggcccucacgccagccuggauggagaaccccuacaucaagguacc

SEQ ID NO: 21020 - RNA, 2188 nt, Homo sapiens
gguaccuugauguagggguucuccauccaggcuggcgugagggccguggccguguccgcaucgcucucauaguagaagacggugaaggucuccuugcaggagcgcccagcccgaggcagggacaggcacucgagcauggugaagcgcagcguggcguacacguggacggcgccccgccgugggacccaaccugugcgaagccagugggccuggcccggggcacgcugcacgucacacacuucguaggugcgcacgcugugcuguuccucauccaggccgcucaguuccucccacugugcagagaaggaggucagcaagggggcuggggagccgccagggagagggcugcauggggugaauccuauaaagugagagggacugagaaaggggggcugcugguacugcgaggagggcgccucugagaagggcucagacgacacugcuggggcugcugucaucuggggggacaggggagaggaguggcacacagaaagcaggcggcacaggcgcccucuccucccucaguuucccuccagagcuccagcuccugggugcagcucucaccugcccguccaccugagggaaugucacccacuucagaucagcaguuuccaauuuuguguucagcagggucucugagacagacagagagacagagucagugccuggggugggggagggaggucaggaagaccagaucccugggaaccgaggcagguggauccucuuagcucugagcuagaggaguuggggggccaagaggggagcaagcccugcccucugcacccgccugauuucuggccucuucugcuaagugccaaccccacccccaacaucugguaggcauggggcucccuugggauaccccagaucuaggccucccuggaggagggagggagaucaaaauguacggggagaaggggcggcagcucagaaaggguuaaaaugagagcugcgcccugguccugacccccacgagcagaggcugcuggugugggaggggaaccucuugucucagccuccacguuuccuccccuaagucccagaaucagccucucuaccccacaauuucauucccuguccaagaccccucucugcuuucagaccaaacaccccguccuucccuccuugaagggagcgcuccgugccuggggcauagcccuggcccccaucccaguaccucccuccccacgagugcccugaucaggaagcacuggaggucgggaugcuaggguucccaggcucccgccgaggccucacaucuggauuugguuaugggaaggcagaggggaggagauucuggggggcgguaugaaugggaggggugaacacaccuggcuuggcucggaucaucgggggaggggacaggcacuggaggaaggggggggauuaggaaaaacugcacagccccuggcaguggagaguggaggagggaggguacaggaauccccucgggggccggcaauguggggggcauugggcgcugggaaggguggagaggggagccagaacaccuggcucccaccccaugggagcugcaggagagaagagaaagagggugggugaggcagccucuuccuggggaccaaaugauguccuccagcuaggggucagaugggaagccagccagccugaggugagaggcgcaagguccccauggguggcaagagacagcccugcucacuggggacaggaugcccggguucugggaaggggguggauagaggcugccgucuccacccuccauuguuccagccgggauaguguuuuccugucuccaauuuacacacugucucugccucgggcuguccgcagcccagagcaagcgcaggcucccuuucugcgucccagcucagcugcagccacgcuuugaucugucaguucgcaugucucucaccuaucucuccuccacucucuguccaccuccguuucucuuucugacagucacuaucucuccuucgcuuucggccuccacuucucgcuguuccucgcggcacagggccuuggauaaacuacuuaaccuuaacuaagccccagccuccucaucugaaaaaugggggcaauaauagcaccacccuuagcguugcuggaugggugaaauuaauauuuguaaggcgcucagcacaggccuggugcuuggaaacacucagguaauaggugucacaaucaccauuuccucuuugcgucu

SEQ ID NO: 21021 - RNA, 263 nt, Homo sapiens
aucauuuuacagacaggaaaauugaagcuuagaaagauuugguaacuugcccacacuacagagcuaguaagcaaagaagccaggacuugaauucaggucuucuugacucuuaaaaaauccgugcuuuaaccacuguaugacuguuuccccaaaagaauggaaugaugcuaggcacaugauggaugcucgauagugucugucauugaaggaaugaaugacaggauauaaagcagccauugcacaguaagcccaaauguggaaag

SEQ ID NO: 21022 - RNA, 263 nt, Homo sapiens
cuuuccacauuugggcuuacugugcaauggcugcuuuauauccugucauucauuccuucaaugacagacacuaucgagcauccaucaugugccuagcaucauuccauucuuuuggggaaacagucauacagugguuaaagcacggauuuuuuaagagucaagaagaccugaauucaaguccuggcuucuuugcuuacuagcucuguagugugggcaaguuaccaaaucuuucuaagcuucaauuuuccugucuguaaaaugau

SEQ ID NO: 21023 - RNA, 748 nt, Homo sapiens
acuaaaucaccaacucaaacuaugcagcauaauuguggaugucuggaaaacagcagcaacugaugcgguggccuaauaugcugcuacaaaaaauguaauggcucuuucugagggaaaacuucaggcugucuaugaaucuacaaacccaaagaaggaaaugucaucaggcaguuuagaaaaggaaaugcagauacugaucaaaacacuauuuuccacauuuucucaguagggaaaggauugcugaugcugcauugaccuaacagucaagaucacaacuugccuuucauucugucaccuuucaaaagaaagaaaaacauguauacuggaaagcucaucacauuuuaggacuauggucuuuuaagagauucccaccaaaagauuccuucuauggggcccagggccauguuuuaugccacugacucugccacuaugaucacaaaugacaggaccaagagagagcaacugucccaagagcagccaaucuacagacuggccagcaaccuaugaaggggacugacaugagagauuagcccaacaggcaaugaaucuaacuggacuaauuagauuuccucuuacagaagauugaacucaagcuguacagaaggggaaaguagcggaaggacacagagcagaggguggaacgaggcaguuaagaccauauugagaagauacagagugagguaauuuguuuaaaacaaaauaaagcagagucugaaaagggcuaauagcagcagagaagcaauacuuc

SEQ ID NO: 21024 - RNA, 748 nt, Homo sapiens
gaaguauugcuucucugcugcuauuagcccuuuucagacucugcuuuauuuuguuuuaaacaaauuaccucacucuguaucuucucaauauggucuuaacugccucguuccacccucugcucuguguccuuccgcuacuuuccccuucuguacagcuugaguucaaucuucuguaagaggaaaucuaauuaguccaguuagauucauugccuguugggcuaaucucucaugucaguccccuucauagguugcuggccagucuguagauuggcugcucuugggacaguugcucucucuugguccugucauuugugaucauaguggcagagucaguggcauaaaacauggcccugggccccauagaaggaaucuuuuggugggaaucucuuaaaagaccauaguccuaaaaugugaugagcuuuccaguauacauguuuuucuuucuuuugaaaggugacagaaugaaaggcaaguugugaucuugacuguuaggucaaugcagcaucagcaauccuuucccuacugagaaaauguggaaaauaguguuuugaucaguaucugcauuuccuuuucuaaacugccugaugacauuuccuucuuuggguuuguagauucauagacagccugaaguuuucccucagaaagagccauuacauuuuuuguagcagcauauuaggccaccgcaucaguugcugcuguuuuccagacauccacaauuaugcugcauaguuugaguuggugauuuagu

SEQ ID NO: 21025 - RNA, 464 nt, Homo sapiens
aaaacucuuaauugaucaaauagcagcaaagguagauauaauuuauagccagauaggucuuauauaaaauaagcaguuucugauggcucuuugugugcuguaauccucacuauaacaauacaaaaucaccuaaauauguguuuauguagccuacaugcagaaaagcuucuggcacaaacuucuuaggccucuucucaagagccuuaagccugagccccugaagugacagagcucaagucaaaucaggaaggaugaagaccagaaaggaauaagaagaacaauacuuuguggucacuuguuuguucuaccuuucuaaacugguccuaguucagguucucuuauauaugccauuauccauuaauucagcuauuaugauaaaauguuuccagucugucuaauguaggcaaguacugacacagugcuauuuuuccuacaugacccagaugaaaucuuuugacagcccu

SEQ ID NO: 21026 - RNA, 464 nt, Homo sapiens
agggcugucaaaagauuucaucugggucauguaggaaaaauagcacugugucaguacuugccuacauuagacagacuggaaacauuuuaucauaauagcugaauuaauggauaauggcauauauaagagaaccugaacuaggaccaguuuagaaagguagaacaaacaagugaccacaaaguauuguucuucuuauuccuuucuggucuucauccuuccugauuugacuugagcucugucacuucaggggcucaggcuuaaggcucuugagaagaggccuaagaaguuugugccagaagcuuuucugcauguaggcuacauaaacacauauuuaggugauuuuguauuguuauagugaggauuacagcacacaaagagccaucagaaacugcuuauuuuauauaagaccuaucuggcuauaaauuauaucuaccuuugcugcuauuugaucaauuaagaguuuu

SEQ ID NO: 21027 - RNA, 997 nt, Homo sapiens
auugaucaagguccagccauuugccaagguauauacacguuuauuuaaaaaaguuuacaguuuucauuauacacaacuauuaagagguuauagucagaggaggcauguguccuguugacagacgugccuacuagaucaucacaaugcaaggagaaagguggaagggaggagacagggcgaggaaaaauaagcgauaaaaagcuucagauuucaguuaggggcuggcagucccuuuuaucuuuucaaguaucacacaauauguaccaaauacaaucuguaaauaauggccauuucuucccaagcccacagccaagaugaguguuaggcuaaauucagagcccuggcucuuccucagaugaguggaaaaccugcgcaugacagggccggcucccccuucucaaagggcuuccucccacucaucccaucccuaacagaaucgccgagguguucacgggccagagaaagcacaaacauggauucagaaguccaaagaaaugcaguucguugcgcccaaucagagauagaugauuucauucaacaaggcuggaagcccaguugggaagucgauaaaaaaucuugcuaacuuuuuuaaauggcuuuuacuuuucuaagucacugaaacaaggaagggccacaugccauuuaaaaucaaacacuaguucccagagacuugguguccagaaacuugacccacagaggcuagcggaggaucugucuuucaugauucucagccaucccaacgggaggccuaacauaaagcaugugccaggccaaugccaacuaggacuucagggggccuuuggagggaaaaauuccuuugagaggagacauuccucaggagcuuagaucagccagcuggcagucagaacagcuuuugaaguggaugagaaauguuagguacuggagagaugauauggcaacuccugauaaugaccucacuaggauaaaaugcugguugaaacugcacaguaaccucaaggagggugaugaaauugac

SEQ ID NO: 21028 - RNA, 997 nt, Homo sapiens
gucaauuucaucacccuccuugagguuacugugcaguuucaaccagcauuuuauccuagugaggucauuaucaggaguugccauaucaucucuccaguaccuaacauuucucauccacuucaaaagcuguucugacugccagcuggcugaucuaagcuccugaggaaugucuccucucaaaggaauuuuucccuccaaaggcccccugaaguccuaguuggcauuggccuggcacaugcuuuauguuaggccucccguugggauggcugagaaucaugaaagacagauccuccgcuagccucugugggucaaguuucuggacaccaagucucugggaacuaguguuugauuuuaaauggcauguggcccuuccuuguuucagugacuuagaaaaguaaaagccauuuaaaaaaguuagcaagauuuuuuaucgacuucccaacugggcuuccagccuuguugaaugaaaucaucuaucucugauugggcgcaacgaacugcauuucuuuggacuucugaauccauguuugugcuuucucuggcccgugaacaccucggcgauucuguuagggaugggaugagugggaggaagcccuuugagaagggggagccggcccugucaugcgcagguuuuccacucaucugaggaagagccagggcucugaauuuagccuaacacucaucuuggcugugggcuugggaagaaauggccauuauuuacagauuguauuugguacauauugugugauacuugaaaagauaaaagggacugccagccccuaacugaaaucugaagcuuuuuaucgcuuauuuuuccucgcccugucuccucccuuccaccuuucuccuugcauugugaugaucuaguaggcacgucugucaacaggacacaugccuccucugacuauaaccucuuaauaguuguguauaaugaaaacuguaaacuuuuuuaaauaaacguguauauaccuuggcaaauggcuggaccuugaucaau

SEQ ID NO: 21029 - RNA, 1448 nt, Homo sapiens
aaguccaacauuaccuuucuuucaaugucuggcucaaaggcucuuuauccaugaagcauuucuugaucaucccagccacagauaaacacacaaccuuucuuuucuaugaacuugugguauguuuaucucucuaccuuuuauacauuucucuuucucucugcauuuauucuuuguuuuucuuuuuucuaagacaucuuguuauagcaucucugcauuuauucuaauuuuaucugugcacagaaccuuagcuucaagcuccuugaaggguagcaucgugucccagccuacacugucacacucaggagaagcacccaguagaugguggcucuguaucuaccuacagagugccacugaggagcacaggccuucaggucuguagcccaucagcugagccuucgcaucagcuccuagaacagugccuggcauagagcaacacccagaaaucauuguuaaaugaaauuauccacaagggagucaccuagugucuacaugauagaaauucuuucccuguagaauauaacaugaaagggggugugaagaagccuucucucuccccauacuuccagaugcaagaaagcuucacguuaacugucucccacaagcuauauagcuacucucggcaauaaacaugacauauaauacuuuggugcauuuggcgugucaaaaauauucaauuuuaacaugucagaaagaaucauuuuucaaaaacagucuccuuuggagaagagaguuauucaaacaauauccaaaaccuuuuuggaucucacauuuugaagagguccaacuuccguugguuaaaaaaaaaagucuauuauauaaugaaagccuuacaacugacugagaauuauagaauuucagaaauaaaucccagucuguucauccuuaaaauaagaagcuauuuuucagggcuuucauguccaaaauuauauuauguaagccacuucauaaaucauguacacaacaauucucauuuuuccauuaaaucucuauuuugaaauuuaauucacucauccauuuuuucagagaugggaucuuguucugucgcucaggcuagagugcaguggugugaucauagcucacuauagccuucaacuccagggcucaagggauccuccugccucagccucccaaguagcuaggacuauagaugcaugccaccauguguggcuuauuuuuuuauuuuauuuuauuuuuuuguagagauggggaucuauguugcccaggcuggucuugaacuccuggccucaagugauccucccaccucagccuccuaaagugcugggaucacagguaugagccaccgugcccugucuuuuuauuuugacccccucuuggcucuaacagcacacguguaccucuguuacaggacaucagucuacagugcuaccucuuuuuauagucauuuaucucacuaaccugugucuuucugaaaugccagacccauguuc

SEQ ID NO: 21030 - RNA, 1448 nt, Homo sapiens
gaacaugggucuggcauuucagaaagacacagguuagugagauaaaugacuauaaaaagagguagcacuguagacugauguccuguaacagagguacacgugugcuguuagagccaagagggggucaaaauaaaaagacagggcacgguggcucauaccugugaucccagcacuuuaggaggcugaggugggaggaucacuugaggccaggaguucaagaccagccugggcaacauagauccccaucucuacaaaaaaauaaaauaaaauaaaaaaauaagccacacaugguggcaugcaucuauaguccuagcuacuugggaggcugaggcaggaggaucccuugagcccuggaguugaaggcuauagugagcuaugaucacaccacugcacucuagccugagcgacagaacaagaucccaucucugaaaaaauggaugagugaauuaaauuucaaaauagagauuuaauggaaaaaugagaauuguuguguacaugauuuaugaaguggcuuacauaauauaauuuuggacaugaaagcccugaaaaauagcuucuuauuuuaaggaugaacagacugggauuuauuucugaaauucuauaauucucagucaguuguaaggcuuucauuauauaauagacuuuuuuuuuuaaccaacggaaguuggaccucuucaaaaugugagauccaaaaagguuuuggauauuguuugaauaacucucuucuccaaaggagacuguuuuugaaaaaugauucuuucugacauguuaaaauugaauauuuuugacacgccaaaugcaccaaaguauuauaugucauguuuauugccgagaguagcuauauagcuugugggagacaguuaacgugaagcuuucuugcaucuggaaguauggggagagagaaggcuucuucacacccccuuucauguuauauucuacagggaaagaauuucuaucauguagacacuaggugacucccuuguggauaauuucauuuaacaaugauuucuggguguugcucuaugccaggcacuguucuaggagcugaugcgaaggcucagcugaugggcuacagaccugaaggccugugcuccucaguggcacucuguagguagauacagagccaccaucuacugggugcuucuccugagugugacaguguaggcugggacacgaugcuacccuucaaggagcuugaagcuaagguucugugcacagauaaaauuagaauaaaugcagagaugcuauaacaagaugucuuagaaaaaagaaaaacaaagaauaaaugcagagagaaagagaaauguauaaaagguagagagauaaacauaccacaaguucauagaaaagaaagguuguguguuuaucuguggcugggaugaucaagaaaugcuucauggauaaagagccuuugagccagacauugaaagaaagguaauguuggacuu

SEQ ID NO: 21031 - RNA, 3351 nt, Homo sapiens
acccacaagcuuacaggguauaaguaauuuuuauuaauuuuuuaaugccaaguguuuauuauaucuuauaccaacuggaaacaaaguuuugccucaaaauuagaaaucuauuuccuugucauuuguacuggagaugcagggaucugguauauuuuuacugucuccuggucuuccaauauuuugucacucauuuaacuuacagucucauauaugaugcaucguuuuauguuacuagagguauuucauggggaaguuuagcucuucugcuccucugaaucaucuugucuccuuugggaaaauuuaauugauauccacaccucuguuuuccauuuucccaacugaaugcuccccuguucugccauagcacucuauggauagcucuguuauugcacuuaauacacucaaaugucaaccauagcaaacuuuguaaccuugggcaagcacuuaaucucucugggucucaacuuacuuauguauaaaauggagaaaauaacaguaagaacuucaucaggcuauuuauccacucaugagcuaaugcccagaaaguaguuagaacagcaccuuccauauaguaagugcuacugaaguuuuugcuauuaguaucaugauaugcauuugcacgucucuccuuucagauuugucugcaccuuuaaaauggggacuaggucuuaaucucuguauccgcagugccuaguauagugaauaaaugcaugcaucaauugaucaguuuuuuuuuuuuuuuuuucugagacagguucucucucugucauccaggcugaagugcaguggugcccacugcagccucaacauccuggacucaaucaauccucccaucucagcugucccuguagcugggacuacagguggguaccaccaagcccagcuaauuuuuguauuuuuuuuguagauacaagguuuuaccauguugcccaggcuggucuugaauuccuaggcucaagcaauccgccucucugggucucccaaagugcuaggauuauaggugugagccacugugcccagccccauuaguuuuuaucucacaaaaaaguaaaaauguagauauuaaaaauaauaggccaaagcaucaccuuauuuauaacccaucuuguuugaaaaguaauuuaaggcaguucauaaaguacagucugacauuucaaauauguaacuuaaaugaaacaaguuaaaauuaagggugcagcaccuuggggguugaggcaagaggacuguuugagcccaagaguucaagaccagccacggcaacacagugagaccccaucucuaaugauuaaaaaaaaaaacaaauaaaauuaaagguagaacuguaucaucaauaccacuaaaaugucagugucaaaauaaacuucuuaagaauuaaguacacuuacauauauuuggacuguaagaauaagaaauuuuucacuauugcuacagaaaaaggaaaaaaaauguccagagauguagcucuagacaagcguuugcuauguggauuucuuucacagaucuagguaucuagggaggagaaaaacuccauaacaacugaggucuccuacuuaauaugcgacaauucugcaguagggaagucccaaaguuguuggugacagaaggaaaacaacuggggcauccaaaaaaauucaaaugauuguggcuuaaguuccaaauguucaugaugcccacagaugcucagcguggggagguggcuccucuccaucuccaguagaaaacagccacuucccacaucucacccguguuuaacauuucuacaggacaccuaucuaggaccauaacaccacccuauguaaaacuaccagugcuaagauucugucauucugguucuuuucagauaguaauuauuucuaaaacuguugaaaaugagggcugggcaugguggcucacgccuguaaucccagcacuuugggaggccaaggcgggcggaucaccugaguucaggaguucgagaccagccugacuaacguggagaaacccugucucuacuaaaaguacaaaauuagccgggcguggugacgcgugccuauaaucccagcuacucgggaggcuuaggaaggagaaucgcuugaacccaggaagcagagguugcagcgagcugagauggcgccacugcacuccagccugggcaauaagagcgaaucuccaucucaaaaaaaaagaaagugagucucacauaacuagcagaacuuuccucuuucacuggcacaugaaaaaaaaaaagccaccuuuuucauuaaaauguuaaaauggaauuuaaugaaaagucuguguuaaagucugggagugguaguguuucacagaggaagaaaaauguuucucauauccuucaggucaccugaguagaaaccuauauaaaaagggugagugugaagaguuaagaggaaaaccuuuagcaaacugagguuguuucuacuugcuaaaagggucucucauuucuauucaugaauggccuuucuacgcuuucuccugagccacagaagaggacauuucagcacaaucuaagguagacugaaacaaguaaaacaucuggauaaacucccccaugaacacugaaaaaagaaacaugacuaauaagcucucuucuccacaugcuggagauucuacugaugguaacacauucagauacaaacacgugaaccaauaauaaccaaccucacugcuaaagcagucacuugaagcgauaaccucacuucugcuuucccaaauaggugaguauaaaauauauacauauauauaugaacauucccuuccaagacagagcauuaaaaagauaaagcaacacacacacauacacacacacacgcacacacacaccccccuuaauaacaguguguguccuuuaauuaaauguuggccuuuuuaauuuacuuauuuuaaguuguuguuucugugaucucaaucugacaaggauugcauuugaggauuaaaauugccgagcacauaccuuuuuaguuccucaucuuuuaauuacuacauaagugguugccuaggaaaccuccagaccgaaugaugaaacucaaaugaauucuccuuucuaagcuugcagguuugacucacuaccuuugcuccccaaaaacuaaguccuccggaauuauuaaagccagauauuuuugcaaccuggaugacaugcgaaaaaaaacauaagaggugaauaauuauuuauucugaauacagguuucuuagggaaauaaaaguuaaaaaggccaagucccuacucacagcaaauucagaagagaaaugcaugucuucaaauauacccauacuaucuguuaccagguaauuguggaguguuauuuuauggcaguauguuaacaugguagugauuaaacauuauaaugaaagaca

SEQ ID NO: 21032 - RNA, 3351 nt, Homo sapiens
ugucuuucauuauaauguuuaaucacuaccauguuaacauacugccauaaaauaacacuccacaauuaccugguaacagauaguauggguauauuugaagacaugcauuucucuucugaauuugcugugaguagggacuuggccuuuuuaacuuuuauuucccuaagaaaccuguauucagaauaaauaauuauucaccucuuauguuuuuuuucgcaugucauccagguugcaaaaauaucuggcuuuaauaauuccggaggacuuaguuuuuggggagcaaagguagugagucaaaccugcaagcuuagaaaggagaauucauuugaguuucaucauucggucuggagguuuccuaggcaaccacuuauguaguaauuaaaagaugaggaacuaaaaagguaugugcucggcaauuuuaauccucaaaugcaauccuugucagauugagaucacagaaacaacaacuuaaaauaaguaaauuaaaaaggccaacauuuaauuaaaggacacacacuguuauuaaggggggugugugugugcguguguguguguauguguguguguugcuuuaucuuuuuaaugcucugucuuggaagggaauguucauauauauauguauauauuuuauacucaccuauuugggaaagcagaagugagguuaucgcuucaagugacugcuuuagcagugagguugguuauuauugguucacguguuuguaucugaauguguuaccaucaguagaaucuccagcauguggagaagagagcuuauuagucauguuucuuuuuucaguguucaugggggaguuuauccagauguuuuacuuguuucagucuaccuuagauugugcugaaauguccucuucuguggcucaggagaaagcguagaaaggccauucaugaauagaaaugagagacccuuuuagcaaguagaaacaaccucaguuugcuaaagguuuuccucuuaacucuucacacucacccuuuuuauauagguuucuacucaggugaccugaaggauaugagaaacauuuuucuuccucugugaaacacuaccacucccagacuuuaacacagacuuuucauuaaauuccauuuuaacauuuuaaugaaaaagguggcuuuuuuuuuuucaugugccagugaaagaggaaaguucugcuaguuaugugagacucacuuucuuuuuuuuugagauggagauucgcucuuauugcccaggcuggagugcaguggcgccaucucagcucgcugcaaccucugcuuccuggguucaagcgauucuccuuccuaagccucccgaguagcugggauuauaggcacgcgucaccacgcccggcuaauuuuguacuuuuaguagagacaggguuucuccacguuagucaggcuggucucgaacuccugaacucaggugauccgcccgccuuggccucccaaagugcugggauuacaggcgugagccaccaugcccagcccucauuuucaacaguuuuagaaauaauuacuaucugaaaagaaccagaaugacagaaucuuagcacugguaguuuuacauagggugguguuaugguccuagauagguguccuguagaaauguuaaacacgggugagaugugggaaguggcuguuuucuacuggagauggagaggagccaccuccccacgcugagcaucugugggcaucaugaacauuuggaacuuaagccacaaucauuugaauuuuuuuggaugccccaguuguuuuccuucugucaccaacaacuuugggacuucccuacugcagaauugucgcauauuaaguaggagaccucaguuguuauggaguuuuucuccucccuagauaccuagaucugugaaagaaauccacauagcaaacgcuugucuagagcuacaucucuggacauuuuuuuuccuuuuucuguagcaauagugaaaaauuucuuauucuuacaguccaaauauauguaaguguacuuaauucuuaagaaguuuauuuugacacugacauuuuagugguauugaugauacaguucuaccuuuaauuuuauuuguuuuuuuuuuuaaucauuagagauggggucucacuguguugccguggcuggucuugaacucuugggcucaaacaguccucuugccucaacccccaaggugcugcacccuuaauuuuaacuuguuucauuuaaguuacauauuugaaaugucagacuguacuuuaugaacugccuuaaauuacuuuucaaacaagauggguuauaaauaaggugaugcuuuggccuauuauuuuuaauaucuacauuuuuacuuuuuugugagauaaaaacuaauggggcugggcacaguggcucacaccuauaauccuagcacuuugggagacccagagaggcggauugcuugagccuaggaauucaagaccagccugggcaacaugguaaaaccuuguaucuacaaaaaaaauacaaaaauuagcugggcuuggugguacccaccuguagucccagcuacagggacagcugagaugggaggauugauugaguccaggauguugaggcugcagugggcaccacugcacuucagccuggaugacagagagagaaccugucucagaaaaaaaaaaaaaaaaaacugaucaauugaugcaugcauuuauucacuauacuaggcacugcggauacagagauuaagaccuaguccccauuuuaaaggugcagacaaaucugaaaggagagacgugcaaaugcauaucaugauacuaauagcaaaaacuucaguagcacuuacuauauggaaggugcuguucuaacuacuuucugggcauuagcucaugaguggauaaauagccugaugaaguucuuacuguuauuuucuccauuuuauacauaaguaaguugagacccagagagauuaagugcuugcccaagguuacaaaguuugcuaugguugacauuugaguguauuaagugcaauaacagagcuauccauagagugcuauggcagaacaggggagcauucaguugggaaaauggaaaacagagguguggauaucaauuaaauuuucccaaaggagacaagaugauucagaggagcagaagagcuaaacuuccccaugaaauaccucuaguaacauaaaacgaugcaucauauaugagacuguaaguuaaaugagugacaaaauauuggaagaccaggagacaguaaaaauauaccagaucccugcaucuccaguacaaaugacaaggaaauagauuucuaauuuugaggcaaaacuuuguuuccaguugguauaagauauaauaaacacuuggcauuaaaaaauuaauaaaaauuacuuauacccuguaagcuugugggu

SEQ ID NO: 21033 - RNA, 695 nt, Homo sapiens
ugccugaggcuagagacgugagcaggcccgggaaagacagagauggggcaagugggcucaguggcuggaggcagaguacacucagcagaaggccuuugacuacuuucucucagcccugaucucaaagucuggcugcuuccucuaacauccuugcaucaugaucuuaccaucauuuacuuuaaauuuaaaaauuuugaaccaacucuucuggaggaaaagcaacaaccaauuuccaccuccauccccccagcuaugcuucugccucgggguagaggaguuugaguaggagaggaaaagacagaucagaacucaaggcucucaggcugggcacgguguggcucuugccuguauucccagcacuuugagaggccaaggcagguggaucacuugaggucaggacuuugagaccagccuggcuaacauggugaaauacugucucuacuaaaaauacaaaaauuagcugggcauggugggaugcgccuguaaucccagcuauuugggaggcugaggcaggagaauugcuugaacccaggaggcggagguugcagugagccgagauugugccacugcacucaaucaagccuaggcaacagagcaagacuccaucucaaaaaaaagacaaaaaacaaaaaacaaaaaaacucaaagcccucaucauuucuccccaggauaacuaaacuuuucugccaacuacu

SEQ ID NO: 21034 - RNA, 695 nt, Homo sapiens
aguaguuggcagaaaaguuuaguuauccuggggagaaaugaugagggcuuugaguuuuuuuguuuuuuguuuuuugucuuuuuuuugagauggagucuugcucuguugccuaggcuugauugagugcaguggcacaaucucggcucacugcaaccuccgccuccuggguucaagcaauucuccugccucagccucccaaauagcugggauuacaggcgcaucccaccaugcccagcuaauuuuuguauuuuuaguagagacaguauuucaccauguuagccaggcuggucucaaaguccugaccucaagugauccaccugccuuggccucucaaagugcugggaauacaggcaagagccacaccgugcccagccugagagccuugaguucugaucugucuuuuccucuccuacucaaacuccucuaccccgaggcagaagcauagcuggggggauggagguggaaauugguuguugcuuuuccuccagaagaguugguucaaaauuuuuaaauuuaaaguaaaugaugguaagaucaugaugcaaggauguuagaggaagcagccagacuuugagaucagggcugagagaaaguagucaaaggccuucugcugaguguacucugccuccagccacugagcccacuugccccaucucugucuuucccgggccugcucacgucucuagccucaggca

SEQ ID NO: 21035 - RNA, 175 nt, Homo sapiens
uggauuugguauuuagugacauuaaaaauuauucaaauaccuacaauuauacauacuuugcaauuuuaucuacuggugcaggaugauuucauagcacauuuaauuucauauuuaauuuacauauugauacaggagacagaguaaagacaauuucuggucuuuacuagaccuauaa

SEQ ID NO: 21036 - RNA, 175 nt, Homo sapiens
uuauaggucuaguaaagaccagaaauugucuuuacucugucuccuguaucaauauguaaauuaaauaugaaauuaaaugugcuaugaaaucauccugcaccaguagauaaaauugcaaaguauguauaauuguagguauuugaauaauuuuuaaugucacuaaauaccaaaucca

SEQ ID NO: 21037 - RNA, 299 nt, Homo sapiens
uaauguauauauauaaugucuauauaaggauguauaaugugccuaaaaucacuggagaccagguuagcacuccaacucuaccacuuaguugugggaccagagaccagguacuuucuaaauuuugguuuccuuauccguaaaaugggaauagaaaugucuacacuucacaggguuucaguguuucacuggaagagauaaccuaugcaguguuuagcauagugccugacacauuguuuaacaaauguuuaaugaaggcuauuauauuuaauaaagguucacuauuauuuuuguggauuccu

SEQ ID NO: 21038 - RNA, 299 nt, Homo sapiens
aggaauccacaaaaauaauagugaaccuuuauuaaauauaauagccuucauuaaacauuuguuaaacaaugugucaggcacuaugcuaaacacugcauagguuaucucuuccagugaaacacugaaacccugugaaguguagacauuucuauucccauuuuacggauaaggaaaccaaaauuuagaaaguaccuggucucuggucccacaacuaagugguagaguuggagugcuaaccuggucuccagugauuuuaggcacauuauacauccuuauauagacauuauauauauacauua

SEQ ID NO: 21039 - RNA, 127 nt, Homo sapiens
agcggugagggucgggcaagcccccgccgauuccuuguuucccagcgaggcuucuagccaggcuugagcagcccagaaaauauagggcggcuguucacuaaaaucuggggcucccauuccagaaagg

SEQ ID NO: 21040 - RNA, 127 nt, Homo sapiens
ccuuucuggaaugggagccccagauuuuagugaacagccgcccuauauuuucugggcugcucaagccuggcuagaagccucgcugggaaacaaggaaucggcgggggcuugcccgacccucaccgcu

SEQ ID NO: 21041 - RNA, 17 nt, Homo sapiens
uggcccccauuguguaa

SEQ ID NO: 21042 - RNA, 17 nt, Homo sapiens
uuacacaaugggggcca

SEQ ID NO: 21043 - RNA, 63 nt, Homo sapiens
guuaacaauuguuucugaucuguaacaugaugagggggggcaagccugacauuuagggauggc

SEQ ID NO: 21044 - RNA, 63 nt, Homo sapiens
gccaucccuaaaugucaggcuugcccccccucaucauguuacagaucagaaacaauuguuaac

SEQ ID NO: 21045 - RNA, 252 nt, Homo sapiens
auauggaaacccagcaauguuguuuauguuuuacuugaauucguuucaucagaauugcauuccuuuuaacagugugauuagaucagcucuuagaggggauggcagcuucaguaggguuuaggaaaggaaaggaauauuuguguggggcacacacuuuggcuuugauagcuugaggauaccagguacaugauaauuuagauggauaacagaaacuugugucccuugagagccaggcauguauuagaugcuuuc

SEQ ID NO: 21046 - RNA, 252 nt, Homo sapiens
gaaagcaucuaauacaugccuggcucucaagggacacaaguuucuguuauccaucuaaauuaucauguaccugguauccucaagcuaucaaagccaaagugugugccccacacaaauauuccuuuccuuuccuaaacccuacugaagcugccauccccucuaagagcugaucuaaucacacuguuaaaaggaaugcaauucugaugaaacgaauucaaguaaaacauaaacaacauugcuggguuuccauau

SEQ ID NO: 21047 - RNA, 61 nt, Homo sapiens
cucaaaaacuugcccuagcuguuugcuauugcuugggaucccacaauugaaauuucuuuuu

SEQ ID NO: 21048 - RNA, 61 nt, Homo sapiens
aaaaagaaauuucaauugugggaucccaagcaauagcaaacagcuagggcaaguuuuugag

SEQ ID NO: 21049 - RNA, 681 nt, Homo sapiens
uaaagauuaggaauugggagguuagagauaacacacaagcugacucagaaccaugcucuuuccacuucucaaaacguuuuauauguguggguauguuuccuuauaagaauguauguguccaggcgcaguggcucaugccuguaaucccagcacuuugggaggcugaggcgagcagaucaugaggucaggagauugagaccauccuggccaacauggugaaaccccaucucuacuaagcugggcaugguggcgcacgccuauagucccagcuacucaggaggcugaggcaggagaauugcuugaacccgggaggcggagguuacggugagccgagauggcaccacugcacuccagccuggcgacagagcgagacuccgucucaaaaaaaaaaaaaaaaggaauguauacauagauaguugucuaaagagacugauaguaaaauguuagccaugcuuaucucaagugguaggauuuugauuuuuuuuuuuuaaauauuuuaaucuggguuguuuuuauuuucuaacgugucauuuuuguaaucagaaaaagcaaaaacuauacauugaauccaaagaaguccgaugaaagaguauuugaaggaaaguucugugaccaagucauauuuucucugcagacacgucaaguucuugaggagcugacugaguugccugugauggugga

SEQ ID NO: 21050 - RNA, 681 nt, Homo sapiens
uccaccaucacaggcaacucagucagcuccucaagaacuugacgugucugcagagaaaauaugacuuggucacagaacuuuccuucaaauacucuuucaucggacuucuuuggauucaauguauaguuuuugcuuuuucugauuacaaaaaugacacguuagaaaauaaaaacaacccagauuaaaauauuuaaaaaaaaaaaaucaaaauccuaccacuugagauaagcauggcuaacauuuuacuaucagucucuuuagacaacuaucuauguauacauuccuuuuuuuuuuuuuuuugagacggagucucgcucugucgccaggcuggagugcaguggugccaucucggcucaccguaaccuccgccucccggguucaagcaauucuccugccucagccuccugaguagcugggacuauaggcgugcgccaccaugcccagcuuaguagagaugggguuucaccauguuggccaggauggucucaaucuccugaccucaugaucugcucgccucagccucccaaagugcugggauuacaggcaugagccacugcgccuggacacauacauucuuauaaggaaacauacccacacauauaaaacguuuugagaaguggaaagagcaugguucugagucagcuuguguguuaucucuaaccucccaauuccuaaucuuua

SEQ ID NO: 21051 - RNA, 1079 nt, Homo sapiens
cauaauguauuccuuucaaccacaccugaguuuauacuaauuaggugacucuuggugggccucuagauagcuucaggauagggcugguugccaggggaaccaaccaagcgauuagaguauuggaacuuuuaguccuccacuccucaaccuuuggggaagagagaggaacuggggacugacuaaaugaugggguuuggaaagauucccagguagugaauacauggaggugcugggaggguuuugugcccagagaggacaugaaagccucacaccccucccccauagcuugcccuauguauuuauuucauuuagcuguuccugaguuguacccuuuauaauaaauugauaaacauaaguguuuuccugaguucuaugagucuuuccagugaauuaacgaaccugaggaaggggucacgagaaccccugaauuugcagccaagccagacagaaguguggguggcccaagacuugugacuagcaucucaagcagcagcagucuuuugggacugagcccuuuaacuugagaucugacacuaacuccagguagacagugucagaauugaauggaauuguugaacacucagugucauagaacugaaggugaauuaggugugguauggaaaaacccccauagguaguaauucuugggauauauuuguaaagcuugaugauacaaauguauuuguugauauaaccucccaacuuaccuugaugcacauguacaaauagaaaacccaaaaauguaagcaaugcugucaagaacaguugccacuaaaaauaccuggcauuaauuuuaugccaucuacaugccaggcauuaagcucagcauaaauuauuugcaguguacaaaacucugagaugcagauacuguccucaacagcagaagagacaauuaaaucucauaaaugucccacuauacacagcaaguagcagaguuaugaacuaaagcuaguuuuaacacauaaaucccugccaacuucuacauuacagcaaccuuuacuuuuuaucauguaguguaaaauuauaaacuuuaacaauccuugaggacagcauccucaaaauauguucuugaaagacua

SEQ ID NO: 21052 - RNA, 1079 nt, Homo sapiens
uagucuuucaagaacauauuuugaggaugcuguccucaaggauuguuaaaguuuauaauuuuacacuacaugauaaaaaguaaagguugcuguaauguagaaguuggcagggauuuauguguuaaaacuagcuuuaguucauaacucugcuacuugcuguguauagugggacauuuaugagauuuaauugucucuucugcuguugaggacaguaucugcaucucagaguuuuguacacugcaaauaauuuaugcugagcuuaaugccuggcauguagauggcauaaaauuaaugccagguauuuuuaguggcaacuguucuugacagcauugcuuacauuuuuggguuuucuauuuguacaugugcaucaagguaaguugggagguuauaucaacaaauacauuuguaucaucaagcuuuacaaauauaucccaagaauuacuaccuauggggguuuuuccauaccacaccuaauucaccuucaguucuaugacacugaguguucaacaauuccauucaauucugacacugucuaccuggaguuagugucagaucucaaguuaaagggcucagucccaaaagacugcugcugcuugagaugcuagucacaagucuugggccacccacacuucugucuggcuuggcugcaaauucagggguucucgugaccccuuccucagguucguuaauucacuggaaagacucauagaacucaggaaaacacuuauguuuaucaauuuauuauaaaggguacaacucaggaacagcuaaaugaaauaaauacauagggcaagcuaugggggaggggugugaggcuuucauguccucucugggcacaaaacccucccagcaccuccauguauucacuaccugggaaucuuuccaaaccccaucauuuagucaguccccaguuccucucucuuccccaaagguugaggaguggaggacuaaaaguuccaauacucuaaucgcuugguugguuccccuggcaaccagcccuauccugaagcuaucuagaggcccaccaagagucaccuaauuaguauaaacucaggugugguugaaaggaauacauuaug

SEQ ID NO: 21053 - RNA, 128 nt, Homo sapiens
aaggaguugcuguucuugggccucaaauagacaaagcaagcaaauccauaguguauggacacaacagugaggugggaggagcaaguugagaaggccuuagaccuccccuuugcagagggcaucuuuau

SEQ ID NO: 21054 - RNA, 128 nt, Homo sapiens
auaaagaugcccucugcaaaggggaggucuaaggccuucucaacuugcuccucccaccucacuguuguguccauacacuauggauuugcuugcuuugucuauuugaggcccaagaacagcaacuccuu

SEQ ID NO: 21055 - RNA, 1094 nt, Homo sapiens
uuggaugcccucuucaacaucaugauggagaacucagagagugagacuuuugacacguuagucuuugaugcucugguaagagagcuuuccuucucauaugcuuggauaacacagcguucuuccaugcugcagcgucugaggcuggagucgggggcuucgucacagugaccuugaacgcauuuucaguuguaaauccaaucagagaugaauugggguggcagauuuuuuuucucuuuuuuuuaaauguaaaacuguaguuaggcaaaugucauuucuaggguaagaaaagguaaacuagccaccaacuucuaucugaaaauguuaugguucauauccuaacacaggggugcagaugguucugaugaagauuauaaaauggcuuacauuauguugcuaaugaaaauauuauugauuaauuugacagguauuuaucauuggacugauugcugauagaaaauuucagcauuuuaauccuguuuuggaaacuuacauuaagaaacacuuuagugcaacguuagccuacacguaaguuccuacuuuguuuuaaaaccaauacuucuuuuuuugguauuuguguuauuuagagucuuuuucauguacuuuugucuaugacuguguauuuacuccugcucaaaacucugaguuuacuggaauaauuuuuaguauuguuucccucuuaacauaccuaaaaaccuuguugaaagagauaugugauaaaucaucguaauauucuggaauaaauucuuguucucccucacaccuuccauuuaucuuugaaaucuucacuuuauguucgaugaaacugagcuuuggaugcggagugucugacaccgcggcuuccucgcgagccuuugaugaauggauaaaugcauguguucccguguuaaggagauugguuguuuagugugaauuagaugcaguuuuguacuuugcaauguaucuccuugcucuuuaaagagcaccuucccuuuucuuugacaagcuucagcugucacugucuuggauuccuucuauccaccccucugcccgucugugccccagaggucuaggaagacaccagaggcuaugcauggugccugggccagcuuagcagu

SEQ ID NO: 21056 - RNA, 1094 nt, Homo sapiens
acugcuaagcuggcccaggcaccaugcauagccucuggugucuuccuagaccucuggggcacagacgggcagagggguggauagaaggaauccaagacagugacagcugaagcuugucaaagaaaagggaaggugcucuuuaaagagcaaggagauacauugcaaaguacaaaacugcaucuaauucacacuaaacaaccaaucuccuuaacacgggaacacaugcauuuauccauucaucaaaggcucgcgaggaagccgcggugucagacacuccgcauccaaagcucaguuucaucgaacauaaagugaagauuucaaagauaaauggaaggugugagggagaacaagaauuuauuccagaauauuacgaugauuuaucacauaucucuuucaacaagguuuuuagguauguuaagagggaaacaauacuaaaaauuauuccaguaaacucagaguuuugagcaggaguaaauacacagucauagacaaaaguacaugaaaaagacucuaaauaacacaaauaccaaaaaaagaaguauugguuuuaaaacaaaguaggaacuuacguguaggcuaacguugcacuaaaguguuucuuaauguaaguuuccaaaacaggauuaaaaugcugaaauuuucuaucagcaaucaguccaaugauaaauaccugucaaauuaaucaauaauauuuucauuagcaacauaauguaagccauuuuauaaucuucaucagaaccaucugcaccccuguguuaggauaugaaccauaacauuuucagauagaaguugguggcuaguuuaccuuuucuuacccuagaaaugacauuugccuaacuacaguuuuacauuuaaaaaaaagagaaaaaaaaucugccaccccaauucaucucugauuggauuuacaacugaaaaugcguucaaggucacugugacgaagcccccgacuccagccucagacgcugcagcauggaagaacgcuguguuauccaagcauaugagaaggaaagcucucuuaccagagcaucaaagacuaacgugucaaaagucucacucucugaguucuccaucaugauguugaagagggcauccaa

SEQ ID NO: 21057 - RNA, 256 nt, Homo sapiens
caaggggccgcgugguugccuucucugauaugcucuuccagagagacuuccccacggggcauuuacauccucccaggacuuguuuuauggaaauugcuguguucgcuucaguuuuucguuuucuguguuacaacgguuuuggcauuuguugccuugcaugaauuucuccgcaugacgugacagucugcugccugaauucaguauguccacgucaccuguucacgucaucuggccugagucuggcugcacugauguu

SEQ ID NO: 21058 - RNA, 256 nt, Homo sapiens
aacaucagugcagccagacucaggccagaugacgugaacaggugacguggacauacugaauucaggcagcagacugucacgucaugcggagaaauucaugcaaggcaacaaaugccaaaaccguuguaacacagaaaacgaaaaacugaagcgaacacagcaauuuccauaaaacaaguccugggaggauguaaaugccccguggggaagucucucuggaagagcauaucagagaaggcaaccacgcggccccuug

SEQ ID NO: 21059 - RNA, 685 nt, Homo sapiens
uucuauccugucaaauaaucucauuguagaacguaaaaagcauuuuaaaaauuuuuuuccauuaaagacaaggguauuuggcaauuauuauucaagaaaaaagucaccuuagcuucuaauaucaauagaacuguauuuucaaucgaaaaagcuuccuguuaaugaaugauagucaauuuucuacaccaacuuuuaaauuuuuuugguuuuauagaaauaccauaaaggaaaauguaccugaaugaucugugcuucaucuuugaaauucaugaacuccuaggaaacccagauccacagcugcccuaaauguuuacccugugcugggagaagggaagauucgcagguaacuucagacuccagggcgccagcauuuucuuucugaagugcggcccuuucaucugacuuguuugcugggacuuuucagagagguucgcguccugauuccuguccaaguguugucaggcuguuaggaagaaaucucugaaaaggccuccgccugcugagccgaagugugggcuucacaaaagucaauacuuucaacuuuuccuuugcccuggguguguuuaaaggggcuuuccaguacagaucccuuuuauugcaggugaggguugguagagaaauaauagcuuucaucuuuuguccuucugcgaagaauaaaaaugaagaaacagggaugcccucuuuu

SEQ ID NO: 21060 - RNA, 685 nt, Homo sapiens
aaaagagggcaucccuguuucuucauuuuuauucuucgcagaaggacaaaagaugaaagcuauuauuucucuaccaacccucaccugcaauaaaagggaucuguacuggaaagccccuuuaaacacacccagggcaaaggaaaaguugaaaguauugacuuuugugaagcccacacuucggcucagcaggcggaggccuuuucagagauuucuuccuaacagccugacaacacuuggacaggaaucaggacgcgaaccucucugaaaagucccagcaaacaagucagaugaaagggccgcacuucagaaagaaaaugcuggcgcccuggagucugaaguuaccugcgaaucuucccuucucccagcacaggguaaacauuuagggcagcuguggaucuggguuuccuaggaguucaugaauuucaaagaugaagcacagaucauucagguacauuuuccuuuaugguauuucuauaaaaccaaaaaaauuuaaaaguugguguagaaaauugacuaucauucauuaacaggaagcuuuuucgauugaaaauacaguucuauugauauuagaagcuaaggugacuuuuuucuugaauaauaauugccaaauacccuugucuuuaauggaaaaaaauuuuuaaaaugcuuuuuacguucuacaaugagauuauuugacaggauagaa

SEQ ID NO: 21061 - RNA, 25214 nt, Homo sapiens
auuuuuauugcuaguuucauuugcuucuguucuugccauuauucaucauucuuucccugaaagucuuugugauauaaccuuuuuuucucaugaaccacucaauuggauaaaagacucaaaaucugccuuaccaugcaguauuauuauacuguuauugaaaauuguuucuuuguauauuuuucuuauaggacauacagugggagaaguuauuaaauuagguccuaauggaucuccaagaagagccugggggaaaaguccgacagauucuguucuaaagauacuuggagaagcugaacuacaacuucagacagaacuauuagaaaauacaacuauuagaagugguaaggagaaacugguaguuuuucuauacuagaaguaauauuauuaaaaaucuaauuauguauuuuaagauguuuccauuuuaagugaauuauuuuuaauuaucuuucucuuauaauaauuuuuuaauuagauugagaaugauuguguuuucuagggggauuguccaaaugguagucuugaguuuugaccugauagaccuggaugggaucuaaaaggaaaaugaaguguguauggguggaguuggaaaagucagaaugauguuuuacaugaaaacagauauaggagaaaugcacugagaugaauugugucuguuuugauauggauucaagaaugagauugacuaaaagguauuuuaguagguaugacagacauuauuaauucuaggacuggggaaggagaguugucaugaggcaggaggaaauauuccugauccauaaguuuuguggccuuugguauuacagcuaugcaucaagaagaguggcuauguaugaaacagguauuuucagauuaaacagcuuguuuaaaugaugaggaaguggaguguacuuuuccucuuuuuagaaguugugucuaggcaggaguguguguugcacuuuuguguucuuuuuccuucucuaucucucucacucuuuuucucugucuccccuuaaaaagcuucuagugacacucauauccagagcugguggaaaaauaaccuaggagaugacacugcugauauguucaauaauggaauuagccagugaaacgaaccuauacacauguuacugaaauggcaaaaguaggcugcuaauaauucuguuauuuucuuuaauauuaaagggagaaaacaauuugaauugagaaauacagucaucugcaaaaaaggcaaaaaguguauauguuuguaauuaauuuguucacauucucauauaaggaaauuuugcaguuguaugccaaauacuaauuaaaaauacuaguaacuuuuucaaaauguuccaggcuuuauucaagacaaaaaugccuucaggcucuaacauuuuuuuaaauaauaauaauaauuuuacucugcagugcaaaacucucuggaaaaaaaugagaaaaaaauucagauuuuuuuuguagucuaaaagcucuauaauaugcugaugcucauuaacacuauuacuuuuaaaauauuagauucugauuccuugaugucguuuuauuaauuaaauauaugcaauuugguguacaguaauacuuaaaccgcauaaaaauugggcuuucauucuucguauucaucauaauccauuugcacagaauuggaacugagaaauaacuuaugauuucucuucauucagucaccaacuauuuauugaacacuucuuaguuguguucacuauuauauguuagaugguaagcuauaaaggaaaaaaagaucauucuugcucucagaggacagacaaaaaugaaaacaaauaauaacauugcgugaaaaggacaagaauaaaaaguacccacaaaguucagaauuaaugcagagauauuuagguaauuaacuuuaucuuguauagucaagaaagacaucccagaccuguuaucuccccucuucuuuuucucccaaauacauuuacugggaagaauaugcucuguauugggauuuuaagccaaagaagugacaguuuuuaccaucaucgaaaucacauguggcaaaaucuguguuacagauguuuuuugugaaaugcucugcggccacagcugagguagcuuuacuuuaucaguacuauaugccuuuauuaaugauaacacauauggcccuuuuggguaagggagagccacaagacaauaagcaguuuugggaccacagaugagguggcuuuucuuuaucaguaccauacgguuuuauuaaugacaauauauauggcccuuuuagguaagggaaagccacagagaauaagcaauuuuuggguguaucaaagauuguuuuucaaauaacucauaagguagauaagggggagaaugaaauuccaggcaguaugcuauucuaguauaugcaaagacaaagguuuagcucauguguauguggagguagcuucaugugguagaaagagaaugggcuuugguuccaauccuggcuuuauuacuugcucagcaacaauggauaaguuccucugacuuuggcauucauuuccuccauguguagaauggaaacacuacuaucaaggcuuguuuuguguauuaaaugagaaacauaaaagauccuugguguucuuuauuuuagucuuccaauucuuaugucagugucuccuuagucauucugauugcuugaaacucuuuuuguaauagauuccuuaggaaggacuugugugaacacuacacucauagauuuuccauuuucauaacaguuugucuuaugacuuuauuugugagggucgauuuggcugcauguaaaauccuuggcuuacuuuuuuuuccuugacugucuuuaauauauaguuuaauuauauucuggcauaaaacauugcugcagaaagucugauggcaguuuuauuuucuuuaccuuauaagugauuuggucuuuuugcuuggaugcucagaguauaucuuucuuuuuacuuaaaguccaaucauuuucuuaaaauauauuuuggcauugaguuuauuuuucuaguacaguacauaguggguuuuuuuuguuuguuuaauagaccuuuucuuauaggaguuuuggauacauagugauaugguuuggcucuguguccccacccaaaucucaucuuauagcucccaugauucccacguguuaugagaggaaccuggugggagaugccugaauuaugggggcaggucuuucccaugauauucucguaauagugaauggaucucacgagaucugaugguuuuuaaaaaaugagaguuucucugcacaagcuuuuuuuuuuuuuaaccugccaccauccauguaagaugugacuugcuccuccuugccuucugccaugaucgugacgccuccccagccauguggaacugugaguucaguuguaccgcuuucuuuuaugaauuucccagccucaggcauguccuuaucagcagcaugaaaacggacuaauacacguagcaaaauugagugaaaaguacagaguuccuguauaugcccuucccccauacacacacagccucccccaccaucaauagcccacaccagagagguacguuuguuuuaaucaauagaccaauguugacacaucauuaucaccaaaguguauaguuuacauuaaaauuuacucuuggugcuuuaauugcccuggguuuugacaaauguauaaugcuauguaaccacuauuauuacacaagaauuugcugccccaagaauccccugugcucugcuuauauuaucccucccuuucuuccaaacccuggcaaccacugauuauuuuacuaucuccauaguuuugucuuuuccagaaugucauguaauuggacucauacaguauguacucuuuucagauuggaugguuucacuuaguaauauacacuuaagguuccucuguaaucuuuuugugucucaauagcucauuacuuuuuagcgcagaauauuacauuguauggaugugccacaguuuauuuauucacuuucaagauguacugaaagacaucgugauugcuuccaagugauagcaauuaugaauaaagaugauauaaacaucuaugagcagguuuuuguguggacuuaaguuuucaauucauuugggugaauacagaggaauacaguugcuggauugucuaguaagaguauguuuaguuuuguaagaaaccaccagucucccaaagugucuguaccauuuugcaguguaugaaugagaguuccuuuuacuccauguccucuccagcauuugguguugucaguguuuuggauuuugguuauuuuaguugcuguguagugguaucuuguuguuguuuuuauuugcaaucuccuaauaacauaugauguugaaccucuuuucauaugauucuuacuauaugcugcuuugccaccuguauaccuuagugaguugccuguugagaucuuucacccauuuuuaaauuggguacuuuauuuucuuauuguugaguuuaagaauucuuaguauauuuugguuaaugguccuuuaucaaauaugucuuuugcaaauacggauugaguaucucuuaucugaaaugcuugggaucagaaguguuuuggauuggguuuuuuuuuucagauuuuggacuguuugcauuauaccaguugaguaucucuaauccguaaauccaaaaucugaaaugcuccaaugaacauuccuuugggcauuauaacaauguuccaaaagguucauauuuuggagcauuuuggauuagagauagucaaccuguauuuucuccuagucuguggcuuuucuucauguucucuugacauugucuuuuuuuuuuuuuuuuugagauggggucucacuguguugcccaggcuggagugcaguguugcaacauggcucacugcagccucaaccucccugggcccaggugauccuuccaccuuaacuuccugaauagcuaggacaacagguaugcaccaccaugccuggcuaauuuuuguauuuuuaguagagagaggguuugcccaugugauccucccaccucaaaccccaaguagcugggaccaccagugugcaucauugugccuggcuaauuuuuguauguuuuguagagaugguguuucuccguguugcuuaggcuggucucaaacuucugaggucaagugaaccauccgcuucagccucccaaagugcugggauuacuggugugagccacugcacccggccuaguuuugcauuuuauauuuaguuaugugauuuauuuggaguaaauauuuuugaagaguuauaaggucugugucuagauacauuuuuuucguaaguagauguacaguguuuuuuuagcaccacuuauuguaaauacuauuccuucuucgaugaauuaacuuugcuccuuugccaaagaucaguugacuauaucuguauggggccauuucugaacucuguauccauuccauucaacuuuuuuccuguucuuuugccaguaccccaguauccugauuacuguagcuuuauaguauuucuugaagucacauagugucagucccccaacuuuguucuccuucaauuauguauuggcuauucugggucuuuuguauauccauauaaacuuuagaguuauuaugucuguauccacaaaagagcuugcuggguuggcugggauuauguuaaauccaaagaucaaguuggaaaaaaacugacaucuuaaugauauugaagcuuccuguccauaaguuugagauaucucuuuauuguucuuuaauuuuuucaucaguuuuguagucuucaucauaguauaucuuuuuaauauguagcuuccggucuuuuuuuccccugucaguuuuaggagucuuuuuuuauccucucaauuuuaggacaguacucuugaauuauugccugucuucuucccuccccuccccuccccuccucuccuuucuccuccucuucccucccucuccccuccuucuccccuccccccuucuuucucuccuuccuuccuuccuuccuucucucccccugccccgcacuuucucucuuucucccuuucuccuuuucuccuuuucucccuuucuuucuuuuuucuaacagcaauggagucuugcuauguuucccaggcuggucuugaacucauggccucaagugauccgccugccucagccuccaaagggcugggauuauaggcaugugccaccauaccgggcaucuaguauucuguuuuuuuuucuccagucuuugggaauuuccacuuuguauauuuugggucaucuuugccuuuccucucagucaauugcucuuuuuucuuaaugucuuauuaacuauuguggguacauaguagguguauauauuuauuggguacaugagguauuuugauacagauaugcaaugcauaguaaucacaugaggguaaaugggucacauaaagcauuuauccuuucuuuguauuacaaacaguccaauucuacuauuuuaguuauuuuuaaaugcacaauauauuauucuugacuuaacucuagucaccuaguugugcuaucaaauacuggaucauauacauucugucuaacuguauuuuuguacucauuaaccaucccccaccacccaccaccaccacccuuccuagccucuaguaacuaccauucugcucucuuuaucaccaugaguucaguuauuuuaauuguuaacucccacaaauaagugagaacaugugagauuugucuuucugugccugucuuauaucacuuaauauaaugaccuccaguuccauacaugaaacugacaggaucucauucuuuuuuuguggcugaauaguacuccauuguguauaugucccacauuuucuuuauccauucaacuguugauggacauuuagguugcuucuaaaucuucgcuguuguaaauagugcugcaauaaacauggaacugcagauaucuguuugauauacugauuuccuuucuuuuggauauauacccagcagugggauugcuggaucauaugguagcuauauuuuuaguuucuggaggaaccuccaaacaguuauauaugucuagaaauuuauccauuucuucuaaguuuuccaaucuauugaaauacagcugcucauaguagcuucuaaagauccuuuuaauuucugcaguaucaguuguauuauaauuccuccuuuuucaucucugauuuuguuugcuugggucuucucucuuuuucuuagucuggauaaagguuuguugauuuuguucaucuuuucaaaaagccaacuuuugauuucauuuaucuuuuguauucuuuguuucuauuuuauuuauuucugcacucaucuuuauuauuucuuuucuucuacuacuuuugggcuuacuuugcucuugcuuuuguaguucuuuaagauggaucauuagauugucuacuugaaguuuuuccucuuuuuugguguagggaccgauagcuauaaacuuccgucuuaguacugcuuuugcuguaucccagagguauugguauauuguguuuccauuaucauuuguuucaaaauuuuuuucaauuuccuucuuaauuucuucauugacccacuguuuauucagaagcauauuguuuaauuuccauguguuuguauaguuuccaaaaauuccucuuguuauugaugucuaguuuucuuccauuguggucagagaagaaacuugguauaauuucagguuuuuugaauguuuuaagacuuguuuugugaucuaacauauguucuauccuugagaaugauucauguacugaggagaagaagccguauucugcagcuguuagaugaaauguucuguagauaucgauuagguccauuuggucuacaauacagaugaagucugauguuucuuuucuuuuuuuuauuuuucuuuugcugcuccuugcagagcugugaugaccccuaggcagugcuacuagacuagagucagcuaagucugauguuucuaugucgauuuucugccuggaugaucuguucaaugcugagaguauaguguuaaagucuccagguauuauuguauugggggcuaucucucacuuugacucuaauaauauuuccuguacauauauggguacuccaguauuggaugcauauauauuuauaacuguuauauccucuugcugaauugaccauuuuauaauuauauaaugacguuauuuguaucuuuuuauaguucuugucuugaaaucuauuuugucucauguaaguauaguuacuucugcccuuuuuugguuucuauuggcauagaauaucuuuauucaucccuuuauuuuuggucugugugugucuuuauaggugaagucuguuucuuguaggcaacuguucauugagucuucuuuuuuuuuuuugauuaugcuucaaguucuaggguacaugugcacaacgugcagguuugauacauagguauacaugugccauguugguuugcugcaccaaucaacucaucauuuacauuagguauuucuuguaaugcuaucccucugccaggccccaaccccccaacaugccccagugugugauguucccugcccugugucaaaguaaucucauuguucaguucccaccuaugagugagaacaugugguguuugguuuucuguccuugugauaguuugcugagaaugaugguuuccagcuucauccaugucccugcaaaggacaugaacucauccuuucuuauggcugcguaguauuccaugguguauaugugccacauuuucuuaauccagucuaucauugauggcauuuggguugguuccaagucuuugcuguugugaauagugccaccauaaacauacaugugcaugugucuuaaaggagcaugauuuauaauccuuuggguguauacccaguaaugggauuucugggucaaaugguaauuauaguucuagauccuugaggaauugccacacugucuuccacaaugguugaaccaauuuacacucccaccaacaguguaaaagcguuccuauuucuccacauccucuccagcaccuguuguuucuucacuuuuuaaugauugccauucuaacuggugugaaaugguaucucauuguggcuuugauuugcauuucucuaaugaucagugaugaugagcauuuuuucauauguuuguuggccacauaaaugucuucuuuugagaaguuucuguucauauccuuuuccccaccuuuugaugggguuguuuuuuucuuguaacuuugcuuaaguucuuuguagauucuggauauuagcccuuugucagauggguagauugcagaaguuuucucccauucuguagguugacuguugacuaugaugguaguuucuuuugccaugcagaagcucuuuaguuuaauuagaucccauuugucuauucuggcuuuuguugccauugcuuuugguguuuuagucaugaaguccuugcccaugccuauguccugaaugguauugccuaggguuuucuucuaggguuucuaugguuuuaggucuaacauuuaagucuuuaauccaucuugaauuaauuuuuguauaagguguaaggaagggauccaguuuuagcuuucuauauauggcuagccaguuuucccagcaccauuuauuaaauagggaauccuuuccccauuucucguuuuugucagguuuguuaaagaucagaugguuguagauguguggcauuauuucugaagccucuguucuguucuauuggucuauguaucuguuuugguaccaguaccaugcuguuuugguuacuguagccuuuuagugcugagaccaucuuggucagggagacccuaacccagccgcacuagaggaauuaaagacacacacaggaauauagaggugugaagugggaaaucaggggucucacagcuuucagagcugagagccccgaacagagauuuaccuacguauuuauuaacaguaagccagucauuagcauuguuucuauagauauuaaauuaacuaaaaauaucccuuaugggaaaugaaggaaugggccgaauuaaaggaauagguugggcuaguuaacugcagcaggagcauguccuuaaagcacagaucgcucaugcuauuguuuguggcuuaagaaugccuuugaacaguuuucugcccugggcgggccagguguuccuugcccucauuccaguaaacccacaaccuuccagcaugggcguuauggccaucaugaacaugucacagugcugcagagauuuugauuauagccaguuuuggggccaguuuauggccagauuuuggggggcuuguacccaacauuguaguauaguuugaagucagguagcaugaugccuccagguuuguucuuuuggcuuaggauugucuuggcaaugugggcucuuuuuugguuccauaugaacuuuaaaguaguuuuuuccaauucugugaagaaagucauugguagcuugaugggaauggcauugaaucuauaaauuacuuugggcaguguguccauuuucacgauauugauucuuccuauccaugagcauggaauauucuuccauuuguuuguguccucuuuuauuucguugagcagugguuuguaguucuucuugaagauguccuucacaucccuuguaaguugaauuccuagguauuuuauucucuuuguagcuauugugaaugggaguucacucaugauuuggcucugugugugucuguuaaugguguauaggaaugcuugugauuuuugcacauugauuuuguauccugagacuuugcugaaguugcuuaucagcuuaaggaaauuuggggcugagacgauaggguuuuaaauauacaaucaugucaucugcaaacagggacaauuugacuuccucuuuuccuaacugaauacucuuuauuucuuucucuugccucauugcccuggccagaacuuccaacacuauguugaauaggaguggugagagagggcauccuugucuugugccaguuuucaaagggaaugcuuccaguuuuugcccauucaguaugauacuggcuguggguuugucauaaauaguucuuauuauuuugagauauguucugucaauaccuaguguauugagaguuuuuagcaugaagggcuguugaauuuuguugaaggccuucucugcaucuauugagauaaucaugugguuuuuguuguugguucuguuuaugugauggauuacguuuauugauuuguguacguugaaccagacuugcaucccagggaugaagccaacuugaucaugguggauaagcuuuuugauaugcugcuggauucaguuugccaguauuuuacugaggauuuucgcaucgacguucaucagggauauuggucuaaaauuaucugguugugucucugccagucuuugguaucaggaugauguuggccucauaaaaugcguuagggaggauucccucuuuuucuauugauuggaauaguuucagaaggaaugguaccagcuccucuuuguaccucugguagaauucagcugugaauccaucugguccuggacuucuuuugguugguaagcuauuaauuauugccucaauuucagagccuguuauuggucuauucagggauucaacuucuuccugguuuagucuugggagaguauauuguuaaagucuccagguaguaauuauguaaguacguguccaggaauguaugcauuucuucuguauuuucuaguuuaucugcauagagguguuuauaguauucucugaagguaguuuguauuucugugggauugguggugauauccccuuuaucauuuuuuauggcaucuauuugauucuucugucuuuucuucuuuauuagucuugcuaguggucuaucaauuuuguugaucuuuucaaaaaaccaucuccuggauucauugauuuuuugaaggguuuuugugucuaucuccuucaguucugcucugaucuuaguuauuucucaccuucugcuagcuuuugaauuuguuugcucuugcuucucuaguucuuuuaauugugauguuagggugucaauuuuagaucuuuccugcuuucucuugugggcauuuagugcuauaaauuucccucuacacacugcuuuaaaugugucccagggauucugguauguugugucuuuguucucauugguuucaaagaacaucuuuauuucugccuucauuuuuuuauuuacccaguagucauucaggagcaaguuguucaguuucuauguaguugugcgguuuugagugaguuucuuaauccugaguucuaauuugauugcacuguggucugagagacaguuuguugugauuucuguuauuuuacauuugcugaggagugcuuuacuuccaauuauguggucaauuuuagaauaagggcuauguggugcugagaagaauguauauucuguugauuugggguggagaguucuguagaugucuauuaggucugcuuauugcagagcugaguucagguccuggauauccuuguuaaccuuuuuucucguugaucugucuaauauugacaguuggguguuaaagucucccauuauuauugugugggagucuaagucucuuuguagguaucuaagaacuugcuuuaugaaucuggguccuccuguauugggugcauauauauuuaagauaguuagcucuucuuguugcauugaucccuuuaccauuauguaauggccuucuuugucucuuuugaucuuuguugcuuuaaagucuguuuuaucagagacuaggauggcaacccccgcuuuuuuuugcuuuccauuugcuugguagaucuuccuccauuccuuuauuuugagccuaugugcaucuuugcacgugagaugggucuccuaaauacagcacaccaauuugccagucugugucuuuuaauuggggcauuuagcccauuuauauuuaagguuaauauuguuaugugugaauuugauccugucauuaugauguucacuguuuauuuugcccauuaauugaugcaguuucuucauagcaucaguggucuuuauaauuuggccuguuuuugcaguggcugguaccaguuuuuccuuuccauguuuagugcuuccuucaggagcucuuguaaucccucagcauuuucuugucuguaaaggauuuuauuucugcuucacuuaugaaacuuaguuuggcuggauaucaaauucuggguugaaaauucuuuccuugaagaauguugaauaauggcccccacugucuucuggcuuguaggauuucugccgagagaucugcuguuagucugaugggcuucccuuuguggguaacucgaccuuucucucuggcugcccuuaauacuuuuuccuucauuucaaccuuggugaaucugacaauuaugugucuugggguugcucuucuagaggaguaucuuugugguguucucuguauuuccugaauuugaauguuggccugccuugccagguuggggaaguucuccuggauaauauccuggagaguguuuuccaacuugguuccauucuccccaucacuuucagguacaccaaucagacguagauuuggucuuuucacauagugucauauuucuuggaggccuuguucguuucuuuuuacucuuuuuucucuaaacuucucuucucgcuuuauuucauucauuugaucuucaaucacugauacccuuucuuccacuugaucgaaucagcuauuuaagcucaugcaugugucacgaaguucucaugccaugguuuucagcuccaucaggucauugaaguucuucucuacacuguuuauuauaguuagccauucuucuaaucuuucuucaagguuuuuagcuuccuugcuaugaguucaaacauccuccuucagcuaggagaaguuuguuauuaccgaccuucugaagccuacuucugucaacuugucaaagucauucucuguccagcuuuguucuguugcuggcaaggagcugugauucuuuggaggagaggaggugcucugauuuuuagaauauucagcuuuucugcuuugguuucuccccaucuuugugguuuuaucuaccuuuagucuuugauguuggugaccuccaggugggguuuugguguagauuaccuuuuuguugauguugaugcuauuccuuacuguuaguuuuccuuuaauagucaggucccucagcugcagaucuguuagaguuugcuggaguuccacuccagacccuguuugccuggguaccaccaguggaggcugcagaacagcaaauauugaagaacagcaaauauugcugccugauccuuccucuggaagcuuugucccagaguggcagccaccuauaugaggugucagucagccccuacugggagaugucucccaguuaggcugcgugggggucagggacccaguugaggaggcagucuaucuuuucucagagcucaagcaccaugcugggagaaccacugcucucuucagagcuguuagacagggucguuuaagucugcagaaauugucugcugccuuuuguucagcuaugcccugcccacagagguggagacuacugaggcgguaggccuuguugagcugcggugggcuccgcccauuuugaacuucugggcagcuuuguuuaccuacucaagccucagcaauggcggaugccccuccccgagucaggcugcugccuggcagauccaucucagacugcugggcuagcagugagcaaggcucugugggcgugggaccugccgagccaggcacaggagagaaucaccuagucugccgguugcuaagaccuugggaaaagcacaguauuuggguggggagugucccguguuuccagguagucugucacggcuucccuuggcuaggaaagggaaaucccccgacucauugcgcuucccaggugaggugaugccccacccugcuucggcucacccuccgugggcugcacccacuguccaaccagucccauugagaugaaccagguaccucaguuggaaaugcagaaaucacccaucuucuccaucaagcacgcuggaagcuguagacuggagcuguuccuauuccgccaucuuggaacuccuguugagucuucuuuuuuaaucuauucagccacucucugucuuuugauuggagaguuuauuccauuuacauucaaugggauuauuacaaguaaagacuuaauucugccauuuuguuauuuguuuucugguuguuuuguggacuucucuuccuuccuuccuucauaucuucauuuuagagaaggugauuucuuuagugguauguuuuaauuucuugcuuuuuauuuuuuugcguaucuguuguaugauuuuuuauuuuugaggguacuaugagguauaaauacuaucuuauaacccacuauuuuaaacugaugacaacagugauugcaaaaacagauaccaaacaagcaaauaaaaaacuaauaaagacucuaacuuugucccucacuuuucaacuuuuuguuucuauuuguaucuuacuguauugucucucaaaaaguuguaauuuuuuuuuucuugagacagggacucacucugucacccaggcuggagggcaguggcacaaucucagcuuacuacaacuuccaccuucuggcucaggugaucucacaucagccucccaagcagcugggacuacaagcaugucccacugcuuguagccaccacacauggcuaaauuuuuuuguauuuuuuuuuuguagagaaaggguuuugccuguugcccaggcugguuucauguugcauguugcccaggcugguuucaaauuccuggguuccagcaauccucccaccucagccuuccaaaguucuaggauuacaggcauaagccaucacaccucacauaauguuuauuuauuuuauuucauuuuauuuuuugagacagagucucacuccguugcccgggcuggagugcaguggcacgaucucggcucacugcagccuccaccucccggguucaagugauucuccugccucagccucccgacuagucuggaucacaggugugugccaccacaccuggcuaauuuuuuuguauuuuuaauagagaugggauuuuagcauguuggccaggcuggucucaaacuucucaccucaagugauccacccgccuucaccucccaaaaugcugggauuacaggcgugaauaauuuuuauuuucaaucaguucaucuuuuagucuuucuacucaagauaugaguagcuuacacaccacaauuacaguguucuaauauucuguguuuuucuguauacuuacuauuacuggugaauuuuacaccuucagaugauuucuuauuacucauuauuguccuauucuuucauauuaaagaacuccuuuuagcauuucuuaugggacaggucuuguguugaugaaaucccucagcuuuuguuugucugguagucuuuauuucuucauuauguuugaaggauauuuucucuggauauacuauuuuaggauaaaaguuuuuuuccuucaguacuuuaaauauguccugucacucucuccuggccaguaagauuuuugcugaaaagucugcugccagacacaaagucugcugcugcuuuucuccuuuguuugucuuugaccuuuuggaguuugauuaguaaaugucuugagguagucuuccuuggauuacaucugcuugguguucuauaaccuucuuguaguugaauauugguaucuuuuucuagguucaggaaguucucugacauuaucccuuugaauaaacuuuguaccccggucucucuacuuccucguuacaacgaaucacucuuagauuugcccuucugagucuguuuuuuagaucuuguagguauuccuuauucuuuuuccuuuguuuuuugucuccucugacuauguauuuucaauuguuuuuugucuccucucacuauguauuuucaagcagccugucuucaagcucgcuaauucuuucuucuuuugauguguucugcuauuaaaggacucuuaugcauucaucaguaugccaguugcauuucucagcuccagaauuucugcuugauucuuuuuaauuauuucaaucuuuuuguuaaauguaucugguaagauucugaauuuuuucuguuauuuugaauuucauugaguuuccuuaaaacagcuauuuugaauuuucugucugaaaggucauauaucucugucuuucugggauuggugucugguaccuuauuuaguuauuuggugaggucauauuuuccuggguggucuugauguuauggguguucaucggugucuggguguugaagaauuugauauuuauuguaguuauuuugggagguugucugugugcaggaauuugucuauuaccucuagguuuuccaauuuguuaacauauaguuguucauaauaguuucacaugguacuuugcauuucuguaguauuuguuguaauggcucuuuguuuuuuauuuucuuuauuugggucuucacucuuuuucucuuagucucguuagugguuuuucaauuuuguuuaucuuuucaaaacgccaacuuuuguugauuuuuuuagugucuguuugauuuuguucugcuugauuauuauuucuucuacuaguuuugcuuuuuuucauuaacuguagucauccuacuguacuauuuuaaacacuagaauuuuauucuauuuaacuguauuuuguaugcauuaaccagccacacuuuccagcuucugauaagcaccauucugcucucuacuuccaugagaucaauuuuuuuagcucccaccuauaagucagaaacaugcaauguguauuucucuauauggauaaugaccuccaguucuauccaucuuacugcaaaaaaauaagauuucauucuuuuuauggcugaauaaugguccauuuugugcauguguguguguguguguguguauauauauauauauauguauauaguuguuuuguuuuaaguuuagugggugcaugugcauguuuguuacauggguauaucgcauaaugcugagauuugggcuucuguugaacccaucacucaaauagugaugauaguaccugauaguuuuguuuuguuuuuuuuugccuucuccccacucccuccuuccuuccuuuuggaguccucaucaucuuauuauuuucaccuuuguguccauguguaccaauuauuuagguuccacuuauaagugagaacauguaguacuugauuuucuguuucugaguuaguucacuuaggauaauggccuccagcuccauccauguugcugcuuuuacuaauuuuggauuugaccuuuuuuugcuuuucuaguuccuugaaauacaucauuacauuauuuauuugaaaucugucucuuuuuuuuauaaacagggucucacucugucgcccauguuggaguacaguagugcaguuguagcuugcuauaaccuuaaacuccugggcucaagcaauccucucaccuuagccuccugaggaacuaguacuacaggcagccaccaugaccagcuauuuuuuguuuuuguuuuuguuucaguagugacagggucucacuuuguugcccaggccgaucucuaacuccuggccucaaggauucuccuacaucagccucccaaaauauugaaauuacagccaugagcuucuggcccuuuugugauauggguguuuauugcuauaaacucucagcacugcuuuugcuguuucccauagauuuugguuuguuguguuucuguccccauuuguuucaugaaauccauuuauuuccuucuuaauuucuucguugacucaauguuugcucaggagcauguugcuuaaauuccauguauauguacaguuuccaaaguuccucucgugauugauuucuaguuuucuucaguuguggucugagaagguacuugauaugaaguaguuacguuuuaauuuguugagauuuguuuuguagccuaccauguggccuguccuggagaauguugcaugugcugaugagaagaauguauauucugcugcuguuggauguguucuguagaugucuguuacguccauuuggucuaaagugcaguuuaaaucaaauguuucuuuguuaauuuucagucuagauuaucuguccagugcuguccauggggcguugaaguccacaacucuuauuauauuggagucuaucucucccuguaguugcuuuauauaucuagggguucugcuguugagugcacaucuauuuauaauuguuagaucugcucauuuaauuuuucccuucaucauuauguaaugaccuucuuugucuuuuuuuacagcuuuuggguuaaaauaugucuuaucugauauaaguguaugccuucucccacucuuuuuuuguuuccauuugcauggaauaucuuuuucuguuucuucauuuucagucuauauauguaaugaguuuauuguaggcagcauguaguuuggucauuuuuuuuuaaccauucagccaaccuguaucuucuaaaugauuaauuuauuucauuuauauuagagguuauuauugauaggugaggacuuaacucuagucauuuuguuaauugguuuuuggauguuuuguauauuuguuguucuuuucuuucucuuuuauuguuucauugcaguuugguuauuuucuauaacauuugacuccuuuuucucuuuuguuugugaaugugcucugucagguuuuauacuuuaaugugcuugcaugguguuagauacuguccuuuuauuuccacauguagugcucucuuaagcauuucuuauaggaucagucugcuguugaauucucccaguuuuugcuucuuugggaaagacuuuauuucuccuucauuuuugaaggauagcuuugguggguauaguauucuuggcugacaguuuguuguugguuuguuuuugguuuuguuuuuguuuucucagcacuuugaauauaucaucccguuuucuccuaucuuauaaguuuucugcugagaaagccauuguuagucuguugggggugcccuuauauguaauuugaugcucuuuucuuucuguuuuuagaauucucuuugacuuuuaacugucugauuguaaugugccuugggaagaucuuuuuggguugaauauuuuugugucuuuaaguuuccuguaucugaaugucuauaucucuuacaaggcuugggaaauuuucagcuguuauuucguuagagaaauuuucuauguccuugcccaucucuuuuuuuuucugaaacacccaaaauuugaauauuugggcacuuuacaauuucucuuaugucacauagacuuccauucuuuuuuuuucuuuuauccuuuucuuuauuuucugaguggauuauuucgaaagaacuguuuucauucagaaacucuuuuuucuguuuagucuauuguugaagcucucaguuguaauuuuauuuaauucauugaauuuugugguggguggggggguuugggguuuuauuuguuaguuaauuuguuuguuuuugagacagggcucugucacccaggcuggagugcaguggcagugcugugaucacagcuuacugcagccuugaccuccuggguucaagggauccucccaucucagccucccaaguagaugggacuacaggcuuuugacaccaugcuuggcuaauuuuguuuauuuuguguagagacagaguuuugccauguugcccaggcuggucucaaauuaugagauagauagauagauagauagauagauagauagauagauagauagauagauaaaauauuuuuacuugguuagagacaggcugucugccauccaggcuagaguacauuggugcaaucauagcucacuacagccucaaauccuggacucaggagauccuuccaccuuaucuuccagacuagcuauggcuauaggcacaugccaccacaccugacuuacuuuuuaaagaauuuccuguagagacaguaucucacuguguugcccaggcuggucuccaacuccuggcugcaagcgguccuucugccuuccuuuucuaaaacacuaggauuacauuugugagucauagcaucuggcccuguuugguuaucuuuaaugauaucuauguugaauuucucauugagaccaugaauuguuuuucugauuucuuuguauuauuuaucuguguucuccuauaccucacuuagcuuuaauuuuacuuugaauuguuuuaggcauuuuguagauuuauuuuuguuggaaucuuguuggagaauuaccguguucuuuuggagguaucauguuuccuuacuuuucauguuucuuguguccuuauauugauaucugugcaucuauuguaauaaucacuucuuccgauuuuacggauugacuuucguaggcaaagacuuuuucccguauauguauccauaguguugguugaguaggguguuuuggcuuugauucugggugggcagaguagugcagucuucauaugauuucuuuggcuguaaucagugucagugguaucugugaauuccugugugucuuagguuaugauuguuaguggagacucugguaaggauuuaccguggacagggagccaguugagccaguccucaggccccagucuuggcagcaugcugagaaugcagguacuuggccccccagaugguguucaggcacuggugauaguggguccagguaauccuugggccuccacauggcuuacuugggugccagcaguagcaguggugggccaggugggcagggcuagucccuggguccaucaucagcacucaugggcaccagcaguggugguggugaacugagagggcuagucuccaggccuuuagugcagguggaugguggcaguggcugcagguugggucucagggcccucuggaagguauguuugggugucugugguggcggacagagguggguagaucuccagaccucuggacaauacacauagcacuauugggggcaucgccagguagagcaggccuauacuugggccccuguguggugcaugugcaggcaguuuauguugggcaggacugguugaucucuagacccuagaugaugugugugggugcuggcaggcugggugggcccuuucccaagccccuggaaagcuuauacaggcacuagcagcaauaggcauggcaaauugaucccugugccccuggaugaugcucacaggccuuugccaaggcaguagcagggcagggugggucugucuucaagcccugugauggugcugucaggcacagguugugcuuagcacaguaggucuacccccaggaccccagacugcacacucagaaaucaguggugguggugguaggcaggagggccuguccucaggcccccugacugugugugcaggcaccugcaucagcaggcaugguggguugaucuccaguccuggaugacaugcuugcuagugccagcucugaugcauggggcagaucgaucucccagcuaccagguagcauucucaggugguggcaucagugagugggccaggccugaccucaggcucuaggauggcacccaagcaugccuaucuccuugcuccugaaggugcacacaagugcacauucacccaggugcuaggggaggcaggguugcugucaguaccagcaacuccaggaaggcagcucccaggcucuggggagcacaugcuucagcucccuuuuucccaggggcagccuuccuaaugugcugcaccacccauuuccugugguguaggacuguaugugggcuagaggacuagggaccuggcugcacaguugaguccagcucaugucacaagguugcaaaucuauagguggacauggaguaaaugucaguagggcuccagggguguggagauucagggccuguugagcccuggggcagguuguuaucugguagggauuggguucucaaaguggcaccauguugcagcugcuugggucucaggaugcugugugagauccagcacaaacuuccucucuagaauaaugcaucacuuugacuccaggcagcuuccucuacuagucucagggcgcuugagggcugaggagccauggcuaggcuugcaggaguccauggugagaacauggagcacuggggaucucucuuaccauuuuccugcauucaggcaggucaaucugugguguuucuccuggcuucuagccaguccuagccaggccaacuguuucgcuucccucuccuuccaugccucagagguuccccaucccuuugcggcugaauuccuguguucucuuucagaugcucuauucaauguguuauuaucuacuugcuguuuuguacuucuuuguggaacagacaagugccaggugucuguggucagccaugcugaagcucucuccaaacccauuuuccaaaucaauuaauauaauaguauaauuucucuuuuauuauauuaauguugcaaauugcauugauugauuuuuaaauaucaaacagccugaaagguaauaucccuuuaaaaaaauuuuuuaccauuuuugugugguauauauuucauugguuuuauuuuuccuuuucugauugugagugaauuucauuauguugcauucuauugacuauuuugauuugcugcuuugaaaauugccuguuuauauucucugcccuuuuuuauauuucauugcuuuuugcuauguuuuaagaauuuuuaucuaguauagcuauccagccgggugugguagcucaugccuguaaucccagcacuuugggaggcugaggcaggucauuucaggucaggaguuugaggccagccuagccaacauggcgaaaugcugucucuacuaaaaauauaaaaaauuagccaggcauagugccgugcgccuguaaucccagcuacuagggaggcugaggcaggagaauugcuugaacccgggagguggagguugcagugagcugagaucacgccaccgcacugggugacagagcaaaacucaggucucuaacaaaaaaaaaaaaaaaaaaaaagauacccuaaccuccuccucuuccuuccccuauuucuuucuauauauagauagaaaauuuuauaucuggacgcuguacugauuauuuuuacuaaaucuauuaagcuuucuuccuugagauauuagauguuccaaaugugcagauuuaucaucagugacaagaaauagauuuuuauccuauauuuugauuauuuccuauucuucuguuagaacccacuaaagcaaucuuuaauaauaauaauaaugcgauaugguauccugauuccugguguuaauagacaugauuuuauugcagaaugguagggcugaaggaggaaaaacacagaugugaucucugcuacagucaguuuguuuuggcaagcaguuuguugaaguacagugcagggaaaugauucugaaacauuugcaacacuauaguuuuguucucuguugacuagaaagaaguaaagaguaaaacaacuuauaaauacuugaugaacaacuuuuuugcucuggaaauuaacugagcuaaggacaguuccugcuagcccaguguuauaaaaggacugcagccaacacaaagggccuacuuggcuuuagaaacaaugaauuuaaauugagaccaaugagcaaggauuucuguuuuucuucaaccauuuuaacccuguguaugcagauauaguaggcagagaauugaauuuaugcaaaauugggguuuugccacuugaauacaauaaguugaggaugcacaagagaaugacuauauuauggaauuucugugaauuuuaauggagaugacagaaaauguagcagaaucagugcauuguagguacuuucaggguaaaauuuuuuuagaguuggaguuguagaggcggagaaguggaaaaugaguguuagagauuagaggguggaauacuuaacacuggaaauuuaaagaggcuauaauuaaugacaaguucucuaagauaugaccauuggagugcuggagauaggaugaagacugagguagagugaagugcaacaaaccaagaggccuaccuuuuggaaggauuauugauacaaauauagaaaucaccuaaauuaguuaugacagaguuaguguuggggagcuuguaaccuggaaaguaaaaucuucaacggauuaauaggagugagaaggugguaaauaacugcauuaagcuauucugagguaguuuuuuuuucuuuuuauucuuuuuugaaccugucucaggauguucugagguaaaccuccucucuccuuaguguggagaauuucagagcaauuagaaguaacuaggaguuacuucauauaaacagaaucaacuaguuaauaauuuaaaaaauaguauucuaauacacauauuaauuuuaccaaaagcagaaagaagguaaaccauuuugaccaccauagaaauuauuauguacaauugaaaugaaauuugacuuucauauacuguagucacuuauuaacuucuaauauguaacagagcuuaacuag

SEQ ID NO: 21062 - RNA, 25214 nt, Homo sapiens
cuaguuaagcucuguuacauauuagaaguuaauaagugacuacaguauaugaaagucaaauuucauuucaauuguacauaauaauuucuaugguggucaaaaugguuuaccuucuuucugcuuuugguaaaauuaauauguguauuagaauacuauuuuuuaaauuauuaacuaguugauucuguuuauaugaaguaacuccuaguuacuucuaauugcucugaaauucuccacacuaaggagagaggagguuuaccucagaacauccugagacagguucaaaaaagaauaaaaagaaaaaaaaacuaccucagaauagcuuaaugcaguuauuuaccaccuucucacuccuauuaauccguugaagauuuuacuuuccagguuacaagcuccccaacacuaacucugucauaacuaauuuaggugauuucuauauuuguaucaauaauccuuccaaaagguaggccucuugguuuguugcacuucacucuaccucagucuucauccuaucuccagcacuccaauggucauaucuuagagaacuugucauuaauuauagccucuuuaaauuuccaguguuaaguauuccacccucuaaucucuaacacucauuuuccacuucuccgccucuacaacuccaacucuaaaaaaauuuuacccugaaaguaccuacaaugcacugauucugcuacauuuucugucaucuccauuaaaauucacagaaauuccauaauauagucauucucuugugcauccucaacuuauuguauucaaguggcaaaaccccaauuuugcauaaauucaauucucugccuacuauaucugcauacacaggguuaaaaugguugaagaaaaacagaaauccuugcucauuggucucaauuuaaauucauuguuucuaaagccaaguaggcccuuuguguuggcugcaguccuuuuauaacacugggcuagcaggaacuguccuuagcucaguuaauuuccagagcaaaaaaguuguucaucaaguauuuauaaguuguuuuacucuuuacuucuuucuagucaacagagaacaaaacuauaguguugcaaauguuucagaaucauuucccugcacuguacuucaacaaacugcuugccaaaacaaacugacuguagcagagaucacaucuguguuuuuccuccuucagcccuaccauucugcaauaaaaucaugucuauuaacaccaggaaucaggauaccauaucgcauuauuauuauuauuaaagauugcuuuaguggguucuaacagaagaauaggaaauaaucaaaauauaggauaaaaaucuauuucuugucacugaugauaaaucugcacauuuggaacaucuaauaucucaaggaagaaagcuuaauagauuuaguaaaaauaaucaguacagcguccagauauaaaauuuucuaucuauauauagaaagaaauaggggaaggaagaggaggagguuaggguaucuuuuuuuuuuuuuuuuuuuuuguuagagaccugaguuuugcucugucacccagugcgguggcgugaucucagcucacugcaaccuccaccucccggguucaagcaauucuccugccucagccucccuaguagcugggauuacaggcgcacggcacuaugccuggcuaauuuuuuauauuuuuaguagagacagcauuucgccauguuggcuaggcuggccucaaacuccugaccugaaaugaccugccucagccucccaaagugcugggauuacaggcaugagcuaccacacccggcuggauagcuauacuagauaaaaauucuuaaaacauagcaaaaagcaaugaaauauaaaaaagggcagagaauauaaacaggcaauuuucaaagcagcaaaucaaaauagucaauagaaugcaacauaaugaaauucacucacaaucagaaaaggaaaaauaaaaccaaugaaauauauaccacacaaaaaugguaaaaaauuuuuuuaaagggauauuaccuuucaggcuguuugauauuuaaaaaucaaucaaugcaauuugcaacauuaauauaauaaaagagaaauuauacuauuauauuaauugauuuggaaaauggguuuggagagagcuucagcauggcugaccacagacaccuggcacuugucuguuccacaaagaaguacaaaacagcaaguagauaauaacacauugaauagagcaucugaaagagaacacaggaauucagccgcaaagggauggggaaccucugaggcauggaaggagagggaagcgaaacaguuggccuggcuaggacuggcuagaagccaggagaaacaccacagauugaccugccugaaugcaggaaaaugguaagagagauccccagugcuccauguucucaccauggacuccugcaagccuagccauggcuccucagcccucaagcgcccugagacuaguagaggaagcugccuggagucaaagugaugcauuauucuagagaggaaguuugugcuggaucucacacagcauccugagacccaagcagcugcaacauggugccacuuugagaacccaaucccuaccagauaacaaccugccccagggcucaacaggcccugaaucuccacaccccuggagcccuacugacauuuacuccauguccaccuauagauuugcaaccuugugacaugagcuggacucaacugugcagccaggucccuaguccucuagcccacauacaguccuacaccacaggaaauggguggugcagcacauuaggaaggcugccccugggaaaaagggagcugaagcaugugcuccccagagccugggagcugccuuccuggaguugcugguacugacagcaacccugccuccccuagcaccugggugaaugugcacuugugugcaccuucaggagcaaggagauaggcaugcuugggugccauccuagagccugaggucaggccuggcccacucacugaugccaccaccugagaaugcuaccugguagcugggagaucgaucugccccaugcaucagagcuggcacuagcaagcaugucauccaggacuggagaucaacccaccaugccugcugaugcaggugccugcacacacagucagggggccugaggacaggcccuccugccuaccaccaccaccacugauuucugagugugcagucugggguccuggggguagaccuacugugcuaagcacaaccugugccugacagcaccaucacagggcuugaagacagacccacccugcccugcuacugccuuggcaaaggccugugagcaucauccaggggcacagggaucaauuugccaugccuauugcugcuagugccuguauaagcuuuccaggggcuugggaaagggcccacccagccugccagcacccacacacaucaucuagggucuagagaucaaccaguccugcccaacauaaacugccugcacaugcaccacacaggggcccaaguauaggccugcucuaccuggcgaugcccccaauagugcuauguguauuguccagaggucuggagaucuacccaccucuguccgccaccacagacacccaaacauaccuuccagagggcccugagacccaaccugcagccacugccaccauccaccugcacuaaaggccuggagacuagcccucucaguucaccaccaccacugcuggugcccaugagugcugaugauggacccagggacuagcccugcccaccuggcccaccacugcuacugcuggcacccaaguaagccauguggaggcccaaggauuaccuggacccacuaucaccagugccugaacaccaucuggggggccaaguaccugcauucucagcaugcugccaagacuggggccugaggacuggcucaacuggcucccuguccacgguaaauccuuaccagagucuccacuaacaaucauaaccuaagacacacaggaauucacagauaccacugacacugauuacagccaaagaaaucauaugaagacugcacuacucugcccacccagaaucaaagccaaaacacccuacucaaccaacacuauggauacauauacgggaaaaagucuuugccuacgaaagucaauccguaaaaucggaagaagugauuauuacaauagaugcacagauaucaauauaaggacacaagaaacaugaaaaguaaggaaacaugauaccuccaaaagaacacgguaauucuccaacaagauuccaacaaaaauaaaucuacaaaaugccuaaaacaauucaaaguaaaauuaaagcuaagugagguauaggagaacacagauaaauaauacaaagaaaucagaaaaacaauucauggucucaaugagaaauucaacauagauaucauuaaagauaaccaaacagggccagaugcuaugacucacaaauguaauccuaguguuuuagaaaaggaaggcagaaggaccgcuugcagccaggaguuggagaccagccugggcaacacagugagauacugucucuacaggaaauucuuuaaaaaguaagucaggugugguggcaugugccuauagccauagcuagucuggaagauaagguggaaggaucuccugaguccaggauuugaggcuguagugagcuaugauugcaccaauguacucuagccuggauggcagacagccugucucuaaccaaguaaaaauauuuuaucuaucuaucuaucuaucuaucuaucuaucuaucuaucuaucuaucuaucucauaauuugagaccagccugggcaacauggcaaaacucugucucuacacaaaauaaacaaaauuagccaagcauggugucaaaagccuguagucccaucuacuugggaggcugagaugggaggaucccuugaacccaggaggucaaggcugcaguaagcugugaucacagcacugccacugcacuccagccugggugacagagcccugucucaaaaacaaacaaauuaacuaacaaauaaaaccccaaacccccccacccaccacaaaauucaaugaauuaaauaaaauuacaacugagagcuucaacaauagacuaaacagaaaaaagaguuucugaaugaaaacaguucuuucgaaauaauccacucagaaaauaaagaaaaggauaaaagaaaaaaaaagaauggaagucuaugugacauaagagaaauuguaaagugcccaaauauucaaauuuuggguguuucagaaaaaaaaagagaugggcaaggacauagaaaauuucucuaacgaaauaacagcugaaaauuucccaagccuuguaagagauauagacauucagauacaggaaacuuaaagacacaaaaauauucaacccaaaaagaucuucccaaggcacauuacaaucagacaguuaaaagucaaagagaauucuaaaaacagaaagaaaagagcaucaaauuacauauaagggcacccccaacagacuaacaauggcuuucucagcagaaaacuuauaagauaggagaaaacgggaugauauauucaaagugcugagaaaacaaaaacaaaaccaaaaacaaaccaacaacaaacugucagccaagaauacuauacccaccaaagcuauccuucaaaaaugaaggagaaauaaagucuuucccaaagaagcaaaaacugggagaauucaacagcagacugauccuauaagaaaugcuuaagagagcacuacauguggaaauaaaaggacaguaucuaacaccaugcaagcacauuaaaguauaaaaccugacagagcacauucacaaacaaaagagaaaaaggagucaaauguuauagaaaauaaccaaacugcaaugaaacaauaaaagagaaagaaaagaacaacaaauauacaaaacauccaaaaaccaauuaacaaaaugacuagaguuaaguccucaccuaucaauaauaaccucuaauauaaaugaaauaaauuaaucauuuagaagauacagguuggcugaaugguuaaaaaaaaaugaccaaacuacaugcugccuacaauaaacucauuacauauauagacugaaaaugaagaaacagaaaaagauauuccaugcaaauggaaacaaaaaaagagugggagaaggcauacacuuauaucagauaagacauauuuuaacccaaaagcuguaaaaaaagacaaagaaggucauuacauaaugaugaagggaaaaauuaaaugagcagaucuaacaauuauaaauagaugugcacucaacagcagaaccccuagauauauaaagcaacuacagggagagauagacuccaauauaauaagaguuguggacuucaacgccccauggacagcacuggacagauaaucuagacugaaaauuaacaaagaaacauuugauuuaaacugcacuuuagaccaaauggacguaacagacaucuacagaacacauccaacagcagcagaauauacauucuucucaucagcacaugcaacauucuccaggacaggccacaugguaggcuacaaaacaaaucucaacaaauuaaaacguaacuacuucauaucaaguaccuucucagaccacaacugaagaaaacuagaaaucaaucacgagaggaacuuuggaaacuguacauauacauggaauuuaagcaacaugcuccugagcaaacauugagucaacgaagaaauuaagaaggaaauaaauggauuucaugaaacaaauggggacagaaacacaacaaaccaaaaucuaugggaaacagcaaaagcagugcugagaguuuauagcaauaaacacccauaucacaaaagggccagaagcucauggcuguaauuucaauauuuugggaggcugauguaggagaauccuugaggccaggaguuagagaucggccugggcaacaaagugagacccugucacuacugaaacaaaaacaaaaacaaaaaauagcuggucaugguggcugccuguaguacuaguuccucaggaggcuaaggugagaggauugcuugagcccaggaguuuaagguuauagcaagcuacaacugcacuacuguacuccaacaugggcgacagagugagacccuguuuauaaaaaaaagagacagauuucaaauaaauaauguaaugauguauuucaaggaacuagaaaagcaaaaaaaggucaaauccaaaauuaguaaaagcagcaacauggauggagcuggaggccauuauccuaagugaacuaacucagaaacagaaaaucaaguacuacauguucucacuuauaaguggaaccuaaauaauugguacacauggacacaaaggugaaaauaauaagaugaugaggacuccaaaaggaaggaaggagggaguggggagaaggcaaaaaaaaacaaaacaaaacuaucagguacuaucaucacuauuugagugauggguucaacagaagcccaaaucucagcauuaugcgauauacccauguaacaaacaugcacaugcacccacuaaacuuaaaacaaaacaacuauauacauauauauauauauauacacacacacacacacacacaugcacaaaauggaccauuauucagccauaaaaagaaugaaaucuuauuuuuuugcaguaagauggauagaacuggaggucauuauccauauagagaaauacacauugcauguuucugacuuauaggugggagcuaaaaaaauugaucucauggaaguagagagcagaauggugcuuaucagaagcuggaaaguguggcugguuaaugcauacaaaauacaguuaaauagaauaaaauucuaguguuuaaaauaguacaguaggaugacuacaguuaaugaaaaaaagcaaaacuaguagaagaaauaauaaucaagcagaacaaaaucaaacagacacuaaaaaaaucaacaaaaguuggcguuuugaaaagauaaacaaaauugaaaaaccacuaacgagacuaagagaaaaagagugaagacccaaauaaagaaaauaaaaaacaaagagccauuacaacaaauacuacagaaaugcaaaguaccaugugaaacuauuaugaacaacuauauguuaacaaauuggaaaaccuagagguaauagacaaauuccugcacacagacaaccucccaaaauaacuacaauaaauaucaaauucuucaacacccagacaccgaugaacacccauaacaucaagaccacccaggaaaauaugaccucaccaaauaacuaaauaagguaccagacaccaaucccagaaagacagagauauaugaccuuucagacagaaaauucaaaauagcuguuuuaaggaaacucaaugaaauucaaaauaacagaaaaaauucagaaucuuaccagauacauuuaacaaaaagauugaaauaauuaaaaagaaucaagcagaaauucuggagcugagaaaugcaacuggcauacugaugaaugcauaagaguccuuuaauagcagaacacaucaaaagaagaaagaauuagcgagcuugaagacaggcugcuugaaaauacauagugagaggagacaaaaaacaauugaaaauacauagucagaggagacaaaaaacaaaggaaaaagaauaaggaauaccuacaagaucuaaaaaacagacucagaagggcaaaucuaagagugauucguuguaacgaggaaguagagagaccgggguacaaaguuuauucaaagggauaaugucagagaacuuccugaaccuagaaaaagauaccaauauucaacuacaagaagguuauagaacaccaagcagauguaauccaaggaagacuaccucaagacauuuacuaaucaaacuccaaaaggucaaagacaaacaaaggagaaaagcagcagcagacuuugugucuggcagcagacuuuucagcaaaaaucuuacuggccaggagagagugacaggacauauuuaaaguacugaaggaaaaaaacuuuuauccuaaaauaguauauccagagaaaauauccuucaaacauaaugaagaaauaaagacuaccagacaaacaaaagcugagggauuucaucaacacaagaccugucccauaagaaaugcuaaaaggaguucuuuaauaugaaagaauaggacaauaaugaguaauaagaaaucaucugaagguguaaaauucaccaguaauaguaaguauacagaaaaacacagaauauuagaacacuguaauugugguguguaagcuacucauaucuugaguagaaagacuaaaagaugaacugauugaaaauaaaaauuauucacgccuguaaucccagcauuuugggaggugaaggcggguggaucacuugaggugagaaguuugagaccagccuggccaacaugcuaaaaucccaucucuauuaaaaauacaaaaaaauuagccaggugugguggcacacaccugugauccagacuagucgggaggcugaggcaggagaaucacuugaacccgggagguggaggcugcagugagccgagaucgugccacugcacuccagcccgggcaacggagugagacucugucucaaaaaauaaaaugaaauaaaauaaauaaacauuaugugaggugugauggcuuaugccuguaauccuagaacuuuggaaggcugaggugggaggauugcuggaacccaggaauuugaaaccagccugggcaacaugcaacaugaaaccagccugggcaacaggcaaaacccuuucucuacaaaaaaaaaauacaaaaaaauuuagccaugugugguggcuacaagcagugggacaugcuuguagucccagcugcuugggaggcugaugugagaucaccugagccagaagguggaaguuguaguaagcugagauugugccacugcccuccagccugggugacagagugagucccugucucaagaaaaaaaaaauuacaacuuuuugagagacaauacaguaagauacaaauagaaacaaaaaguugaaaagugagggacaaaguuagagucuuuauuaguuuuuuauuugcuuguuugguaucuguuuuugcaaucacuguugucaucaguuuaaaauaguggguuauaagauaguauuuauaccucauaguacccucaaaaauaaaaaaucauacaacagauacgcaaaaaaauaaaaagcaagaaauuaaaacauaccacuaaagaaaucaccuucucuaaaaugaagauaugaaggaaggaaggaagagaaguccacaaaacaaccagaaaacaaauaacaaaauggcagaauuaagucuuuacuuguaauaaucccauugaauguaaauggaauaaacucuccaaucaaaagacagagaguggcugaauagauuaaaaaagaagacucaacaggaguuccaagauggcggaauaggaacagcuccagucuacagcuuccagcgugcuugauggagaagaugggugauuucugcauuuccaacugagguaccugguucaucucaaugggacugguuggacagugggugcagcccacggagggugagccgaagcaggguggggcaucaccucaccugggaagcgcaaugagucgggggauuucccuuuccuagccaagggaagccgugacagacuaccuggaaacacgggacacuccccacccaaauacugugcuuuucccaaggucuuagcaaccggcagacuaggugauucucuccugugccuggcucggcaggucccacgcccacagagccuugcucacugcuagcccagcagucugagauggaucugccaggcagcagccugacucggggaggggcauccgccauugcugaggcuugaguagguaaacaaagcugcccagaaguucaaaaugggcggagcccaccgcagcucaacaaggccuaccgccucaguagucuccaccucugugggcagggcauagcugaacaaaaggcagcagacaauuucugcagacuuaaacgacccugucuaacagcucugaagagagcagugguucucccagcauggugcuugagcucugagaaaagauagacugccuccucaacugggucccugacccccacgcagccuaacugggagacaucucccaguaggggcugacugacaccucauauagguggcugccacucugggacaaagcuuccagaggaaggaucaggcagcaauauuugcuguucuucaauauuugcuguucugcagccuccacuggugguacccaggcaaacagggucuggaguggaacuccagcaaacucuaacagaucugcagcugagggaccugacuauuaaaggaaaacuaacaguaaggaauagcaucaacaucaacaaaaagguaaucuacaccaaaaccccaccuggaggucaccaacaucaaagacuaaagguagauaaaaccacaaagauggggagaaaccaaagcagaaaagcugaauauucuaaaaaucagagcaccuccucuccuccaaagaaucacagcuccuugccagcaacagaacaaagcuggacagagaaugacuuugacaaguugacagaaguaggcuucagaaggucgguaauaacaaacuucuccuagcugaaggaggauguuugaacucauagcaaggaagcuaaaaaccuugaagaaagauuagaagaauggcuaacuauaauaaacaguguagagaagaacuucaaugaccugauggagcugaaaaccauggcaugagaacuucgugacacaugcaugagcuuaaauagcugauucgaucaaguggaagaaaggguaucagugauugaagaucaaaugaaugaaauaaagcgagaagagaaguuuagagaaaaaagaguaaaaagaaacgaacaaggccuccaagaaauaugacacuaugugaaaagaccaaaucuacgucugauugguguaccugaaagugauggggagaauggaaccaaguuggaaaacacucuccaggauauuauccaggagaacuuccccaaccuggcaaggcaggccaacauucaaauucaggaaauacagagaacaccacaaagauacuccucuagaagagcaaccccaagacacauaauugucagauucaccaagguugaaaugaaggaaaaaguauuaagggcagccagagagaaaggucgaguuacccacaaagggaagcccaucagacuaacagcagaucucucggcagaaauccuacaagccagaagacagugggggccauuauucaacauucuucaaggaaagaauuuucaacccagaauuugauauccagccaaacuaaguuucauaagugaagcagaaauaaaauccuuuacagacaagaaaaugcugagggauuacaagagcuccugaaggaagcacuaaacauggaaaggaaaaacugguaccagccacugcaaaaacaggccaaauuauaaagaccacugaugcuaugaagaaacugcaucaauuaaugggcaaaauaaacagugaacaucauaaugacaggaucaaauucacacauaacaauauuaaccuuaaauauaaaugggcuaaaugccccaauuaaaagacacagacuggcaaauuggugugcuguauuuaggagacccaucucacgugcaaagaugcacauaggcucaaaauaaaggaauggaggaagaucuaccaagcaaauggaaagcaaaaaaaagcggggguugccauccuagucucugauaaaacagacuuuaaagcaacaaagaucaaaagagacaaagaaggccauuacauaaugguaaagggaucaaugcaacaagaagagcuaacuaucuuaaauauauaugcacccaauacaggaggacccagauucauaaagcaaguucuuagauaccuacaaagagacuuagacucccacacaauaauaaugggagacuuuaacacccaacugucaauauuagacagaucaacgagaaaaaagguuaacaaggauauccaggaccugaacucagcucugcaauaagcagaccuaauagacaucuacagaacucuccaccccaaaucaacagaauauacauucuucucagcaccacauagcccuuauucuaaaauugaccacauaauuggaaguaaagcacuccucagcaaauguaaaauaacagaaaucacaacaaacugucucucagaccacagugcaaucaaauuagaacucaggauuaagaaacucacucaaaaccgcacaacuacauagaaacugaacaacuugcuccugaaugacuacuggguaaauaaaaaaaugaaggcagaaauaaagauguucuuugaaaccaaugagaacaaagacacaacauaccagaaucccugggacacauuuaaagcaguguguagagggaaauuuauagcacuaaaugcccacaagagaaagcaggaaagaucuaaaauugacacccuaacaucacaauuaaaagaacuagagaagcaagagcaaacaaauucaaaagcuagcagaaggugagaaauaacuaagaucagagcagaacugaaggagauagacacaaaaacccuucaaaaaaucaaugaauccaggagaugguuuuuugaaaagaucaacaaaauugauagaccacuagcaagacuaauaaagaagaaaagacagaagaaucaaauagaugccauaaaaaaugauaaaggggauaucaccaccaaucccacagaaauacaaacuaccuucagagaauacuauaaacaccucuaugcagauaaacuagaaaauacagaagaaaugcauacauuccuggacacguacuuacauaauuacuaccuggagacuuuaacaauauacucucccaagacuaaaccaggaagaaguugaaucccugaauagaccaauaacaggcucugaaauugaggcaauaauuaauagcuuaccaaccaaaagaaguccaggaccagauggauucacagcugaauucuaccagagguacaaagaggagcugguaccauuccuucugaaacuauuccaaucaauagaaaaagagggaauccucccuaacgcauuuuaugaggccaacaucauccugauaccaaagacuggcagagacacaaccagauaauuuuagaccaauaucccugaugaacgucgaugcgaaaauccucaguaaaauacuggcaaacugaauccagcagcauaucaaaaagcuuauccaccaugaucaaguuggcuucaucccugggaugcaagucugguucaacguacacaaaucaauaaacguaauccaucacauaaacagaaccaacaacaaaaaccacaugauuaucucaauagaugcagagaaggccuucaacaaaauucaacagcccuucaugcuaaaaacucucaauacacuagguauugacagaacauaucucaaaauaauaagaacuauuuaugacaaacccacagccaguaucauacugaaugggcaaaaacuggaagcauucccuuugaaaacuggcacaagacaaggaugcccucucucaccacuccuauucaacauaguguuggaaguucuggccagggcaaugaggcaagagaaagaaauaaagaguauucaguuaggaaaagaggaagucaaauugucccuguuugcagaugacaugauuguauauuuaaaacccuaucgucucagccccaaauuuccuuaagcugauaagcaacuucagcaaagucucaggauacaaaaucaaugugcaaaaaucacaagcauuccuauacaccauuaacagacacacacagagccaaaucaugagugaacucccauucacaauagcuacaaagagaauaaaauaccuaggaauucaacuuacaagggaugugaaggacaucuucaagaagaacuacaaaccacugcucaacgaaauaaaagaggacacaaacaaauggaagaauauuccaugcucauggauaggaagaaucaauaucgugaaaauggacacacugcccaaaguaauuuauagauucaaugccauucccaucaagcuaccaaugacuuucuucacagaauuggaaaaaacuacuuuaaaguucauauggaaccaaaaaagagcccacauugccaagacaauccuaagccaaaagaacaaaccuggaggcaucaugcuaccugacuucaaacuauacuacaauguuggguacaagccccccaaaaucuggccauaaacuggccccaaaacuggcuauaaucaaaaucucugcagcacugugacauguucaugauggccauaacgcccaugcuggaagguuguggguuuacuggaaugagggcaaggaacaccuggcccgcccagggcagaaaacuguucaaaggcauucuuaagccacaaacaauagcaugagcgaucugugcuuuaaggacaugcuccugcugcaguuaacuagcccaaccuauuccuuuaauucggcccauuccuucauuucccauaagggauauuuuuaguuaauuuaauaucuauagaaacaaugcuaaugacuggcuuacuguuaauaaauacguagguaaaucucuguucggggcucucagcucugaaagcugugagaccccugauuucccacuucacaccucuauauuccugugugugucuuuaauuccucuagugcggcuggguuagggucucccugaccaagauggucucagcacuaaaaggcuacaguaaccaaaacagcaugguacugguaccaaaacagauacauagaccaauagaacagaacagaggcuucagaaauaaugccacacaucuacaaccaucugaucuuuaacaaaccugacaaaaacgagaaauggggaaaggauucccuauuuaauaaauggugcugggaaaacuggcuagccauauauagaaagcuaaaacuggaucccuuccuuacaccuuauacaaaaauuaauucaagauggauuaaagacuuaaauguuagaccuaaaaccauagaaacccuagaagaaaacccuaggcaauaccauucaggacauaggcaugggcaaggacuucaugacuaaaacaccaaaagcaauggcaacaaaagccagaauagacaaaugggaucuaauuaaacuaaagagcuucugcauggcaaaagaaacuaccaucauagucaacagucaaccuacagaaugggagaaaacuucugcaaucuacccaucugacaaagggcuaauauccagaaucuacaaagaacuuaagcaaaguuacaagaaaaaaacaaccccaucaaaagguggggaaaaggauaugaacagaaacuucucaaaagaagacauuuauguggccaacaaacauaugaaaaaaugcucaucaucacugaucauuagagaaaugcaaaucaaagccacaaugagauaccauuucacaccaguuagaauggcaaucauuaaaaagugaagaaacaacaggugcuggagaggauguggagaaauaggaacgcuuuuacacuguuggugggaguguaaauugguucaaccauuguggaagacaguguggcaauuccucaaggaucuagaacuauaauuaccauuugacccagaaaucccauuacuggguauacacccaaaggauuauaaaucaugcuccuuuaagacacaugcacauguauguuuaugguggcacuauucacaacagcaaagacuuggaaccaacccaaaugccaucaaugauagacuggauuaagaaaauguggcacauauacaccauggaauacuacgcagccauaagaaaggaugaguucauguccuuugcagggacauggaugaagcuggaaaccaucauucucagcaaacuaucacaaggacagaaaaccaaacaccacauguucucacucauaggugggaacugaacaaugagauuacuuugacacagggcagggaacaucacacacuggggcauguugggggguuggggccuggcagagggauagcauuacaagaaauaccuaauguaaaugaugaguugauuggugcagcaaaccaacauggcacauguauaccuauguaucaaaccugcacguugugcacauguacccuagaacuugaagcauaaucaaaaaaaaaaaagaagacucaaugaacaguugccuacaagaaacagacuucaccuauaaagacacacacagaccaaaaauaaagggaugaauaaagauauucuaugccaauagaaaccaaaaaagggcagaaguaacuauacuuacaugagacaaaauagauuucaagacaagaacuauaaaaagauacaaauaacgucauuauauaauuauaaaauggucaauucagcaagaggauauaacaguuauaaauauauaugcauccaauacuggaguacccauauauguacaggaaauauuauuagagucaaagugagagauagcccccaauacaauaauaccuggagacuuuaacacuauacucucagcauugaacagaucauccaggcagaaaaucgacauagaaacaucagacuuagcugacucuagucuaguagcacugccuaggggucaucacagcucugcaaggagcagcaaaagaaaaauaaaaaaaagaaaagaaacaucagacuucaucuguauuguagaccaaauggaccuaaucgauaucuacagaacauuucaucuaacagcugcagaauacggcuucuucuccucaguacaugaaucauucucaaggauagaacauauguuagaucacaaaacaagucuuaaaacauucaaaaaaccugaaauuauaccaaguuucuucucugaccacaauggaagaaaacuagacaucaauaacaagaggaauuuuuggaaacuauacaaacacauggaaauuaaacaauaugcuucugaauaaacagugggucaaugaagaaauuaagaaggaaauugaaaaaaauuuugaaacaaaugauaauggaaacacaauauaccaauaccucugggauacagcaaaagcaguacuaagacggaaguuuauagcuaucggucccuacaccaaaaaagaggaaaaacuucaaguagacaaucuaaugauccaucuuaaagaacuacaaaagcaagagcaaaguaagcccaaaaguaguagaagaaaagaaauaauaaagaugagugcagaaauaaauaaaauagaaacaaagaauacaaaagauaaaugaaaucaaaaguuggcuuuuugaaaagaugaacaaaaucaacaaaccuuuauccagacuaagaaaaagagagaagacccaagcaaacaaaaucagagaugaaaaaggaggaauuauaauacaacugauacugcagaaauuaaaaggaucuuuagaagcuacuaugagcagcuguauuucaauagauuggaaaacuuagaagaaauggauaaauuucuagacauauauaacuguuuggagguuccuccagaaacuaaaaauauagcuaccauaugauccagcaaucccacugcuggguauauauccaaaagaaaggaaaucaguauaucaaacagauaucugcaguuccauguuuauugcagcacuauuuacaacagcgaagauuuagaagcaaccuaaauguccaucaacaguugaauggauaaagaaaaugugggacauauacacaauggaguacuauucagccacaaaaaaagaaugagauccugucaguuucauguauggaacuggaggucauuauauuaagugauauaagacaggcacagaaagacaaaucucacauguucucacuuauuugugggaguuaacaauuaaaauaacugaacucauggugauaaagagagcagaaugguaguuacuagaggcuaggaagggugguggugguggguggugggggaugguuaaugaguacaaaaauacaguuagacagaauguauaugauccaguauuugauagcacaacuaggugacuagaguuaagucaagaauaauauauugugcauuuaaaaauaacuaaaauaguagaauuggacuguuuguaauacaaagaaaggauaaaugcuuuaugugacccauuuacccucaugugauuacuaugcauugcauaucuguaucaaaauaccucauguacccaauaaauauauacaccuacuauguacccacaauaguuaauaagacauuaagaaaaaagagcaauugacugagaggaaaggcaaagaugacccaaaauauacaaaguggaaauucccaaagacuggagaaaaaaaaacagaauacuagaugcccgguaugguggcacaugccuauaaucccagcccuuuggaggcugaggcaggcggaucacuugaggccaugaguucaagaccagccugggaaacauagcaagacuccauugcuguuagaaaaaagaaagaaagggagaaaaggagaaaaggagaaagggagaaagagagaaagugcggggcagggggagagaaggaaggaaggaaggaaggagagaaagaaggggggaggggagaaggaggggagagggagggaagaggaggagaaaggagaggaggggaggggaggggagggaagaagacaggcaauaauucaagaguacuguccuaaaauugagaggauaaaaaaagacuccuaaaacugacaggggaaaaaaagaccggaagcuacauauuaaaaagauauacuaugaugaagacuacaaaacugaugaaaaaauuaaagaacaauaaagagauaucucaaacuuauggacaggaagcuucaauaucauuaagaugucaguuuuuuuccaacuugaucuuuggauuuaacauaaucccagccaacccagcaagcucuuuuguggauacagacauaauaacucuaaaguuuauauggauauacaaaagacccagaauagccaauacauaauugaaggagaacaaaguugggggacugacacuaugugacuucaagaaauacuauaaagcuacaguaaucaggauacugggguacuggcaaaagaacaggaaaaaaguugaauggaauggauacagaguucagaaauggccccauacagauauagucaacugaucuuuggcaaaggagcaaaguuaauucaucgaagaaggaauaguauuuacaauaaguggugcuaaaaaaacacuguacaucuacuuacgaaaaaaauguaucuagacacagaccuuauaacucuucaaaaauauuuacuccaaauaaaucacauaacuaaauauaaaaugcaaaacuaggccgggugcaguggcucacaccaguaaucccagcacuuugggaggcugaagcggaugguucacuugaccucagaaguuugagaccagccuaagcaacacggagaaacaccaucucuacaaaacauacaaaaauuagccaggcacaaugaugcacacugguggucccagcuacuugggguuugaggugggaggaucacaugggcaaacccucucucuacuaaaaauacaaaaauuagccaggcaugguggugcauaccuguuguccuagcuauucaggaaguuaagguggaaggaucaccugggcccagggagguugaggcugcagugagccauguugcaacacugcacuccagccugggcaacacagugagaccccaucucaaaaaaaaaaaaaaaaagacaaugucaagagaacaugaagaaaagccacagacuaggagaaaauacagguugacuaucucuaauccaaaaugcuccaaaauaugaaccuuuuggaacauuguuauaaugcccaaaggaauguucauuggagcauuucagauuuuggauuuacggauuagagauacucaacugguauaaugcaaacaguccaaaaucugaaaaaaaaaacccaauccaaaacacuucugaucccaagcauuucagauaagagauacucaauccguauuugcaaaagacauauuugauaaaggaccauuaaccaaaauauacuaagaauucuuaaacucaacaauaagaaaauaaaguacccaauuuaaaaaugggugaaagaucucaacaggcaacucacuaagguauacagguggcaaagcagcauauaguaagaaucauaugaaaagagguucaacaucauauguuauuaggagauugcaaauaaaaacaacaacaagauaccacuacacagcaacuaaaauaaccaaaauccaaaacacugacaacaccaaaugcuggagaggacauggaguaaaaggaacucucauucauacacugcaaaaugguacagacacuuugggagacuggugguuucuuacaaaacuaaacauacucuuacuagacaauccagcaacuguauuccucuguauucacccaaaugaauugaaaacuuaaguccacacaaaaaccugcucauagauguuuauaucaucuuuauucauaauugcuaucacuuggaagcaaucacgaugucuuucaguacaucuugaaagugaauaaauaaacuguggcacauccauacaauguaauauucugcgcuaaaaaguaaugagcuauugagacacaaaaagauuacagaggaaccuuaaguguauauuacuaagugaaaccauccaaucugaaaagaguacauacuguaugaguccaauuacaugacauucuggaaaagacaaaacuauggagauaguaaaauaaucagugguugccaggguuuggaagaaagggagggauaauauaagcagagcacaggggauucuuggggcagcaaauucuuguguaauaauagugguuacauagcauuauacauuugucaaaacccagggcaauuaaagcaccaagaguaaauuuuaauguaaacuauacacuuuggugauaaugaugugucaacauuggucuauugauuaaaacaaacguaccucucuggugugggcuauugauggugggggaggcuguguguguaugggggaagggcauauacaggaacucuguacuuuucacucaauuuugcuacguguauuaguccguuuucaugcugcugauaaggacaugccugaggcugggaaauucauaaaagaaagcgguacaacugaacucacaguuccacauggcuggggaggcgucacgaucauggcagaaggcaaggaggagcaagucacaucuuacauggaugguggcagguuaaaaaaaaaaaaagcuugugcagagaaacucucauuuuuuaaaaaccaucagaucucgugagauccauucacuauuacgagaauaucaugggaaagaccugcccccauaauucaggcaucucccaccagguuccucucauaacacgugggaaucaugggagcuauaagaugagauuuggguggggacacagagccaaaccauaucacuauguauccaaaacuccuauaagaaaaggucuauuaaacaaacaaaaaaaacccacuauguacuguacuagaaaaauaaacucaaugccaaaauauauuuuaagaaaaugauuggacuuuaaguaaaaagaaagauauacucugagcauccaagcaaaaagaccaaaucacuuauaagguaaagaaaauaaaacugccaucagacuuucugcagcaauguuuuaugccagaauauaauuaaacuauauauuaaagacagucaaggaaaaaaaaguaagccaaggauuuuacaugcagccaaaucgacccucacaaauaaagucauaagacaaacuguuaugaaaauggaaaaucuaugaguguaguguucacacaaguccuuccuaaggaaucuauuacaaaaagaguuucaagcaaucagaaugacuaaggagacacugacauaagaauuggaagacuaaaauaaagaacaccaaggaucuuuuauguuucucauuuaauacacaaaacaagccuugauaguaguguuuccauucuacacauggaggaaaugaaugccaaagucagaggaacuuauccauuguugcugagcaaguaauaaagccaggauuggaaccaaagcccauucucuuucuaccacaugaagcuaccuccacauacacaugagcuaaaccuuugucuuugcauauacuagaauagcauacugccuggaauuucauucucccccuuaucuaccuuaugaguuauuugaaaaacaaucuuugauacacccaaaaauugcuuauucucuguggcuuucccuuaccuaaaagggccauauauauugucauuaauaaaaccguaugguacugauaaagaaaagccaccucaucuguggucccaaaacugcuuauugucuuguggcucucccuuacccaaaagggccauauguguuaucauuaauaaaggcauauaguacugauaaaguaaagcuaccucagcuguggccgcagagcauuucacaaaaaacaucuguaacacagauuuugccacaugugauuucgaugaugguaaaaacugucacuucuuuggcuuaaaaucccaauacagagcauauucuucccaguaaauguauuugggagaaaaagaagaggggagauaacaggucugggaugucuuucuugacuauacaagauaaaguuaauuaccuaaauaucucugcauuaauucugaacuuuguggguacuuuuuauucuuguccuuuucacgcaauguuauuauuuguuuucauuuuugucuguccucugagagcaagaaugaucuuuuuuuccuuuauagcuuaccaucuaacauauaauagugaacacaacuaagaaguguucaauaaauaguuggugacugaaugaagagaaaucauaaguuauuucucaguuccaauucugugcaaauggauuaugaugaauacgaagaaugaaagcccaauuuuuaugcgguuuaaguauuacuguacaccaaauugcauauauuuaauuaauaaaacgacaucaaggaaucagaaucuaauauuuuaaaaguaauaguguuaaugagcaucagcauauuauagagcuuuuagacuacaaaaaaaaucugaauuuuuuucucauuuuuuuccagagaguuuugcacugcagaguaaaauuauuauuauuauuuaaaaaaauguuagagccugaaggcauuuuugucuugaauaaagccuggaacauuuugaaaaaguuacuaguauuuuuaauuaguauuuggcauacaacugcaaaauuuccuuauaugagaaugugaacaaauuaauuacaaacauauacacuuuuugccuuuuuugcagaugacuguauuucucaauucaaauuguuuucucccuuuaauauuaaagaaaauaacagaauuauuagcagccuacuuuugccauuucaguaacauguguauagguucguuucacuggcuaauuccauuauugaacauaucagcagugucaucuccuagguuauuuuuccaccagcucuggauaugagugucacuagaagcuuuuuaaggggagacagagaaaaagagugagagagauagagaaggaaaaagaacacaaaagugcaacacacacuccugccuagacacaacuucuaaaaagaggaaaaguacacuccacuuccucaucauuuaaacaagcuguuuaaucugaaaauaccuguuucauacauagccacucuucuugaugcauagcuguaauaccaaaggccacaaaacuuauggaucaggaauauuuccuccugccucaugacaacucuccuuccccaguccuagaauuaauaaugucugucauaccuacuaaaauaccuuuuagucaaucucauucuugaauccauaucaaaacagacacaauucaucucagugcauuucuccuauaucuguuuucauguaaaacaucauucugacuuuuccaacuccacccauacacacuucauuuuccuuuuagaucccauccaggucuaucaggucaaaacucaagacuaccauuuggacaaucccccuagaaaacacaaucauucucaaucuaauuaaaaaauuauuauaagagaaagauaauuaaaaauaauucacuuaaaauggaaacaucuuaaaauacauaauuagauuuuuaauaauauuacuucuaguauagaaaaacuaccaguuucuccuuaccacuucuaauaguuguauuuucuaauaguucugucugaaguuguaguucagcuucuccaaguaucuuuagaacagaaucugucggacuuuucccccaggcucuucuuggagauccauuaggaccuaauuuaauaacuucucccacuguauguccuauaagaaaaauauacaaagaaacaauuuucaauaacaguauaauaauacugcaugguaaggcagauuuugagucuuuuauccaauugagugguucaugagaaaaaaagguuauaucacaaagacuuucagggaaagaaugaugaauaauggcaagaacagaagcaaaugaaacuagcaauaaaaau

SEQ ID NO: 21063 - RNA, 1395 nt, Homo sapiens
acgcuucggagccaagauccaccuccucucccgcccgcaccggggagcccacccacccaccugcugcacuaaccuggccgccucggcggggccuggguucccacgcccgccaggcuccgcucuacuccgccgcuuccgggugugcgcggaggcgcuggggcggugcccuagcccgagccgccccguccgcccgcgcgucccgccccgcgggcucccgguggcugcuucccguccgcuguccucugcugccaguccccugccccgggcaaagcccaucugguccgccgagcagguaagacaccagcgcccaagguuagacggcaggaagacccgacuuuggggguuugcgauucuuacgaggcggggggcucguaagagcuacagcugccagacuucgguaaaucaagggggcgcccccuggagaccagaauuuucugguaccccuggggauccggcuucaagaucgcugcuaccagugggcacucaaaacggggugcccaugggucccagguacaagcccggccgaacguaucugaagccccaggaaacacguggcacaaauuccgggagaaacuguuagcccggaagauaugggaacauuaacuggcgaguagugugaagccuuguguacacaaaccuuuaagaaccuuaaaacaagauuggcggccgggcgcgguggcucacgccuguaaucccagcacuuuggaaggccgaggcagguggaucaccugaggucaggaguuugagaccagccuggccaauauggugaaaccccgucucuacuaaaaauacaaaaauuagcccggcgagguggcgcgcgccuggagucccagcuacucgggaggcugaggcagaagaaucgcuugaacccgcgaggcggaguuugcagugagccgagaucucgccacugcacuccagccugggcgacacagcuagauuccgucucaaaacaaaacaaaacaaaaacaaacaggauuggcaacuucaaagaggacgcacacuuuccaguaacccaucccccucuaaaggcugcgcuccagggugggucugcggaguuccagccgaacccaaauugcucagcgggagccagggcugcucaggggucggaacuuaaaucuugagccccucaggccccagaaccgucaggucccagagacccaaguuuuuuuucauccaguggggcugucuuaggaagcacccgggacaucuccccggcgaggcggaggcggggaaggagccuccccuccagggguggauccagcuuugccccgcccacgccucgcuuccugauuggcucauggucccugacaaagaaaagccuacauuaacgcucccgccuuauuaacccuguagucacuuucuacuaaccggcgggguuaagaugggguuucucag

SEQ ID NO: 21064 - RNA, 1395 nt, Homo sapiens
cugagaaaccccaucuuaaccccgccgguuaguagaaagugacuacaggguuaauaaggcgggagcguuaauguaggcuuuucuuugucagggaccaugagccaaucaggaagcgaggcgugggcggggcaaagcuggauccaccccuggaggggaggcuccuuccccgccuccgccucgccggggagaugucccgggugcuuccuaagacagccccacuggaugaaaaaaaacuugggucucugggaccugacgguucuggggccugaggggcucaagauuuaaguuccgaccccugagcagcccuggcucccgcugagcaauuuggguucggcuggaacuccgcagacccacccuggagcgcagccuuuagagggggauggguuacuggaaagugugcguccucuuugaaguugccaauccuguuuguuuuuguuuuguuuuguuuugagacggaaucuagcugugucgcccaggcuggagugcaguggcgagaucucggcucacugcaaacuccgccucgcggguucaagcgauucuucugccucagccucccgaguagcugggacuccaggcgcgcgccaccucgccgggcuaauuuuuguauuuuuaguagagacgggguuucaccauauuggccaggcuggucucaaacuccugaccucaggugauccaccugccucggccuuccaaagugcugggauuacaggcgugagccaccgcgcccggccgccaaucuuguuuuaagguucuuaaagguuuguguacacaaggcuucacacuacucgccaguuaauguucccauaucuuccgggcuaacaguuucucccggaauuugugccacguguuuccuggggcuucagauacguucggccgggcuuguaccugggacccaugggcaccccguuuugagugcccacugguagcagcgaucuugaagccggauccccagggguaccagaaaauucuggucuccagggggcgcccccuugauuuaccgaagucuggcagcuguagcucuuacgagccccccgccucguaagaaucgcaaacccccaaagucgggucuuccugccgucuaaccuugggcgcuggugucuuaccugcucggcggaccagaugggcuuugcccggggcaggggacuggcagcagaggacagcggacgggaagcagccaccgggagcccgcggggcgggacgcgcgggcggacggggcggcucgggcuagggcaccgccccagcgccuccgcgcacacccggaagcggcggaguagagcggagccuggcgggcgugggaacccaggccccgccgaggcggccagguuagugcagcaggugggugggugggcuccccggugcgggcgggagaggagguggaucuuggcuccgaagcgu

SEQ ID NO: 21065 - RNA, 1759 nt, Homo sapiens
cucuuggcucugcggugcgcgugccccgaagaugcacgcgcguccccgcugcccaacgaagccugggucgcguugcgccgccgccacccugggcuggcaguggagcuggagcuggagcccgcgcugcccgcugagagcgugacgcgcguccugcagccagccguccccguggcugcgcugcgccucaaccucucaggcgacaccguaggcccagugcgcuucgcagcacaccacuacgccgcaacccugugcgcgcucgaggugcgcgcagccgcuucggccgagcugaacgccgcgcuggaggagcuggcggcgcgcugcgcggcccugcgcgaggugcauuguuucugcguggugagccacucggugcuggacgccuuccgcgcgcacugcccgcgccugcgcaccuauacccucaagcucacgcgcgagccgcaucccuggaggccuacgcucguggcgugauugggcgacuucucucccccguccccguggacguaagcgcucugagagggaacgggggggguguccaggcgcgccccgagugcuagugccuucuuuugggauuguugccccccgggucuuuaccgaguugggaacugugauggcaucgggaccaguccugggcgcccugagaccacucgcugcucucacccucugcagacgccccacccgcucgguccuggacacacugccccccucucuugccuccaccccucugcggacucugcagcuccgcggccccggcgcagggagagggagggcacgggcgcgggccgggccucaagggugagugugaaauaaacaaauccugcaguguuucugcguccuauuaaaggcggggucggaucugaaagggaaggacagggaacgcgcgggguaccggaggagccaucccggcagagguuggguuuccucaagagccucuggacgacacagcugcggggggucagggucggggcacucacacccuuggaaugacuacgucccgggguucggcgggagggggcgugcuucccugcccccccuuccuaucugcuugcccugccuggggcuucacugugccucuggccauuaccuucuaggacuugcccagcccacaccaggucgcgcaccggcgauuucuccuguagaacaaagaaggaaauagagggaccgagaggggugggacucgaacccaagucucccacucaucucaccccaccccaccccacuccaccccaccccaccccuccacuccacuccacuccacacaucccauccagccagccuuuucugccugcuggugccucggccgcuguccgagccccgccccgcgggcuugcacguggcccccgccugacccggcgccccggggcggaguagggcggagcgggcggcaaacgcagcacuuuccgcggcuuugacgagcccgcagcggccgggcccgagcgcagagccgggccgagacugcaccaugcaggaagcgccagcugcgcugcccacggagccaggccccagccccgugccugccuuccucggcaagcuaugggcgcuggugggggacccaggcacagaccaccugauccgcuggagcccggugagggccggggccccucgauucccccuguggucccggggucccuccacgucagugaacacccaugcccgcccaacccccuccugagacugggccguggauccccggauuuggccauucagagaaguucaccuuggagggggugugcgagagggggguuuccucugcggccgaagaagg

SEQ ID NO: 21066 - RNA, 1759 nt, Homo sapiens
ccuucuucggccgcagaggaaaccccccucucgcacacccccuccaaggugaacuucucugaauggccaaauccggggauccacggcccagucucaggaggggguugggcgggcauggguguucacugacguggagggaccccgggaccacagggggaaucgaggggccccggcccucaccgggcuccagcggaucagguggucugugccugggucccccaccagcgcccauagcuugccgaggaaggcaggcacggggcuggggccuggcuccgugggcagcgcagcuggcgcuuccugcauggugcagucucggcccggcucugcgcucgggcccggccgcugcgggcucgucaaagccgcggaaagugcugcguuugccgcccgcuccgcccuacuccgccccggggcgccgggucaggcgggggccacgugcaagcccgcggggcggggcucggacagcggccgaggcaccagcaggcagaaaaggcuggcuggaugggauguguggaguggaguggaguggagggguggggugggguggaguggggugggguggggugagaugagugggagacuuggguucgagucccaccccucucggucccucuauuuccuucuuuguucuacaggagaaaucgccggugcgcgaccuggugugggcugggcaaguccuagaagguaauggccagaggcacagugaagccccaggcagggcaagcagauaggaagggggggcagggaagcacgcccccucccgccgaaccccgggacguagucauuccaagggugugagugccccgacccugaccccccgcagcugugucguccagaggcucuugaggaaacccaaccucugccgggauggcuccuccgguaccccgcgcguucccuguccuucccuuucagauccgaccccgccuuuaauaggacgcagaaacacugcaggauuuguuuauuucacacucacccuugaggcccggcccgcgcccgugcccucccucucccugcgccggggccgcggagcugcagaguccgcagagggguggaggcaagagaggggggcaguguguccaggaccgagcggguggggcgucugcagagggugagagcagcgaguggucucagggcgcccaggacuggucccgaugccaucacaguucccaacucgguaaagacccggggggcaacaaucccaaaagaaggcacuagcacucggggcgcgccuggacaccccccccguucccucucagagcgcuuacguccacggggacgggggagagaagucgcccaaucacgccacgagcguaggccuccagggaugcggcucgcgcgugagcuugaggguauaggugcgcaggcgcgggcagugcgcgcggaaggcguccagcaccgaguggcucaccacgcagaaacaaugcaccucgcgcagggccgcgcagcgcgccgccagcuccuccagcgcggcguucagcucggccgaagcggcugcgcgcaccucgagcgcgcacaggguugcggcguaguggugugcugcgaagcgcacugggccuacggugucgccugagagguugaggcgcagcgcagccacggggacggcuggcugcaggacgcgcgucacgcucucagcgggcagcgcgggcuccagcuccagcuccacugccagcccaggguggcggcggcgcaacgcgacccaggcuucguugggcagcggggacgcgcgugcaucuucggggcacgcgcaccgcagagccaagag

SEQ ID NO: 21067 - RNA, 98 nt, Homo sapiens
ccacagcacaggucacaaaaucaaccuguugcgaaaccuucuggcucucccaaccuuuccaggcucaacauuccccacucucuuccauauggugcucc

SEQ ID NO: 21068 - RNA, 98 nt, Homo sapiens
ggagcaccauauggaagagaguggggaauguugagccuggaaagguugggagagccagaagguuucgcaacagguugauuuugugaccugugcugugg

SEQ ID NO: 21069 - RNA, 136 nt, Homo sapiens
ccuguuagaaggauaauaucuagaguuauaaaauuucucuaauguaaauuaugucugaauuccugguacuucauauauucugauauggaugggggauaucauauauucauauauucugauauggaugggggcaaau

SEQ ID NO: 21070 - RNA, 136 nt, Homo sapiens
auuugcccccauccauaucagaauauaugaauauaugauaucccccauccauaucagaauauaugaaguaccaggaauucagacauaauuuacauuagagaaauuuuauaacucuagauauuauccuucuaacagg

SEQ ID NO: 21071 - RNA, 828 nt, Homo sapiens
uucuaggauuuauucaucccuuaauuggucuguuagguacuguguucauuugcuagggcuacuguaguaaaauaccacaaacuggguggcuuaaaaauuaauagcaaauauauuuuccuacaguucuggaagcuagaaguuaagguaccagaagguuuaguuuuuuucaaaaggcuucucuccuuggcucacagauggucacuuucuugcguguccuuacauggccuuuccucucuguguuugucuguguccuaaucccuucuucuuguaaggacaucagucagauuagguuaggggccaccucauuuaaccuaauuaccucuuuaaaaguucccaucucuaaauacgcaguuaauccaugaacaacguguguuugaccuuugcgaguccacuaauacacagauuuuuuuuuuuuuuuuuuuaucaaacgcuauugaaaauacaguauuugugggaugugaaacccucauauauggagggcaggcuuuuggaauaugacgugggauuugaguauguguggauuuggcuauaugaggggguucuggaaccaaucccccagcuauguugagaaaugacuguagucgcauccugaguuucuggggguuaggaauucaacauuaugaauuuugggggagaggggcacaauuuuuagcccauaauagaugucaaccaguccugaauggagaagcugguugagccaccuuuagggcuggccugaaggcaccugagggacucucuuacauagacuugguggggaacaggucccuaccugagccaggcugguuucaggcucaaggcaggcaggacauggaggacuagcagaccuca

SEQ ID NO: 21072 - RNA, 828 nt, Homo sapiens
ugaggucugcuaguccuccauguccugccugccuugagccugaaaccagccuggcucagguagggaccuguuccccaccaagucuauguaagagagucccucaggugccuucaggccagcccuaaagguggcucaaccagcuucuccauucaggacugguugacaucuauuaugggcuaaaaauugugccccucucccccaaaauucauaauguugaauuccuaacccccagaaacucaggaugcgacuacagucauuucucaacauagcugggggauugguuccagaacccccucauauagccaaauccacacauacucaaaucccacgucauauuccaaaagccugcccuccauauaugaggguuucacaucccacaaauacuguauuuucaauagcguuugauaaaaaaaaaaaaaaaaaaaucuguguauuaguggacucgcaaaggucaaacacacguuguucauggauuaacugcguauuuagagaugggaacuuuuaaagagguaauuagguuaaaugagguggccccuaaccuaaucugacugauguccuuacaagaagaagggauuaggacacagacaaacacagagaggaaaggccauguaaggacacgcaagaaagugaccaucugugagccaaggagagaagccuuuugaaaaaaacuaaaccuucugguaccuuaacuucuagcuuccagaacuguaggaaaauauauuugcuauuaauuuuuaagccacccaguuugugguauuuuacuacaguagcccuagcaaaugaacacaguaccuaacagaccaauuaagggaugaauaaauccuagaa

SEQ ID NO: 21073 - RNA, 2136 nt, Homo sapiens
uuguaccugccguugccccugcugagaauguuuuuacuuuucuuucaccuaaacuucgauuuaucuuuccucagggaaggcuucccuaucacagacucucagagcaccaugaacucuccucauagcacuugcugucauuguaauuucauauguguuggagauuaacaucuguuuuuccaaauagauuguaaccuccagaaauccugauaauguguuucuuuuuccucaccauuauagaguuaaugcuuaccacagugcuugaaacucgucuauuaauucuuggaacucauuuguggcaaggauuaauaaauagaugauaaucaucacagagaacaacucuaaguguucaacaauuggcaaaugguugcauaaacuggguauauucauuugggaggauguguuuaaaacauguuguagaaguauguguaauaacaugggaaagugcugucauauuaugugaaaaaauuaguuuacaaaauagucacuuauuaaaaguguggaaaaaaauacaccgaaguauaaaaguugguuaucucuggaagguauguuuuauauuuucagauuuuuuacagauaacaugugcugauuuuauaauuuaaaaaaaccauguacaaaauuaaggaaaaauugauuuucuagauaugguuccagaaauguagugggagacaugagauucguaauggucuccaaaauaugugucaaccaaaaugcaugauugcaugaugaucauauugaacuuaauuauauaaauuccauuuagaaauugcaaaaugauucauaaauuaaagcaagccaguaauuucugguuguauuauucuuacuuguauguaaagugguuuuaauuuuaaaauguuuugaaaaguaacaugguuuuggcacaugacagcacuaaaacagaguaaagacuagaauuaacuuaaauauauaugagagcuuaauauagguugagcaucccuuaucuaaaacuccauaaucugaaauccuucaaaaucugaaauguuuugaacaccaacaugaugccacaaguagaaaauuccacaccugaccucaugaugggucgcagucaaaacuucguuucaggcuggaugcaguggcucaugucuguaaucccaacacuuugggaggcuaaggugggaggauugcuucagcccaggaguucaagaccagccugggcaacauggaaagacgcuaucucuacaaaaaaauacaaaaguuagccaggcagggugguacacguuugugguuccagcuacuugggaggcugaggcaggaggaucgcuugagcccaggaggugaaggcugcagugagccaugauuguaugacugcauuccagccugggugacagagcaagucccugucucaaaaacaaucaaaacaacuuuguuucauguguaacauuauuuaaaauuauauaaaauuacauucagguuuggucccauccucaggauaucucauguaugugcaaauauucuaaaaucugaaacacuucuggucccaagcauuucagauaagggguauucaacuuguauaugaaaauggaucccaccuucauuuaugaguagggaaaagaagaauuguuuaauaaacaguguugggauagccaguuagucaucuggaaaaauaauguuggcuuccagaggaguuaaagauuuaaauaugaaacaaagaaacaaaaaagguaggguaauuauuuuuuacguaauccaggauuggugaaguccuuuaauagcauacuggguugcuggauuuuaggacauaaaaauaaaauucuguacaggggaaaaaaucaaacaaaguuaaaagagaaacagacuaguaaaacuuauuuguauacuucacaaagggcuaaguuccucuuaauacaaagaacuagaaaauaauccaguagaaaaauuagcaaagagaauucauaugaaaaaauguacaacuuuauuuauaauauaauaaagauguaaauucaagcuacaacauacucuuugucaccuaucaaaugagcaaagguuauguauaguauaacucgggaaaggugagaagagaaaauggucagccuuauacauugcuggugggauuauaaaguauucauacucuauagaaagcaguuugaaaaugguuuucaaaaauuaaaacacagauuu

SEQ ID NO: 21074 - RNA, 2136 nt, Homo sapiens
aaaucuguguuuuaauuuuugaaaaccauuuucaaacugcuuucuauagaguaugaauacuuuauaaucccaccagcaauguauaaggcugaccauuuucucuucucaccuuucccgaguuauacuauacauaaccuuugcucauuugauaggugacaaagaguauguuguagcuugaauuuacaucuuuauuauauuauaaauaaaguuguacauuuuuucauaugaauucucuuugcuaauuuuucuacuggauuauuuucuaguucuuuguauuaagaggaacuuagcccuuugugaaguauacaaauaaguuuuacuagucuguuucucuuuuaacuuuguuugauuuuuuccccuguacagaauuuuauuuuuauguccuaaaauccagcaacccaguaugcuauuaaaggacuucaccaauccuggauuacguaaaaaauaauuacccuaccuuuuuuguuucuuuguuucauauuuaaaucuuuaacuccucuggaagccaacauuauuuuuccagaugacuaacuggcuaucccaacacuguuuauuaaacaauucuucuuuucccuacucauaaaugaaggugggauccauuuucauauacaaguugaauaccccuuaucugaaaugcuugggaccagaaguguuucagauuuuagaauauuugcacauacaugagauauccugaggaugggaccaaaccugaauguaauuuuauauaauuuuaaauaauguuacacaugaaacaaaguuguuuugauuguuuuugagacagggacuugcucugucacccaggcuggaaugcagucauacaaucauggcucacugcagccuucaccuccugggcucaagcgauccuccugccucagccucccaaguagcuggaaccacaaacguguaccacccugccuggcuaacuuuuguauuuuuuuguagagauagcgucuuuccauguugcccaggcuggucuugaacuccugggcugaagcaauccucccaccuuagccucccaaaguguugggauuacagacaugagccacugcauccagccugaaacgaaguuuugacugcgacccaucaugaggucagguguggaauuuucuacuuguggcaucauguugguguucaaaacauuucagauuuugaaggauuucagauuauggaguuuuagauaagggaugcucaaccuauauuaagcucucauauauauuuaaguuaauucuagucuuuacucuguuuuagugcugucaugugccaaaaccauguuacuuuucaaaacauuuuaaaauuaaaaccacuuuacauacaaguaagaauaauacaaccagaaauuacuggcuugcuuuaauuuaugaaucauuuugcaauuucuaaauggaauuuauauaauuaaguucaauaugaucaucaugcaaucaugcauuuugguugacacauauuuuggagaccauuacgaaucucaugucucccacuacauuucuggaaccauaucuagaaaaucaauuuuuccuuaauuuuguacaugguuuuuuuaaauuauaaaaucagcacauguuaucuguaaaaaaucugaaaauauaaaacauaccuuccagagauaaccaacuuuuauacuucgguguauuuuuuuccacacuuuuaauaagugacuauuuuguaaacuaauuuuuucacauaauaugacagcacuuucccauguuauuacacauacuucuacaacauguuuuaaacacauccucccaaaugaauauacccaguuuaugcaaccauuugccaauuguugaacacuuagaguuguucucugugaugauuaucaucuauuuauuaauccuugccacaaaugaguuccaagaauuaauagacgaguuucaagcacugugguaagcauuaacucuauaauggugaggaaaaagaaacacauuaucaggauuucuggagguuacaaucuauuuggaaaaacagauguuaaucuccaacacauaugaaauuacaaugacagcaagugcuaugaggagaguucauggugcucugagagucugugauagggaagccuucccugaggaaagauaaaucgaaguuuaggugaaagaaaaguaaaaacauucucagcaggggcaacggcagguacaa

SEQ ID NO: 21075 - RNA, 308 nt, Homo sapiens
augccuuugauauuuuccagucuuaaaacaaaaaaauaaaugaaggaagaaaaaguaaauucagucacauacaauccccuggucacuaucucuuuaaucauucaaagucuuccuuauaaugaaugcaaucuaacccuuugggcuuuagucuucucaucuucaaaaaagaagagggcuacacuggaucagugguucuuacugagaucagaaucauagauggaacaauaaaaauggaauuccaaggcccaaaccccaucuagaucuaaugacucaaucacugacuucgaaccugucuacccaacucccaa

SEQ ID NO: 21076 - RNA, 308 nt, Homo sapiens
uugggaguuggguagacagguucgaagucagugauugagucauuagaucuagaugggguuugggccuuggaauuccauuuuuauuguuccaucuaugauucugaucucaguaagaaccacugauccaguguagcccucuucuuuuuugaagaugagaagacuaaagcccaaaggguuagauugcauucauuauaaggaagacuuugaaugauuaaagagauagugaccaggggauuguaugugacugaauuuacuuuuucuuccuucauuuauuuuuuuguuuuaagacuggaaaauaucaaaggcau

SEQ ID NO: 21077 - RNA, 545 nt, Homo sapiens
auauggugauauucugacugaucagcuacuuucuggcauguacaauagccucuuaaaaauuugaaaagcgaagcuucucucuaaaggucaagaugcacucagccggucgcgguggcuuacaccuauuaucacagcucuucaggaagccgaggugggcagaucauuacaggucaggaguucgagaccagccuggccaacauggugaaaccccaucucuacuaaaaauacaaaaauuagccaggcaugguagcaggcauuuguaaucccagcuacuugggaggcugaggcaugagaaucacuugaacccaggagguggagguugcagugagccaagaucacaccacuguacuccauucagccugggcaacagagcaagacucugucucaaaaaaaaaaaaaaaaaaguugcacccaauuuccccauaacccuuuucucugccacauugacaucacugcugcuucacuugguuggcauugcuaaagucagcacauccuugagggcaguauuuggacuuugauccugccuuggcagcagcuacagugug

SEQ ID NO: 21078 - RNA, 545 nt, Homo sapiens
cacacuguagcugcugccaaggcaggaucaaaguccaaauacugcccucaaggaugugcugacuuuagcaaugccaaccaagugaagcagcagugaugucaauguggcagagaaaaggguuauggggaaauugggugcaacuuuuuuuuuuuuuuuuuugagacagagucuugcucuguugcccaggcugaauggaguacaguggugugaucuuggcucacugcaaccuccaccuccuggguucaagugauucucaugccucagccucccaaguagcugggauuacaaaugccugcuaccaugccuggcuaauuuuuguauuuuuaguagagaugggguuucaccauguuggccaggcuggucucgaacuccugaccuguaaugaucugcccaccucggcuuccugaagagcugugauaauagguguaagccaccgcgaccggcugagugcaucuugaccuuuagagagaagcuucgcuuuucaaauuuuuaagaggcuauuguacaugccagaaaguagcugaucagucagaauaucaccauau

SEQ ID NO: 21079 - RNA, 135 nt, Homo sapiens
uguaacacacaccauacugcacaccuacaggauaaacuacaaguacaccuacaggauaaacucccagaagcagaacuacuaggucaaaugauauacguguuccagaauucuugaccuuccuaagguuucuagaug

SEQ ID NO: 21080 - RNA, 135 nt, Homo sapiens
caucuagaaaccuuaggaaggucaagaauucuggaacacguauaucauuugaccuaguaguucugcuucugggaguuuauccuguagguguacuuguaguuuauccuguaggugugcaguaugguguguguuaca

SEQ ID NO: 21081 - RNA, 492 nt, Homo sapiens
uaauagaccuucugaugcauucacaaucaauguaucucgacugacucugacaacagcauucugaggcuggcacagaaggcauuauauaccaucuacgagugacauaaaaggcaaugcaagaucaaagcaucaaaacuugcucaaggccacagauaaaaucagugauagagcaaagauuuaacugaagucuuuguauuuucaguccaggauucccaggauucuauacugcuucaaaugcaccacaggaauuuucuguuugagucuauaagaaucuaagccuggcuuuuauccaaggugugaacugaauaugaacuucuacugcauuccuaggagaucuggaaauucccacuuuccuggccagaaggagcucccucuucacucaacaaccacgggaugugucugcacccccuuuuuguaucuaucacaucaugccuugcaucucugcuagcuguuuuugcuucagcugcaucccucucuuucuaacucucccua

SEQ ID NO: 21082 - RNA, 492 nt, Homo sapiens
uagggagaguuagaaagagagggaugcagcugaagcaaaaacagcuagcagagaugcaaggcaugaugugauagauacaaaaagggggugcagacacaucccgugguuguugagugaagagggagcuccuucuggccaggaaagugggaauuuccagaucuccuaggaaugcaguagaaguucauauucaguucacaccuuggauaaaagccaggcuuagauucuuauagacucaaacagaaaauuccuguggugcauuugaagcaguauagaauccugggaauccuggacugaaaauacaaagacuucaguuaaaucuuugcucuaucacugauuuuaucuguggccuugagcaaguuuugaugcuuugaucuugcauugccuuuuaugucacucguagaugguauauaaugccuucugugccagccucagaaugcuguugucagagucagucgagauacauugauugugaaugcaucagaaggucuauua

SEQ ID NO: 21083 - RNA, 2890 nt, Homo sapiens
ugcuccaacccugauggcugcaucauacuugauuaaaagaauccuggccgggcgcgguggcucacgccuguaaucccagcacuuugggagguugaggcggguggaucacuugaggucaggaguucaagaccagccuggccaacauggugaaacaccgucuuuacuaaaaauacaaaaauuagccgggugugguggugcaugccuguaaucccagcuacuagggagacugaggcaggagaaucgcuugaacccgggagguggagguugcagugagccgagacggugccacugcacuccagccuguuuaccucucugaccucauuuccuccugcucuguucuuugaucacucuguucaaguuacacuggacuccuugcuaauucuagaacucauuagccuugccccugcuucagggucuuuguauuugcugucuccucuaccucucaugcucuccuuuuagauagcugcaagguuuacucccucacuuccucaaaucuuuauuuaaugccgcuuucuuagugagaccuugccuguuggcucacucagaauugaccuucccccugcacauuucucuuuccucccugcucuaguuuuuuccuuaaucauguucaccaucuaaccuaguuuaugucuuauuucuccagcuuacuuucuccccaacucugcuucauguauuuguacuugcauuguucacagcuguaguucagcaccuugaacauaguucuuagcauguaguaggcauccaauauaaucauugaaugaauggauggaugaaugaauggauggaugaaugaaugaaugcauuagcaccauggcuuuaaaguuaagcuguccagguaugaauccucacucugccaccacuugcuacauaugugaucuuuggcaauuuauuuagccucuucuggagaugaucauggucccuaccuuacagggcuguugugagaauuaauugagcuaaucuaugaaaagugcuuuggaacuuagcaaauacuuaauaacaauuagcuguuauuucaacugucauccuuuuacucucggugaguuuggauuuuucugucuauggauaagauugucuuacauuugccuauguaaaauucaauggucaccuccacccccaccaaaccucccauccuguggcuuccagagaacuucauguaguugguucccuggagcgcccuuucggcuuuaaaauuuacagguuuccaaagugauuccauuuguuccuagauuuucagaccauaucuauucaguguggcagauucauggcugcagugaugaacgguuauucuccaugaggagcgaagggagaagauuuucacaaagcuggagcauuuccuccacugccugcacugaggaguugccaaggcuugaaaaucucuucugugugccaaaccagaacuggacauuucugguuuugcaaugcagacguucuaguacuggaauuaacaaaugcuccacacugagcuacugccaaauugccaggagaguuuuucaguguuuguuugggggauaggguaacaauaggauggccuuuggagauugugucugacacaccugugggcagaagguaggcuuuaaguauccaccaucucuuccuuuuagaguuugccaucuccguaccaccaccaccaccacacacagcacccucaagacucccugugauccugggaugcacucaacgaagaguguguggcccaggugagccaaugggaaugacucgagcucuuggacauagagguuuguccaguaucacaaguccaguagaaccaaccagauuauuuuuauuuucaggauuugauggaaaugcuacaagagaagcaggcucuccccuucugaaaugaugagugauaaugaccauacaggucaacuuuuccaccacuuggagggagccugucaaagaacaaaggcaacagagaagagagcagagcugagguugggugagagggagaaauuccugagugcuugaaucccacaugccggaagccgcaccacacuuggacuucucaauacaggagccagugaguuuauuuuuuccugaccugguuggauuugggcauucucaagaguuuggggguuggguggggggcauuuaggggagagagcagaaugcagaauugagaaggggaagaagagagcugccuuccacuuuaaugagcaucuccuacuuuuccucuggugcuucucagcacuaagucccuuuuacaauauacugcuugcuccauccccauaauggaggacacucacugguagacaaaggaagagggagaggagcagagcugaugccacuggcauuagugcucugggcccaggauggggcagggagcagugaggcagauggcuuucuccuggacuucugggacccaagaacaugguaaauguccaugccgucugucuuuccgcccacagaauggaggggaaacauguucuaggacagcagucaucaaucuuauuuaagacaugaaucaaucagaaauuccgguagaaucuagagaccagaggucacaaaccaccugccuaucgggaccauauuugacucacucagaguguucugguugguaugccaggauucucuaaagaaaaugugaacuaaauugagauuucaucuccaaagagaaccagauuucugcuuucucuuaaucagccauaaggucugucaauacugggucccauuuccucaaggcagugaucaacugaagcagaggagugagugccugccuuagaaggcaugugcccucccguuugcccaauccucacccgccccaaggucuccccaacacugagcauugcuugccuuuugucaucacccuugcauuacuguuucuuaugguggagagauauuuauuuggacccaagucucuaccagaagugacgaaauaaaagacagacccaga

SEQ ID NO: 21084 - RNA, 2890 nt, Homo sapiens
ucugggucugucuuuuauuucgucacuucugguagagacuuggguccaaauaaauaucucuccaccauaagaaacaguaaugcaagggugaugacaaaaggcaagcaaugcucaguguuggggagaccuuggggcgggugaggauugggcaaacgggagggcacaugccuucuaaggcaggcacucacuccucugcuucaguugaucacugccuugaggaaaugggacccaguauugacagaccuuauggcugauuaagagaaagcagaaaucugguucucuuuggagaugaaaucucaauuuaguucacauuuucuuuagagaauccuggcauaccaaccagaacacucugagugagucaaauauggucccgauaggcaggugguuugugaccucuggucucuagauucuaccggaauuucugauugauucaugucuuaaauaagauugaugacugcuguccuagaacauguuuccccuccauucugugggcggaaagacagacggcauggacauuuaccauguucuugggucccagaaguccaggagaaagccaucugccucacugcucccugccccauccugggcccagagcacuaaugccaguggcaucagcucugcuccucucccucuuccuuugucuaccagugaguguccuccauuauggggauggagcaagcaguauauuguaaaagggacuuagugcugagaagcaccagaggaaaaguaggagaugcucauuaaaguggaaggcagcucucuucuuccccuucucaauucugcauucugcucucuccccuaaaugccccccacccaacccccaaacucuugagaaugcccaaauccaaccaggucaggaaaaaauaaacucacuggcuccuguauugagaaguccaaguguggugcggcuuccggcaugugggauucaagcacucaggaauuucucccucucacccaaccucagcucugcucucuucucuguugccuuuguucuuugacaggcucccuccaagugguggaaaaguugaccuguauggucauuaucacucaucauuucagaaggggagagccugcuucucuuguagcauuuccaucaaauccugaaaauaaaaauaaucugguugguucuacuggacuugugauacuggacaaaccucuauguccaagagcucgagucauucccauuggcucaccugggccacacacucuucguugagugcaucccaggaucacagggagucuugagggugcugugugugguggugguggugguacggagauggcaaacucuaaaaggaagagaugguggauacuuaaagccuaccuucugcccacaggugugucagacacaaucuccaaaggccauccuauuguuacccuaucccccaaacaaacacugaaaaacucuccuggcaauuuggcaguagcucaguguggagcauuuguuaauuccaguacuagaacgucugcauugcaaaaccagaaauguccaguucugguuuggcacacagaagagauuuucaagccuuggcaacuccucagugcaggcaguggaggaaaugcuccagcuuugugaaaaucuucucccuucgcuccucauggagaauaaccguucaucacugcagccaugaaucugccacacugaauagauauggucugaaaaucuaggaacaaauggaaucacuuuggaaaccuguaaauuuuaaagccgaaagggcgcuccagggaaccaacuacaugaaguucucuggaagccacaggaugggagguuugguggggguggaggugaccauugaauuuuacauaggcaaauguaagacaaucuuauccauagacagaaaaauccaaacucaccgagaguaaaaggaugacaguugaaauaacagcuaauuguuauuaaguauuugcuaaguuccaaagcacuuuucauagauuagcucaauuaauucucacaacagcccuguaagguagggaccaugaucaucuccagaagaggcuaaauaaauugccaaagaucacauauguagcaagugguggcagagugaggauucauaccuggacagcuuaacuuuaaagccauggugcuaaugcauucauucauucauccauccauucauucauccauccauucauucaaugauuauauuggaugccuacuacaugcuaagaacuauguucaaggugcugaacuacagcugugaacaaugcaaguacaaauacaugaagcagaguuggggagaaaguaagcuggagaaauaagacauaaacuagguuagauggugaacaugauuaaggaaaaaacuagagcagggaggaaagagaaaugugcagggggaaggucaauucugagugagccaacaggcaaggucucacuaagaaagcggcauuaaauaaagauuugaggaagugagggaguaaaccuugcagcuaucuaaaaggagagcaugagagguagaggagacagcaaauacaaagacccugaagcaggggcaaggcuaaugaguucuagaauuagcaaggaguccaguguaacuugaacagagugaucaaagaacagagcaggaggaaaugaggucagagagguaaacaggcuggagugcaguggcaccgucucggcucacugcaaccuccaccucccggguucaagcgauucuccugccucagucucccuaguagcugggauuacaggcaugcaccaccacacccggcuaauuuuuguauuuuuaguaaagacgguguuucaccauguuggccaggcuggucuugaacuccugaccucaagugauccacccgccucaaccucccaaagugcugggauuacaggcgugagccaccgcgcccggccaggauucuuuuaaucaaguaugaugcagccaucaggguuggagca

SEQ ID NO: 21085 - RNA, 583 nt, Homo sapiens
uauaaaguuauugaaugaauaaauaaauaaaugaaucuaaugcgucuguaagugagggaaccgaaacauuuuugccaccuucuuucugcccuggauccacuuuuuuuuaucuuccccuacuuggaugugcuucccagcuuacucuuuggcuuacccuucagacucuggugugcuaccaagaagagcuuggcuuucuugaaguuccugcuuaaucuccaugagccuggccccaaaacaauaguaccuaguagcaugagagagauucaucaagucaacaaacaugcaugaguacuuacaauguuccaggccucguagaacccacuagggggacucagccuuccucuuaaagaggucuaguucuagugagagagaaaccaucaacagauaauucuaacaaagggugagaagucacgggagagugcacagaaugguuuugcaaacagccagaagcaccacuguaaucaccuugggauguccagaaaggcaucacaguagaggggacccggauggagcccccuaacgucucugaauuuuuguuuucccauccaugucaugagaaauuuggacuggaugagcuauuaag

SEQ ID NO: 21086 - RNA, 583 nt, Homo sapiens
cuuaauagcucauccaguccaaauuucucaugacauggaugggaaaacaaaaauucagagacguuagggggcuccauccggguccccucuacugugaugccuuucuggacaucccaaggugauuacaguggugcuucuggcuguuugcaaaaccauucugugcacucucccgugacuucucacccuuuguuagaauuaucuguugaugguuucucucucacuagaacuagaccucuuuaagaggaaggcugagucccccuaguggguucuacgaggccuggaacauuguaaguacucaugcauguuuguugacuugaugaaucucucucaugcuacuagguacuauuguuuuggggccaggcucauggagauuaagcaggaacuucaagaaagccaagcucuucuugguagcacaccagagucugaaggguaagccaaagaguaagcugggaagcacauccaaguaggggaagauaaaaaaaaguggauccagggcagaaagaagguggcaaaaauguuucgguucccucacuuacagacgcauuagauucauuuauuuauuuauucauucaauaacuuuaua

SEQ ID NO: 21087 - RNA, 237 nt, Homo sapiens
aaaguaacauuuauaugucuaauaacaugcaaccucauccauuuauuuugugguguaugugcagggacagaagagaacauguuugcacacuauggguggcaugcuuuugucauugcagcuuuaaucgguuauacuaagaggaaaacucaucaaaagugccaagauccuaccaccagaauaccugguuuuaugucagacgguugacugagauaaguuacuuauucauucaguuuacua

SEQ ID NO: 21088 - RNA, 237 nt, Homo sapiens
uaguaaacugaaugaauaaguaacuuaucucagucaaccgucugacauaaaaccagguauucuggugguaggaucuuggcacuuuugaugaguuuuccucuuaguauaaccgauuaaagcugcaaugacaaaagcaugccacccauagugugcaaacauguucucuucugucccugcacauacaccacaaaauaaauggaugagguugcauguuauuagacauauaaauguuacuuu

SEQ ID NO: 21089 - RNA, 161 nt, Homo sapiens
uuuaccuauuaggaaaaaauauauacuuuuuuuucaauaaacaugaaagacgauaauaagacugaaggagcccacaucucucagaagugaagaauucccucccauguucuauuuuaaaugaaagacaaaacaaagucaccaaaagcacaaacguguaccug

SEQ ID NO: 21090 - RNA, 161 nt, Homo sapiens
cagguacacguuugugcuuuuggugacuuuguuuugucuuucauuuaaaauagaacaugggagggaauucuucacuucugagagaugugggcuccuucagucuuauuaucgucuuucauguuuauugaaaaaaaaguauauauuuuuuccuaauagguaaa

SEQ ID NO: 21091 - RNA, 906 nt, Homo sapiens
agagucaagaaccugaacagaguuuccaugaagguucuccaagcacuagaagggagagugucuaaacaaugguugaaaagcaaaggaaauauaaaacagacaccucuuuccauuuccuaagguuucucucuuuauuaaggguggacuaguaauaaaauauaauauucuugcugcuuaugcagcugacauuguugcccucccuaaagcaaccaaguagccuuuauuucccacagugaaagaaaacgcuggccuaucaguuacauuacaaaaggcagauuucaagaggauugaguaaguaguuggauggcuuucauaaaaacaagaauucaagaagaggauucaugcuuuaagaaacauuuguuauacauuccucacaaauuauaccugggauaaaaacuauguagcaggcaguguguuuuccuuccaugucucucugcacuaccugcaguguguccucugaggcugcaagucuguccuaucugaauucccagcagaagcacuaagaagcuccacccuaucaccuagcagauaaaacuauggggaaaacuuaaaucugugcauacauuucuggaugcauuuacuuaucuuuaaaaaaaaaggaauccuaugaccugauuuggccacaaaaauaaucuugcuguacaauacaaucucuuggaaauuaagagauccuauggauuugaugacugguauuagaggugacaauguaaccgauuaacaacagacagcaauaacuucguuuuagaaacauucaagcaauagcuuuauagcuucaacauaugguacguuuuaaccuugaaaguuuugcaaugaugaaagcaguauuuguacaaaugaaaagcagaauucucuuuuauaugguuuauacuguugaucagaaauguugauugugcauugaguauuaaa

SEQ ID NO: 21092 - RNA, 906 nt, Homo sapiens
uuuaauacucaaugcacaaucaacauuucugaucaacaguauaaaccauauaaaagagaauucugcuuuucauuuguacaaauacugcuuucaucauugcaaaacuuucaagguuaaaacguaccauauguugaagcuauaaagcuauugcuugaauguuucuaaaacgaaguuauugcugucuguuguuaaucgguuacauugucaccucuaauaccagucaucaaauccauaggaucucuuaauuuccaagagauuguauuguacagcaagauuauuuuuguggccaaaucaggucauaggauuccuuuuuuuuuaaagauaaguaaaugcauccagaaauguaugcacagauuuaaguuuuccccauaguuuuaucugcuaggugauaggguggagcuucuuagugcuucugcugggaauucagauaggacagacuugcagccucagaggacacacugcagguagugcagagagacauggaaggaaaacacacugccugcuacauaguuuuuaucccagguauaauuugugaggaauguauaacaaauguuucuuaaagcaugaauccucuucuugaauucuuguuuuuaugaaagccauccaacuacuuacucaauccucuugaaaucugccuuuuguaauguaacugauaggccagcguuuucuuucacugugggaaauaaaggcuacuugguugcuuuagggagggcaacaaugucagcugcauaagcagcaagaauauuauauuuuauuacuaguccacccuuaauaaagagagaaaccuuaggaaauggaaagaggugucuguuuuauauuuccuuugcuuuucaaccauuguuuagacacucucccuucuagugcuuggagaaccuucauggaaacucuguucagguucuugacucu

SEQ ID NO: 21093 - RNA, 4599 nt, Homo sapiens
agacccagcagccacgcuugggugggcauggcgcuccauggcucccuaugauggcucaucucagcuacucaacugcugcaaagggaggagggaaaacugaucaacucauggagccucaauuccaucaucuguaaaaugugugcagcagucauuccuacccauugguuuguugugaggauuaaauaaggucacagcagcgcugguagaugcuuuuccugagaccagaguacacaguaccuuggccugauuaauuauauguaacuaucuacaggcugauguagaagacagaggcacuauucaguuacucacaguaacaggcaugagccccacucuccccuauuuucaucauguucugguuuuaugaaacguuuaccuuacuuugcuugcauaaggaaaaccauuucaucaggaccugagaaaaaucuaguauucaaaaaugauuaugaguggggcacgguggugcccaccugcagucccaacuacuuggaggccaaggugggaggaucagcugaguccaggaguuagaggcuacagugugcuaugaucacaccugugaacagcaaccauacuccagccugggcaacauagcaaguccccaucucuauuuuuacagaauaaauauaaauucauuuaaaaugaucauagcaaaacaauauuucaaaacaauauacaauggcauuuggguugauuguaugcauucucuuuuucucucagguuaggagcuuaugcagacuacaugaaaauuaaguauuacaguuuguuuguaaaauaaguuaguguguaaaauaaguuaguuuguagugauuaaaagcauuagcccugguuaagcuucuuguaaaaucccuuguugugacagccgggaaagugaguuaaugaaaauucugaugcucuaucaaaucaguuggucaagaaacuuggucaggaggucagaaacaugggcccugcccgagcagcaagucaccaugacccaggccaaccugaggacaaaggccucaacuauuccuugaaccaugcugauaaucaggacauuccgaagaaacaagugauguggauuucagugacguaaguaaggggccccugagggucacaacaaggccugccucuuugcagcugcagcugcugcccucaagagcugagucaagguggaaggcagaccccucaacuacagaaaugcugccugauauucaugaaaaccaccucugacucccaauaccuguggcauucucccugucauaucugaaaugucucccuccagggaacaauuauccaacuaucuuacaauuuucagucagaaauucuacaagcaaggaaaccacaugacccaaaaauuauacuccuggauauuuauccaagagaagugaaaacauauguccauaugaagucguacacaaauguuccuagcagcuuuauucauaauagauugugaaucugccuuaaagacugaggccaaguuuacuucaaaaccagaauuuaguuucuccucaaacugucugcagaguuccaucuuggcaucacgagggacucuuuugauuagagaggacaaacacauccaagacagcuuuggaccagcugucacgcucacagaugucugggaaccccagagcauugccucgcccugaguugcuacagacacgggcacgcuguccaggaguagcaagaaccucaccagaaggcccaacuuauccuggguucucuccuuuaaacauuuucuggccuuaccaucaaaauccaagcauucacggucugaaucgccagagccagguugcagagugcaaugagucccauucagcagcaccccaugcguuaccacaaugcuucgagaugggucacgcucugcccauuuugcagauggggaaaucagucccuacagaggugaagugacuuucccaaagccucauggcugguggaucuugggcugacauugaacccacguggucuggcuccuacaguaacugagggcgugcacuuacacguggaaugaacugcugagaaugaucuaggagcuggagccaaggggagcagaagggucugguccugugaggacaugcgcuguagauaggucugucagcugggccaggcugcauuuccugucgugcuccaucaagagcaggcuugccucacggacacaccuaugcccaucagcuggacuugacaccuuccugggauccgcccagacuaagagaugggauuuuaaaaggcuugaguucuaaccuuggcccuuuacaagaauuugcugagugauuccucacaacacccucugcaguaagugcuguuagcuuccccaucugcaguaagugucauuagccuccgcauuuaacaaggggaggaaacagguagaaaggagcgaaguguucccccaucuucugccacccagcuaguagcaaagucagaucuaacacccgggucuuuuucugaccccagaucugggcucuaaucucugauuucucugaggcuagagacauaagccaugaggaaaacguuggugcaacaaaugaaggucuuagcucccuugcaguggaauagccguuccuggguucagcggcaaagcagugaggguagcugaggcugcuggaggcaaccgcucaggccaggccacagauaaaagugagagcgcacccaguuaaacuaaggccuuaauuacaggcuucguuuagagccuagcagcaaaagcuugcugcagccccacaggugcuggacgcugaggaguucccaccagccuggcucagcccucugcacccaggcagcccaccccacccccaccuuccgaagguagaaccacgaggacuuccgaaucagaugcacuuuggaaugugagaugcucgguaagaagcucauuccaaaucuagaaguucacugguaucgggauguccuucucagagcuuucggugcacaaagaaacggacaucucugccccugaggccgcuauuccucaccaugcuaccaacccaggcucagcucucccuccggggccuucccgccgcacccagcccuuccuccagguccgcgacggggaggaaacccggccagccucccagcccgcaaccguccacuccuggcugccacacccaaggcagucucugccuucucuagagcgagagcgcagcgggccaggggagaaguggaaagacacaaaaggcugcggggcugggacggcgaagcagcagcccgcacggcagggggcuuggcagcggcgcccggggucgccgauccccggcucucggccagcccagcccagcgacccuuuccgcgggggaugcuggccccugcuggccgcgcgagagaucgcaggguggcuaucgccucgggagagcagagaggcccgggaccgggaagcggugcccgccccgggaaaggggcugagcucucagggcagcagcagcacccggcccccgcguggaggugguuagccuggaggggagcugggagaaggcaaggacgggaggaccugggcgcgaggccccaaguucugguccuguccccgccgccacccugguaacagugcuagcugccucagcaccuccaggcucacacgugcuaucaaacgccucauaucauaguuucuagaaaggagaugagucagaagaaagaggugagaggucucuagcaugacuggcucuggucucccuccagggccuaccuccagaagacuuccuucagccugaugucuuccucaagaccagccaaccccgaaccaugagcugauggggccacgugcauuucacagguuacugacugggugggcugaaugauggcccccaaagacagccagguccuaaccccuggaaccugugaauauuacccuacauggcaaaacggacuuugcuggugugacugaaagcccuugaguggggagauuaucccggauuauucagauggaucuuaaauguaaucacaaggguccuucuaaaagagaggcagaggaagauuuuacuacagaagacaaacaaagccauaugacaaaggaagcagacagagagagagauuuggaaaugcuaugcugcuggcuuugaagauggguaagaggccaagagccaaagaaugcaaacacugcagcucuggaugcuagaaagggcaaggaaauguagagccccugcaggcucugcuuaccccuuaauuuuggcccagugaaacugauuucagauuucugaucugcagaacugaaagagaauaaauguguguugcuuucagccaccaaguuuguggcaauuuguuacagcagccacaggacgcuaauacaugacccuuuacucucugacucuuguacucagcacuugggaucaaacagugaacccgauaaaccucuacaccucccagggaaauugaccaucucucugucucuggauuuuaaaaaggaacagccacguagacauuuuaucaaagauauaugaauggucaauaaacacaugaaaagaaaaugcacaaaaucauuagcauuagggcaaugaaaauuaaaaccacaaugagauaccacuucauacucacuaggauggcuauaauaaaagacaauaacaaaugucaaaaguguggaagaacuauaauuuucauauauugcugaugagauuguaacaugguacaacugacuuggaaaauaguuuggua

SEQ ID NO: 21094 - RNA, 4599 nt, Homo sapiens
uaccaaacuauuuuccaagucaguuguaccauguuacaaucucaucagcaauauaugaaaauuauaguucuuccacacuuuugacauuuguuauugucuuuuauuauagccauccuagugaguaugaagugguaucucauugugguuuuaauuuucauugcccuaaugcuaaugauuuugugcauuuucuuuucauguguuuauugaccauucauauaucuuugauaaaaugucuacguggcuguuccuuuuuaaaauccagagacagagagauggucaauuucccugggagguguagagguuuaucggguucacuguuugaucccaagugcugaguacaagagucagagaguaaagggucauguauuagcguccuguggcugcuguaacaaauugccacaaacuugguggcugaaagcaacacacauuuauucucuuucaguucugcagaucagaaaucugaaaucaguuucacugggccaaaauuaagggguaagcagagccugcaggggcucuacauuuccuugcccuuucuagcauccagagcugcaguguuugcauucuuuggcucuuggccucuuacccaucuucaaagccagcagcauagcauuuccaaaucucucucucugucugcuuccuuugucauauggcuuuguuugucuucuguaguaaaaucuuccucugccucucuuuuagaaggacccuugugauuacauuuaagauccaucugaauaauccgggauaaucuccccacucaagggcuuucagucacaccagcaaaguccguuuugccauguaggguaauauucacagguuccagggguuaggaccuggcugucuuugggggccaucauucagcccacccagucaguaaccugugaaaugcacguggccccaucagcucaugguucgggguuggcuggucuugaggaagacaucaggcugaaggaagucuucuggagguaggcccuggagggagaccagagccagucaugcuagagaccucucaccucuuucuucugacucaucuccuuucuagaaacuaugauaugaggcguuugauagcacgugugagccuggaggugcugaggcagcuagcacuguuaccaggguggcggcggggacaggaccagaacuuggggccucgcgcccagguccucccguccuugccuucucccagcuccccuccaggcuaaccaccuccacgcgggggccgggugcugcugcugcccugagagcucagccccuuucccggggcgggcaccgcuucccggucccgggccucucugcucucccgaggcgauagccacccugcgaucucucgcgcggccagcaggggccagcaucccccgcggaaagggucgcugggcugggcuggccgagagccggggaucggcgaccccgggcgccgcugccaagcccccugccgugcgggcugcugcuucgccgucccagccccgcagccuuuugugucuuuccacuucuccccuggcccgcugcgcucucgcucuagagaaggcagagacugccuuggguguggcagccaggaguggacgguugcgggcugggaggcuggccggguuuccuccccgucgcggaccuggaggaagggcugggugcggcgggaaggccccggagggagagcugagccuggguugguagcauggugaggaauagcggccucaggggcagagauguccguuucuuugugcaccgaaagcucugagaaggacaucccgauaccagugaacuucuagauuuggaaugagcuucuuaccgagcaucucacauuccaaagugcaucugauucggaaguccucgugguucuaccuucggaagguggggguggggugggcugccugggugcagagggcugagccaggcuggugggaacuccucagcguccagcaccuguggggcugcagcaagcuuuugcugcuaggcucuaaacgaagccuguaauuaaggccuuaguuuaacugggugcgcucucacuuuuaucuguggccuggccugagcgguugccuccagcagccucagcuacccucacugcuuugccgcugaacccaggaacggcuauuccacugcaagggagcuaagaccuucauuuguugcaccaacguuuuccucauggcuuaugucucuagccucagagaaaucagagauuagagcccagaucuggggucagaaaaagacccggguguuagaucugacuuugcuacuagcuggguggcagaagaugggggaacacuucgcuccuuucuaccuguuuccuccccuuguuaaaugcggaggcuaaugacacuuacugcagauggggaagcuaacagcacuuacugcagaggguguugugaggaaucacucagcaaauucuuguaaagggccaagguuagaacucaagccuuuuaaaaucccaucucuuagucugggcggaucccaggaaggugucaaguccagcugaugggcauagguguguccgugaggcaagccugcucuugauggagcacgacaggaaaugcagccuggcccagcugacagaccuaucuacagcgcauguccucacaggaccagacccuucugcuccccuuggcuccagcuccuagaucauucucagcaguucauuccacguguaagugcacgcccucaguuacuguaggagccagaccacguggguucaaugucagcccaagauccaccagccaugaggcuuugggaaagucacuucaccucuguagggacugauuuccccaucugcaaaaugggcagagcgugacccaucucgaagcauugugguaacgcauggggugcugcugaaugggacucauugcacucugcaaccuggcucuggcgauucagaccgugaaugcuuggauuuugaugguaaggccagaaaauguuuaaaggagagaacccaggauaaguugggccuucuggugagguucuugcuacuccuggacagcgugcccgugucuguagcaacucagggcgaggcaaugcucugggguucccagacaucugugagcgugacagcugguccaaagcugucuuggauguguuuguccucucuaaucaaaagagucccucgugaugccaagauggaacucugcagacaguuugaggagaaacuaaauucugguuuugaaguaaacuuggccucagucuuuaaggcagauucacaaucuauuaugaauaaagcugcuaggaacauuuguguacgacuucauauggacauauguuuucacuucucuuggauaaauauccaggaguauaauuuuugggucaugugguuuccuugcuuguagaauuucugacugaaaauuguaagauaguuggauaauuguucccuggagggagacauuucagauaugacagggagaaugccacagguauugggagucagaggugguuuucaugaauaucaggcagcauuucuguaguugaggggucugccuuccaccuugacucagcucuugagggcagcagcugcagcugcaaagaggcaggccuuguugugacccucaggggccccuuacuuacgucacugaaauccacaucacuuguuucuucggaauguccugauuaucagcaugguucaaggaauaguugaggccuuuguccucagguuggccugggucauggugacuugcugcucgggcagggcccauguuucugaccuccugaccaaguuucuugaccaacugauuugauagagcaucagaauuuucauuaacucacuuucccggcugucacaacaagggauuuuacaagaagcuuaaccagggcuaaugcuuuuaaucacuacaaacuaacuuauuuuacacacuaacuuauuuuacaaacaaacuguaauacuuaauuuucauguagucugcauaagcuccuaaccugagagaaaaagagaaugcauacaaucaacccaaaugccauuguauauuguuuugaaauauuguuuugcuaugaucauuuuaaaugaauuuauauuuauucuguaaaaauagagauggggacuugcuauguugcccaggcuggaguaugguugcuguucacaggugugaucauagcacacuguagccucuaacuccuggacucagcugauccucccaccuuggccuccaaguaguugggacugcaggugggcaccaccgugccccacucauaaucauuuuugaauacuagauuuuucucagguccugaugaaaugguuuuccuuaugcaagcaaaguaagguaaacguuucauaaaaccagaacaugaugaaaauaggggagaguggggcucaugccuguuacugugaguaacugaauagugccucugucuucuacaucagccuguagauaguuacauauaauuaaucaggccaagguacuguguacucuggucucaggaaaagcaucuaccagcgcugcugugaccuuauuuaauccucacaacaaaccaauggguaggaaugacugcugcacacauuuuacagaugauggaauugaggcuccaugaguugaucaguuuucccuccucccuuugcagcaguugaguagcugagaugagccaucauagggagccauggagcgccaugcccacccaagcguggcugcugggucu

SEQ ID NO: 21095 - RNA, 74 nt, Homo sapiens
uuucuguucacuaugguugugagaagcccaguuauuuaaaaggccauuaagauugaaaauagauuuagaggugu

SEQ ID NO: 21096 - RNA, 74 nt, Homo sapiens
acaccucuaaaucuauuuucaaucuuaauggccuuuuaaauaacugggcuucucacaaccauagugaacagaaa

SEQ ID NO: 21097 - RNA, 306 nt, Homo sapiens
auguacaaagcuucaccucaaguaaggaggcaggaccaaccuucauacagaagcccagccuucaaggaugaguguucuaguuccagaagagcagaggcagaguggguaacaugcuaaagguauggaggccugagagaauuguuuuuuuucaaggaaugcuagcuauguaauaaggaauagggagaacaugguauuuuaacuggaacauauggaaaagauuauuacuagggaaaaaagaaugaaggccuuuacuaagaaggcagcaggaauuaagaagggacauauucaagaggagacaagcucaaa

SEQ ID NO: 21098 - RNA, 306 nt, Homo sapiens
uuugagcuugucuccucuugaauaugucccuucuuaauuccugcugccuucuuaguaaaggccuucauucuuuuuucccuaguaauaaucuuuuccauauguuccaguuaaaauaccauguucucccuauuccuuauuacauagcuagcauuccuugaaaaaaaacaauucucucaggccuccauaccuuuagcauguuacccacucugccucugcucuucuggaacuagaacacucauccuugaaggcugggcuucuguaugaagguugguccugccuccuuacuugaggugaagcuuuguacau

SEQ ID NO: 21099 - RNA, 1062 nt, Homo sapiens
gcaaacugcauaaaaguuacuuuacuccuguguucuauuuggaaaacauuacaaaacuuugagcagacaguggugcugugacaacacagugcuuaccaaagcacaguaugcuuuucugauaaagauguaacuuuauugcccuuuauguacucucuugguuaauauaguaagcaaaugggagauaauuugaaauaccuuuacuaccauuuauagugucagaacauacaacuugccuuuaaaaaugugaaagauucauugcaauagaaggcauuguguauacauacaaaugcauuuuuaaaacaaucaccaguggagugcugagaggaaucaugagcugagaucuuucaccuuuguagagaugaaauaggauguucuuguuaacuguguucuuggagcagugagccaggcugcuccaauaugcacugugggcaagaugccagcuuuugugaucuccuuugcaggaacuuuuagauggaagaggugaaaagcaggguccucuaggcuaacaaaugacuuuaagucuuuucuggggaagaaugaucugauuugcuaguaaagauuccagagaugccccugccucaaauuucugguggguggguuaggguguggaacaguucuggcagauugagagagaucaucaagacacaggccacagauaaugccauucaaucuuuaugaggucgcggcuugcuguuguucuauagauguuguaaucuugcagcccugcuucugcauaggcugagcaugaagcugagugcacagaauccuuugaggaggucaugggauuggugaaaagaugcuaggccuagaagacauggcuucuagucuuggcugugcccuguuugauuuuggacgcauccugugucgucucccacccuaguuucuacuaacaugacauauaagcuggcugcacuucaucaagucccagcuacugauuuucugggaguauguaauauguguauaaccauguaucagauugauuaggacccauuugugugacugauaucacauguccaaaauaguuucacauuuauaaucuuaauuuuuaaccauacuacaaac

SEQ ID NO: 21100 - RNA, 1062 nt, Homo sapiens
guuuguaguaugguuaaaaauuaagauuauaaaugugaaacuauuuuggacaugugauaucagucacacaaauggguccuaaucaaucugauacaugguuauacacauauuacauacucccagaaaaucaguagcugggacuugaugaagugcagccagcuuauaugucauguuaguagaaacuagggugggagacgacacaggaugcguccaaaaucaaacagggcacagccaagacuagaagccaugucuucuaggccuagcaucuuuucaccaaucccaugaccuccucaaaggauucugugcacucagcuucaugcucagccuaugcagaagcagggcugcaagauuacaacaucuauagaacaacagcaagccgcgaccucauaaagauugaauggcauuaucuguggccugugucuugaugaucucucucaaucugccagaacuguuccacacccuaacccacccaccagaaauuugaggcaggggcaucucuggaaucuuuacuagcaaaucagaucauucuuccccagaaaagacuuaaagucauuuguuagccuagaggacccugcuuuucaccucuuccaucuaaaaguuccugcaaaggagaucacaaaagcuggcaucuugcccacagugcauauuggagcagccuggcucacugcuccaagaacacaguuaacaagaacauccuauuucaucucuacaaaggugaaagaucucagcucaugauuccucucagcacuccacuggugauuguuuuaaaaaugcauuuguauguauacacaaugccuucuauugcaaugaaucuuucacauuuuuaaaggcaaguuguauguucugacacuauaaaugguaguaaagguauuucaaauuaucucccauuugcuuacuauauuaaccaagagaguacauaaagggcaauaaaguuacaucuuuaucagaaaagcauacugugcuuugguaagcacuguguugucacagcaccacugucugcucaaaguuuuguaauguuuuccaaauagaacacaggaguaaaguaacuuuuaugcaguuugc

SEQ ID NO: 21101 - RNA, 17 nt, Homo sapiens
cccuccuuucauuacuc

SEQ ID NO: 21102 - RNA, 17 nt, Homo sapiens
gaguaaugaaaggaggg

SEQ ID NO: 21103 - RNA, 1128 nt, Homo sapiens
uaggaggguggucugagggggacaccgcugggcgccugacgcggcgcagcggucuggagagcgccgcccagagagugccgccgggugacuugucaccucgggggacgggugcugagugauggucaagcugcagaacagcugggugggcaguucacgccccccaacgugcucagggagugggugguuucagcgagagagugagugacagugaauggcagccacgugagagucacagcugggcagcuuggccaccccagacugacggggucaagagggggaccccccccaccgcacuugacacaaaagagcccagagccccggcgagaugaaggggguggagccggggguaucugguuccccagacacucuucucuccgcuccccaauccgaauggacugcugucccugcacaggcugggggagcgaggggacgagcuccugccuuauuccaggaaguggucugcguggacuguggccaccaccugccccuacucaucagcagcccacaaacauucacaagaccccucccucgcgugccaccgcaugccccucaguuggcgggcaccuaagucuccgcggguggagggggguccgauggacaccguccccacucugccuguccaaguccugagcggagggggcaggcccgucggcugcuccgugcggggaaaccccacucucccucgguccaaccccaccggggccagagcccgaggggcgcucgcgcggccgccccucccccacgugccccucccccacgccgccguccggccgccagggucucggcggucccucgcucggccagggagggggcccuggcuucgccuuggccguuuccugccuacccccuccccgccgaggguaaaaaaaaaaccuccuccuccuccucccccgaaagccgcgaccgaguggcccgguccgcgcgcgcagcucgcgcccagcgcucuccagccgggguggcggcggcggcggcggcggcggcggcggcggcggcgggggaggggugcggcgggggaggggaggaggccuggccccgcggucgcagccgccaccgcccgccccgaccucccggaccgccgcggggccacgggcccgagccccggauucgcgcuccggauucgccucggcu

SEQ ID NO: 21104 - RNA, 1128 nt, Homo sapiens
agccgaggcgaauccggagcgcgaauccggggcucgggcccguggccccgcggcgguccgggaggucggggcgggcgguggcggcugcgaccgcggggccaggccuccuccccucccccgccgcaccccucccccgccgccgccgccgccgccgccgccgccgccgccgccaccccggcuggagagcgcugggcgcgagcugcgcgcgcggaccgggccacucggucgcggcuuucgggggaggaggaggaggagguuuuuuuuuuacccucggcggggaggggguaggcaggaaacggccaaggcgaagccagggcccccucccuggccgagcgagggaccgccgagacccuggcggccggacggcggcgugggggaggggcacgugggggaggggcggccgcgcgagcgccccucgggcucuggccccggugggguuggaccgagggagagugggguuuccccgcacggagcagccgacgggccugcccccuccgcucaggacuuggacaggcagaguggggacgguguccaucggaccccccuccacccgcggagacuuaggugcccgccaacugaggggcaugcgguggcacgcgagggaggggucuugugaauguuugugggcugcugaugaguaggggcaggugguggccacaguccacgcagaccacuuccuggaauaaggcaggagcucguccccucgcucccccagccugugcagggacagcaguccauucggauuggggagcggagagaagagugucuggggaaccagauacccccggcuccacccccuucaucucgccggggcucugggcucuuuugugucaagugcgguggggggggucccccucuugaccccgucagucugggguggccaagcugcccagcugugacucucacguggcugccauucacugucacucacucucucgcugaaaccacccacucccugagcacguuggggggcgugaacugcccacccagcuguucugcagcuugaccaucacucagcacccgucccccgaggugacaagucacccggcggcacucucugggcggcgcucuccagaccgcugcgccgcgucaggcgcccagcggugucccccucagaccacccuccua

SEQ ID NO: 21105 - RNA, 345 nt, Homo sapiens
cagccgggggggcuguggcggucgcggccccggucguggcccggcccgcgcccgaguacucccucgucgucguccuccucaucguccucgucggccgccuccaccuccuccuccuccuccucgucgcccucuucuuccuccucuucuuccuccuccgacaccaccaucuccuccuccuccuccuccucgucccucagaggggaagccauccuguggcucuggcccccccaccacccccccacccaccgcccgcccgccucccccaccgcuaccaccaccaccuccuccuccuccuccuccuccuccuccuccuccuccucggcggcggcguccuccuccuccuca

SEQ ID NO: 21106 - RNA, 345 nt, Homo sapiens
ugaggaggaggaggacgccgccgccgaggaggaggaggaggaggaggaggaggaggaggaggaggugguggugguagcggugggggaggcgggcgggcgguggguggggggguggugggggggccagagccacaggauggcuuccccucugagggacgaggaggaggaggaggaggagaugguggugucggaggaggaagaagaggaggaagaagagggcgacgaggaggaggaggaggagguggaggcggccgacgaggacgaugaggaggacgacgacgagggaguacucgggcgcgggccgggccacgaccggggccgcgaccgccacagcccccccggcug

SEQ ID NO: 21107 - RNA, 1029 nt, Homo sapiens
gggcaugaaggauuucugcauaaaacaaaaauggcugcugugacuaacuccccccuuauaaaaaauauuugagggggggcauuaaucaguacucaugcucagucugacaucagcauaaauuguuaaagguuaacuaguuagauacuaguccaacuagauuuaauuuuuuuuauuuucuuuacuagucucuuccuccccaccucccuucucuaaagaaaagcuuuuuuuuuuuugaauacuucagaagggagugguuugaugugaagguuuuuuuccccuucaggcauugaaaaggaaaaagaugaaauauauguuuauauauaacucuguuucuacauaccucauugaagucacaacgcauuuaauuguguacauaucuuuuaaaugagaagcgggacuggauuuuuuucugcuuucuuuaaaaaaagugauagaaauccuagugacuuuugggggagagauaugaauagauacgaugauugaguuuuuuucaaaggaguccauguuugauucuccccuuuacccagccuuuucagugauuuauaauuguuauaaauuuuaucuuuacucuuuuccccuuucccucgcuuuccccuccuccaauuguuagaauguaaaauucaacugacuugagaaauuaauuugggggguaaacaacaaauuuuuaggauaaagaggaaagagucaaaucugaagaucgugaaauuauguucucuuuucuuccguuucaguauauuugccuucccuccaugaucuccaacacuauccgauaaaguagaagcaacugagguaccgugaaagagaaaggagcuggaacugagaaaaagcagagguagggguuauacccaggcguuuucaucuaacuuucugaccugugauuuccaacuguaccccaguguuuaugguaaagugguaccaggaauuggacaguuggaaaggagucccaaaguagcuuucucauacagagauuugcccagagaggucuagacagaaaaugauccuugccaaauggagcaaaggaaggagggc

SEQ ID NO: 21108 - RNA, 1029 nt, Homo sapiens
gcccuccuuccuuugcuccauuuggcaaggaucauuuucugucuagaccucucugggcaaaucucuguaugagaaagcuacuuugggacuccuuuccaacuguccaauuccugguaccacuuuaccauaaacacugggguacaguuggaaaucacaggucagaaaguuagaugaaaacgccuggguauaaccccuaccucugcuuuuucucaguuccagcuccuuucucuuucacgguaccucaguugcuucuacuuuaucggauaguguuggagaucauggagggaaggcaaauauacugaaacggaagaaaagagaacauaauuucacgaucuucagauuugacucuuuccucuuuauccuaaaaauuuguuguuuaccccccaaauuaauuucucaagucaguugaauuuuacauucuaacaauuggaggaggggaaagcgagggaaaggggaaaagaguaaagauaaaauuuauaacaauuauaaaucacugaaaaggcuggguaaaggggagaaucaaacauggacuccuuugaaaaaaacucaaucaucguaucuauucauaucucucccccaaaagucacuaggauuucuaucacuuuuuuuaaagaaagcagaaaaaaauccagucccgcuucucauuuaaaagauauguacacaauuaaaugcguugugacuucaaugagguauguagaaacagaguuauauauaaacauauauuucaucuuuuuccuuuucaaugccugaaggggaaaaaaaccuucacaucaaaccacucccuucugaaguauucaaaaaaaaaaaagcuuuucuuuagagaagggagguggggaggaagagacuaguaaagaaaauaaaaaaaauuaaaucuaguuggacuaguaucuaacuaguuaaccuuuaacaauuuaugcugaugucagacugagcaugaguacugauuaaugcccccccucaaauauuuuuuauaaggggggaguuagucacagcagccauuuuuguuuuaugcagaaauccuucaugccc

SEQ ID NO: 21109 - RNA, 307 nt, Homo sapiens
uuuauuuaaucacccgggagugggguggucucaaucuaaacguucccuccucccucaaaggcacugagccuguuucacagauccuacguagguggaacaggacgcguuguguuguuggggggagagaggagaaaggcgaaggagaaggaggaaaaaaaaaaagguugauagguuugugcgcgggucccucgugcgggcugcgcuccuccugggugcuauuugacaauuccugccucugccauuggucaguguuggaucagaugguuguauuuccuucuggcccucacuggcaccucgccaucccccc

SEQ ID NO: 21110 - RNA, 307 nt, Homo sapiens
ggggggauggcgaggugccagugagggccagaaggaaauacaaccaucugauccaacacugaccaauggcagaggcaggaauugucaaauagcacccaggaggagcgcagcccgcacgagggacccgcgcacaaaccuaucaaccuuuuuuuuuuuccuccuucuccuucgccuuucuccucucuccccccaacaacacaacgcguccuguuccaccuacguaggaucugugaaacaggcucagugccuuugagggaggagggaacguuuagauugagaccaccccacucccgggugauuaaauaaa

SEQ ID NO: 21111 - RNA, 1629 nt, Homo sapiens
aguuccugccauguguuauuuugugugguccccccaccaacccuaagaacuaggugugcuauauuuuccccauuuuacagaugaguaaacuaaggcucacugaggucauauaacuuaucuugcagcugguagaugggauuuagaacgggcagccuaauuugaaaacuccucaggagccugccaaacagagaaacgagucccaggcagagggacuagcguggacaaaguccugagaggaggaagggcaugggugagcagcgggagaaugggguguuugguggggaagaggcaggagaugaagugagaaagcagagcccgagcugggcuugccucugccccaggcuucagggguccagggggaggcuggaaagggugcuacucugugucuguguuuguggagagacgugugucccagaagcugugagguauucuggagcaguuggcugcagcuuggaucuacccccgagccacaggcuugucaggccuguaagcgggagaguaacaugaucagauuuguuuuuuaggaagauuacccuggcagccgcugugaggcuagaucagaagggcugaggcugguggccgggagacagcugcaagaagggggauggaggggugaggcuggaugcuagaaccauuucuagggagacuugccuaaucgugggaguggcugagaaguaggaguugggggugacauuuaggaucuaggcucuagacacuggguaaauggagcuugaauaccuggggggugccaugaacaagggguacagcuggcuucuguagggggaacacauguccugauuugccccagacagucccaguuuauaccuguugcccugguguaauuauuauuaguuccccuguuucauuuuugaaaguguccagguuuggaucauaaguuacguggucaccgugguuucaggguuugaugauagcuuaggacaagguagcgagcuuggcuugguuugcaggagacaccauguggagacauuuagauuugguggaugucagacuccugggcaggguguaguggcagcuccaggcuuauaaggcuggggccguaaucccagguuguccacaaggauggaucaggcgggccacgaaagagggggccuugcaggguauggggcucugcagguaggagcuguguccaacacuggggagcugcccacuggucagauaaggccugaaauuagcccuuggguuuggcaguugggagguagcuggugaccuuagagggagcagcuauaaccccggggaggguggagccaucaggcugggucuguagugaaggggaugggggaggcaggcccuggcugggaggagacgcagcauguggguuguuuggguuguguugauguuuaacuuccccccuuucuucaaguuaagggcagcauauccuuugggacaggagcaaccacuguguuugguggaggggaggggccaggauaaaggagaagagggugauagcugagccaagugucuggagggaggauuggauauggagugcaggggagcacuggcuccccacgaggguccccugcacgcccucugcuccagggaaggagguagaaacgggccguggcucagucagccaagagggcaccauggagagaaugaaagacccgggcc

SEQ ID NO: 21112 - RNA, 1629 nt, Homo sapiens
ggcccgggucuuucauucucuccauggugcccucuuggcugacugagccacggcccguuucuaccuccuucccuggagcagagggcgugcaggggacccucguggggagccagugcuccccugcacuccauauccaauccucccuccagacacuuggcucagcuaucacccucuucuccuuuauccuggccccuccccuccaccaaacacagugguugcuccugucccaaaggauaugcugcccuuaacuugaagaaaggggggaaguuaaacaucaacacaacccaaacaacccacaugcugcgucuccucccagccagggccugccucccccauccccuucacuacagacccagccugauggcuccacccuccccgggguuauagcugcucccucuaaggucaccagcuaccucccaacugccaaacccaagggcuaauuucaggccuuaucugaccagugggcagcuccccaguguuggacacagcuccuaccugcagagccccauacccugcaaggcccccucuuucguggcccgccugauccauccuuguggacaaccugggauuacggccccagccuuauaagccuggagcugccacuacacccugcccaggagucugacauccaccaaaucuaaaugucuccacauggugucuccugcaaaccaagccaagcucgcuaccuuguccuaagcuaucaucaaacccugaaaccacggugaccacguaacuuaugauccaaaccuggacacuuucaaaaaugaaacaggggaacuaauaauaauuacaccagggcaacagguauaaacugggacugucuggggcaaaucaggacauguguucccccuacagaagccagcuguaccccuuguucauggcaccccccagguauucaagcuccauuuacccagugucuagagccuagauccuaaaugucacccccaacuccuacuucucagccacucccacgauuaggcaagucucccuagaaaugguucuagcauccagccucaccccuccaucccccuucuugcagcugucucccggccaccagccucagcccuucugaucuagccucacagcggcugccaggguaaucuuccuaaaaaacaaaucugaucauguuacucucccgcuuacaggccugacaagccuguggcucggggguagauccaagcugcagccaacugcuccagaauaccucacagcuucugggacacacgucucuccacaaacacagacacagaguagcacccuuuccagccucccccuggaccccugaagccuggggcagaggcaagcccagcucgggcucugcuuucucacuucaucuccugccucuuccccaccaaacaccccauucucccgcugcucacccaugcccuuccuccucucaggacuuuguccacgcuagucccucugccugggacucguuucucuguuuggcaggcuccugaggaguuuucaaauuaggcugcccguucuaaaucccaucuaccagcugcaagauaaguuauaugaccucagugagccuuaguuuacucaucuguaaaauggggaaaauauagcacaccuaguucuuaggguugguggggggaccacacaaaauaacacauggcaggaacu

SEQ ID NO: 21113 - RNA, 315 nt, Homo sapiens
cucuaggauuuucaggcuggggaacacccuucugcugagcagagcaucauagaggacaugagguccucuuagugacagacggggcacauggggcugacccccaggaucaggauccucuaaccuucuggaagcguucccuaagcccgugagaagaggguuugcaauuucucucaaaucucucccgcagaagacaucccggcacagcagcgggggaggcggaggaggcgcuggaggaggagguggcagcauggggggagguggcagugguuucaucucugggaggagaagccggucagccucaccauccacgcagca

SEQ ID NO: 21114 - RNA, 315 nt, Homo sapiens
ugcugcguggauggugaggcugaccggcuucuccucccagagaugaaaccacugccaccuccccccaugcugccaccuccuccuccagcgccuccuccgccucccccgcugcugugccgggaugucuucugcgggagagauuugagagaaauugcaaacccucuucucacgggcuuagggaacgcuuccagaagguuagaggauccugauccugggggucagccccaugugccccgucugucacuaagaggaccucauguccucuaugaugcucugcucagcagaaggguguuccccagccugaaaauccuagag

SEQ ID NO: 21115 - RNA, 34 nt, Homo sapiens
guuggacacugagacugguuuccugcuaaacagu

SEQ ID NO: 21116 - RNA, 34 nt, Homo sapiens
acuguuuagcaggaaaccagucucaguguccaac

SEQ ID NO: 21117 - RNA, 672 nt, Homo sapiens
uccaauggaacugauccgugcccaggccaaccgaauggcugaagauccagcagccuugaagccacccaagauggacuucccagugacggaagggaggaaacagccaccacgggcacauaaucucaaaccccgugacuugaaugugcucacacccacuggcuucuagagcccuuucuuuccagggauucugguaaagaagguuucuugcacuccacugcccuuuuaucuuggcuuugacauaggaaagguauauuuaaaaacuuaaucagcugggcacaguggcucacgccuguaaucccaacacuuugggaggccaaguuagguggaucaccugaggucaggaguuaaagaccagccuggccaacacaaugaaacccugucucuacuaaaaauacaaaaauuagccgggcaugguggugggugccuauagucccagcuacuugggaggcugaggcaggagaauugccugaacccaagaggcagagguugcagugagccgagaucacgccauuacacuccagccugggcgacagagugagacuccgucucuaaauaaauaaauaaauaaaguaaaaaaccuguuaaauugaggcuagagcuggagauacaauugguuuuugagaaauauugauacaaagcuugccccuguuguguggaagaagccauuuugua

SEQ ID NO: 21118 - RNA, 672 nt, Homo sapiens
uacaaaauggcuucuuccacacaacaggggcaagcuuuguaucaauauuucucaaaaaccaauuguaucuccagcucuagccucaauuuaacagguuuuuuacuuuauuuauuuauuuauuuagagacggagucucacucugucgcccaggcuggaguguaauggcgugaucucggcucacugcaaccucugccucuuggguucaggcaauucuccugccucagccucccaaguagcugggacuauaggcacccaccaccaugcccggcuaauuuuuguauuuuuaguagagacaggguuucauuguguuggccaggcuggucuuuaacuccugaccucaggugauccaccuaacuuggccucccaaaguguugggauuacaggcgugagccacugugcccagcugauuaaguuuuuaaauauaccuuuccuaugucaaagccaagauaaaagggcaguggagugcaagaaaccuucuuuaccagaaucccuggaaagaaagggcucuagaagccagugggugugagcacauucaagucacgggguuugagauuaugugcccgugguggcuguuuccucccuuccgucacugggaaguccaucuuggguggcuucaaggcugcuggaucuucagccauucgguuggccugggcacggaucaguuccauugga

SEQ ID NO: 21119 - RNA, 24 nt, Homo sapiens
aauacuuuucuauuuaaaguguuu

SEQ ID NO: 21120 - RNA, 24 nt, Homo sapiens
aaacacuuuaaauagaaaaguauu

SEQ ID NO: 21121 - RNA, 642 nt, Homo sapiens
uugaguaguuugugaauuacuuguuuauaaacuuugccaguauuuccauugcaguauaauuuugaaucuaauaugcuauggcuuuauggucagauuauuuacuaaguuuguguuucuuuuuuuuuucuaaacuuuuauauuuuaauuucuaguuuuagaagauauaggacuguaccugacaaaccuuaaugauagcuuauccagcacucugcaugaugccguugaaaugguaaguaacgauugacuccaacacugaauucugacaggaagaauaucuguaugaauugguugccacugaucagguuuuuucucaauuuuuugaguuauagacacaaaauuuaguaaaauaaccaugaaauaauuuagaguuucuugcacauuucauuauguaaucuuauaauuaugagaaugaaaaaaaguuauuauuaacccucguggcucuaguaguaaaaaaauauacauuuaauguaauuagguaaugaaaucuagcugauugcaaauuguuaccucuguauguugucuuuacaauauuuaagcaggaucuuaccuguuuaaaccaacucucuuguaauacauuuguuauuuuucccuaaccaugauuauaauucuuugugcuaauaaauauuuaaacuuaauggcuua

SEQ ID NO: 21122 - RNA, 642 nt, Homo sapiens
uaagccauuaaguuuaaauauuuauuagcacaaagaauuauaaucaugguuagggaaaaauaacaaauguauuacaagagaguugguuuaaacagguaagauccugcuuaaauauuguaaagacaacauacagagguaacaauuugcaaucagcuagauuucauuaccuaauuacauuaaauguauauuuuuuuacuacuagagccacgaggguuaauaauaacuuuuuuucauucucauaauuauaagauuacauaaugaaaugugcaagaaacucuaaauuauuucaugguuauuuuacuaaauuuugugucuauaacucaaaaaauugagaaaaaaccugaucaguggcaaccaauucauacagauauucuuccugucagaauucaguguuggagucaaucguuacuuaccauuucaacggcaucaugcagagugcuggauaagcuaucauuaagguuugucagguacaguccuauaucuucuaaaacuagaaauuaaaauauaaaaguuuagaaaaaaaaaagaaacacaaacuuaguaaauaaucugaccauaaagccauagcauauuagauucaaaauuauacugcaauggaaauacuggcaaaguuuauaaacaaguaauucacaaacuacucaa

SEQ ID NO: 21123 - RNA, 2214 nt, Homo sapiens
ugugauuacaggagccuaccuaccucgauaacucuauuuugcauuuucuggcaauaggccaguggucuguuggaucccaaggcaagcaccccuuuugacacauagaggacacugaccgguucucuuucagcuuugcuuugaacacuuccuccaggcuuuuauggggauccauggcuuuugcacgcaaggucacagauuuggacauugcuugagacuucuuuuuguguaucuccagccacugaauacucucaucugcuuuguucuuuuuuucaagugcacuucuaaaggaaggaggcagaaaaagaguauagauuaccaaccuggguauacugaaaagcaaucuuaggccaggugugguggcucacacuuguaguccuagcacuuugggaggccaaggcagguggaucaccugaggucaggaguccaagaccagccuggccaauacggugaaaccccagcucuacuaaaaauacaaaaauuagcugggcaugguggugugcaccuguaaucccaacuacucgggaggcugaggcaagagaaucgcuugaacccgggaggcagagguugcaauaagccaagaucgcacugcugcacuccagccugggcgacagaucaaauuccgucucaaaaauaauaauaauaauaaaauaaaauaaaauagccgggcaugguggcucaugccuguaaucccagcacuuugggaggccgaggcgggcggaucacaaggucaggagaucgagacuauccuggcuaacacugugaaaccccaucucuacuaaaaauacaaaaaauuagccgggugcgguggugggcgccuguagucccagcuacucgggaggcugaggcaggagaauggcaugaaccugggaggcggagcuugcagugagccgagaucgugccacugcacuccagccugggcgacagugagagacuccgucucaaaaaauaauaauaaauaaauaaauaaaauaaagcaaucuuaguaaccuuuucuggaaaguaaguugguguuuuuaaugaauggggcauguaauuuaccucaacugccauuuuuaaaaauaauaaaauucuaggauuaaaugcacuggcagaugaagccuuuccagcacuagggacacagugaguuccuacccuagaagugcauuuacugaacuggagaaacgucaguuaaaauauccuuacuuaggucgggcacgguggcucauggcuguaaucucagcacuuugggaggcugaggcgggcugaucacaaggucaggaguucgagaccagccuggucaacauggugaaacccugucucuaccaaaacuacaaaaaaaauuagcuggguguaguggcacgugccgguaaucccagcuacuugggaggcugaggcaggagaaucacuaaacccgggaggcagagguugcagugagcugagauugcgccauugcacuccagcaugggcgacagagcaagacucugucucgaaaaaaaauauauauauccuuacuuaaacaguccaacauucaauaggucuucgccuaucuggauacaaaauaauacuaauagcuaccauuuacugagcuccuuauuaugaaccaaguaccauuacauuucacauuguccucauaacugccuuaugagguaaauacuaaauucccuuuuuauaggggaggugauugaggcucaaaggagguaagccccuugcucaaagcuacccagcaugccaguggaaaagccccuauuggaccaggaccucugacuccgaagccucuggccuugaccacucugcuggaaacagugggcuggaaggugucuggguucaugguccuuugggaauacaaaucugcacauucagagagaacuggaaaugagccucccucagugcagacuauuuggguucaacuuguagcacuuaguuuguucaguuaucuacaaaguaauauguugaguucuuccaaaaggaaaaucaaccaagacucuuauauuuggauguuuauauucaaauggacauacugggaagaaggacaugaaaauuuaaucuguuaauaugucagauucccuguggcuggaaagcagauguggauguccucuauaggaaggccagccucuuuguucaggaggccuguguucuugggcccucaggauacugagcaauuaauuagcccugauuuaguaggucuaacugaagucugaagaagaaaggaguaucccuuggaccguaaauacucuu

SEQ ID NO: 21124 - RNA, 2214 nt, Homo sapiens
aagaguauuuacgguccaagggauacuccuuucuucuucagacuucaguuagaccuacuaaaucagggcuaauuaauugcucaguauccugagggcccaagaacacaggccuccugaacaaagaggcuggccuuccuauagaggacauccacaucugcuuuccagccacagggaaucugacauauuaacagauuaaauuuucauguccuucuucccaguauguccauuugaauauaaacauccaaauauaagagucuugguugauuuuccuuuuggaagaacucaacauauuacuuuguagauaacugaacaaacuaagugcuacaaguugaacccaaauagucugcacugagggaggcucauuuccaguucucucugaaugugcagauuuguauucccaaaggaccaugaacccagacaccuuccagcccacuguuuccagcagaguggucaaggccagaggcuucggagucagagguccugguccaauaggggcuuuuccacuggcaugcuggguagcuuugagcaaggggcuuaccuccuuugagccucaaucaccuccccuauaaaaagggaauuuaguauuuaccucauaaggcaguuaugaggacaaugugaaauguaaugguacuugguucauaauaaggagcucaguaaaugguagcuauuaguauuauuuuguauccagauaggcgaagaccuauugaauguuggacuguuuaaguaaggauauauauauuuuuuuucgagacagagucuugcucugucgcccaugcuggagugcaauggcgcaaucucagcucacugcaaccucugccucccggguuuagugauucuccugccucagccucccaaguagcugggauuaccggcacgugccacuacacccagcuaauuuuuuuuguaguuuugguagagacaggguuucaccauguugaccaggcuggucucgaacuccugaccuugugaucagcccgccucagccucccaaagugcugagauuacagccaugagccaccgugcccgaccuaaguaaggauauuuuaacugacguuucuccaguucaguaaaugcacuucuaggguaggaacucacugugucccuagugcuggaaaggcuucaucugccagugcauuuaauccuagaauuuuauuauuuuuaaaaauggcaguugagguaaauuacaugccccauucauuaaaaacaccaacuuacuuuccagaaaagguuacuaagauugcuuuauuuuauuuauuuauuuauuauuauuuuuugagacggagucucucacugucgcccaggcuggagugcaguggcacgaucucggcucacugcaagcuccgccucccagguucaugccauucuccugccucagccucccgaguagcugggacuacaggcgcccaccaccgcacccggcuaauuuuuuguauuuuuaguagagaugggguuucacaguguuagccaggauagucucgaucuccugaccuugugauccgcccgccucggccucccaaagugcugggauuacaggcaugagccaccaugcccggcuauuuuauuuuauuuuauuauuauuauuauuuuugagacggaauuugaucugucgcccaggcuggagugcagcagugcgaucuuggcuuauugcaaccucugccucccggguucaagcgauucucuugccucagccucccgaguaguugggauuacaggugcacaccaccaugcccagcuaauuuuuguauuuuuaguagagcugggguuucaccguauuggccaggcuggucuuggacuccugaccucaggugauccaccugccuuggccucccaaagugcuaggacuacaagugugagccaccacaccuggccuaagauugcuuuucaguauacccagguugguaaucuauacucuuuuucugccuccuuccuuuagaagugcacuugaaaaaaagaacaaagcagaugagaguauucaguggcuggagauacacaaaaagaagucucaagcaauguccaaaucugugaccuugcgugcaaaagccauggauccccauaaaagccuggaggaaguguucaaagcaaagcugaaagagaaccggucaguguccucuaugugucaaaaggggugcuugccuugggauccaacagaccacuggccuauugccagaaaaugcaaaauagaguuaucgagguagguaggcuccuguaaucaca

SEQ ID NO: 21125 - RNA, 965 nt, Homo sapiens
caggagucucaucuucugccagcagucacgacacaauaacaagcuaauuuauuaauuucuaaauaaagcaacccugacagucuguuuucuugccugcuuuuugcuuaaagaauuccauuucugacacccaguaucuggauaguacaagcuaaaaccuuuaagaaaauaaaucucuucucacaagaagaguucugccucauaaaauccuuuggucaccauaccugaacacccaaacuguccuugcccuauaggauaaagguacacaguuagguauuuucuccucuguugaugccugaaaauccugcagacauaggaacucaggccuuagaaaauucuguacccaaaaauuugcaauucucuuuggaaaguugaaagcaccuuuaaaagccacaauuugcaagccaggugaugcacuguagcauaaccuggaagacaugagggcugcuuccucagauacuaagaaucccacugccccaccaccagagcaaaacgaucccccucccagagaaugcaccucgccagaggccaacccacccgauaccucaaguuccccuccaccguggcccuccuccuauagaucccgcccccuccguacccucgggccaaucagagggcggcgucccgucgcgguugccauggugcccgccgagucccucccaucacucaccagaugugcggcggcucguccaagcgguggaagcggguggcgaaggacagcagcgucaccaaggccagcagggcccaccagccgaccgccucgaagcgccgugagccccaagcaggccguuuggggcuucgcgccacagccucagcggccacgucccggccugcggcccuagcagccugggggccacagcggccccuccggggacgcagcucggacucugccaggccuccgcccguggccggcggcaucuucccccuccucugggucgcccuccggcccggaggcacacuuugucuga

SEQ ID NO: 21126 - RNA, 965 nt, Homo sapiens
ucagacaaagugugccuccgggccggagggcgacccagaggagggggaagaugccgccggccacgggcggaggccuggcagaguccgagcugcguccccggaggggccgcuguggcccccaggcugcuagggccgcaggccgggacguggccgcugaggcuguggcgcgaagccccaaacggccugcuuggggcucacggcgcuucgaggcggucggcuggugggcccugcuggccuuggugacgcugcuguccuucgccacccgcuuccaccgcuuggacgagccgccgcacaucuggugagugaugggagggacucggcgggcaccauggcaaccgcgacgggacgccgcccucugauuggcccgaggguacggagggggcgggaucuauaggaggagggccacgguggaggggaacuugagguaucggguggguuggccucuggcgaggugcauucucugggagggggaucguuuugcucuggugguggggcagugggauucuuaguaucugaggaagcagcccucaugucuuccagguuaugcuacagugcaucaccuggcuugcaaauuguggcuuuuaaaggugcuuucaacuuuccaaagagaauugcaaauuuuuggguacagaauuuucuaaggccugaguuccuaugucugcaggauuuucaggcaucaacagaggagaaaauaccuaacuguguaccuuuauccuauagggcaaggacaguuuggguguucagguauggugaccaaaggauuuuaugaggcagaacucuucuugugagaagagauuuauuuucuuaaagguuuuagcuuguacuauccagauacugggugucagaaauggaauucuuuaagcaaaaagcaggcaagaaaacagacugucaggguugcuuuauuuagaaauuaauaaauuagcuuguuauugugucgugacugcuggcagaagaugagacuccug

SEQ ID NO: 21127 - RNA, 230 nt, Homo sapiens
gccuccuguaacagggagcucccucucuccccaggcagccugcucagggcucgcacgcagagcugcuuugcugagcccuccccugccuuuugcaucugccuccucggcugugcagcagcccccuugcccccucugcccuccgaucucugcaggcugugggcucccucucuuuucaguccucuccuuucugugcugaauggcaauacccccaccaauggugggaacaggau

SEQ ID NO: 21128 - RNA, 230 nt, Homo sapiens
auccuguucccaccauugguggggguauugccauucagcacagaaaggagaggacugaaaagagagggagcccacagccugcagagaucggagggcagagggggcaagggggcugcugcacagccgaggaggcagaugcaaaaggcaggggagggcucagcaaagcagcucugcgugcgagcccugagcaggcugccuggggagagagggagcucccuguuacaggaggc

SEQ ID NO: 21129 - RNA, 219 nt, Homo sapiens
ccagugacugucuccuauauucuuuauauuauacauauucaugcuugagcaaguaacaaaagaacuagacagucuagucauagacuagacuuugaacuucuggaggauuauugcaauugaaaacuuuauaaacaucuuucaaaguuuuugagguaguauugaauuuuuuguaagugaauauuuaugaauauaauauaggcccuuaugguauaauuggca

SEQ ID NO: 21130 - RNA, 219 nt, Homo sapiens
ugccaauuauaccauaagggccuauauuauauucauaaauauucacuuacaaaaaauucaauacuaccucaaaaacuuugaaagauguuuauaaaguuuucaauugcaauaauccuccagaaguucaaagucuagucuaugacuagacugucuaguucuuuuguuacuugcucaagcaugaauauguauaauauaaagaauauaggagacagucacugg

SEQ ID NO: 21131 - RNA, 633 nt, Homo sapiens
ucucaaagacccacaagcccacaccacgcaggccgggacaggaaagagucacccuuuaaaacggccgagugaagagcaagaaccacgcagcgguuccgagccucuguuuuccgcuuuuagcuaggaggacggaaguugcuggcaggcggcauuuggccgguacaccgccggaaguguggagguguggcugcccgaggcgguagagcggagaaagccuauuuucuuuucguuuagauacauugccuuuugccuaggcuggcgucgagacuugaggccguugcagacuuuggcgcggcucgcgccuccugcuucaagagcccagcggugagagcuggccugcggcacgcggccuaaugccaggugaguacugcuccgagcugugagacaucgcgcgccugugacccugucacagcgcuggguaccgcugaccuuucaggcugcgacggacacagccagccacggaagaggacaacagggccuccggacuccccucgguguucgcucaguauggaaguuuuucucuaucauucggcgaagucgacucaucuuuguuccggucacucuguguaaugugugcaugauugugaaggauacugaggaaugaaaacuuaguguacagaaaaauggaacuac

SEQ ID NO: 21132 - RNA, 633 nt, Homo sapiens
guaguuccauuuuucuguacacuaaguuuucauuccucaguauccuucacaaucaugcacacauuacacagagugaccggaacaaagaugagucgacuucgccgaaugauagagaaaaacuuccauacugagcgaacaccgaggggaguccggaggcccuguuguccucuuccguggcuggcuguguccgucgcagccugaaaggucagcgguacccagcgcugugacagggucacaggcgcgcgaugucucacagcucggagcaguacucaccuggcauuaggccgcgugccgcaggccagcucucaccgcugggcucuugaagcaggaggcgcgagccgcgccaaagucugcaacggccucaagucucgacgccagccuaggcaaaaggcaauguaucuaaacgaaaagaaaauaggcuuucuccgcucuaccgccucgggcagccacaccuccacacuuccggcgguguaccggccaaaugccgccugccagcaacuuccguccuccuagcuaaaagcggaaaacagaggcucggaaccgcugcgugguucuugcucuucacucggccguuuuaaagggugacucuuuccugucccggccugcguggugugggcuugugggucuuugaga

SEQ ID NO: 21133 - RNA, 1506 nt, Homo sapiens
aagauugcuuuaaucaaggaccauugaaaccaguuaagucccacugaauaacagauucaggcuaagcaccuucucuucucaaagcaucaagcaaugggucuucuuggugugguuaucuggggaguuuguccuuaagugucguggacccuccgcuuccugccucaugaaccuaccagaacuggauuaacucccaggagugugguaugcugaaugcugauuccaugcauucuucucagcauugaacuacccuaauuucuuaggugauugcuuuugcauuauuuauacuugguuuuauagccauuuuuuaauacuuggacuguguuugagacccaauuuucuguaguuuuauuugaauccgaaauuacaaaguuaauuuaaguauuccaaaccccuaaccuaagaaagccaaacuugauaucucuucgacaugaguuuaaauuuauacuucuuaaaaagcuuuuugauuaaaaacaaagcuuugaaaaaaguuuaaauauuguucaccuaagaguauguuggaaauguuaccugcaaaguaguuaugacgauauuguugagaaaauucacccucaaguaauuuuuaaauuguuuuuuuuuuuuuuuuaagagacaaggucucacuauguugcccaggcuggucuugaacuccugggcucaagcagucugccaaccucggccucccaaacccaaagugcuaggauuacagguguaagccaccaugcccauccccaaguaauuuuuaaaguuucucuggaaauugguuuuaauauugaaacuaagguaaucugaaaaauaaugcaguuucuaaauugaccccaagcccucaauauauuggccuguccuucaaaauguaauaugccuucuaaaaauaaagucugcauuuccauguucauuugccuuuuuaauaagauuaugccagagaacaagaauuaacuuuaugggggcuuacauuuagucauuaguguuaauucguuacuucaaacaaaacacuccuaauggaaguacugcuacccuuguuaagcuucuucuaauggggaaucuccuucucucugcuuguaagugcuucauguauuuauugagucaucuguguugugcuuauaguucaccaggcacugagaaggacacaaauaggauuauauuuuacucuaccuaaaggagcuugugauuucauaagggaauuaaauauagccaaaguauuagauaaaaugggugaaugccaugaaaguaguaggaagcagggaauuggggaggauucuuggaaagauuuauauuugagcugagaugauuuuggaggacgugagcauggugggggacauuccagacacagauaagaguccuuuuaacuguaguaccagaugaaggcaggggaguuguguguugaaaaaguaaaaugguuucagacuguagagaaaacuuuaaaaacuacauuaaagaguuugaacuuuguucugagaaugguggagcauaauuuaaagguuucgaagagagaaguaucaaaguacagaa

SEQ ID NO: 21134 - RNA, 1506 nt, Homo sapiens
uucuguacuuugauacuucucucuucgaaaccuuuaaauuaugcuccaccauucucagaacaaaguucaaacucuuuaauguaguuuuuaaaguuuucucuacagucugaaaccauuuuacuuuuucaacacacaacuccccugccuucaucugguacuacaguuaaaaggacucuuaucugugucuggaaugucccccaccaugcucacguccuccaaaaucaucucagcucaaauauaaaucuuuccaagaauccuccccaauucccugcuuccuacuacuuucauggcauucacccauuuuaucuaauacuuuggcuauauuuaauucccuuaugaaaucacaagcuccuuuagguagaguaaaauauaauccuauuuguguccuucucagugccuggugaacuauaagcacaacacagaugacucaauaaauacaugaagcacuuacaagcagagagaaggagauuccccauuagaagaagcuuaacaaggguagcaguacuuccauuaggaguguuuuguuugaaguaacgaauuaacacuaaugacuaaauguaagcccccauaaaguuaauucuuguucucuggcauaaucuuauuaaaaaggcaaaugaacauggaaaugcagacuuuauuuuuagaaggcauauuacauuuugaaggacaggccaauauauugagggcuuggggucaauuuagaaacugcauuauuuuucagauuaccuuaguuucaauauuaaaaccaauuuccagagaaacuuuaaaaauuacuuggggaugggcaugguggcuuacaccuguaauccuagcacuuuggguuugggaggccgagguuggcagacugcuugagcccaggaguucaagaccagccugggcaacauagugagaccuugucucuuaaaaaaaaaaaaaaaacaauuuaaaaauuacuugagggugaauuuucucaacaauaucgucauaacuacuuugcagguaacauuuccaacauacucuuaggugaacaauauuuaaacuuuuuucaaagcuuuguuuuuaaucaaaaagcuuuuuaagaaguauaaauuuaaacucaugucgaagagauaucaaguuuggcuuucuuagguuagggguuuggaauacuuaaauuaacuuuguaauuucggauucaaauaaaacuacagaaaauugggucucaaacacaguccaaguauuaaaaaauggcuauaaaaccaaguauaaauaaugcaaaagcaaucaccuaagaaauuaggguaguucaaugcugagaagaaugcauggaaucagcauucagcauaccacacuccugggaguuaauccaguucugguagguucaugaggcaggaagcggaggguccacgacacuuaaggacaaacuccccagauaaccacaccaagaagacccauugcuugaugcuuugagaagagaaggugcuuagccugaaucuguuauucagugggacuuaacugguuucaaugguccuugauuaaagcaaucuu

SEQ ID NO: 21135 - RNA, 1753 nt, Homo sapiens
ucuacuuuaaauuuacuaaauauaauuuaaaauucugugaaaagaaugccacaauggugguuuggaaauacacaaaaacuuuaauguuaauuuacagccaaauucuuugcaauaaaucaugacagguaauauuuuuaucaaaaauauuuacugaaaacuguguguucauacauauuggacuuuuguccccaucaaauauaaggaguccacacaggaaaagaacacuaucauaaaaugcuugaacguuagaaugcugguaaaagauggaaacaaauuaaaaagcacagaaaaauaucuguaauuaacauaugcauuugcuauauacugagguaccacagcaugccacagacaguaauccuaauucuuggacuacuuaaaaacuaucucagcuggacgcgguggcucacgccuguaaucccagcacuuugggaggccgaggcgggcggaucacgaggucaggaguuugagaccagccuggccaacauagugaaacccugucucuacuaaaaauacaaaaauuagccuggcgugguggcgcacgccuguagccccaacuacucgggaggcugaggcaggagaauugcuugaaccuagaagguggagguugcagcaagccaagaucgugccaugcacaccagccucggcaauagugcgagacucucugucucaaaaaaaaaaaaaacuaucuguaacacaucaacauaugaugucacaaaauuuucuucuucauuggcugccaaaacaaaugauaccaaauuauauuaagugugaaguuauccuugaugcagaaguguacauuacugaauauaaucaaaauaauguuuaugauacauuaccacugcuccauuaucuggcaucauuggaguucccauauuugcggcuccuucuggucccauggcaggaccaggacccauuggugggccagguauaguugcucuguuguucauauucauacccaucauuggaggaggaccuugguuaccagcaggggcugggcuaaacgcaucuauguaaaacaaucuauacuuagagcuguccuaucuuaguuuaguaaacauuaacaauuuaacaauauuuaugcaaucuauauaccaagaccauuaucaaaauuauuuucgcuccuuaagaaugcgauaugcguuaucuacucuguaauaggguauuaccuacacucuagaauuagaauuuucauccccaagccaaacguacauaaaaucaaggaggaaacuaucaaucauuuuagggcauuugagacuaacaguuugcaagcuuugagacaucacuauuauuuuguaauagcaggcuuuuaaaccaaagaaucccuaacaauggggacuacauuuuaccaguuuaaaugaguaacaaaggauuagcacuuacaaaaccacuuaauuuuuuucaacccauggcuaaaaauauuagcaguaaauuaugcuaaguugugagagaggaaaucauuuccugcaauauauaaauaaagaucauuauaacuagccucucaucuuaguuuuuuuuuuuuccucccugaguuuauggaauaccuugcuaaauuacauaagguacucuuuuuuuaacuuuuuauuuugaaauauggacucuaaaccaaaaaauugaaaugacuuauaagaaaacuuauuuuuaaaagcaaccgcaaccaaauacagauaaaauauuaauauagcuaucuggaucuuucugacaagcuuaaauuccauaaauggggacaaccugauaauauuucaaguuuuuucau

SEQ ID NO: 21136 - RNA, 1753 nt, Homo sapiens
augaaaaaacuugaaauauuaucagguuguccccauuuauggaauuuaagcuugucagaaagauccagauagcuauauuaauauuuuaucuguauuugguugcgguugcuuuuaaaaauaaguuuucuuauaagucauuucaauuuuuugguuuagaguccauauuucaaaauaaaaaguuaaaaaaagaguaccuuauguaauuuagcaagguauuccauaaacucagggaggaaaaaaaaaaaacuaagaugagaggcuaguuauaaugaucuuuauuuauauauugcaggaaaugauuuccucucucacaacuuagcauaauuuacugcuaauauuuuuagccauggguugaaaaaaauuaagugguuuuguaagugcuaauccuuuguuacucauuuaaacugguaaaauguaguccccauuguuagggauucuuugguuuaaaagccugcuauuacaaaauaauagugaugucucaaagcuugcaaacuguuagucucaaaugcccuaaaaugauugauaguuuccuccuugauuuuauguacguuuggcuuggggaugaaaauucuaauucuagaguguagguaauacccuauuacagaguagauaacgcauaucgcauucuuaaggagcgaaaauaauuuugauaauggucuugguauauagauugcauaaauauuguuaaauuguuaauguuuacuaaacuaagauaggacagcucuaaguauagauuguuuuacauagaugcguuuagcccagccccugcugguaaccaagguccuccuccaaugauggguaugaauaugaacaacagagcaacuauaccuggcccaccaauggguccugguccugccaugggaccagaaggagccgcaaauaugggaacuccaaugaugccagauaauggagcagugguaauguaucauaaacauuauuuugauuauauucaguaauguacacuucugcaucaaggauaacuucacacuuaauauaauuugguaucauuuguuuuggcagccaaugaagaagaaaauuuugugacaucauauguugauguguuacagauaguuuuuuuuuuuuuugagacagagagucucgcacuauugccgaggcuggugugcauggcacgaucuuggcuugcugcaaccuccaccuucuagguucaagcaauucuccugccucagccucccgaguaguuggggcuacaggcgugcgccaccacgccaggcuaauuuuuguauuuuuaguagagacaggguuucacuauguuggccaggcuggucucaaacuccugaccucgugauccgcccgccucggccucccaaagugcugggauuacaggcgugagccaccgcguccagcugagauaguuuuuaaguaguccaagaauuaggauuacugucuguggcaugcugugguaccucaguauauagcaaaugcauauguuaauuacagauauuuuucugugcuuuuuaauuuguuuccaucuuuuaccagcauucuaacguucaagcauuuuaugauaguguucuuuuccuguguggacuccuuauauuugauggggacaaaaguccaauauguaugaacacacaguuuucaguaaauauuuuugauaaaaauauuaccugucaugauuuauugcaaagaauuuggcuguaaauuaacauuaaaguuuuuguguauuuccaaaccaccauuguggcauucuuuucacagaauuuuaaauuauauuuaguaaauuuaaaguaga

SEQ ID NO: 21137 - RNA, 252 nt, Homo sapiens
cccccauacauguaauuuguccaagcccugccauagccaccaccucccuggauccucaaagcaacccuauuaugcaagacaugcugauccaggugcaucugacgauucagaaaaccaggaccaagccguggggcaccgagccugagcuaauaagcagcagagucgacccuggcacgaaggucucccagcuccaugaagaugcaucaucaagaagguugggccucaaauucuuuccauuacacuucauguuuc

SEQ ID NO: 21138 - RNA, 252 nt, Homo sapiens
gaaacaugaaguguaauggaaagaauuugaggcccaaccuucuugaugaugcaucuucauggagcugggagaccuucgugccagggucgacucugcugcuuauuagcucaggcucggugccccacggcuugguccugguuuucugaaucgucagaugcaccuggaucagcaugucuugcauaauaggguugcuuugaggauccagggaggugguggcuauggcagggcuuggacaaauuacauguauggggg

SEQ ID NO: 21139 - RNA, 2526 nt, Homo sapiens
gucaaaugagugcugcaaagggaauaaucaaaguaucaauuacagacacauccauauuacagugugugcaugcguucacacguguguacucgccauaaggagggagcaacccacaugccacauggaugaacaaaugacaagccguggauguaccgcagugacauucaggagccacgucccuucaggaagccaccucaccuuccucccagcccuccugccuccauggggaggcucaguaggaagagccgggacaagcccaaggcacugggggaaugacugcuggguccacuguggugcugggaccaugugauuucuccauguugugacccucuguacuuggagagcaggcuuucucgcaagaggaccaaugagagagcugcuguucccacccucuucugaagaacagcccagacagagggagcugucccauccacaaccacaggccaugccugggcucucggcuuccucuuucugccacccucccccaccaugaccagaucugaccacagggacucagggagcuggggcugcagagggagccacugcugagcaagcgacagcuuccaucagggugaacacaguccacgucggauaccuaaacccuccucccuccuugugacacuaagucucuuggcaucacucagaggaagcaggauaucaaguaucgucaguguauucagucauucauucauucacucacucauucauucacccaugggcauuaacagagugccucugaggagugaggcugcccaggcggcaggaaauaggaaaauguaagagacagaggggccuugauugaaccacacgcaaggcugaaugccaccugggcugugggauaaaagcccaacguuugcgaagaggccacacagcagccacagaucacaggagaucagugaaugggaagcacccaggcugggccaccaagggugaugaagcuucuagaagcagggaaagaaagggagggcaucccuggcugagaugacaaugcaagucugggcuggggcagcaggaauaggccgcgucguggaggguucugacacuugggcugauucucugagcaagagggagucacugaaggcuucagaggaagaaggcggcacaaugaaagcugcaccagaaaaacagccuggcgagaggcaggaggugggggacagacaguaagacuccucagaggacagggccaaaauccaggaagaggugacaaaagucaaaucuguguggguaagggaaugagugcaagagguaacacagagaugaaagcaacucaaggcagcacgaggacaugaagaugcuaggaugacucugcagauaccgccagcacaaccuccagcgagcccucuccaggacugggcaccggaaaagcagcaaggagcagacagggaguccaacuggggacaguuggauggaggugccugaugcacauccagggagccacagccaggggagaagugacaaggcugguacucaggagggagggccccuuccagcccugcggcagcagcaccuccccuccuccucccugcuagaguccaguccccaucucugcugugcggugcuacccagggaccaggaagccugcuggguauguugugccugagggugcaccuccucuagagagagccuggaguucaggugagcagaaaugacauucagagcagugguucccaagcccuggagauccagagugugcagauccggcaugcaccccugaaagucaugcuuucaaaaagcuccccaagcaccagauucgaauacagagucacagaccccaccagcagauuugcuacuuuaaccagguaaggugggacccaggaaguguaauguuucaagaugccgcccccagaagcaacacacaaagcacacaguccgccagccacgccuagacagcgccugcucucagugaauacucaggucaagcccuacggcagcucagccuguuucuccggccaugcgggggagaguagagcucaguguacaagagaugggagggugucaguacccagcaaggauggaaugacaauagcuaccacaugggagugcucacuacugggcagaugcuguugugaugccaccacaguccaccuuugucaaaacuugccccauuuugcagaugaggccacugaggcugagagcaaagguggccccagggcaagcggugaggccagagcuacagguguauguuccacaccuggccaccugcaccgacgcacaggguaaguguuggcaagucgugucuguccuuccggccucagucuuccccucuauaaaauagagguaacuguucccagcugcuuccuagaaacucugagauccugaacucaaaugaccaugaaggcccugggaaguccguaggguuuuccccaagcagcaaugcggccgcccccgcaaccccucagccggucuggaugccgccugcaggguaugucugcagucucugcccacccaccacuggguggaaagggcaaagggcguucccccugcuccacacugaguccgccucauaaagaucucauugugugauuc

SEQ ID NO: 21140 - RNA, 2526 nt, Homo sapiens
gaaucacacaaugagaucuuuaugaggcggacucaguguggagcagggggaacgcccuuugcccuuuccacccaguggugggugggcagagacugcagacauacccugcaggcggcauccagaccggcugagggguugcgggggcggccgcauugcugcuuggggaaaacccuacggacuucccagggccuucauggucauuugaguucaggaucucagaguuucuaggaagcagcugggaacaguuaccucuauuuuauagaggggaagacugaggccggaaggacagacacgacuugccaacacuuacccugugcgucggugcagguggccagguguggaacauacaccuguagcucuggccucaccgcuugcccuggggccaccuuugcucucagccucaguggccucaucugcaaaauggggcaaguuuugacaaagguggacugugguggcaucacaacagcaucugcccaguagugagcacucccaugugguagcuauugucauuccauccuugcuggguacugacacccucccaucucuuguacacugagcucuacucucccccgcauggccggagaaacaggcugagcugccguagggcuugaccugaguauucacugagagcaggcgcugucuaggcguggcuggcggacugugugcuuuguguguugcuucugggggcggcaucuugaaacauuacacuuccugggucccaccuuaccugguuaaaguagcaaaucugcugguggggucugugacucuguauucgaaucuggugcuuggggagcuuuuugaaagcaugacuuucaggggugcaugccggaucugcacacucuggaucuccagggcuugggaaccacugcucugaaugucauuucugcucaccugaacuccaggcucucucuagaggaggugcacccucaggcacaacauacccagcaggcuuccuggucccuggguagcaccgcacagcagagauggggacuggacucuagcagggaggaggaggggaggugcugcugccgcagggcuggaaggggcccucccuccugaguaccagccuugucacuucuccccuggcuguggcucccuggaugugcaucaggcaccuccauccaacuguccccaguuggacucccugucugcuccuugcugcuuuuccggugcccaguccuggagagggcucgcuggagguugugcuggcgguaucugcagagucauccuagcaucuucauguccucgugcugccuugaguugcuuucaucucuguguuaccucuugcacucauucccuuacccacacagauuugacuuuugucaccucuuccuggauuuuggcccuguccucugaggagucuuacugucugucccccaccuccugccucucgccaggcuguuuuucuggugcagcuuucauugugccgccuucuuccucugaagccuucagugacucccucuugcucagagaaucagcccaagugucagaacccuccacgacgcggccuauuccugcugccccagcccagacuugcauugucaucucagccagggaugcccucccuuucuuucccugcuucuagaagcuucaucacccuugguggcccagccugggugcuucccauucacugaucuccugugaucuguggcugcuguguggccucuucgcaaacguugggcuuuuaucccacagcccagguggcauucagccuugcgugugguucaaucaaggccccucugucucuuacauuuuccuauuuccugccgccugggcagccucacuccucagaggcacucuguuaaugcccaugggugaaugaaugagugagugaaugaaugaaugacugaauacacugacgauacuugauauccugcuuccucugagugaugccaagagacuuagugucacaaggagggaggaggguuuagguauccgacguggacuguguucacccugauggaagcugucgcuugcucagcaguggcucccucugcagccccagcucccugagucccuguggucagaucuggucauggugggggaggguggcagaaagaggaagccgagagcccaggcauggccugugguuguggaugggacagcucccucugucugggcuguucuucagaagagggugggaacagcagcucucucauugguccucuugcgagaaagccugcucuccaaguacagagggucacaacauggagaaaucacauggucccagcaccacaguggacccagcagucauucccccagugccuugggcuugucccggcucuuccuacugagccuccccauggaggcaggagggcugggaggaaggugagguggcuuccugaagggacguggcuccugaaugucacugcgguacauccacggcuugucauuuguucauccauguggcauguggguugcucccuccuuauggcgaguacacacgugugaacgcaugcacacacuguaauauggaugugucuguaauugauacuuugauuauucccuuugcagcacucauuugac

SEQ ID NO: 21141 - RNA, 336 nt, Homo sapiens
uaucccgagccaacaugaugccaugaaaaaaagugaaacaccacacccccguucacucuagugccuuccagaaggcucuuacauaagaggcugccaguggugagggagggaggaauaccaugcuauagguccuaugauaaugcaaccagauuuuuuaaagggugugggggggggggcgcucuuuaaaaaaaaaaaaaaaaaaaaaagucuuguugaucguuugcuuuuaauuuuuuuuucuccccacacugucaaaaugaagcugccuuguucauucacgaagacagcaaauuauuugaggcuugcugcaaaucugcuuuccauccucccucccca

SEQ ID NO: 21142 - RNA, 336 nt, Homo sapiens
uggggagggaggauggaaagcagauuugcagcaagccucaaauaauuugcugucuucgugaaugaacaaggcagcuucauuuugacaguguggggagaaaaaaaaauuaaaagcaaacgaucaacaagacuuuuuuuuuuuuuuuuuuuuuuaaagagcgcccccccccccacacccuuuaaaaaaucugguugcauuaucauaggaccuauagcaugguauuccucccucccucaccacuggcagccucuuauguaagagccuucuggaaggcacuagagugaacgggggugugguguuucacuuuuuuucauggcaucauguuggcucgggaua

SEQ ID NO: 21143 - RNA, 208 nt, Homo sapiens
auguauuaaauguuuuagaguguuguguaguaaauucagaucuuuauauuuugauuuuccaaccuaaggcauuucuauauuuuguaccauuuuaacuacuuuuauuaaaauauauaccuuuuucuguguuagugaauugguucaaugcauuuuagugucuguugagaucucucuguaguggcgaaccuuuuaaucuaauuuaagauaa

SEQ ID NO: 21144 - RNA, 208 nt, Homo sapiens
uuaucuuaaauuagauuaaaagguucgccacuacagagagaucucaacagacacuaaaaugcauugaaccaauucacuaacacagaaaaagguauauauuuuaauaaaaguaguuaaaaugguacaaaauauagaaaugccuuagguuggaaaaucaaaauauaaagaucugaauuuacuacacaacacucuaaaacauuuaauacau

SEQ ID NO: 21145 - RNA, 1190 nt, Homo sapiens
gguugacuaacaccuucuguuuugaauuuguuccuccugucugaccagucuuccucugucaccccuaagcaguagccaugucucucuguucuaauuacucuuacuucucuuuuacccaauaaagcccacauagguugucaggcucugagaguucucauguccuggucucaaucuuccaucuuucucuuccuuuuccuuuuauuaucacauuaauugacaacucacuguucaaggcaggucaccugugcuuuccuuuuuccaugguucccucuggaaucuucauucaaugcccagcuuaaauguuucccccuccaugaacccugcucuaguucccccaagcuauaaaucaccacuucagacuccaucgaccagguccaagcugccaccugcucaugacucgacauuuguaaaagcuucccaacuaguauuccugcuuuuuugccuuucuccuguuuccucuauacaaucaccagaaugaucucucaaucaaaacucuucaccauggccuacaaggccuggucucugcuaacauuuauuggcccaggcacacuaagcgccuuuuaaaaauucauuaauuuaauccucucaauaauccuacggcuauguacuuuuaauauccucauuugcaguagaugcuguuggugacuuacccagaccccuuucacaggacuggugcacccauacccuagcugcuguagguguuggcugguaagaacugacaccuccacccuuaucuggaggauugcccuuggcugaggagagguaacagucacuccuccauccuuucucccuguagccagugguccgugacagccugaugugggaaccuaauggcucagccccuucaacucugggcaggacaacgcugggcccaauucauucagcagagugcccuaugagucagggugaggcugcacuacuccugaaacucuucuuccccggccuuacccugcuugcuuuacuccauuacagauuucuccugaaagugcucccucaaucacuugcccaagaauccccaucuccggcauuguuacagaggaagugaucuaagacaccauuuuacagaucaggaaaccuaagacaaagagggcugaagugaucugccuaaggucaaacagaaaaugggaaagcugaauuuugaagccagagggccuggcugucccaccugagcucuuucccaccauacugca

SEQ ID NO: 21146 - RNA, 1190 nt, Homo sapiens
ugcaguauggugggaaagagcucaggugggacagccaggcccucuggcuucaaaauucagcuuucccauuuucuguuugaccuuaggcagaucacuucagcccucuuugucuuagguuuccugaucuguaaaauggugucuuagaucacuuccucuguaacaaugccggagauggggauucuugggcaagugauugagggagcacuuucaggagaaaucuguaauggaguaaagcaagcaggguaaggccggggaagaagaguuucaggaguagugcagccucacccugacucauagggcacucugcugaaugaauugggcccagcguuguccugcccagaguugaaggggcugagccauuagguucccacaucaggcugucacggaccacuggcuacagggagaaaggauggaggagugacuguuaccucuccucagccaagggcaauccuccagauaaggguggaggugucaguucuuaccagccaacaccuacagcagcuaggguaugggugcaccaguccugugaaaggggucuggguaagucaccaacagcaucuacugcaaaugaggauauuaaaaguacauagccguaggauuauugagaggauuaaauuaaugaauuuuuaaaaggcgcuuagugugccugggccaauaaauguuagcagagaccaggccuuguaggccauggugaagaguuuugauugagagaucauucuggugauuguauagaggaaacaggagaaaggcaaaaaagcaggaauacuaguugggaagcuuuuacaaaugucgagucaugagcagguggcagcuuggaccuggucgauggagucugaaguggugauuuauagcuugggggaacuagagcaggguucauggagggggaaacauuuaagcugggcauugaaugaagauuccagagggaaccauggaaaaaggaaagcacaggugaccugccuugaacagugaguugucaauuaaugugauaauaaaaggaaaaggaagagaaagauggaagauugagaccaggacaugagaacucucagagccugacaaccuaugugggcuuuauuggguaaaagagaaguaagaguaauuagaacagagagacauggcuacugcuuaggggugacagaggaagacuggucagacaggaggaacaaauucaaaacagaagguguuagucaacc

SEQ ID NO: 21147 - RNA, 754 nt, Homo sapiens
uaugagaaacaaacaguuccaguuucaaccuaaauuaaaguuauuuguggcaaguaacaugaaacaaugaucauaugaagucauuaucuuaaaaagaaccauucuucagaaaucacuuuguggcaaagcaccauacuaggguagacuaugaucuuaaacauauaccuucaguuaaagacaaauggucuccauuuuuugaaaauuaccugaaugauucaaauuuuuauuaugcccauaaauuaaaauuaucuuucaaugugaagguuauauauuuugacaccuuaaauaauucuggagauguucaguuaaaccaguaauucccugggaccagauuacuuucaagagcaagaagaaaaaacaauaaucaaaagcccuuucuaaagucacaggcaagguuucugauacgggauuuaauuaauaagaaguuaagcaccacaguaaaauacauuuuuagaaaacagaguggacugccaucaauacacaaguuagggacaaaagaaagcacuuacacuuuaccccacccuuccccccccaaaaauuuaagcacucuaauccuaucaaucagaaauuuuacaaaggauuuuuugugugguuaucugugugugguuauuauauggaagauacaaaccgaaauucuauuuaagaucucaaguucuagaaucaugauuugauucaguaagaaugucacauuauuugugcauguuauauauuuauuuuuagauuauaugcuauauuuuuaugcuuucucuccuca

SEQ ID NO: 21148 - RNA, 754 nt, Homo sapiens
ugaggagagaaagcauaaaaauauagcauauaaucuaaaaauaaauauauaacaugcacaaauaaugugacauucuuacugaaucaaaucaugauucuagaacuugagaucuuaaauagaauuucgguuuguaucuuccauauaauaaccacacacagauaaccacacaaaaaauccuuuguaaaauuucugauugauaggauuagagugcuuaaauuuuuggggggggaagggugggguaaaguguaagugcuuucuuuugucccuaacuuguguauugauggcaguccacucuguuuucuaaaaauguauuuuacuguggugcuuaacuucuuauuaauuaaaucccguaucagaaaccuugccugugacuuuagaaagggcuuuugauuauuguuuuuucuucuugcucuugaaaguaaucuggucccagggaauuacugguuuaacugaacaucuccagaauuauuuaaggugucaaaauauauaaccuucacauugaaagauaauuuuaauuuaugggcauaauaaaaauuugaaucauucagguaauuuucaaaaaauggagaccauuugucuuuaacugaagguauauguuuaagaucauagucuacccuaguauggugcuuugccacaaagugauuucugaagaaugguucuuuuuaagauaaugacuucauaugaucauuguuucauguuacuugccacaaauaacuuuaauuuagguugaaacuggaacuguuuguuucucaua

SEQ ID NO: 21149 - RNA, 841 nt, Homo sapiens
cuguggcaagaaauugacuaacuuggcccaaggucacccauauaauaaaaggcgggcugggugcaguggcucgugccuguaauuccagcacuuugggaguccaaggggaauaggaucacuucaggagaggaguuugagaccagccugggcaacagagggagacccuaccucuaccaaaauuauaaaaaaauuagccgggcaugguggcauagacuuguggucccagcugcccagaaggcugaaguggaaggauggcuugagccugggaggucaagccugcagugagccgugauugugccacugcacuccagccugggugagagagugagauccuaucucaaaaauaaaaaauaaaaaaaaaaugaaaaaaaaaauaaaaaaaaauaaauaaaauaauuaaaaaaagagcugggacuugaagccagauaauaaggcaggcagagggcauacgaaacacccagaugggucaugagcccgugcaucagucagggucuaauggcucagcugaggaagggagguuuaaggaagagacuguggacagagguguuagggaaggugucagagaagguuaaggagccaacauggaucaugggggugguacaguguugccagggcuggggaggauuggcugcagugugggguacccagccgcugccauguggagagggaccugucacuccugcugugaacucucccuucuucugcccucugaccuccugcuggugccucccauuggcuaaacacaguugauggccagugcacuggggagcuguucuuggagcccacaggcaucugcuucuuggcacagagcagacaauggauugagucgggagggagggga

SEQ ID NO: 21150 - RNA, 841 nt, Homo sapiens
uccccucccucccgacucaauccauugucugcucugugccaagaagcagaugccugugggcuccaagaacagcuccccagugcacuggccaucaacuguguuuagccaaugggaggcaccagcaggaggucagagggcagaagaagggagaguucacagcaggagugacaggucccucuccacauggcagcggcuggguaccccacacugcagccaauccuccccagcccuggcaacacuguaccacccccaugauccauguuggcuccuuaaccuucucugacaccuucccuaacaccucuguccacagucucuuccuuaaaccucccuuccucagcugagccauuagacccugacugaugcacgggcucaugacccaucuggguguuucguaugcccucugccugccuuauuaucuggcuucaagucccagcucuuuuuuuaauuauuuuauuuauuuuuuuuuauuuuuuuuuucauuuuuuuuuuauuuuuuauuuuugagauaggaucucacucucucacccaggcuggagugcaguggcacaaucacggcucacugcaggcuugaccucccaggcucaagccauccuuccacuucagccuucugggcagcugggaccacaagucuaugccaccaugcccggcuaauuuuuuuauaauuuugguagagguagggucucccucuguugcccaggcuggucucaaacuccucuccugaagugauccuauuccccuuggacucccaaagugcuggaauuacaggcacgagccacugcacccagcccgccuuuuauuauaugggugaccuugggccaaguuagucaauuucuugccacag

SEQ ID NO: 21151 - RNA, 515 nt, Homo sapiens
acuaagugcuagcuuuuacacuacgcauuuugacacucuguaacuucuuuuucauuuaaucuguuccagaaacuuauguucacuaugaugugaucuugcuuuugauccauuuuacugaugaggaaauugaagcucagagaggucaaguaauuugccuaaggucacacaguuaauaaaugguaacgccauuuucaauucuacaucugccugacuacaaaguuggugguuuuccuuuccuaaauguuacaacuaaaaacccacucuagcucaaaauggcaaugggcuuuauuguaaggauuugggcugugccugggacugucuggugguuauccagcagccucuuaggaggaguuggccuguuggauuuauggacuugggacccuugguaugugcucagcacaugccacagaccuggcaagcaugcuggccuggggucaucugcucuuggggcuguguuuucugauuaagggacauuaggcuagccacuucccacauccagcuucaguuuccccaac

SEQ ID NO: 21152 - RNA, 515 nt, Homo sapiens
guuggggaaacugaagcuggaugugggaaguggcuagccuaaugucccuuaaucagaaaacacagccccaagagcagaugaccccaggccagcaugcuugccaggucuguggcaugugcugagcacauaccaagggucccaaguccauaaauccaacaggccaacuccuccuaagaggcugcuggauaaccaccagacagucccaggcacagcccaaauccuuacaauaaagcccauugccauuuugagcuagaguggguuuuuaguuguaacauuuaggaaaggaaaaccaccaacuuuguagucaggcagauguagaauugaaaauggcguuaccauuuauuaacugugugaccuuaggcaaauuacuugaccucucugagcuucaauuuccucaucaguaaaauggaucaaaagcaagaucacaucauagugaacauaaguuucuggaacagauuaaaugaaaaagaaguuacagagugucaaaaugcguaguguaaaagcuagcacuuagu

SEQ ID NO: 21153 - RNA, 778 nt, Homo sapiens
ucacaagcaagccaaacgcaacuauggcaaauggaggugcacacaagcuuugaggggaacaaccacaaacagaaucaacauggauuagcuggagaguccagaggcugcacgugucaggccacaccccaggcgugcccgacccacgcuggccucccucaccgccccgagccccgggugucccccagggcgggguaagcagacacacagacaggaugcgguuccgagaacaagugcacuuuauugguucugauacagaggagcugccagaaaagccagcaggcggcugcggcacccagcccugcccgaggggagcaccaggucugcaggcaccgggccugauccggagcugccaaucagcaggcagcccugccugcacaguccucuugggcagcccacagccuguggccggcaagucccuccguggaggcguggguucccagguggccagucuuuccugcgcgaauggggcuucucaccuggccacggccacagccacagugccccagccugccuagacuccacgaggccccgguaucuccaggacagcuaaggcugcuacucaccacgggcuguggcugccgcagagaccccaggcccucggccucucuggccugcucgggcccacaucccgcugggcacaguccaggcagcagggcgggacuggcugcccacgaccacccugcuugcgccacgccuggugcucugagcuggccgccuggugugggcugagaguagagggauggagcuuccuccaguggccccagcaucaacaggugcu

SEQ ID NO: 21154 - RNA, 778 nt, Homo sapiens
agcaccuguugaugcuggggccacuggaggaagcuccaucccucuacucucagcccacaccaggcggccagcucagagcaccaggcguggcgcaagcaggguggucgugggcagccagucccgcccugcugccuggacugugcccagcgggaugugggcccgagcaggccagagaggccgagggccuggggucucugcggcagccacagcccguggugaguagcagccuuagcuguccuggagauaccggggccucguggagucuaggcaggcuggggcacuguggcuguggccguggccaggugagaagccccauucgcgcaggaaagacuggccaccugggaacccacgccuccacggagggacuugccggccacaggcugugggcugcccaagaggacugugcaggcagggcugccugcugauuggcagcuccggaucaggcccggugccugcagaccuggugcuccccucgggcagggcugggugccgcagccgccugcuggcuuuucuggcagcuccucuguaucagaaccaauaaagugcacuuguucucggaaccgcauccugucugugugucugcuuaccccgcccugggggacacccggggcucggggcggugagggaggccagcgugggucgggcacgccugggguguggccugacacgugcagccucuggacucuccagcuaauccauguugauucuguuugugguuguuccccucaaagcuugugugcaccuccauuugccauaguugcguuuggcuugcuuguga

SEQ ID NO: 21155 - RNA, 1963 nt, Homo sapiens
cacauucccuuuuggaaacagacuccaacaaacaaaaucuaaauaaauagaagcccuaaauguacuaaaccacaacuauauaucuaccaauuaucuaacacaacauagaaaauaucaaggggaaagaggaaaaugucaucuauaaagugaagugacacucuaagucaagaaguauuaaugauuuacaggucaacagagagcuccucguuuuauacccagcaauggcaggaacucuagacaguucaaauaugcaagaugcagggcacuaacccaccgucaguuaacguuuacuccugccuacaaauuccuuucuauauuaggccaguacaucaucaauuccaacagccacaauuuucuucccaaccuguuccuggcaaguagcagcauaaguacaacuccugucucccuaugacuuccaaaugaaaaauaauucgaccucucccuaaaaaauccuuggcaugaaguaagcugcaaucaaaucaugaaaacaaacucaaauugaaccaccuuuuccagagcaaaaaaaaugcaaugaagaucaaagaauaucucauuaaaugaucucuggcuagguaguuuucagugguuagacaacuaacuuagaauucuuucuagccaagauuuucugaaagauuuauuaaaaauguucacuccuaauaucugggauaaucaagccuccauaacaacaggacucuugaccuauuuuuauaaaggacuuagaaaucuuaagaaccucgaucaagaaccuaaagcuaccaaagaugaacaaucuaaacacaauaguauccauuggcuaggcuuugcucauucucauggcaccaguacuguuaaauucacaagcuccaaucucaagucauauaggcugcaaaaacuugaggauguagcuguuucccuucggauauacacauaaaaagcaugucuuacauuuauaauguaauuuuuaaaacaauguucuaaacuuccaaaucacaauuucauuguuuuuaguauccucuagcuucucccauaugguuugggcuuucacaggcaggauauacauagcacauuccccaucucuuagagaccuuaagacugcucucauuugaacacuuucccaaagccucacuugaaaaaaaagacacacccaauucuguagggcagaagcuggccuugcucgccaacccuccuuccucaaccccaucucuguuuugcacaaaaacaaaaaaagggguaaaaaggaaguucucauaauaagguuaagagucaggguguuggcuguacuugcccaaacuacaaauuagagggcuacuacucaauuauaacauaaagaaagggaaaaauaccaugucaaauacaugccucuuccuuuauguucucaaggccaaccauguuuuucucuaguagacuguuggaaaaugaaaacgguaaggaacagggagggaagauaaaacauuauuuuuaaacacacacacuuaaaaacacacauacccacacuuacauacacacuuaaaagucugaaaaaaguggccugagccuauuucagaacuccuagccaaaaaccuagccucccacccacccucacacauucccacccuccaaucccacccaccaggaguuacugcuauguaucauauacacacagcaaaaucccuauccccuucccaauuauauaaaaaaacuaaacagauaacuuacuuucuuuaaauuauuaagucuauuaaaagauuugacguuuaaauacuuccucucuucugauauauuaaacaccgaaaggauccacaauugucugauacaagaaacccuccauuuuucagcucuggcaagaagagggaagauaucaacuccaaucaaccuaauuagaugguggagaggccaagaauucagaauguguccuuaauccuucacagcuucaacaccucucuaauaccaguaaaaacuguaagaaaauaguuaaaugcaugagacagcagauauauagccaagg

SEQ ID NO: 21156 - RNA, 1963 nt, Homo sapiens
ccuuggcuauauaucugcugucucaugcauuuaacuauuuucuuacaguuuuuacugguauuagagagguguugaagcugugaaggauuaaggacacauucugaauucuuggccucuccaccaucuaauuagguugauuggaguugauaucuucccucuucuugccagagcugaaaaauggaggguuucuuguaucagacaauuguggauccuuucgguguuuaauauaucagaagagaggaaguauuuaaacgucaaaucuuuuaauagacuuaauaauuuaaagaaaguaaguuaucuguuuaguuuuuuuauauaauugggaaggggauagggauuuugcuguguguauaugauacauagcaguaacuccuggugggugggauuggagggugggaaugugugagggugggugggaggcuagguuuuuggcuaggaguucugaaauaggcucaggccacuuuuuucagacuuuuaaguguguauguaaguguggguauguguguuuuuaaguguguguguuuaaaaauaauguuuuaucuucccucccuguuccuuaccguuuucauuuuccaacagucuacuagagaaaaacaugguuggccuugagaacauaaaggaagaggcauguauuugacaugguauuuuucccuuucuuuauguuauaauugaguaguagcccucuaauuuguaguuugggcaaguacagccaacacccugacucuuaaccuuauuaugagaacuuccuuuuuaccccuuuuuuuguuuuugugcaaaacagagaugggguugaggaaggaggguuggcgagcaaggccagcuucugcccuacagaauugggugugucuuuuuuuucaagugaggcuuugggaaaguguucaaaugagagcagucuuaaggucucuaagagauggggaaugugcuauguauauccugccugugaaagcccaaaccauaugggagaagcuagaggauacuaaaaacaaugaaauugugauuuggaaguuuagaacauuguuuuaaaaauuacauuauaaauguaagacaugcuuuuuauguguauauccgaagggaaacagcuacauccucaaguuuuugcagccuauaugacuugagauuggagcuugugaauuuaacaguacuggugccaugagaaugagcaaagccuagccaauggauacuauuguguuuagauuguucaucuuugguagcuuuagguucuugaucgagguucuuaagauuucuaaguccuuuauaaaaauaggucaagaguccuguuguuauggaggcuugauuaucccagauauuaggagugaacauuuuuaauaaaucuuucagaaaaucuuggcuagaaagaauucuaaguuaguugucuaaccacugaaaacuaccuagccagagaucauuuaaugagauauucuuugaucuucauugcauuuuuuuugcucuggaaaaggugguucaauuugaguuuguuuucaugauuugauugcagcuuacuucaugccaaggauuuuuuagggagaggucgaauuauuuuucauuuggaagucauagggagacaggaguuguacuuaugcugcuacuugccaggaacagguugggaagaaaauuguggcuguuggaauugaugauguacuggccuaauauagaaaggaauuuguaggcaggaguaaacguuaacugacgguggguuagugcccugcaucuugcauauuugaacugucuagaguuccugccauugcuggguauaaaacgaggagcucucuguugaccuguaaaucauuaauacuucuugacuuagagugucacuucacuuuauagaugacauuuuccucuuuccccuugauauuuucuauguuguguuagauaauugguagauauauaguugugguuuaguacauuuagggcuucuauuuauuuagauuuuguuuguuggagucuguuuccaaaagggaaugug

SEQ ID NO: 21157 - RNA, 1163 nt, Homo sapiens
ccugcugaaauccugacccugacuacacagugguauuccaggaagaauucaugcaauuauucggauaauuguagagggagagagagaaaguauuucucuuuuauugucugacccucucugaugucugugcagaggaggaggggccagggguguaugggauguagaggaaaaggagacaguagggucucccaacaucacccuaagcccuacaaaauggcuauuccuaaaucaaggaggcccuaggcaggagcuuauagauuuuggaacauacucaagaacgcacaagagaucgaguuugaaugccccugauuuaguuucauuuuccaggauauuugcuuggcuuuacuuugucagcauagaccugccuccucuaguauuguaaucauuacaaguaaggggauaauagauaauuacagggguaucaauaauauuauuuuauagccaaacaagauaugauuagaguuaaugucagaggcucggcuggagccugggaggcagcaauagacaagguggagaggcccuuauagucuuucucuauccuauuuuuacauaugcuuuaaucucuauaaaucccuaguucucuaaaucuccuccucagaugucuuaagggaaagcucuaagauuuuaggggcugaaagccagagaagggugaaccacaauuugguacuugaacucugcuccccuccccauaguuucaggagcugugggaucugcuuuccccaugcccccccagccugaggcuuugcucucaguccaaggccacuagggucacagagacuuugcagguggggccaaugugaggaagacagggucuuauccaaaccaauuucauugucauccccaagugggcacuggucccaaagugaagccucuuuugauccuaaauuggccuucccccucucccccaggaacaccuggguggggcaaaagccaggcuggggcugugaaggccaguucaggguagggaugcaggaaggacugaaaauauuuguguuguuguuguuuccgggauuugagaccagaagggaccagaaggcugggaagagagagaaagagaucaaggaagugccugagaacaaggcaagagagaacccagggaagcuaugaaaccagccggcaaggguaaaaagaaugagugaaagaaagggggcaggaagaacagc

SEQ ID NO: 21158 - RNA, 1163 nt, Homo sapiens
gcuguucuuccugcccccuuucuuucacucauucuuuuuacccuugccggcugguuucauagcuucccuggguucucucuugccuuguucucaggcacuuccuugaucucuuucucucucuucccagccuucuggucccuucuggucucaaaucccggaaacaacaacaacacaaauauuuucaguccuuccugcaucccuacccugaacuggccuucacagccccagccuggcuuuugccccacccagguguuccugggggagagggggaaggccaauuuaggaucaaaagaggcuucacuuugggaccagugcccacuuggggaugacaaugaaauugguuuggauaagacccugucuuccucacauuggccccaccugcaaagucucugugacccuaguggccuuggacugagagcaaagccucaggcugggggggcauggggaaagcagaucccacagcuccugaaacuauggggaggggagcagaguucaaguaccaaauugugguucacccuucucuggcuuucagccccuaaaaucuuagagcuuucccuuaagacaucugaggaggagauuuagagaacuagggauuuauagagauuaaagcauauguaaaaauaggauagagaaagacuauaagggccucuccaccuugucuauugcugccucccaggcuccagccgagccucugacauuaacucuaaucauaucuuguuuggcuauaaaauaauauuauugauaccccuguaauuaucuauuauccccuuacuuguaaugauuacaauacuagaggaggcaggucuaugcugacaaaguaaagccaagcaaauauccuggaaaaugaaacuaaaucaggggcauucaaacucgaucucuugugcguucuugaguauguuccaaaaucuauaagcuccugccuagggccuccuugauuuaggaauagccauuuuguagggcuuagggugauguugggagacccuacugucuccuuuuccucuacaucccauacaccccuggccccuccuccucugcacagacaucagagagggucagacaauaaaagagaaauacuuucucucucucccucuacaauuauccgaauaauugcaugaauucuuccuggaauaccacuguguagucagggucaggauuucagcagg

SEQ ID NO: 21159 - RNA, 926 nt, Homo sapiens
caggagggaaaugaaaauaagaaagacgagagagaaggaucgaaagauaaaaagaggcgggagggaggcagaagcaagggucggcuguugcucucccucgcccgggcgccugcagcagucugggugggcgggggcgccaugacaaagugaaggucaaguuagcaucguaccuuauaaggaaggcgccgguccuccauuucagccuuuucucugccaggacgcggccguggcauuucuggucuuguaaacaucagacucuuuggggccuuaaaaaaauaaagacgccccuccuuccuuuaccgggggugagccggccggggaaagcggcggacagggaaaucaacuaaugaagacuccgggaaacuuuucucucuuuuucucucucuggcuccgcuccccgccagcuggggacccuucccucccuccuuccucccccucccuucccccgccucucuuuuucucuaucucccagucuucuguaccucucgccgccgucuguaacucugggcucccucucuccacuccccacuccccuacugcaggcuucuaaauccguuccauuccacugcgaagcggagcaggaccuaagaauuggagagaaaauuaaacgucauaaagaaaaguucauuuacagcuuaaaugucugaauguuacgguuuccuucagaaaacaaggcgguacacucgguaaggagaagugaggcagcagggguggggagggcuggugcgguaggaggcuugguuuuauuucuuucucagauccagaggcggaaagaaagggggagaagcaggaaagugcgacagaagcguuuuacccgggcagcuagcaaagaaagaugcugcagucgguggaacuggaagcaaagcgcauaagggcccagugcgggggcagcgauccccgagcgcugagcuggcugcgcugaggcc

SEQ ID NO: 21160 - RNA, 926 nt, Homo sapiens
ggccucagcgcagccagcucagcgcucggggaucgcugcccccgcacugggcccuuaugcgcuuugcuuccaguuccaccgacugcagcaucuuucuuugcuagcugcccggguaaaacgcuucugucgcacuuuccugcuucucccccuuucuuuccgccucuggaucugagaaagaaauaaaaccaagccuccuaccgcaccagcccuccccaccccugcugccucacuucuccuuaccgaguguaccgccuuguuuucugaaggaaaccguaacauucagacauuuaagcuguaaaugaacuuuucuuuaugacguuuaauuuucucuccaauucuuagguccugcuccgcuucgcaguggaauggaacggauuuagaagccugcaguaggggaguggggaguggagagagggagcccagaguuacagacggcggcgagagguacagaagacugggagauagagaaaaagagaggcgggggaagggagggggaggaaggagggagggaaggguccccagcuggcggggagcggagccagagagagaaaaagagagaaaaguuucccggagucuucauuaguugauuucccuguccgccgcuuuccccggccggcucacccccgguaaaggaaggaggggcgucuuuauuuuuuuaaggccccaaagagucugauguuuacaagaccagaaaugccacggccgcguccuggcagagaaaaggcugaaauggaggaccggcgccuuccuuauaagguacgaugcuaacuugaccuucacuuugucauggcgcccccgcccacccagacugcugcaggcgcccgggcgagggagagcaacagccgacccuugcuucugccucccucccgccucuuuuuaucuuucgauccuucucucucgucuuucuuauuuucauuucccuccug

SEQ ID NO: 21161 - RNA, 177 nt, Homo sapiens
gcacuugcccccuccccucccuccagacgccccccgcacccgcaagaagcgcugcccuuauucgaaauuccagauccgggaacuggagcgagaguuuuucuucaacguguauaucaacaaagagaagcggcugcagcugucccggaugcugaaccugacggaccgacaagugaaaau

SEQ ID NO: 21162 - RNA, 177 nt, Homo sapiens
auuuucacuugucgguccgucagguucagcauccgggacagcugcagccgcuucucuuuguugauauacacguugaagaaaaacucucgcuccaguucccggaucuggaauuucgaauaagggcagcgcuucuugcgggugcggggggcgucuggagggaggggagggggcaagugc

SEQ ID NO: 21163 - RNA, 1292 nt, Homo sapiens
ccuaccgacagugaggagcgccgccgccgccgccgccgcccgcucgccgcccgccgccgccgccgcccgcgccccagccccgggagcucugcugauccggccgagcucagcaccgaggcgccccccaaccugcccagcccccagcccaccagcccagcccagucccggggagccagcuggccugggguucggucccggggggaggggaguuucggggguacugggcgggguacucgugagccagaggggagggggccgcggguuuucauguacccagcaugagcuccuacuucgucaacccccuguucuccaaauacaaagccggcgagucccuggaaccggccuauuacgacugccgguucccucagagcgugggcaggagccaugcgcugguguacgggcccggcggcucggcgcccggcuuccagcacgcuucgcaccacguucaagacuucuuccaccacggcaccuccggcaucuccaacucaggcuaccagcagaacccgugcucgcuuagcugccacggagacgccuccaaauucuauggcuacgaggcgcuccccagacagucccuuuauggggcucagcaagaggcgagcguggugcaauaucccgacuguaaauccuccgccaacacuaacaguagcgaaggacaaggccacuuaaaucaaaacucgucucccagccucauguuuccauggaugagaccccacggugagaagccuuuucucuuucccccuuggucucccgcgcuccaggguuucccccccucccucgccuccuuuuugucugcccucgcuuuuucuccuggcuuuggggucucucccgccccacccccgugccugugccugggugguuuucucgaaguugggaaggcuccgcuggggcggggcagggagggggugccuagaacauuuaggggauuggggugaaggugagagaaagcugguguguggccgcaaaggguuaaaaaucguuuucuccaucucugucugucugucucucucugacucucccacuccccaucucuaaagucaaaguuggggagguggcugggaaugguacccugaguacccugagacugucagccuuuggaacaaaccaguuucuccagaggcagggagccuggaguccaggacacuggccaggcugucuuggggcaaagggagacagaccccuguugcucugcccuagccagaguguggugagacucuaaggacaggcucucuggcucucuagggcacccauaaccuccucucagagaaccagccugagggccacuaccccaacuu

SEQ ID NO: 21164 - RNA, 1292 nt, Homo sapiens
aaguugggguaguggcccucaggcugguucucugagaggagguuaugggugcccuagagagccagagagccuguccuuagagucucaccacacucuggcuagggcagagcaacaggggucugucucccuuugccccaagacagccuggccaguguccuggacuccaggcucccugccucuggagaaacugguuuguuccaaaggcugacagucucaggguacucaggguaccauucccagccaccuccccaacuuugacuuuagagauggggagugggagagucagagagagacagacagacagagauggagaaaacgauuuuuaacccuuugcggccacacaccagcuuucucucaccuucaccccaauccccuaaauguucuaggcacccccucccugccccgccccagcggagccuucccaacuucgagaaaaccacccaggcacaggcacggggguggggcgggagagaccccaaagccaggagaaaaagcgagggcagacaaaaaggaggcgagggagggggggaaacccuggagcgcgggagaccaagggggaaagagaaaaggcuucucaccguggggucucauccauggaaacaugaggcugggagacgaguuuugauuuaaguggccuuguccuucgcuacuguuaguguuggcggaggauuuacagucgggauauugcaccacgcucgccucuugcugagccccauaaagggacugucuggggagcgccucguagccauagaauuuggaggcgucuccguggcagcuaagcgagcacggguucugcugguagccugaguuggagaugccggaggugccgugguggaagaagucuugaacguggugcgaagcgugcuggaagccgggcgccgagccgccgggcccguacaccagcgcauggcuccugcccacgcucugagggaaccggcagucguaauaggccgguuccagggacucgccggcuuuguauuuggagaacaggggguugacgaaguaggagcucaugcuggguacaugaaaacccgcggcccccuccccucuggcucacgaguaccccgcccaguacccccgaaacuccccuccccccgggaccgaaccccaggccagcuggcuccccgggacugggcugggcuggugggcugggggcugggcagguuggggggcgccucggugcugagcucggccggaucagcagagcucccggggcuggggcgcgggcggcggcggcggcgggcggcgagcgggcggcggcggcggcggcggcgcuccucacugucgguagg

SEQ ID NO: 21165 - RNA, 429 nt, Homo sapiens
agugagggagacaggcuugcaccccuccagcacaggcugcuucugucccugucccgagagcauccccaggcacaugucagcucugccccuucuggggucuccgaggggagcagguccagcagaaaugggaaggggcuggccgggcccucuaagcagagaggagggauggggguggcuugccuacuuaccagcagcucggcgcccgcccgccguggacaagagggagccugagaggaggacgagggacggcucaaggcugcagcaugaguguggcucgccuaagcugucccgguauuuaaacuaucccgggcgugagucacugcagagggcaguguuggcccugggaggggggacugugggccacagugcagugccugcaugucccgggcugacacuacaggguacacauagcuggcaucccuaaaugua

SEQ ID NO: 21166 - RNA, 429 nt, Homo sapiens
uacauuuagggaugccagcuauguguacccuguagugucagcccgggacaugcaggcacugcacuguggcccacaguccccccucccagggccaacacugcccucugcagugacucacgcccgggauaguuuaaauaccgggacagcuuaggcgagccacacucaugcugcagccuugagccgucccucguccuccucucaggcucccucuuguccacggcgggcgggcgccgagcugcugguaaguaggcaagccacccccaucccuccucucugcuuagagggcccggccagccccuucccauuucugcuggaccugcuccccucggagaccccagaaggggcagagcugacaugugccuggggaugcucucgggacagggacagaagcagccugugcuggaggggugcaagccugucucccucacu

SEQ ID NO: 21167 - RNA, 1466 nt, Homo sapiens
auaugugggggaaaaguucguuuaccucugccccgcaggggaauuaaaacgcuggugaagaaaggcaacaggcaaggcuuauauaaggaaacaguaguaggcugcacugaaguccucaaacacaacaaaaagcucuuagguugcaaauguuaaccuugauucuuuuacccuuuugaaaaauucaaugggaugguuggaaaaaaaaaaaaccacagacacacacacacacacacgcaaccuucuaacguaauacccaggcaguccgauaauuuauaguacaacguguaacacugggauccaacuuuucacccagcaaaaucuccuuacaaauuagggcaacauauaccacaaagccaauggaaaaaaaaagaaaaccucgauugaauugcaaacacagcuuuucaauugacauuaaaacaacuaaccuuuaccuuaugacugagcacuaaaaaucaaaaguauuacauaugaaagugagaauaacuacauaaaaugucuauuuucaucaaauaagucuaauuuagacuccaauacaguauuaacagcucaaacuuugacggugaacaauccuuuuccaccuuaaugcaguguaggaagaauagcacacauuaaaguuuguuacgaaaauagaguuuauuaaaaacaucccuauuguuuugaggagcuuucaccguuaccuugucuuaaauuaaaaaaaaaaaaaaaaauagagagcacuucuaauuacgauuuguaaacuuuuuaaagucaaaacuuuuaaaaaguuacagcaaaaaggguaauauuuauucauauuuucaguauuuuuuguuauuuuguggcuauuuuuaaauagaagggaagcaaucaaauugcuuacaguuccccaccagcuggcgcggggcugcaguacagcgggagcggauauaauacagcaucuguacaccucaagcucuacacuccaggaagugucacugucacauuuucacaaauuccagucucuaacgaggagccucugcugcugagccagaauccuuuucggguucaacggaugagguagccucagcagguaacucuucagaaggcuuuaggacugcagccucagacacccccuucucaaguucugaagcagugucuacauuucccacuuggcuaaugggagguucaacgguuuuguuaccaccugcccugucugucaccucaggcuuuuccuuuccucgggcuucuuccuucucucuacgagacucucuaucucuagaaucucucucucugucucgaugcccacuagagcgucuauuucucucuuccaagucucugugccugucccggucagggcuccuccuuccccacucucuccugucacgguuacuauuaucucuaucaucauuacgguucccauaccguucccggucauuuuccacccuauuuccaaaagaucuucuuccaaaccuuucuuggucucuaccugaauugaacugcugccuguu

SEQ ID NO: 21168 - RNA, 1466 nt, Homo sapiens
aacaggcagcaguucaauucagguagagaccaagaaagguuuggaagaagaucuuuuggaaauaggguggaaaaugaccgggaacgguaugggaaccguaaugaugauagagauaauaguaaccgugacaggagagaguggggaaggaggagcccugaccgggacaggcacagagacuuggaagagagaaauagacgcucuagugggcaucgagacagagagagagauucuagagauagagagucucguagagagaaggaagaagcccgaggaaaggaaaagccugaggugacagacagggcaggugguaacaaaaccguugaaccucccauuagccaagugggaaauguagacacugcuucagaacuugagaagggggugucugaggcugcaguccuaaagccuucugaagaguuaccugcugaggcuaccucauccguugaacccgaaaaggauucuggcucagcagcagaggcuccucguuagagacuggaauuugugaaaaugugacagugacacuuccuggaguguagagcuugagguguacagaugcuguauuauauccgcucccgcuguacugcagccccgcgccagcugguggggaacuguaagcaauuugauugcuucccuucuauuuaaaaauagccacaaaauaacaaaaaauacugaaaauaugaauaaauauuacccuuuuugcuguaacuuuuuaaaaguuuugacuuuaaaaaguuuacaaaucguaauuagaagugcucucuauuuuuuuuuuuuuuuuuaauuuaagacaagguaacggugaaagcuccucaaaacaauagggauguuuuuaauaaacucuauuuucguaacaaacuuuaaugugugcuauucuuccuacacugcauuaagguggaaaaggauuguucaccgucaaaguuugagcuguuaauacuguauuggagucuaaauuagacuuauuugaugaaaauagacauuuuauguaguuauucucacuuucauauguaauacuuuugauuuuuagugcucagucauaagguaaagguuaguuguuuuaaugucaauugaaaagcuguguuugcaauucaaucgagguuuucuuuuuuuuuccauuggcuuugugguauauguugcccuaauuuguaaggagauuuugcugggugaaaaguuggaucccaguguuacacguuguacuauaaauuaucggacugccuggguauuacguuagaagguugcgugugugugugugugugucugugguuuuuuuuuuuuccaaccaucccauugaauuuuucaaaaggguaaaagaaucaagguuaacauuugcaaccuaagagcuuuuuguuguguuugaggacuucagugcagccuacuacuguuuccuuauauaagccuugccuguugccuuucuucaccagcguuuuaauuccccugcggggcagagguaaacgaacuuuucccccacauau

SEQ ID NO: 21169 - RNA, 242 nt, Homo sapiens
cccccggguugggggccuccuucuucugugucuuaugaggaaaccacccaagcccacccuccgugucuccugucauuucagccucacgguccagggccgaguggccacccaggacagacacagaccugacaagucaccagccuuccuggguuucugucacuguuuuucaaagaccccaagcuguuuuguuuaaugaugucguccuccuucucagcaccuguccacgccuguugccaugagua

SEQ ID NO: 21170 - RNA, 242 nt, Homo sapiens
uacucauggcaacaggcguggacaggugcugagaaggaggacgacaucauuaaacaaaacagcuuggggucuuugaaaaacagugacagaaacccaggaaggcuggugacuugucaggucugugucuguccuggguggccacucggcccuggaccgugaggcugaaaugacaggagacacggagggugggcuugggugguuuccucauaagacacagaagaaggaggcccccaacccggggg

SEQ ID NO: 21171 - RNA, 1193 nt, Homo sapiens
aggccugaacucagccauguaaaaucaaccuaacacuuaaguuuuaagaaagucauuacauuucaaaaaauuuuccucuuuauuuaaacauaaaacgcauuuacaacaugcaaguuaacuuaaaauuaaacggugucuucccaaaccaaguauuugugaauguaucuucaagcacugaaaauaaaccaacauauuccacagguagacucagacucucuucugucaccucaugucaaauggaguuaagcacaaacugagaguuacgcacaguaguuuucuuaaguuaggcaaauaauuuaauuaaucgccaugaauaaauauucucuuuauuucauugaguuucucuucugaaccaucuaucaaugccauucagaggaacguuaauauauccagucaaaaagacacugcaaauugaaaugugucaauauccuagaugaucagaaauuuucauuuuuaagaguaagugcuguguuuaaugaccuaccauagcaaaaagcaguucacugaaaacaaauuuaugaaauucuugguacacuuuaugaaagucugaaauuauaaauagaaaagaaccaucaagauacuuuuuaaaaaccuaacauuguauauucugaaccacaugcuaauuaaaauucguuguucauuacacagcaccaauacccaugauacaucuuacaagaacaaaacuaacauauuuggaaaaaagagaaaaaaaaauucugcuucauuuacgaauguugccaaaggaggcaaguuuucaacugaaaacaaaacauaaaggucuauguggaugcagccaaauguuucuccauuuagaaaaucaucauaaaagguggcagcacuuuuuuugcuuguuaacuauauuacuuauaacuggcugcaccaacauuucaucucaauuuuuggaguguuucuucugaucaauccuaaaagcaacacaaucauuuuagagguugcagacuacaacagcaaagauuuuugacuauuaaaaaaauaaauaaauaaauuuauauuuuaaaucaaaauuauuacaaaaguggaaauuacaauaguuacggaaauagaaaaauaagccaauuaugaucugagucuucugacuauggcuccaaauuuaauacaaauaucuguguauaaaacuuuugcaaaaaguuaauucugccagcaagauccuaacacagaacuuuccaaguuucucu

SEQ ID NO: 21172 - RNA, 1193 nt, Homo sapiens
agagaaacuuggaaaguucuguguuaggaucuugcuggcagaauuaacuuuuugcaaaaguuuuauacacagauauuuguauuaaauuuggagccauagucagaagacucagaucauaauuggcuuauuuuucuauuuccguaacuauuguaauuuccacuuuuguaauaauuuugauuuaaaauauaaauuuauuuauuuauuuuuuuaauagucaaaaaucuuugcuguuguagucugcaaccucuaaaaugauuguguugcuuuuaggauugaucagaagaaacacuccaaaaauugagaugaaauguuggugcagccaguuauaaguaauauaguuaacaagcaaaaaaagugcugccaccuuuuaugaugauuuucuaaauggagaaacauuuggcugcauccacauagaccuuuauguuuuguuuucaguugaaaacuugccuccuuuggcaacauucguaaaugaagcagaauuuuuuuuucucuuuuuuccaaauauguuaguuuuguucuuguaagauguaucauggguauuggugcuguguaaugaacaacgaauuuuaauuagcaugugguucagaauauacaauguuagguuuuuaaaaaguaucuugaugguucuuuucuauuuauaauuucagacuuucauaaaguguaccaagaauuucauaaauuuguuuucagugaacugcuuuuugcuaugguaggucauuaaacacagcacuuacucuuaaaaaugaaaauuucugaucaucuaggauauugacacauuucaauuugcagugucuuuuugacuggauauauuaacguuccucugaauggcauugauagaugguucagaagagaaacucaaugaaauaaagagaauauuuauucauggcgauuaauuaaauuauuugccuaacuuaagaaaacuacugugcguaacucucaguuugugcuuaacuccauuugacaugaggugacagaagagagucugagucuaccuguggaauauguugguuuauuuucagugcuugaagauacauucacaaauacuugguuugggaagacaccguuuaauuuuaaguuaacuugcauguuguaaaugcguuuuauguuuaaauaaagaggaaaauuuuuugaaauguaaugacuuucuuaaaacuuaaguguuagguugauuuuacauggcugaguucaggccu

SEQ ID NO: 21173 - RNA, 1698 nt, Homo sapiens
augacaaaaaaaucaauaccgauguuaacaucuuaugcauaaauucucgcuacauuuaauauuucuaucccaaacuauauuuuguaaugccauucuuuuaucccuuauuugaaauaacuuauuuauaugaacaaaaauucuuaaaaggaaagccccccacugaaaccaagucccuuaaaggacacuggaaaguuuauugagaccuguagaaucugaacaucauuaagucagacaucauguuugaguucacuucuuacuguaacagguucugcagaacucuuuucacaaaaaccuaugaaggacagauacaguugccaggccaaguccucacccagcugcugugcccagcucagaccugccacagugcacagagacagcagcugccagauuaagaagcucauuuugagguugaucacugcugagaagagugacagacaggaccuuuagccccuucacauaugcaaacuuaguaagaaaaucuaacaggaaaacaggcagggagccugcugacuuggagguacgaacuccagccccaccacugugacugcaagcacuccugggcaucuccccagcccuguuugggugcaacagcucuagcagggcgcugcauucaauaacagcaagucagcaccuuaaccaagcuguuugcaggccuuggcuugaaauccaugcagcuaaagacauaacacccugggagggugaggcaggaggagcacuugaagcugggaguugaagaccggcaugggcaacacagcaagaccccauuucuauagaaaauuuaaaaauuagccuggccaggagcaguggcucacgccuguaaucccagcacuuugggaggcugaggccggcggaucacuugaggucaggaguuugaggccagcccggcaaacauggugaaaccccaucucuaugaaaaauacaaaaauuagucaggugugguggugugugccugcaguuccagauacuugggaggcugagacaggagaaucaguugaaccugugaggcagagguugcagugagcugagauugcaccaccgcacuuccagccugggcgacagagugagacuccaucucaaaaaaaaaaaaacaaguaaauuaggugggcaugguggcacaggcccaucgucccagggaggcugaggcgggaggaucacuugagcccaggaguuggaggcuacagugagcuaugauugugccacugcacaccaggcagagugacaaagugagacucuguuuaaaaauauauauauauuuaaaaauaaauauauauauaaaacccaaguuaaguauccuguuccugucucagugcaagagcauguuucuuguuuccuucucuuuuucaacaaggguaggaccucaucauggcugacuuuucagaagauaaugucuuuaagacccacccaagaugcugacuccaaugacaucaagggagauaaagugguuucagacaaaaugggguaucaauaugaaagugacauguucuauuaggucucuauugugcaacuucucaauugcuggaguagcucucauacuuuugugagucgcucaagaacacagggccaauaccacuuucuaccacugcucuugcaaagaacugguucacucagcauccauaaaaccuguugaauuuuaucucaauauacuaacucaaaaaacacagcaggaaggcaggcacuacuuuguucuauguauauauu

SEQ ID NO: 21174 - RNA, 1698 nt, Homo sapiens
aauauauacauagaacaaaguagugccugccuuccugcuguguuuuuugaguuaguauauugagauaaaauucaacagguuuuauggaugcugagugaaccaguucuuugcaagagcagugguagaaagugguauuggcccuguguucuugagcgacucacaaaaguaugagagcuacuccagcaauugagaaguugcacaauagagaccuaauagaacaugucacuuucauauugauaccccauuuugucugaaaccacuuuaucucccuugaugucauuggagucagcaucuugggugggucuuaaagacauuaucuucugaaaagucagccaugaugagguccuacccuuguugaaaaagagaaggaaacaagaaacaugcucuugcacugagacaggaacaggauacuuaacuuggguuuuauauauauauuuauuuuuaaauauauauauauuuuuaaacagagucucacuuugucacucugccuggugugcaguggcacaaucauagcucacuguagccuccaacuccugggcucaagugauccucccgccucagccucccugggacgaugggccugugccaccaugcccaccuaauuuacuuguuuuuuuuuuuuugagauggagucucacucugucgcccaggcuggaagugcgguggugcaaucucagcucacugcaaccucugccucacagguucaacugauucuccugucucagccucccaaguaucuggaacugcaggcacacaccaccacaccugacuaauuuuuguauuuuucauagagaugggguuucaccauguuugccgggcuggccucaaacuccugaccucaagugauccgccggccucagccucccaaagugcugggauuacaggcgugagccacugcuccuggccaggcuaauuuuuaaauuuucuauagaaauggggucuugcuguguugcccaugccggucuucaacucccagcuucaagugcuccuccugccucacccucccaggguguuaugucuuuagcugcauggauuucaagccaaggccugcaaacagcuugguuaaggugcugacuugcuguuauugaaugcagcgcccugcuagagcuguugcacccaaacagggcuggggagaugcccaggagugcuugcagucacagugguggggcuggaguucguaccuccaagucagcaggcucccugccuguuuuccuguuagauuuucuuacuaaguuugcauaugugaaggggcuaaagguccugucugucacucuucucagcagugaucaaccucaaaaugagcuucuuaaucuggcagcugcugucucugugcacuguggcaggucugagcugggcacagcagcugggugaggacuuggccuggcaacuguaucuguccuucauagguuuuugugaaaagaguucugcagaaccuguuacaguaagaagugaacucaaacaugaugucugacuuaaugauguucagauucuacaggucucaauaaacuuuccaguguccuuuaagggacuugguuucaguggggggcuuuccuuuuaagaauuuuuguucauauaaauaaguuauuucaaauaagggauaaaagaauggcauuacaaaauauaguuugggauagaaauauuaaauguagcgagaauuuaugcauaagauguuaacaucgguauugauuuuuuugucau

SEQ ID NO: 21175 - RNA, 789 nt, Homo sapiens
acgcuguugguacacaagguguuccccgguuucuccaucaaggcuuucgacuacgagaaggcguacagccugcagcggcccaaugaccacgaguuuaugcagcagccguggacgggcuuuaccgugcagaucagcuuugugaagggcuggggccagugcuacacccgccaguucaucagcagcugcccgugcuggcuagaggucaucuucaacagccgguagccgcgugcggaggggacagagcgugagcugagcaggccacacuucaaacuacuuugcugcuaauauuuuccuccugagugcuugcuuuucaugcaaacucuuuggucguuuuuuuuuuguuuguugguugguuuucuucuucucguccucguuuguguucuguuuuguuucgcucuuugagaaauagcuuaugaaaagaauuguuggggguuuuuuuggaagaaggggcagguaugaucggcaggacacccugauaggaagaggggaagcagaaauccaagcaccaccaaacacaguguaugaaggggggcggucaucauuucacuugucaggagugugugugagugugagugugcggcugugugugcacgcgugugcaggagcggcagauggggagacaacgugcucuuuguuuugugucucuuauggauguccccagcagagagguuugcagucccaagcggugucucuccugccccuuggacacgcucaguggggcagaggcaguaccugggcaagcuggcggcuggggucccagcagcugccaggagcacggcucugucccca

SEQ ID NO: 21176 - RNA, 789 nt, Homo sapiens
uggggacagagccgugcuccuggcagcugcugggaccccagccgccagcuugcccagguacugccucugccccacugagcguguccaaggggcaggagagacaccgcuugggacugcaaaccucucugcuggggacauccauaagagacacaaaacaaagagcacguugucuccccaucugccgcuccugcacacgcgugcacacacagccgcacacucacacucacacacacuccugacaagugaaaugaugaccgccccccuucauacacuguguuugguggugcuuggauuucugcuuccccucuuccuaucaggguguccugccgaucauaccugccccuucuuccaaaaaaacccccaacaauucuuuucauaagcuauuucucaaagagcgaaacaaaacagaacacaaacgaggacgagaagaagaaaaccaaccaacaaacaaaaaaaaaacgaccaaagaguuugcaugaaaagcaagcacucaggaggaaaauauuagcagcaaaguaguuugaaguguggccugcucagcucacgcucuguccccuccgcacgcggcuaccggcuguugaagaugaccucuagccagcacgggcagcugcugaugaacuggcggguguagcacuggccccagcccuucacaaagcugaucugcacgguaaagcccguccacggcugcugcauaaacucguggucauugggccgcugcaggcuguacgccuucucguagucgaaagccuugauggagaaaccggggaacaccuuguguaccaacagcgu

SEQ ID NO: 21177 - RNA, 626 nt, Homo sapiens
agucaaauuaaauagacgugaguggauggaaagacguaccuuauucuugcauaagaagacaacggcaugaagacaucacagggaagguuaagguaaacaugcagccuggaauagccaggagaauucuggaaaaguagaauaaugagguagggcuucccuucgcuauuuugaagugcagauuacacuauguaaaaccauuaggaacuggcacgugaauagacagaucaauaguuaauagcuguauuagccagaaaaugguguaaggacaacaggcuaacuaacccugucacuuguuaugcuaaaauuaagucuagauagaguccuccaaaauaaaaauaaaaagaguuaggagaaaacaugggguuuaacaacaacaacaaaaucuucagcuggauuagccuuuucaaacuacucacaaaauccaggaaccauaaaagaaaauuaguauauauauauguauauauauauguauauauauauauauacauauauauauauauacauauauauauaaacuaaagagcaaaauauuacaauaaaacuuaaagauuagugagaaauaggaauguauuugaaaaggguuaauuuccuuaauauguaaagagcucuuauuauuaaucaguaag

SEQ ID NO: 21178 - RNA, 626 nt, Homo sapiens
cuuacugauuaauaauaagagcucuuuacauauuaaggaaauuaacccuuuucaaauacauuccuauuucucacuaaucuuuaaguuuuauuguaauauuuugcucuuuaguuuauauauauauguauauauauauauauguauauauauauauauacauauauauauacauauauauauacuaauuuucuuuuaugguuccuggauuuugugaguaguuugaaaaggcuaauccagcugaagauuuuguuguuguuguuaaaccccauguuuucuccuaacucuuuuuauuuuuauuuuggaggacucuaucuagacuuaauuuuagcauaacaagugacaggguuaguuagccuguuguccuuacaccauuuucuggcuaauacagcuauuaacuauugaucugucuauucacgugccaguuccuaaugguuuuacauaguguaaucugcacuucaaaauagcgaagggaagcccuaccucauuauucuacuuuuccagaauucuccuggcuauuccaggcugcauguuuaccuuaaccuucccugugaugucuucaugccguugucuucuuaugcaagaauaagguacgucuuuccauccacucacgucuauuuaauuugacu

SEQ ID NO: 21179 - RNA, 767 nt, Homo sapiens
aaaaauugcugaaacaacuuaaugguuccccaaaaagggaauggguaauucaaacacggcuaccacacagauguugaaaagaccaaggcagacaugaauacagauaugcggugcuuaccuagauguacuaguaacucaacaguccacagugcaagacaggcugugugguguacccacgccuguacagcuuuacacauacacagguucucuggaaagaaacugcagcaacuggccaugacgguggccucugugggaagggaggcuggggguuagagaaagaugccacugaaucacccacaggguuugaaguucaaacaugugcagguauggcuuugaacaguuuucacacaucuauucauaggugaaauuaacuggaaggaaacuagcaaagcauuugccuuuggggucagcacaggagcagaggcccaggcagggccuugcuuugacacacagaugaugggucacacaguugucaccuugacagaagaguaacagggacagcacaccagucacucuaggagcugaggccagaggaacucagguauuuccuucuagagguaguaaguccaccgaggcagaugccaagccggguggugccucgcuguguacaauguucugcucccugugccccuaugagugacccuaugagguaagagccagagccgggcucacaccugagcuccuggcauguggcggcccuuuagaagacagaaagugugugcuuagccccugaagcagccacgcugugcccagcggagggcaggcgc

SEQ ID NO: 21180 - RNA, 767 nt, Homo sapiens
gcgccugcccuccgcugggcacagcguggcugcuucaggggcuaagcacacacuuucugucuucuaaagggccgccacaugccaggagcucaggugugagcccggcucuggcucuuaccucauagggucacucauaggggcacagggagcagaacauuguacacagcgaggcaccacccggcuuggcaucugccucgguggacuuacuaccucuagaaggaaauaccugaguuccucuggccucagcuccuagagugacuggugugcugucccuguuacucuucugucaaggugacaacugugugacccaucaucugugugucaaagcaaggcccugccugggccucugcuccugugcugaccccaaaggcaaaugcuuugcuaguuuccuuccaguuaauuucaccuaugaauagaugugugaaaacuguucaaagccauaccugcacauguuugaacuucaaacccugugggugauucaguggcaucuuucucuaacccccagccucccuucccacagaggccaccgucauggccaguugcugcaguuucuuuccagagaaccuguguauguguaaagcuguacaggcguggguacaccacacagccugucuugcacuguggacuguugaguuacuaguacaucuagguaagcaccgcauaucuguauucaugucugccuuggucuuuucaacaucugugugguagccguguuugaauuacccauucccuuuuuggggaaccauuaaguuguuucagcaauuuuu

SEQ ID NO: 21181 - RNA, 3763 nt, Homo sapiens
caccuucauuggcuugagugguuucaucacauuucaaaccaaugauuaccaacucucaacagagagcagaucccauccccacucagcagucugcagaccacuugggauaauaccaguucuaucugugguuaccaugcucuccuacauggccuuaauuacuuggagcuagcaaaucuagaccuaaaucuacaauaugaagauacauccaaagucguuaugaaggcaaugugauaggggucgagaaauguaacauagcaauacaacaauucuaaugaguuuagaacucaaacuuuauuugugcuguaaaggggaagaaaagugauuaguaauuauguacaugacguaacagaauuaguucuuaccauacagagcaacauaccaguacuuucaaccaucuacuuuuacaguuucaauuucacaacagcauacccgagacuacuuccccauacaugcgugacuaauacacucuaaaucccaacgacaguaauuguuugcaucauccccaagucauugguuaagaacugaacuaccaugucaacauauuuuuaaacauuuaaaaaauggaacccagaagacagaaagaucccaacgauaaaaauaaccaugauuuuuaaaauuucaagugaaacuuaaagggaagaaggaaaugauaaaaagccauugguauuacuuuaccaauucaauagacgcagcucagaaccaagcaggguuuucagaucacacauguaguaaaggcaccucgcccacucucuccccacaauccccauccccuucccuuuuuaggucuuguuuuccaaacugauuuuaggugauaguuuccccucuagucuuggcucauuuaaaaagcacaaacauucaaauuaaaaauacaauaaauuauucauucuaaccuuagcaaagguacauggauucugucuaccaaauauuaauuuuacagugaccacaaaagguuauuugguuguuacaaagacuacaauuugaagauacuagauaggcaaaaauuuugccauuauuaauaucgaccaaacacagaaaagacaacagauguguuucuaaggcacgauuuacauacuaaauucccuugaaauucaaugcaauuucacuucgcucaugauuuucaaucacaagacaccugugacaaaugaggaacaaauccagaagagcccaucuaaucucgucuuaaguggucccuuaaauacguuaaaagcccacaauauaggcauuuacaaggcuuuucuaagacuuccagcuccugaaaaaaucacaccuucacaguuucaaaucaaccaccuaaguugcuaaggggcagcgaaggaugcugaucugcugcguaugcaagucugacgcccaucuuucaagugacuaauucacuugauaacacccacaccccaaacaaaacaacccucugaaacaggcugucuuggccaccaggaggaagcugguaaagacauuuccccugccugugagauggcaucacacaccccucccuuugguucucggaaaacuggugacucugugucaccuguuuucaguuaacacuucuucagucuuccccaccuuguagcaaagcaaaacaauuuuuguuuguuaguuugucuguuugcacuuaaaguucuaagcacuuuggaaaguuucuaagcaacuucucacuuccaagcaacaacuuaaccaacacuaacaacuuacuauuauuaauuaguauuuucuuggcucacccacgcacuaaauuccccaaagccccagagaauucccuucaaccugcauuuccuaccacccccaccacccacacuguaucucuaaccaacccucuccccuucuucacccucaucccucccaguaccagugccaagcugcauacccccaucccccacacugcaacgcccacgggaccggugccaagcuguccccuucuccccgucccccacaacucccaccucaggguccucuuacuagaaugccaagaaaguauuaugaaaucuaacgaaguaaaguucaaguuuaaaaaaacgaagcaagaacaaaagagcacuaccgguguacccaccauucccuucuccuaguaaucugcaaugcaaucacaaugcccaaacuagaccugccauuucucacacacagauuuaggaaugaccaacuuguacccucccagcguuuagcacaacacaaugacacccuuaauuugacaaucugcuuccucuaauauauccccagucuaaggcauuuaaaauuaaacagcucuucaacgccccaaguuauuucaucaggcuaagaacuucuccgagaaacgcacaagaaggcaggcaaacagguggguaggugagaggucacggggcuccaucugcaagcuccaucuacaaggcaucaaucugcguuguggcaucaacguuaaaauguucuacagcuuagggaucuucuugaagcaagguuccaagcacaaaacuaguaugaccggaggcucaauuuagaagaugcagcaucugaaaaccuuuaccccaggaaaggaggggugccugcuggcauucaugggcucuggaacaagcauuuauucaaagcugauggccccucgagccggaugcaucugcuguggacuuuuuaagauugccccccauaagcucaucugcaaacuuuaaaugguagccuccugaauacagggcuuccugagcaaggccuggaaacagaacauuggagaacuuccuccuccuaagccucuggaaauucaaucugcaggcaucaauugaggcgggcucucuccuccagggucuccccuccugcaaugcuaggacucacacuggccagggacuccaugucucccgguuccaucugcucgccaugaggaacacuauaguaacaaaccacgguccaugaagcauuuuuguaacuuucagcuggauggcugcaggcccacccaagggugcacauucacuccccacccucucugcaggcaagcaacaccgauccgccccaccccagccucagcgggaaggccucucuuccuccaccauuaccaacaauaccgacuccaacagccacucggcuuacugucccgggcuuaccagaugaccagguaauguuuuaagugaauggauaaguuaaagggaggaagaagggguggagugagcucacaagaagaguuuagcgccaaaccuagagaaaaguccaaaaggagcacugccaccuggaaaauaaagcguuggucaauguuguccccaacacccgagcagcgugccucgcaguccccgccugucaaacaugcuaggugccgcaccagucaccggugaggauggcgccuuaacuccacaucacuccucagaccaccccucaccuccgcccaggggccuggcuucgcacccagaccuggacgcuccaccaggcugggcccggccugggccccgucccaggccgagcgaaaauuacauaccacccugggccagagcggucagccccgucgagcuaaguucaguuccacaagaccaggccucauccccaggcggguucacagcccuuggucuggaaaaaaaggggcugcuggcauggacaaguugaagauuagcccucccggcccuccugcagcccugcacccacugccugccuuccugaucauuuccagggcugcugcggccuauuccuccugacuccuccaccccuucuaccucucccugccuuccuccuuccacacagaccagcgcacccgggcucgcucagcuaugcaagagcggcgcccucccagaggucaaguucccccuccaccaggcaguagggacagccu

SEQ ID NO: 21182 - RNA, 3763 nt, Homo sapiens
aggcugucccuacugccugguggagggggaacuugaccucugggagggcgccgcucuugcauagcugagcgagcccgggugcgcuggucuguguggaaggaggaaggcagggagagguagaagggguggaggagucaggaggaauaggccgcagcagcccuggaaaugaucaggaaggcaggcagugggugcagggcugcaggagggccgggagggcuaaucuucaacuuguccaugccagcagccccuuuuuuuccagaccaagggcugugaacccgccuggggaugaggccuggucuuguggaacugaacuuagcucgacggggcugaccgcucuggcccagggugguauguaauuuucgcucggccugggacggggcccaggccgggcccagccugguggagcguccaggucugggugcgaagccaggccccugggcggaggugagggguggucugaggagugauguggaguuaaggcgccauccucaccggugacuggugcggcaccuagcauguuugacaggcggggacugcgaggcacgcugcucggguguuggggacaacauugaccaacgcuuuauuuuccagguggcagugcuccuuuuggacuuuucucuagguuuggcgcuaaacucuucuugugagcucacuccaccccuucuuccucccuuuaacuuauccauucacuuaaaacauuaccuggucaucugguaagcccgggacaguaagccgaguggcuguuggagucgguauuguugguaaugguggaggaagagaggccuucccgcugaggcugggguggggcggaucgguguugcuugccugcagagaggguggggagugaaugugcacccuugggugggccugcagccauccagcugaaaguuacaaaaaugcuucauggaccgugguuuguuacuauaguguuccucauggcgagcagauggaaccgggagacauggagucccuggccagugugaguccuagcauugcaggaggggagacccuggaggagagagcccgccucaauugaugccugcagauugaauuuccagaggcuuaggaggaggaaguucuccaauguucuguuuccaggccuugcucaggaagcccuguauucaggaggcuaccauuuaaaguuugcagaugagcuuauggggggcaaucuuaaaaaguccacagcagaugcauccggcucgaggggccaucagcuuugaauaaaugcuuguuccagagcccaugaaugccagcaggcaccccuccuuuccugggguaaagguuuucagaugcugcaucuucuaaauugagccuccggucauacuaguuuugugcuuggaaccuugcuucaagaagaucccuaagcuguagaacauuuuaacguugaugccacaacgcagauugaugccuuguagauggagcuugcagauggagccccgugaccucucaccuacccaccuguuugccugccuucuugugcguuucucggagaaguucuuagccugaugaaauaacuuggggcguugaagagcuguuuaauuuuaaaugccuuagacuggggauauauuagaggaagcagauugucaaauuaagggugucauuguguugugcuaaacgcugggaggguacaaguuggucauuccuaaaucugugugugagaaauggcaggucuaguuugggcauugugauugcauugcagauuacuaggagaagggaaugguggguacaccgguagugcucuuuuguucuugcuucguuuuuuuaaacuugaacuuuacuucguuagauuucauaauacuuucuuggcauucuaguaagaggacccugaggugggaguugugggggacggggagaaggggacagcuuggcaccggucccgugggcguugcagugugggggauggggguaugcagcuuggcacugguacugggagggaugagggugaagaaggggagaggguugguuagagauacaguguggguggugggggugguaggaaaugcagguugaagggaauucucuggggcuuuggggaauuuagugcgugggugagccaagaaaauacuaauuaauaauaguaaguuguuaguguugguuaaguuguugcuuggaagugagaaguugcuuagaaacuuuccaaagugcuuagaacuuuaagugcaaacagacaaacuaacaaacaaaaauuguuuugcuuugcuacaagguggggaagacugaagaaguguuaacugaaaacaggugacacagagucaccaguuuuccgagaaccaaagggaggggugugugaugccaucucacaggcaggggaaaugucuuuaccagcuuccuccugguggccaagacagccuguuucagaggguuguuuuguuugggguguggguguuaucaagugaauuagucacuugaaagaugggcgucagacuugcauacgcagcagaucagcauccuucgcugccccuuagcaacuuaggugguugauuugaaacugugaaggugugauuuuuucaggagcuggaagucuuagaaaagccuuguaaaugccuauauugugggcuuuuaacguauuuaagggaccacuuaagacgagauuagaugggcucuucuggauuuguuccucauuugucacaggugucuugugauugaaaaucaugagcgaagugaaauugcauugaauuucaagggaauuuaguauguaaaucgugccuuagaaacacaucuguugucuuuucuguguuuggucgauauuaauaauggcaaaauuuuugccuaucuaguaucuucaaauuguagucuuuguaacaaccaaauaaccuuuuguggucacuguaaaauuaauauuugguagacagaauccauguaccuuugcuaagguuagaaugaauaauuuauuguauuuuuaauuugaauguuugugcuuuuuaaaugagccaagacuagaggggaaacuaucaccuaaaaucaguuuggaaaacaagaccuaaaaagggaaggggauggggauuguggggagagagugggcgaggugccuuuacuacaugugugaucugaaaacccugcuugguucugagcugcgucuauugaauugguaaaguaauaccaauggcuuuuuaucauuuccuucuucccuuuaaguuucacuugaaauuuuaaaaaucaugguuauuuuuaucguugggaucuuucugucuucuggguuccauuuuuuaaauguuuaaaaauauguugacaugguaguucaguucuuaaccaaugacuuggggaugaugcaaacaauuacugucguugggauuuagaguguauuagucacgcauguauggggaaguagucucggguaugcuguugugaaauugaaacuguaaaaguagaugguugaaaguacugguauguugcucuguaugguaagaacuaauucuguuacgucauguacauaauuacuaaucacuuuucuuccccuuuacagcacaaauaaaguuugaguucuaaacucauuagaauuguuguauugcuauguuacauuucucgaccccuaucacauugccuucauaacgacuuuggauguaucuucauauuguagauuuaggucuagauuugcuagcuccaaguaauuaaggccauguaggagagcaugguaaccacagauagaacugguauuaucccaaguggucugcagacugcugaguggggaugggaucugcucucuguugagaguugguaaucauugguuugaaaugugaugaaaccacucaagccaaugaaggug

SEQ ID NO: 21183 - RNA, 937 nt, Homo sapiens
gguucaauucagaucucuuuaagagcccccaggguccugcuaccacagguuggugucuugauacugguuacauaacaaucaguccccaaagcucugacaucacccacugaagauucucaccagccuggacagccaaaggggucuguguguggccggggaggauggcgggggagugagccccauggaacagccaggaacugguaaggggagguagggcacagaucccaguaaaugaugguaaaugguggugaccccgagaggaaaguggaaguauuuggguuuuuaaacuucccccuaaauucccacaagauuucauuguugcccccacacuuccccucuuccccacauagggaauuuccgauuucacuucccaauacgcaaguggccagagagccucaacuuccuccucaugcccucccugccuugccccagcuauagccuuuguggggaagccuucucuucucccgcgcgaguccggugucacccauguccucccucgcuugcgucccucucccauucccaccccgucggccugaggggaggucaggccucucgcugcccauuuuucuuuccccagucaccagcccgccccggauucucuacucccucagcuugcucugcuaccacuuuccugucucucccucucccaaagcagauaaaagaugaggggacaaagacagugugugucugggaagcugggcugagaggaggaggugccgccgccuggggguacuccgaugcuuccggggauuccgagccagcuggaggaccgcacguggcgaacggcgggcgcggcgcguagucagggaaccagggugccugacugggugucucguggagccaucccgcgggggugugggggggccacggugccggaaggcgcgcggcccagaggccgucuccgccgaacgcccgcuccucgccuuccuaaccgcag

SEQ ID NO: 21184 - RNA, 937 nt, Homo sapiens
cugcgguuaggaaggcgaggagcgggcguucggcggagacggccucugggccgcgcgccuuccggcaccguggcccccccacacccccgcgggauggcuccacgagacacccagucaggcacccugguucccugacuacgcgccgcgcccgccguucgccacgugcgguccuccagcuggcucggaauccccggaagcaucggaguacccccaggcggcggcaccuccuccucucagcccagcuucccagacacacacugucuuuguccccucaucuuuuaucugcuuugggagagggagagacaggaaagugguagcagagcaagcugagggaguagagaauccggggcgggcuggugacuggggaaagaaaaaugggcagcgagaggccugaccuccccucaggccgacggggugggaaugggagagggacgcaagcgagggaggacaugggugacaccggacucgcgcgggagaagagaaggcuuccccacaaaggcuauagcuggggcaaggcagggagggcaugaggaggaaguugaggcucucuggccacuugcguauugggaagugaaaucggaaauucccuauguggggaagaggggaagugugggggcaacaaugaaaucuugugggaauuuagggggaaguuuaaaaacccaaauacuuccacuuuccucucggggucaccaccauuuaccaucauuuacugggaucugugcccuaccuccccuuaccaguuccuggcuguuccauggggcucacucccccgccauccuccccggccacacacagaccccuuuggcuguccaggcuggugagaaucuucagugggugaugucagagcuuuggggacugauuguuauguaaccaguaucaagacaccaaccugugguagcaggacccugggggcucuuaaagagaucugaauugaacc

SEQ ID NO: 21185 - RNA, 188 nt, Homo sapiens
guuaaugaccugcagugagaucccuauugguggaaauuugaguuguuuuuacuacuuuuauauuacaaacaaugcugcaauaaauauuauuaggcuagugccccucuguacauauucaagcacuucuagaagauaaguuccuggaagcagcauuaaugaguuagcgguggcuacauaugccgugguga

SEQ ID NO: 21186 - RNA, 188 nt, Homo sapiens
ucaccacggcauauguagccaccgcuaacucauuaaugcugcuuccaggaacuuaucuucuagaagugcuugaauauguacagaggggcacuagccuaauaauauuuauugcagcauuguuuguaauauaaaaguaguaaaaacaacucaaauuuccaccaauagggaucucacugcaggucauuaac

SEQ ID NO: 21187 - RNA, 1017 nt, Homo sapiens
cccacucuuccacccaccacuccccgccaggccucccgagacaaacacacauauaaauauagcaauauauauuuauauuucccaggauugucacauuuugcugagcucauaacggaacugaacaaauagcccugucauccucuguaauauauucuaucauucaccggggcuucaucucucccuguccuccugggcuccuggagcucagaaauucaugugcucggcugcuucuucaaugugaucuguacuaaccugauguaauucucaggccuucauuuccugugcaaguugauagaauuuuuagaccagagggaccuccuaggucuggucaucuugcugagcaauugguuugcuacuucaaaaaucugcauuuuaaauaaaaaggaaugaacucugauaccuacaacaagaaggaugaaucucaaaaacaaaagagcuggacacaaaagaauacucaugguaugauuccauuuauuggaaauucuagaacaggcaaaauuaaucuauggugacagaaagcaagucagugguaccuggggcuggcaugggggcaacugcgaaagguaccaaagaacuauuggaaguugaaaaugucagcaucggcugggcgugguggcucacgccuguaaucccaacacuuugggaggccaaggcaggcagaacaugaggucaggaguucaagaccagccucaccaacauggugaaacccccucucuacuaaaaauacaaaaauuagccaggugugguggugcaugccuauaaucccagcuacucaagaggcugaggcaggagaaucgcuugaacccaggaagcggagguugcagugagcugagauggcgccauugcacuccagccugggauacagaacgagagaaagaaugagagaaagaaagaaagagagaaagaaaaagaaagaaagaaagaaagaaagaaagaaagaaagaaagaaagaaagaaagaaagaaagaaagaaagaaagaaagaaaagaaaagaaagaaagaggaaggaaggaagga

SEQ ID NO: 21188 - RNA, 1017 nt, Homo sapiens
uccuuccuuccuuccucuuucuuucuuuucuuuucuuucuuucuuucuuucuuucuuucuuucuuucuuucuuucuuucuuucuuucuuucuuucuuucuuucuuucuuuuucuuucucucuuucuuucuuucucucauucuuucucucguucuguaucccaggcuggagugcaauggcgccaucucagcucacugcaaccuccgcuuccuggguucaagcgauucuccugccucagccucuugaguagcugggauuauaggcaugcaccaccacaccuggcuaauuuuuguauuuuuaguagagaggggguuucaccauguuggugaggcuggucuugaacuccugaccucauguucugccugccuuggccucccaaaguguugggauuacaggcgugagccaccacgcccagccgaugcugacauuuucaacuuccaauaguucuuugguaccuuucgcaguugcccccaugccagccccagguaccacugacuugcuuucugucaccauagauuaauuuugccuguucuagaauuuccaauaaauggaaucauaccaugaguauucuuuuguguccagcucuuuuguuuuugagauucauccuucuuguuguagguaucagaguucauuccuuuuuauuuaaaaugcagauuuuugaaguagcaaaccaauugcucagcaagaugaccagaccuaggaggucccucuggucuaaaaauucuaucaacuugcacaggaaaugaaggccugagaauuacaucagguuaguacagaucacauugaagaagcagccgagcacaugaauuucugagcuccaggagcccaggaggacagggagagaugaagccccggugaaugauagaauauauuacagaggaugacagggcuauuuguucaguuccguuaugagcucagcaaaaugugacaauccugggaaauauaaauauauauugcuauauuuauauguguguuugucucgggaggccuggcggggagugguggguggaagaguggg

SEQ ID NO: 21189 - RNA, 382 nt, Homo sapiens
uuucgaaccgcgcugcggugccggagcauggggucgcuccggacgccgagcggcugcgacuaccugagcgcgaggugaccaaggagcacggugacccgggggacaccuggaaggauuacugcacacuggucaccaucgccaagagcuuguuggaccugaacaaguaccgacccauccagacccccuccgugugcagcgacagucuggaaaguccagaugaggauaugggauccgacagcgacgugaccaccgaaucugggucgaguccuucccacagcccggaggagagacaggauccuggcagcgcgcccagcccgcucucccuccuccauccuggaguggcugcgaaggggaaacacgccuccgaaaagaggcacaagug

SEQ ID NO: 21190 - RNA, 382 nt, Homo sapiens
cacuugugccucuuuucggaggcguguuuccccuucgcagccacuccaggauggaggagggagagcgggcugggcgcgcugccaggauccugucucuccuccgggcugugggaaggacucgacccagauucgguggucacgucgcugucggaucccauauccucaucuggacuuuccagacugucgcugcacacggagggggucuggaugggucgguacuuguucagguccaacaagcucuuggcgauggugaccagugugcaguaauccuuccaggugucccccgggucaccgugcuccuuggucaccucgcgcucagguagucgcagccgcucggcguccggagcgaccccaugcuccggcaccgcagcgcgguucgaaa

SEQ ID NO: 21191 - RNA, 1939 nt, Homo sapiens
uugauccuucuucuuauuuuaauuuuuguggguacauaguagaucuguguauuugugggguauaugggauauuuugauacaggacuauagucacccuguuguacuaucaaauacuagauuuuauucaucaucaucaccauuauuauuuugagacagggucucacucugucacucuggaguacagagucaugaucauggcuuacugcagccucgaccucuugggcucaagcaauucucccaccuuagcauccugaguagcugggaguacagaugcaugccaccaugccuaguuaauuuuuugaagagauguggucuugcuguguugcccaggccggucucagacuccuggacacaagugaucugcccaucucagccuccuaaagugcuaggauuacaagcaugggccaccacacccaguccuuauucauuuuuucuauuuuuuguacccauuaaccauccuuccuucccccuccgucuuuaauccuucuugaguugauaguguaagauaaggguccaguuuccuuccuuagcauguggauauccaguuuuucuaacacuaugguguugaaaagucaguguugcaagauguguuuucuccauucuuagcacuuugugaaagauugacuauauaugcaugcgugguuuuauuucuggacuccauucuguugcauuggucuauguaucucuuuuuaugucaguaccauacuauuuugauuacuauagcuuuguaauauacuuugaaaucagguugauaugguuuggcucuauuuccccacccaaauuucaucucuaaucguaauccucauaauccccauguauggagggcaggaccugguagggggucauuagaucauagcgggaguuuuccucaugcuguucuugugauaguaaguucucacgagaucugaugguuuuauaaguguuugacuguuccuucuacacgcucugucucucucuugccugccagcauguaacaagugccugcuuccccuucugccaugauuguaaguuuccugaggccucaccagccauuauggaacugaaucuauucaaccuuucuuuauaaauuaccaaaucucagggaaguuuguuauagcagugugaaaauggacuaacacacagguaaugugacacuuccagcuuuguuguucuuucucaagauggccuuggcuauucaugggcuauugugguuuuguauaaauuuuaggauuguuuuucuguuuaugugaaaauaucauugaaauucugauagagauugcauugaauccauagauugguuuggauaguagggacauuuuaacaauauuaauucuuccaauccaugaacauaagauauccagccauuuauuuguaccuucuucaguuuauuucaucagcauuuuaugguguuuaguggcgguuaaauguauucuaaguauuuaguuuuuuggagcuaccauaaaugguauuguuuucuuuuucuuuuucuguuuuuuuuagacaaagucucgcucuugucaccgaggcuggagugcaauggagcgaucucaacucacugcagccucugccuccuggguucaagcaauucuccugccccagccuccugaguagcugggauuacaggugccugccaccauacccggcuaauuuuuguauuuuuaguagagacaggguuucaccauguuggccaggcugguaucgauuccugaccucaguugaucugccugccucagccucccaaagugcugggauuauaggugugagccaccacucccagccauguuuucuuaauuuauuuuuuagauacucauuguucuuguguagaaacacaacuuauucuuguauauugauuuuauaucuugcaacuuuacuaaauucauuucuuaguucuaaauuuuuuggugguuuuuagguuuuucuaaauauaagauuaugucaucuucagagacaauuuugcuuu

SEQ ID NO: 21192 - RNA, 1939 nt, Homo sapiens
aaagcaaaauugucucugaagaugacauaaucuuauauuuagaaaaaccuaaaaaccaccaaaaaauuuagaacuaagaaaugaauuuaguaaaguugcaagauauaaaaucaauauacaagaauaaguuguguuucuacacaagaacaaugaguaucuaaaaaauaaauuaagaaaacauggcugggagugguggcucacaccuauaaucccagcacuuugggaggcugaggcaggcagaucaacugaggucaggaaucgauaccagccuggccaacauggugaaacccugucucuacuaaaaauacaaaaauuagccggguaugguggcaggcaccuguaaucccagcuacucaggaggcuggggcaggagaauugcuugaacccaggaggcagaggcugcagugaguugagaucgcuccauugcacuccagccucggugacaagagcgagacuuugucuaaaaaaaacagaaaaagaaaaagaaaacaauaccauuuaugguagcuccaaaaaacuaaauacuuagaauacauuuaaccgccacuaaacaccauaaaaugcugaugaaauaaacugaagaagguacaaauaaauggcuggauaucuuauguucauggauuggaagaauuaauauuguuaaaaugucccuacuauccaaaccaaucuauggauucaaugcaaucucuaucagaauuucaaugauauuuucacauaaacagaaaaacaauccuaaaauuuauacaaaaccacaauagcccaugaauagccaaggccaucuugagaaagaacaacaaagcuggaagugucacauuaccuguguguuaguccauuuucacacugcuauaacaaacuucccugagauuugguaauuuauaaagaaagguugaauagauucaguuccauaauggcuggugaggccucaggaaacuuacaaucauggcagaaggggaagcaggcacuuguuacaugcuggcaggcaagagagagacagagcguguagaaggaacagucaaacacuuauaaaaccaucagaucucgugagaacuuacuaucacaagaacagcaugaggaaaacucccgcuaugaucuaaugacccccuaccagguccugcccuccauacauggggauuaugaggauuacgauuagagaugaaauuuggguggggaaauagagccaaaccauaucaaccugauuucaaaguauauuacaaagcuauaguaaucaaaauaguaugguacugacauaaaaagagauacauagaccaaugcaacagaauggaguccagaaauaaaaccacgcaugcauauauagucaaucuuucacaaagugcuaagaauggagaaaacacaucuugcaacacugacuuuucaacaccauaguguuagaaaaacuggauauccacaugcuaaggaaggaaacuggacccuuaucuuacacuaucaacucaagaaggauuaaagacggagggggaaggaaggaugguuaauggguacaaaaaauagaaaaaaugaauaaggacugggugugguggcccaugcuuguaauccuagcacuuuaggaggcugagaugggcagaucacuuguguccaggagucugagaccggccugggcaacacagcaagaccacaucucuucaaaaaauuaacuaggcaugguggcaugcaucuguacucccagcuacucaggaugcuaaggugggagaauugcuugagcccaagaggucgaggcugcaguaagccaugaucaugacucuguacuccagagugacagagugagacccugucucaaaauaauaauggugaugaugaugaauaaaaucuaguauuugauaguacaacagggugacuauaguccuguaucaaaauaucccauauaccccacaaauacacagaucuacuauguacccacaaaaauuaaaauaagaagaaggaucaa

SEQ ID NO: 21193 - RNA, 1759 nt, Homo sapiens
aucaccuucaugcuggagauguggcuggcgcuggcaaaaccucugugagaugcugacucaggacaggugccgcugaggcccuuuaggaaacagaauuccacccauuagaaccccuucaaauggggaagcagcuaaguuuguagucccgcuucagguagguuuggagggguuucucauucucucucaauuugaguucagaugcagaugccuccugggaacugaaaccccuccuaugcuuggccuguaucuuguuuggaugcugcugugucuuguagccaugccacuggggucaccagccagggcacaucauugucacacagccuccagcuucccaauucugacccuuaccugcaaagcccucccucuguccccuggggcucaccaacacuguuucccaucucccuuuuucuuucaucuucaccacagccugggacagaugucagggagggauaauuaucuacauuuuagagaggaacaaacugauccagagaaguagagugacucacuguucuugccuggcuggaucuagucaucuccuaacccagcuaccaucucucuaauccacccagcccugucaccugucaccaggguuaccuucuuaaagccaaugccccauucagacuucuggcuauuuuccagugagcacccaguaaagaguccccagcugcccucuccugcgucaucacucccgugucccuuucuacaccccaugcugugaccacaucagcccacucacucuuccuacuauauguucuccccaucucaguggcuccccucaugcugcauucucugccugguauucucucccuucccucccuuccuucucugaaugucaaaguugaauuccuccaccaggguccagcucaaauguuaccgccugcuuuggagccucccccgccaguccccaguaagcaugaaucucuucuuucucugcacucgcugagugcuuggcuuuuaccugcccuggugcaucgauuucauuccaccuggagcuagcgguguuuugcaccauuugccucccccagggucuguaagcaacuucagacccagaaccccaacuuagucauuguguucuaugaccuuggcaaguaacuugaccuuuucugggcuauaaaauggggaugacagcagcuuuaccaggguaggauaaggauugaacaaaucaccaaggucagugcuuggugaaugaugggggacgaugauugugaagccagucagagccagcuguggcugagucuucugagcccagaaacuuguuucuguucacuuccuuccuuccccaaaaaggcauuaaacccaccugaggaaauuagacugcugugauuuuguuuguuuauuuguuuuugagacagagucuugcuuugucacccaggcuggagugcaguggcgugaucuuggcucacugcaaccucugccuucuggguugaagcaguucuccuuccucagccuccugaguagcugggauuacaggugcuuaucacuacacucggcuaauuuuuauuuuuuuaguagagacaggguuuuaccauagugcccaggcugcuuuugaacuugugacuucaagugauccacccacuucggcuucccaaaguacuaggauuacaggcguaaaccaccacgcccagccuagacuauugugauucuuaaaggcagcuacacacuagaaucaucggcgagcuguugcaucagaaucccuugaggaacuggcugaaaauuuagauuacugggccuuacccuggaccuucuaaaucagauuucc

SEQ ID NO: 21194 - RNA, 1759 nt, Homo sapiens
ggaaaucugauuuagaagguccaggguaaggcccaguaaucuaaauuuucagccaguuccucaagggauucugaugcaacagcucgccgaugauucuaguguguagcugccuuuaagaaucacaauagucuaggcugggcguggugguuuacgccuguaauccuaguacuuugggaagccgaaguggguggaucacuugaagucacaaguucaaaagcagccugggcacuaugguaaaacccugucucuacuaaaaaaauaaaaauuagccgaguguagugauaagcaccuguaaucccagcuacucaggaggcugaggaaggagaacugcuucaacccagaaggcagagguugcagugagccaagaucacgccacugcacuccagccugggugacaaagcaagacucugucucaaaaacaaauaaacaaacaaaaucacagcagucuaauuuccucagguggguuuaaugccuuuuuggggaaggaaggaagugaacagaaacaaguuucugggcucagaagacucagccacagcuggcucugacuggcuucacaaucaucgucccccaucauucaccaagcacugaccuuggugauuuguucaauccuuauccuacccugguaaagcugcugucauccccauuuuauagcccagaaaaggucaaguuacuugccaaggucauagaacacaaugacuaaguugggguucugggucugaaguugcuuacagacccugggggaggcaaauggugcaaaacaccgcuagcuccagguggaaugaaaucgaugcaccagggcagguaaaagccaagcacucagcgagugcagagaaagaagagauucaugcuuacuggggacuggcgggggaggcuccaaagcaggcgguaacauuugagcuggacccugguggaggaauucaacuuugacauucagagaaggaagggagggaagggagagaauaccaggcagagaaugcagcaugaggggagccacugagauggggagaacauauaguaggaagagugagugggcugauguggucacagcaugggguguagaaagggacacgggagugaugacgcaggagagggcagcuggggacucuuuacugggugcucacuggaaaauagccagaagucugaauggggcauuggcuuuaagaagguaacccuggugacaggugacagggcuggguggauuagagagaugguagcuggguuaggagaugacuagauccagccaggcaagaacagugagucacucuacuucucuggaucaguuuguuccucucuaaaauguagauaauuaucccucccugacaucugucccaggcuguggugaagaugaaagaaaaagggagaugggaaacaguguuggugagccccaggggacagagggagggcuuugcagguaagggucagaauugggaagcuggaggcugugugacaaugaugugcccuggcuggugaccccaguggcauggcuacaagacacagcagcauccaaacaagauacaggccaagcauaggagggguuucaguucccaggaggcaucugcaucugaacucaaauugagagagaaugagaaaccccuccaaaccuaccugaagcgggacuacaaacuuagcugcuuccccauuugaagggguucuaauggguggaauucuguuuccuaaagggccucagcggcaccuguccugagucagcaucucacagagguuuugccagcgccagccacaucuccagcaugaaggugau

SEQ ID NO: 21195 - RNA, 49481 nt, Homo sapiens
aucgcgccuccugacauguuggggguaucccuggccgggccgggccggggcuaagagcggcgcugcgggccggggucggggucgggucgcgguccgcccccgcugucccuccguccugcccugucgaggacgugcguuccgcacucggccgccuccagagggagcgagggaagcggcuagaggaucggggagaaggagcauucgccggaggcuggaggaggcugacccgcguccccgcccagccugcuccuaugcgguacuugaaggauggcgaagaggucgcgcagguggguggcaccccuuucgcccaggccugucggcgccgucucggcucagauucucuuuccuaucccgcugcccccucccgccauaaggcccucccuggcgagggcagagguuuuucuucccgcguccccgcggccgcuuggccucgaugaccggagggcagcugcgacguguggagaguuggggaccaggguguuugaggcgcgggacguaagagaugcccagguuucucggugacucuccccguaaugcgcguccagauuucugaccucaugcugccacuucuucgaggcagguuucuugccagguaagucgagcgcuuuuagggaguccgcuacgcagagaaaacugacuguguccugccgggaggacuugaaaaugguguucgggcgacucuuuucugaaugacgguacagucaaaauaggaacuccgcggugaaccugggcggccaccccucugccaacuuggcuaucuugaaacguuguggaaaauccucuggggaauagcugagaggacuuuuuugauguuuucuguaauuccuauacccauaugcucagcuuuauguauauauguauauuuuaauauccucucuugggaccaugucacauaguaacaacuaguaguaacaacuaguagcuugaucuugaaauaaaacaauguguuugauucacuuaauauuuugagugucuguguuuggcucugaccguaccuaaguguuccacagagguaaggcacuuuuuuccaccuuugccuggaaaaugugcuaggaugaauuuaugcaucuaauuuucguuuacaugccauuacagcagcuacucauaaauuauguggaguaauugcuuagauaacaaaaauauaggaugucuuccgauuuucagcauuaucaaauaaaccugaaaagauguuuggcaggauuuccaaauauuuauuuaucuagauccacagccccaaaaucuuaacuagagauguauuuccuaaguugaaauuuaguaaugggggucauucauugcagaguucugcuaaaaauuggcaguaacuauacauaauuguuuuuuccuuaguuuucuguuaagcaucugcugugugcaggaugcuucugcagaaauccuuaagucucuguaagcuuauuaguuuugaaguaaguuauaggacaaacucuugagaugaaauaaauguguacacagaccccucuaaaacuguuuucagccuuugcacuauugacaucuuggaccagauaauucuuuguaauggggagauguuuagcagcaucgcuggcuucuacccaguagagauaguaacacuccacuucccucagucaugacaguaaaaaugucuccagacauugccaaauaucuuuugggggacaaaaucacccaggaaagaaccacccuucuagaacuucaaggacccaauuaacaucaaucuucagaaaagauagauauuuaaagcucuuguaauuaugauugccgaaguacugguuuaggcuuuuugaauuuuuaaauauaaaaaaauuuaaaaauaagaugacaauugaauauguuaacucaauaacaaguuuauuaaugugugauauuaucuacuuaucaguauugauguuaaucuuauuugaaacaguuucuuggcuaauucugucaucagcauuuaguuaaauuaaaauuauggcuagacacgaauguuuaaaugucagaaccuuccccuccccauggguuuucuguccauuucauaugugugaaguguauguuucauaauaauggacaaagaaaggagaaacaacuuaauguuaguuugcauauauaaguuguuuuauugagaauacugugagcuugaaaucuaaauauuguacuuuugacauuuaucccuugacaguuguguaaguuaauuuaaacaugauagaaugauuuaaagggucguaaaucuggaguaauuaaaugugguggggugaagcuauacucucccugggaguauacagauagaggauguggggagaaauuaucaucucugaaugauguaucucuuaagucuucauacuuaaauguguuucauacucugaauuacauuucuugcccacguaaauaugauuuacauaucuuagaagauaguagaugcucugcuuuugugcuucaacaaaaaacaaaagaggauagagugugaauuguuuugaagcaaaaauaaugucauugggaaaaaucucucuugccuuuuaccuaaguaucuuaauauauuugaacucaauuuauaguugaaagggaaaagaaauaauucaguuacuucaaguuguaauuugagaucuccaguauacaaccacuuaagcguucaagugaaaacuauacuuugcuguauaaaaguuuugccuaagagcauaggcguaaauccuguaauauauguuuccuaugugaacugaaaaaaaaaaacccaaaaaaaccuaagaguagaaaacuaaguguuaccucaagugugaacaacugcaggauguuagcuguuuugaucuuuaagauagccguaguaucuguccucuagauuuacauaaaggaagacucauuuguauugugacuuuaaauaauuuuacaucccacugggaauugcgaugacaauuuacaggcaauacuaaaauuaauauaucuguuacuaacauauauuuaacuuuuaagcauauuuauauauacguaauuaauuuuagauucgaaagucaguuuuacccuuuaaaguaagcuuuaaaaaaugucauuuagaaaccuguuuacuaguaacagauuauuuacacuugagaugaccuaugacuacacuaaccugaaaagauaaaagccagcucuugaaauagaagauguuuuuugcaguguuauguauauguguguguauaggaaccaauuuuacuguguuguuuccagcaaaaugggugggagugaaauuauacugaaauaugagaacugaucuuuuaaucgguuuugucauuaacuggcaauauuguuuggggaagcagguaaacucugccucaguuuuucaucugguuaauauauagaguuuggauuuuauggucuguaagguaguuucuagcuuuaauguauauauuugaagacauuuuguaaucuuauuuaaaaguauauacauacuaaugaaauagaaauuuucucacaauguuuuuguuuauggaauuacuagguagaacucuccucaauauugcuguuaauaaugaucaaagguuuuguaaaguuugucuuacuauaauacugcuaguuugcacaguccagauuuggaaauaaaauauucauguaugcaguacauauauuaaccacuggguggccuaauuucacuuuauuaaaucaaccugguaaauuuucauaccuugaauaugauuggacuuguccucaagauuguauaauaaagauuuuuuuuuugucugugauaaagauuucggacuugaguuaauuugugauuaaaaauauuaucaacuugaugcgauuuuacuagagcaaauuuauagaaccgguauuucucuuucuuuuagaauaaaaaauuuaaaaaaauuucaguuuccuccuuggaauaccucauuuacugguuuaagugauauaauuguuauccucuaaaauugaacuucuaaauguuuuaucuuaacaucacaugugaauuauuucaucaagugcguguuauuucacggacaaagucaugacuaucauguccuguuagcuuguacaccaauguaaaguuacucuuaaacuauuuuccuggccuaaugaguucuacaauuuuuuugugugcuuccuuugacuguuuuauaaucacccuaaucacuuuaauucacagucuaugaaacuguuuccauuugaauauaguaguuugguuauguauuagacauuuaucacauaaauauuuucuuugacuuagguaaacuggcagaaucauucuggaaaccgaguccugggcuggagagccaaagaccaaauuaaucuauuauugcuuugugacuagagaaauaaugucacuuuauuuugcugucuucuagauaauuacacuaggcuaggaaugguuuauuuaacuacauaguaggaagccaauuuuauuaaauuauuacauauuaccagcauugauuguuauaauacagaaaugucaaaagauuauguaaaaguagacaaauagagcagauccauuuugaugauaucuaaccauuuuucagugaugggacuuuuucacuguuaaauggugaaagugggauauuggugcagugauuugugggguuuuauccuuucccuguuuucuuugcaaauuauacacauucucaggcaucuuucuuuguagcuagugauguugauagauaucuaggaucuuuuuuuuggucucauguauuggaaaguuaacauugucuuuucaauacucauauauauguagagauaacuugaugcuauaacuaagaaguagguagacucuaggaaagucagagugguagauaauucuaagaauucuacuugcuucuucacacuuacccauucaaaaagcccagcuuacugaacauugaaugggcuauauaacucagugucugaaacugaugaccaugcugaaaugcaaaauagagaaugaaaccucauguagaaauagaaauuucucacaauaaaguauguggguaaaaaguaaggggcaaaauuuuacaguuaaaaugaacuaguuuuuaggaaaauuacucuuugaaaacucagcuuuuugaccaaaauaauguuuuuguacucauauccuuaaaauauuuuguaagaaccuuaaaguggguuucguaugauuaaaugugauguagauuugugaauacucaagauuuauaugggcaaauucccaagguaaaaauuauuuugacuuagaaauaaccuguauuuuaaagcagucucaaauauacuguuauggaaacuuugaggaucugaagagagggaggaaaagaaagagacccugugaaaagcaugccugagggcuauuuggggugucaggaagugguaauguugcugguggcauuucuaagaaagguuaaacaguacaguagauaccuucaaauaaccuuuucuguauugaauauuuaaaauguuuguuucagcagguucugcuucuuaaaauucuaccacuuggagguguuuuuuuuuuuuuuuggguuuugaaagucuucuuuaacaaauaagaaugcuuuuaccucuuccuagagguauuuucauuuguuaaaaaguuuucuuucucagauccacuuugagaucacauguauugaagaagguggaaguuuugguuggguuggaaaggagugagauaauuuuggaauauagagcucuuggugaagcuggaagauuagggaagauuguucauuaguuuuacaaauauuugaguggcagguacugugcuuaguuaguccugagaggugaacgugguagacauggucugcacucaugagcuuacuuuuuggauguggagguuggcaaaugugauaaacauuaaaaagaagaaagguaggugcucuuaguacauacaaauaggacagaaagcugcagugugguguuuuaucugauucgguagcuuucuuagaaauuuaugaagucauuggacccugaagcaugucgaacuuaacaauuuaauauuggccuaucaggugauauuucugauagcugaaaauggcugcauguaucagauauuuaaucaagccuguagaguuuuuuuuuuuuuuuuuuuuuguuguuuuaacacaguuuaauaaaacaaccauauaugggccaggcgugguugcucaaaccuguaaucccagcauuuugggaggccaagguuggcggaucaccugaggucaggaguucgagaccagccuggcuaacaugcugaaaccccgucucuacgaaaaaaauucaaaaauuagccaggcaugauggcagacgccuguaauuccuucuaccugggaggcugaggaaggagaauugcuugaaccagggagguggagguugcagugagccgagauugcgccacugcacuccagccugggcaacagagcaagacuccaucucaaaaaagaaaaaaaaaaaacagccauguauggaaggagaacugguggauuauuguuacaaauagacaauggcuucagggagagcgaacacuggacuauugaaguguguugaacuguagaagcagaucauaggggaaugggagaaucuugguguuuugccuggucaaauaugaagaauuuuguuccaauggaauugacaagucaauggaaguuagacguuccuacaaaggaucuauagacaguauauauuaaaucugggccuucauuuuucaauuuuguaagauuaaaauuacauaacuuacauagauauuagaaacuacuugcaugcgcuuaacuauauuagaguaagguuaaacaaaucuucaaauuuugcucugugaaaucagaaugaauuuuugagaaagaguugaaucuaguaaggcaaaaauaauuuugaauacuauuaggugaucagccuaugcacguaauacuaauauugaggcaccuuucugugccaugugcuguaugagguguuauauauguuuucucauuuaauuuuauccuuaaagcagcacuauaagguaggugguauuauuaucauuuuacaaacaaguaaacuaaaccccugagagguuaacauguucaagguuacagagugaguaauuaaguuagaaccagaaccuuguucugauuccaaaaugaacuugagguuugucuuuaguaucuuccagcuuccuagcacuuucccccuauuuuuccaguaugucguaguauagcgguuaaguagugacugugggcaagagguuacauuucugagucaaaguuuccuauuccgugaaaugggaauaaugauaauauuccccucuuccaguugugaggcuuuaagagaaaaauuuaauagacuacuuagaaaguuuuaaauaaaugguagacuguguuauuuucagaugccaugacuuuauucaguccacugccuacucagaauccucuaauucaguuuacuuauuuauuuauugagacggagucuugcucugucaccugggcuggagugcaauggugcaaucucggcucacuguaaccucuaccucccggguucaagugauucuccugccucagccucccgaguagcuggcauuacaggcacccaccaucaugcuccgcuaauuuuuguauuuuuaguagggguuucaccauguuggccaggcuggucuugaacuccugacuucaggugauccgccugccucagccucccaaagugcugggauuacaggugggagccacugcgccuggccuuguauuucaguuuaucauuaaggcuugcccuuuuuuauggggcuuuauucuuuaaaauugcuuuuucuuuuuuuacuccaucaaaacucagguucugacuuuggccccuuccucacuuuauuaauuuuccuugggucauccugugcccucagcuauucuuuguaugcuggccaaaacugcaucucuacccuagaccuuguauuugagcagguccacaugcucauuugccuucuagauuugcucugcccuguaggauagccauuagccacauguggcuauugagcucuugaacuguggcuagucugaauuguaaugaacucuaacuacaaaacacacaccagauuuugaagacuuuaguaagaaaaaaauauguaaaacauuucauuuauacuuuuuuauguugauuacauguugaaaugauuauauuuuugauauauuaagcuaaggaauauugacuauugaaguacauuucacuuauuucucuuuuuuuaaaaaauguggcuacuagaaaauuacauauguggcuuguauuaugucucuguugggaagugcuguuccagacauccaccuguguauuuuucaaguaccuugaaaacagcuagucccaaacuauacauacucuccccauuuucuucucucucccaaaguucuguuucuccuucuaucauuuuccauaguaaauagcucuacuuauguuuucaaagccagaaacuuuggagucauccuuaauuccuccuucuuccaugucccucaucuaucaguugcaaaauccuuucuuuucuacuuuuuaaauaucucucaguuuaauauauuucuuucaauuccuaauaucauuaccuugguugaucuauuuuaucacuuccagauuuuugucacauuuaccugucuuuuacucaaggauaugaaaaguagacuucuuuucuguuuucuuauaguacuauuaugguuucauguaaaaaauguaaauaauugcuucacuccaguuuauuuuauuguaaaguaggacaccaucuuuuuuuuuuuuuaauuuugaaauggagguucucuugguugcccaggcuggagugcaguggugcagucuuggcucacuggguacaagcgauucuccugcuucagccucccaaguagcugggauuacaggcacauaccaccacacccagauaauuuuugcaauuuuaguagagacaggguuuugccauguuggucaggcuggucucgaacuccugaccucaaaugaucugcucgacucagccucccaaagugcugggauuacagguguccacgcccagcccaucuuaauuuuaaaaaauggcuacccagugucuuaacaccauuuauugaaaagucuaccuuuacuccacugauuugaaauguuacuguuauaauuuaccaaauuccaugugggucuuuuuucuuuucuaaauguucuguuccauuuaucuauguguguguucgugugguaguaccauucuguuuuauuucucuacaguguauuuugauauuggguagugguaauucucugauuauucuuuuuuaaaacuuuucuugccauucuucuugauuuuuuuuuuucauaugaauuguagauucagcuugucuaguugccucccaaagucuauugguauuuuuauucauuuaauuuaauuuaugaauuagggagaauggacaucucccuaaauuagagaauggacauaucuauaauauuguuuucuuauccaauaauauggucaggaggcugggcauggugaugcaugccuguaaucucaagcgugggauuugggaggcugaggcaggaggaucacuugagcucaggaguucaagaccagcauugcggguggagcaacauagcaaaaccccaucucuacaaaaaauagaaaaaauuagcugggcaugauggugcaugccuguagucccagcuacucgggagacugaggugggaggauugccugagccugggaguuugaggcuacagugagcugugauugugccacugcacuccagccugggugacagagcaagcugagacccugucuggaaaaaaaaaaaaaagucagaauguucuuccauuuguucaagacaucugugucucacaacagugucuugucacuuacuguaccuuuaucuuguauguuaaauuuuuuuuauuguugguauuguuaauuggaucacuucuauugugucuuuuaauuggcugcgguuuauauuuuaccauuaccauuugucaggccccaauaauuucuugcuuggguuguugugaagauuacuaauugguuuuucuuuuucaguuucaccacacucuugucacugauuuuucuaaaacacaagauaucugucuuuugucuuuugcuguguuaaaauuauuuaacucuuuagaauaaaggucaaauaaagaauaaaggucaaauuccuuaacaugacguacaagguuaugauuuuucccguaguggcauauccaaccucauguguuuggugucaguaagaaguauaguuccaggccaggugcaguggcucacgccuguaaucccagcacauugggaggccgagucgggcagaucacaaggucaggagaucgagaccauccugguuaacacggugaaacccugccucuacuaaaaauacaaaaaauuagcugggcguaguggugggcgcccguagucccagcuacucgagaggcugaggcaggagaauggcgugaaccugggaggcggagcuugcagugagccgagaucaugccacugcacuccagccugggcgacagagcgagacuccgucucagaaaaaaaaaaaaaaaaaaaaaaaaaaaauauauauauauauauauauauauauauauauauagcuccaccccaccccgcugucugacucuuaauuuuuuguacuuugaauaauuucauugugaauaugacuuguagucuguaugauuucuucagucauaccugcacacacaaguucaguguuugaauuuacaaauuuaaauaaaauucuugauaucacaaauuguguuuuuuuuguagugaggaugaggaugaugaccuucaguaugccgaucaugauuaugaaguaccacaacaaaaaggacugaagaaacucuggaacagaguaaaauggacaagggacgagguaauuaucugacaagguuucauaguuucuuacauguauuuauugguuaauacugcuauaguuauacggccaggugugguggcucacgccuguaaucccagcccuuugggaggccgagaugggcggaucacuugagguuaggaguucaagaccagccuggccaacaugaugaaaccccgucucuacuaaaauacaaaaauuagccugguaugguggcgcaugucuguaauccuaauccuacuugggaggcugaggcaggaggaucacuugaaccugggaggcagaggguugcagugagccgagauugcaccacugcacuccagccugggugacagagcgagacuccaucucaaaaacaaaaaaaaaaugcugcuauaguuaugaaagauauuuaaaaacaaaauaugagaaaagauaugcaucaaauuaacuguacguucuuuuucuucaaccagagacaugaauaacugaugacauuggaacuuagagaaacaguauaauaaauggaagaauuuguauuauaguggguggcuuuaguuauucuaugguuaccagauauuccuuaauagaauuggagaguuaucuauauuuagggguagaggaaaaggacggggggaaagcuuucuaauuuuuguacuguuuuaauaggaugauaaauuaaagaaguugguugaacaacauggaacugaugauuggacucuaauugcuagucaucuucaaguaagugaaauauuaaauuauauuucuaacauggcugguuuaaggcauuggguuaaauuugcuauuuuucaaaaaugugucuacauauuuuaauuuuagguuuccuuccuaaaaacaucccuguugguuuggucugccucuaguugguugcuaauggcuuggagagucugguuuagagucugguuuucuaguaaugcguuuauccaggggccuaaaaagauuauuaacuuaaaacaaaaaugauaauaaauguaugugggaccuuauaaauauuugcuaauacacguuaaaacauucugugagaaauauauugagauauuugauagcuaaccaaaaaauccagaaaagcccuauuaaaaaaagcuuaucaucugaggcuuaccuuuuaaaauguugauuuuaaaaacuauuaugccuauuguuuaccauacuacuauucaccugcuguucguuauauaacuuuauaauuuaugaaguauuuucacauguacucuuuuuuuuuuuuuuuuuuuuuuuuuuugagacggaguuucgcucuuguugcccagucuggagggcaauggcacgaucucggcucacugcaaccuccgccucccagauucaagcgauucuccugccucagccucccgaguagcugggauuacaggcaugaaccaccacauccgucuaacuuuuuguauuuuuuuuuuaguagagacgggguuucuccauguuggucaggcuggucucaaacucccgaccucaggugaucuaacugccucggccucccagagugcugggauuacaggcgugaguuaccgcgccugguccucacauaugcucuuauuuguauccuuaauacacugugaguagugagggaaaauauacauauuugaauuuaaauauugacuacuuuggguuucagaaaccauguuaacuauguuuuuucuauauugucauaugacuuucaacauaacccaaaaauugagaucaaguaauggaaagagcauaaauuuuggagucaguuugaauuauguucaaaugucagcuccaugagcguggaaaaauuacuuagccucuuugauugucaccuuccuuaucuauaaugucuagauaaucauacuuguuucuguaguaugguuguguagaacuagaaauaacauauaggauguuuggcacaauucuuaauauuuagcagguguucaauaaauggaagcuagguuagaaaaguuauuuacauuagcauuaacagaaaugcuacaaggacauacaggagcaaccugauuauuuugaagaaagugucagccuuaaaauggauuagcguugguguacagaagccauaaaugaagcugaguuugaauaaaaauaauuuuaaguacauugggcaaaagagccauugguagacaaaacauuuuuaucugucccuuuauaugucucuagauuuucuguaaucuugcuuaugaacuaacaauuuuguaaacugugaaucacuaauaaaguguuaggugucauuauccuuguaauguauaggaguuaccagguucuggacugacuaaaauaaggcuucauuuauuauuuuuggaguuugagauguuucuacccagauacugcguaggauuucuuauucuggugaauucauuuucuuuuuaagugucaacacuuaaccaauuuagugaauucauuuucuuuuuaagugucaacacuuaaccaauuuaauugaaauguaacauucaucuucuauguagacuauguaauguuuucuuaauaacuuggaaucauaauuuauaacauccuuuugauccuaugcaguaguauagcaaugccuuuacauuucuuuaaaacuguauaguuagguacugcugaacuacgugaauccagacugauaggcuauuugaguucuuuuucuuuuuuuuuuuugagaugagaguuucgcucuuguugccuagguuggaaugcaauggugcaaucucggcucaccgcaaccuccaccuccuggguucaagcaauucuucugccucagccuuaugaguagcugggauuacaggcaugcaccaccacauccggcuaauuuuguauuuuuaguagagacgggguuucuccauguuggucaggcuggucucgaacuccagaccucaggugauccacccaccucggccuccgaaaguguugggauuacaggcaugagccacugcgccuggcacuauuugaguucuuaugucagcuuuguguaguuuucuguccacugcuuuuuauuccucaguguuaaauccauuucuuuauuucaguuaucuguguuuuaucuuugcugcuucuguauuauaagguguaguguaaagauacacacuuuaguuuuaaauaaauuguuuuuauuuguagucuaagcccuguugacuacuauaauuaagaaaaaacauaauuggggcagagauauguaacauaaauguuacauguuuaaagaaugcuauugaauacacuauucuugaagucuuuguucuaaggaugugagacauaaauucgggcugacuugcuuucuggaagacaguuguuuaauaacaaaaucuucuaaauuuuuucagaaucgcucugauuuucagugccagcaucgauggcagaaaguuuuaaauccugaauugauaaaggguccuuggacuaaagaagaagaucagaggguaauguguucauauucuuuauauucacuauguagguagacuagcuuuuuucuuuuuaauguguuguuuugacauaugaaguacauguuuaagucacuuugauuuuguucuccggaggcuacuugcauaagaauugaauguuaagugucuggaaauguuguuggguuuuuagaaaauugagucaaaccaaguauaacauacagcccuuucuuucugagaguuugguuugcagaaggaaaaauacuugcuguaagguuaguuaccuuguuuugagcucaguuucacaacuauuaggguauaguuuuuugucaaaaaucuaauuaacauuuuaaaacagauuuucauuuuauuuuuacaucuaauaacuugauaugcacggaagucauucuuaacuuuuucucuuaaccuauaaugagucccaggauuagacagaugucagagcaucauguuuccaaagguuuugugauuuaaaaaccaaggucauuguuuguacuaugaaguuggagaugaauagaaguguuucugcacucuuuaguuaaugcccuuuaagucauaaagguugcuaaugcaguugaggaauuagagcauccuuacuccugcucaaaacaaacuuuauuuguuguucuuauuuuuuaaauuuuuuaaauaaguagagauggaaucucgcuauguugcccaggcuggucuugaacuccugggcucaagcaaucugcccaucuuggccacucaaaaugcugggauuagaggcugagccaucaugcccagccagaacaaacuuuaaaguuacuucaccuagacugcacugauuuacuugauggcuacuccuaaguuuuaaaaugugugaucuuguuuaaaaaugcauuuaccaaagccugaaauuuuaguuuuaaagauaguaaauagacacauauagugaaaauaucaacauauauuaaacuuagucuaccaauauaaaauguuuaugagaugauauuugacauagggcagugagguaaagugggcuggaauaacuauucuugcaauuuuaggugaaauaaaaacaacuguaaaauguggaaaaaagaauauguaaucuguguccuuucaguuugagaaaggaagaaaugacaaccaauaacuugguagaaucuuucugcuuccuaauuguauuuuuguuuuuugcuuuuggcugaagcguuuuuuuuuuuuuuuuuuuuuuuuuuagauguaggaguagaaaauguacaaguuucagcauguuuacaguuauuucaaauuaauagggugugaaagcaauugaauuucaagagucuuuaauuagccccuuggauuuuuagaugaguuuggcaucaauuuuugaagcuggcaaaugcuaaagggguauuuauugguaauuuuuuuuuaacaaauuguaguuguggcuuggauuuaaugcauuuauuuaaaaugguauucuugaauuauguuuuaaaauucuuugaagguaaugcuuuuuuaaacuuuguuuuucuguuuccuagguuauugaauuaguucagaaauaugggccaaaaagauggucuuuaauugcaaaacauuuaaaaggaagaauaggcaagcaguguagagaaagauggcauaaucaucugaauccugagguaaagaaaucuuccuggacagaagaggaggacaggaucaucuaugaagcacauaagcgguugggaaaucguugggcagaaauugccaaacuacuuccaggaaggugcuuauauaaauguauauauauuuuucuguacuuaaacaugaccuuuauuaccuuacuguuaaauacauuugcaaguccccgaugacuuauuuuuuaaauuuguaauuaaaauguagacuauauaacauaagcaaccuuugggaccauuuguacuaaauucugugguaaaggguaugauuacuuuuuuaaugaauuauuuuauggcaauaauuuguacaauaaaaugauagauuuuagauuauauaaacauuuaauacacuccuaaaaucauguugacauaucagugucaaucaagugagacccccuuuguauaaacucuguuggaaaagaaucuaaaucuaagauuucuuucauauugcguucuauguguaagaccagggaaugauaugcuagcuacaguaaacugcuaugaaaguguguuggggaaaauucaaucuuaauuaauuaugguaugauccaaaccauggaaguaguauauauauucauguggcuaaaauaccaaauuuuccucagaggcagugaugugcuaaguacacucuacauuguacugguucauauguuuucuaauagcguuuaguacagcagaccaacaaccuugugaaaauucauaacuuagaagauacgcauuugucuuuuguugcuguaaucucuaucuguauaguacuuuauagcauuaagugcuuuuucauguauucuuaauuuuuauagacuuggaaaguauacugagcaaacauugcuaucuuuguuuuauagauaagauauuaaggcauaguguuaaauuuuuuauucaaguuauuaaaccaggucuagaugcuuuuaaucucuuauacgucuucuuacuuuucauagaaccuagcuuagugccuuaacauuuacugaaaaccugcuuuauguguguauauuuuaugagggaugaaauuugcaaguaaccauagguugaagauuuucauuuuuauaaagggaaccuuagauaagaagggagccaauuaacucuuucuuaccauaaauauuuuguucuaagaagugaaaaagaauacugggauucuuuaguuugugauuugcuuuucaugaucauguuuguuccuggcuuaagaccuuggcccuugcuauacucuuuaucuggaaugcucuuuuuuucuuucuguucucguauagcugguuuguucuaaccaaaccaaaauuacuccguuacccacuuuucuuauccuacuuuauuugcauuguagugaauuuuuuauucauuuauuuguuuuucuauucuuccuuccuucccacucccacacuuccaaggagaguguaagcuccacgagagcagugaccuacuuugccuuacucacugcaauauuucuggugcuuagaacuaugccugacauaugcacauacaguuuaucuuuugaauuuuuaaaaaauaccuaucuuccugaguagaaacuccaaaagaaaaauuaagaaaaaaguaucuaauuucaucaguguaaaaauuuguuuuaagcacuuuguacaaguuaacacaguguugaaaucuguggaauccuuuuuucuuuuuaaaucauaccuuuccuuucuuaggacugauaauucuaucaaaaaucauuggaauucuacuaugcgaagaaaaguggaacaggagggcuauuuacaagauggaauaaaaucagaacgaucuucaucuaaacuucaacacaaaccuugugcagcuauggaucauaugcaaacccagaaucaguuuuacauaccuguucaggcacauacuuuuaauaccuuuauuauuuaaaaaauuuucuuaaguugcuauaugggaagauguuugguuucuuaauaggacaaauacaaugcguauuaagggguaaauagacaaacugaaaaaaauguguaacuuugauuuauaaauauuuugagaacaaauuuauuaaaauguuuccuuuuauauguaauuuuuacaucaagaaacuauguacauuuccuaauacucugauucuuugaaucuucauuuaugauucaaagcuaauggucaucugugcuuuaacauucuauuguacuuuccauuuaaacaauuuuggcguaauuauaguauugcuuaucucuaagagguagguauauauaaaauggcuuaaaagagaaaguagcaaaaauaaguaauuguuuugggggugugguaauuaauuggauuuugcuggcauucaacuuugcuuuucccccuaauaacuaaucacuuggguaauuuuagucuuuguuuagaugauucauuaaaguagguauuacacgagcucaaaauggggcaagcucuauguugucccuuacagugcauuuuucuacuuggaagaaauuaguguaggagucuucaugagauuuguuuuacauuucccugucuaccuguuaugccauuuuucacaaugagcaauucuugguucuugucacauaaauuguaaagauuaagucaggacuuaguaguuuucuaccaaaagauaaaauugggcaagauauuaaaaaucugugcuuacuaugccucagauuugauuuuugacauuuuguggacauuguuaaguuuuuuaagcaucauuuuaaaagaaccacuuagaguaaugacauuuucauuaacaauaggaaaacaugugaagacaguauaauuaucugcugauacucaauaccuuaagguuuuuauuauguuucuucacauuuuucuuuagagucuagauuucagcagcauaaacugaaacauucugcuucugucuuagaaaguuuaucauuuaaauuuauuuuuuuaacucguagaaagauaauacauggggccaacagaguauuuaacagucuuaaucuaaauauguuggaaagaugaggauauuucuuauacuguaagaauuguuucccuuuuaauuuagauauauucauuauucaauuaauuuaaacuaauaaaauaauuuuauuauaugugugacuugauaaaagaauagauggguuuaaaauacugucacagauuuucaugaaaaguuugggaaagauacguuucuaauucauuagaguuaccaaguugagcaauaagugguacuaaucgaguauucuaaaaguuaagcucuauguuagaaguuauacauaaugauucugcauuauauagugauuuagguagaccauuacggaaagcagacaauuucauauuuaugguuuuugauuuuaaggcuuuuuuuuuuucuuuuugagacagaaucucuuucuguuaccaggcuggaaugcaguggugcgcacacagcucgcugcagccucaaccuucugggcucaugugauccuccugcuucggccuccugaguagcugggacuacaggcgugcuccacuacaccuggcuaauuuuuuuauuuuuuguaaaaacagggucuugccauguugcccaggcuggucuuggacuccugggcucaagcgaccauacccccucagccucccaaagugcuggaauuacaggggugggccacuguacccggccccgauuuuaaggcuuuuaaaaacaccuccucucauauuucuuuccacuacugcuuacuaaauuuauauguaucuugaaaauucuuauuacagauguuuuagaaaagaagcagaaugauacuuagccuaucaucaguauaucuauuaaaaguaugugagugauucugauuguuuuucuaagacaaguaauagaagaagacuuuggcaugggguggugauaaaaguaggagauaugaacauugaaaaacuugcuucaggucucuguccuugugagugcuucauucauauggacacauaggaacacaauuacuuuguuuucuuuaggagauagagcaacccuucuaauaguagauguuuaaauauauuuggugaaugucagauuuaauaaacuggcugauaaaucuaggcuaaguaauucucauauuucaucugaaaaaaagucuuuucuaaguguuacgacuuuuaaucauagauucuaggaguggagcuguaguuauuuaauagauaagaaaguauuauagguauaacauuucaaaauuaauacagguacuuucuaaguuuuuuauauugauacugugucaaaaguuuuugucauuugcuucagauuuucaacauuuauagcauuauauguaugauaauaaugcauuaauuacuuuuuagaucccuggguaucaguaugugucaccugaaggcaauuguauagaacauguucagccuacuucugccuuuauucagguaacuuuuauuuauaacgaaaaccaaaggaaauguguucagucacauuuuuaaaagccuaauaguaucuauuuccucaucuauuaaacuaguauaaaaauaauacgaucuguccuacuuggaguacucuaacuauaaagaagaaaguguguaagugaguuugaagaaauauaaacuguacaaaugugauugaugauaccaguaugguagucauuucauucuuucaagguaaagcauucaaguugggaauggacauauuuuugcuaaauuguauagaauauauuuauuaagauuuaaaaauauaaaauauuucagacauacauuucagcugauagagaugaugcaacauuuuuuaagucauuaaaauuuucccaaaucuuuuaaguugaaaauauuugccagcaccucuuuagauaccagagggauugugauaaugaguaguuaguauuuaguagcauuaagcuuuauuagaaaaaguauauuucauguugcauagaagaaaauaaaaaugagaauacuaauaauaaagcaauuauauaagcauccuguuuucucuuuuauuuaacuuauuuuagcaacccuucauugaugaagauccugauaaggaaaagaaaauaaaggaacuugagaugcuucuuaugucagcugagaaugaaguuagaagaaagcgaauuccaucaguaagaaauaagcuuguuauuuguauuguuagaaucuuucauauaugcuuuuugucauuuuuaucagcuagaaagcauacucaguaugacugcagauuuuaauauggaguaaaaauaguuuuguuuuuuuuuaauuugcaacuuugagguugccuguuuuuuucuuuuucuuuuugagacagggucuugcucugucacccaggcagaaaugcagugguguaaucacugcucacugaagccuugaccuccugggcucaaaugaugccccaccucagccucucaaguagcugggacuacaggugccugccaccaugccugacaauuuuuuuuuauuuuuguagagaugggguuucaccguguugcucaggcuggucucaaacuccugggcucaagugauucuccugccuuggccucccaaagugcugggauuauaggugugagccucugugccuggcccaagguugccugauuuugauaugcauuucuuugagcauaauuuacaauguucuguauuaggauacuucuugagucauaaaugcaaagcagauguaaaguaaaaucuuauauauguguguauauauauauaaauauacacacauauauauuugugaaaauuauguguguuuagauuaggcuuuggcuuuauuuuagacauuccauguaaugauggguuuaauucuuuuuaaaauaaagaauugaauagauguagagggauuuaugagcuccaaaauuauuuuuauucucuuugaaaauuuuuuccuauuuacuagauuuagaauaugaguucaguaaauuuaaaaaaguaauaacacuaaaaauauauggaaaaaggaacauuuagauuuuaugcucucuaaacaauucuucuaaaagaagaaauuuuauauagauguuggguguugguuaccacaugugaaaacuauuguguaagauuuggcugaugagacuaacuaggaguguuaaguuaggaucaaagguaaucauucuaguagaauuaagcagguuaugcuagauugguuaaaagaaagauacaaguuuauauuuaaauaacuuuucuuagguuuuuaaauuaaaaaaaaauuuuuuuuuuuuugagacagaguuuugcucuguugcccaggcuggagugcaguggcgugaucuuggcucacugcaagcuccgccuccuggguucacgucauucuccugccucagccucugaguagcugggacugcaggcgccugccaccacucccagcuaauuuuuuauauuuuuaguagagacuagguuucaccguguuagccaggaugaucucgaucuccugaccucgugauccuccugccucagccucccaaagugcugggauuagggcgugagccaccgcaccuaaccaaauuaaaauuuuuaaauugggaaauaauuguacauauucgugggguacacagugauguuucuguacauguaauguauacugaccagaucaugguaauuagcauaucuaucaucucaaauuaguuauaauuucucugucuugggaacauugaauaucccugcuucuaacuauuugaaacuauuuaauauuguuaacuguagucauccuacagugauauagaacacuagaacuuguuccuucuaucuagcugugauuuuguauucuuuaacauauauuucccugucccucccuucauccuacccuuccuuuaaauaacauuuuuaaaaauuuaaaauaaugccuugagccuuauuauuuuuauuaguauuaguauuauuuuuuuuugagacagagucucacucucucacucaagcgggagugcaguggugcaaucuuggcccuacaaaaaguuuuuuuuuuuuuuuugauuagcuaagugugguggugcacaccugugguccuaacuacccagaaggcuccuggguucaagugauucuccugccucagccuccugaguagcugggauuacaggcauguaccaacaugcccggcuaauuuuuaaaauuguuuuaguagagauggcauuucaccauauuccccaggguagucuugaacaccuaaccucaagugauuugcccaccuuggccucccaaaguacugggauuacagacaugagccaccauuccuugccccuuuuuacauuuagaaaaggguuuguuuguuuauuuuuuguuugggacugaaugagaggacagaauauugagagugacugggaacucaggcaaaauuacuaagaagauaaccugagaucuugaaauaguauuaugaggcaacuggugaugucuuuauacuacuuaagaggauauuaauaaaaaugauauuuauugauuauaauaggcaagauauauaccauaagaaaagcaauuucuguuuuuuguuuuuuugggauuuuuugagucagggucuuggucuguugccuaggcuggagugcagugguacgaucauggcucacugcagccucagccucuuagguuuaagcaguccucccaccucagcuuccuggguagcuaagaccacaggugugugccaccacacuuggcuaauaaaaaaaaauacuuuuuguagagacgagauuucccuauguugcaguuucuguuuugaaacugcaaaaaccaugagcaacuaggaagaccugacauauacuuaccuuaaaguuaauuuguuuuguuaagaagcuacaaauagacugggcuugguggcucaugccuguaaucucaggacuuugagaggcugaggugggagggucacuuaagcccaggaguuugagaccagccuuggcaacauagugagaccccaucucuacaaaaaauuuaaaaagaaauagauaggcaugguggcacaugccuguggcuccagcuacucaggaggcugaggcagaaggaucacuugagccugggaggucgaggcugcagucagcaguuaucacaccccugcacuccaaccugggcaacagagcaagaccccaucuuaaaaauaaauaaauaaauuagccaggcaugguggcacgugccuguagucccagcuacucaaaaggcugaggagggagaggauuguuuaagcucagggguuugaggcugcggugagcuaugaucauaucacugcacuucagccugggugacagagcaagaaccugucucaaaaaaaaaaaagccacaaagaauuaugguuagagaaucagcauuuguagaugauuauaucauguuuaaaccauuuuggauuuuuaauagaaucuuacccuuuuuuaauuuaacaggaaaaauauaacuaaaggaaugaauauuuugcauuaaaaaggaagaaaguuauuuucuuuuuagaacucacuaucuaaaaucuguucucauaaagauuugguugaauaaguguauauucugaaaucuagagggaaguugcugcagccaguagaauagacuccauacccauaugaagcauuuuuuuaauuucuuuuuguguuggagucuuacacugucgcccggcuggagugcaguagcgugaucucggcucacugcaaccuccaacucccugguucaagcgauucuccugcuucagccuccugaguagcugagauuacaggcaugugccaccauacccagcuaauuuuuguguuauuaguagaaacgggguuucaucauguuggccaggauggucuugauuuccugaccucgugauccaccugccuuggccucccaaaguguugggauuacaggcaugagccaccgugcccucccuaaaguuuuuuuuccuaaacaguuaugugacaauauugacugccauuuuacugaguauccauugagcucuacucuugugaauguuuuauauguaugcuugguaauccugauguuaacucuguuaaguggguagaauuucauuagagaguucacauuuagggccgaauguagugacucaacgccuguaaucccaacacuuugggaggcugaggcaggcagauuacuugaggccaggaguucgagaccagccugggcaacauggcgaaacccugucucugcaaaaaauacaaaaacuaaucaggugugauggugcgcuccuguagucccagcuacuugggaaggugaggugggaggaucacuugagccugggagguggaguuugcagugagcugagaucgggcuagugcauuccagccuggacgacagagugagacccugucucaaaaaaaaaaaaaaaaaaaagagauucacauuuaggucugucugauuguaaccuaugguuuuuucacugggcccaguuaucgcccuauuuguguguuggaucuuuuucucaccugcauaccaacugaaagguaugugguuuggagggaaccacguguucccuccagcaugagaggaaaaccaugcugucuccugaaagugauugucaagucagaagguggcuaugcuaaugaaauggaaaauaaugaaaugaaauaagauuacuuuaauuucuuuuauuuauaaaacacaucgaauuugcuuugcaacaguguuuuauuaccuuauuuagguugaaauguaacauuuuauagugaaucccuagaacauucugaaaauuuuuacuuuuaguaguaauaguuaccauuauucagugcuuccuauagacuuccagugugcugucuaccauauggcaguuacuagccacauuuaauuuuaaacaaaacuuaaaauucaguucauuaguugcacuagccacauaucaguugcuuauauggcuaguggcucccauauugagcagcuggaaauauagaacauuuucaucaucucagaaaguuuggaguucccuccaaaccacauaccuuucaguugguaugcgggugagaaaaagauccaacacacaaagagggcgauaacugggccccaugaaaaaugcuacacacuuuacauguuguuucucauucauaacucuucaaggccucuuuucuuauuuuuuaauuauaaaacacuagaaaacuaggcuugcaagauaaguaaauugccuaguguacauuucuaaagagauaaagaaaaaugacauagucucugacuucagguuuuacucugcagugggaaccuacacaagaaacaggauaguauaugauaaaauaaggcacaaggguuuuuuuuuugcuuuuauuauuauuuuuaauugacacaauaauuguacauauuuucuggguguacaguguacuauuuugauacauguaugcaaugugucuuggucaagucuugguaauuagcauauccaucaccucaaacauuuaucauuucuuuguguugggaacauuuaaauccugcuuuuauaguuauuugaaaauauacaacaaguugcuguuaauuauaguuacccuauagugcuauagaacacuggaacuuacuccuccucucuaguuguacuuauauauccauuaaccaaccuuuggcuacucucccuucuccgcuucccuuccuuggcuccccuucuucuccucuaguagccacuauucuucucuauacuucuaugagaucuacuuuuuuagcuuccacauguaagugagaaccuacaguguuuaucuuucucugccuggcuuauuucauuuaacauaauguccuccaacuucauuuguguugccacaaaugauagaauuucauguuauuuuuauggcuaaauaguauuaugugguuaugugucuauguauguguguguguauaaauauacagacacagcacauuuucuugcuuuauucaucuguugauaggcaauuagguugauuccauaucugugaauagugcuauaauaaacauggaaguacauauaugauuuucuuuccuuuggauacauacccaguagugggauuacugcaucauaucauagucuauuuuuaguuuuuugaagagccuccauaguguuuuugauaauggcuguacuaauuuacauuccuuccaacaguagaguuccccuuucuccacaucuuugccagcaucuguuauuuuuugucuuuuugauaauagucauucugacaagggugagaugauaucucaucgugguuuugauuugcauuucccugaugacuagugauauugagcauuuuuuaauauacccauuguccauuuguauguuuucuuuugagaaauauugguucagcucauuugccuauuuuaagucagauuauuggcugggugccuugucucaugcuuguaauuccaacacuuugagaggcuaagguggguagauugcuugagcucaugaguucgagaccagccugggcaacauggugaaaccccaucuuuacaaaaaauacaaaacuuagccaggcgugguggugagcaccuguagucccagcuacucagaaugcugaggugggaggauggcucgagccugggagguggagggugcagugagcugggauggcaccauugcaguguagccugggcaacagagccggaccuuaucucaaaaaaaaaaaaaaaaaaaaacaccaaaaaacaaaacccaaaccagauuauuauuaguauuuuuuguuguugauuuuuuugucuagucuagauauuaauccuuuguugguuaauaguuugcaaauauuuucucccauccuguacaucauuucucucuucauucuguugauugccuccuuugcugugcagaagcuuuuuaguuuaauauaaucccauuugucuauuuuugcuuuuacugccuguguuuuugaggucuuccccauaaaauuuuugcccaaacaauguccuaaaacauuucuccuauguuuucuuucuuuuuuugagacaaagcuucauucuugucacccaggcuggagugcaguggcaguggcgcgaucucgguucacugcaaccuccgccuuuuggagguucuccugccucagccuccugaguagcugggauuacaggugccugccaccacgcccagcuaauuuuuugguauuuuuaggagagacgagguuucaccauguuggccaggcuggucucgaacuccugaccucaagugaucugccugccucggccucccaaagugcugggauuacaggcaugaggccacugugcccagccuuuauguuuucuucuaguaguuuuauauuuuggguguuaaauuuaagucuuucauccauuuugaauugauuuucuucuuucacaaaaaaggagguuuuuuuaauauggugagagauagggagcuaguuucauuuuucugcauauggauauccaguuuucccagcauuauuuauugaagagacucucucuucuuccaucaguguucuuggugccuuuguugagagucuguaaaugcguggauuuauuucuggguuauguauucuguuccaguaccaugcuguuuugguuacuacagcucuauauagaauauuuggaagcguguuagugugaugccuccagcuuuguuuuuguuuguuuguuuguuuguuuuuuugcucaggauuacuuuagcuauuuguaguuuuuuaaaugaauuuuagcauuguuuuugcuacuuuuggggagaaugucguugguauuuugauaaagauugcacugaaccguagauuacuuuugguaauauggucauuuucacaauauuaauucuucuaauucuugaacaugggagaucuuuguauuuuuucauguccucuucaauuuuuuuuaucaguguuuuguaguuuuucuuguagaaaucuuuuaccuucuugguuuaauuuauccuacguauuuuauuuuuuuguagcuauuguaaauggcauugcuuucuugauuucuuuuugugcuaguuuguuguugguguauagaaacacuacugauuuauuuuauuuuauuuuuuaauuuuagagaugggggucucgcuaucuugcccaggcuggucuugaacuccugaccucaagugauccuccugcuuuguccucccaaagugcugauauuacaggcgugagccaccaugcccagccaaaacacgacugauuuuuuguguguugauguuuuguccugcaacauuaccccauuuguuugucaguucuaagaguuuuuuuagaggagcuuuauauaggguuauaggguuuucuauauauaaguucauguugucugcaaauggggacaguuugacuuccuuuuuuccauuuuggaugccuuuucuuuuucucuugccuaauuguuuuggcuaggacuuccaguacuguguugaauagaaguggugaaaauggacauccuugucucauuugagaucuuagagaaaaagcuuucaacuuuuccuuguucaguaugauguuggcugugguuuugucauauauggccuuuauuguguguuuuuucuauaguuaacuuguugagaguuuuuaucgugaagggauguugauuuuaucaaaugauuuuucaugucuauugagauaaucuuuauucuauugauauuugauuuuauuuauugauuuauguauguugaaucauccuuacaucccugggauaaauuccauuugaucuuggugaaugucuuuuugcaucuauguucaucagggauauuggcuuacaguuuucuuuauuugguuuugguaucaggguaauguugaccuuguagaaugaguuuggaaaaauuccuuacucuucaguuuucugagagaauuggaaaagaauugauaguucuucuuuauauguuugguagaauucugcaaugaagccauuggguccugggcuuuaauuuuauaggagacguuuuauugcacauucagucuugcuacuuguaauuggucuguucagguuuucuguuucuucuugguucaaucuugauagguuauaucuauccagaaguuuauccauuucugguaaguuuucuaauuggauacacaguuauucaugauaaccucuaaugauccuuuguauuccugugguauuaguuguaaugucuccuuuuuuguuucugauuuuauuuauuugggucuuuuuuuuuucuugguuagucuggccagcaguuugucaauuucguuuauuucuuuaaaaagucaacuucucauuucauugauuauuuguauuuguuugucucaguuuuguuuauuucugcuuugauuuuuauuauuuauuuuccucugcuagcuuuggguuugguuuguucuuauuuuucuagcuacauuguuuauuugaaauguuucuacuuuuuugguguagguauuuauuucuauaaacuucccuuuugauacugcuuuugcuguaucccauagguguugguauguuuguuucuacuuuucauuuguuuccagaaauguuuugguuuccuucuuaauuucuucauugaccuauugguuguucaggagcauguuguuuaauuuccguuuacgauuucaaaaguuccuuuuguuauugauuucuaguuuuauuucauugugguccaaaaagguauuugauaugucuuuaauucuguuaaauuuguucagacuuauuuuguggccuaauacguggucugucaugaagaaugugcugaugaaaagaauguauauucugcagauauuggaugaaauauucuguagaugucuguuaggcucauucaguauaaaugugcaauuuaaagccaauguuuguuucuuuguugauuuuucugucuagaugaucuuucauugcugagaaugggguguugaagucuccaacuauuuuuuauuggaaucuauuacuccuuuuagaucaaauaguauuugcuugauguagcugggugcucugauauuggugcauauauauuuacaauuauauucuuuugcugaauugaucccuuuaucauuauauauugaccuuuuuugucuuuuuuuauaggguuuuuuuuuuuuuuuugaggcaggguuucacuccguccccccaggcugaaauacagugcugugaucuuggcucucuguaaccucgaccuuccaggcuaaggugaugcuuucaccucagccucccaaguagcggggaccacaggcaugugcugccauguccagcuaauuuuuuuuuuuuuuuuuuuuuuuuuuuguagagauggaguuuugccauguugccgaggcugguuucaaacuccugagcccaccuuggccucccaaagugcugugguugcaggcaugugcuaccaugcccagcuucuuuuuauaguuuuuaguuuaaauuaugcuuuaucugauaugaguauagcuauuccugcuugcuuuuaguuucuguuugcauagaauaucuuuuuccauccuuuuacauucaguccguaugugucuuuacaggugacaugaguuuuuguaggcagcauauaguugggucauguguuuuuaauccauucagcuagucuaugucuuuuaaguguagagcuuaaucuguuuacauucaggguuauuacugauaugugaagacuuacucuuuucauuuuguuaauuauuuucuguuuuuguguauucuuuguuccuuucuuccucucuuaauguuuauuauugcaguuuggugguuuucuguaguacagugguuugauuauuuuaucuuucuccuuuguguaccugcucuacuagugaauuuuauacuuuuacauauuuucauaauagugucuguuaucuuuuugcuuucagguauaggacuuuuuugagcacuucuuguaaggcugaucuaguggugaugaauucccaccauuuaaaaagaaaaagucugggaaagacuuuauuucucccucauuucugaaggauagcuuugcuggguauucuuggcaggcauuuuucuuuuuucagugcuucucaaauauaucauuucauucucuucuggccuguaagauuuuuucaaauaaaucugcuguuaucuaauaaagauuuccauauaugggauguaauacuuuuacuuugcaguuuuuauuuuuaauuuucuuuugauaagggucucacucugucagccaggcuggagugugguggugugaucacaguuugcugcagccuugacuuccuggguucaagugaugcccucaccucagccucucgaguucugggacuacaggcgcaugguaccaugcccagcuaauuuuuguauuuuuuguagagaugggguuucguuauguuggccaaacuguucucaaacuccugggcucaagcaaucugccugccuugacuucccaaagugcugggacuaugugcgugagccaccguaccuguucucucuugcuauuuuuagaauucugucuuugaauuuugacaauuuguaagucacaaaguuuaugguaacauacaggagaggugcuugauuuagauuguugucaucagggaaggguuccuagaaguccuaagugaacucagccuugaaggacaaugauuauauauuagcaagauaaaugaauuaggacauuauuauaaaugaagcagauaaaaguguauaaucagaugaaguacuuuccaguauuugaacugugucuuaagaauagcuucccuuugggaggcugaggugggcggaucaccugaggucaggaguuugagaccagccuggccaacauggugaaacccugucucuacuaaaaauacaaaaaauuaaccggguguggugauggguaccuguaaucccagcuacccgggaggcugaggcaggagaauugcuugaacccaggagguggaaguugcagugagccgagagagcaccgcuguaccccagccugggcaacugagugaaaacuccaaucucagaaaaaaaaaaaaaaaagaagagcuucccuggucaguagguuacagagcauuuuauuaauagauagagggagcagcaauaugugcaaaggcacuccaggucaaaagaguauauaauucacuggggaauugcaagugcuauaguuggguauuucugauaacuaccaggaauaaauagauacacaugauaagguuuaaauauauagcucuugaguagaaguguugagaaaugaaguuuggaaggaagggaguagccagauucuaagaguuuggacuuuauguuguauguaaaugcuuguuuuaucucaucaugauuguauagauuaaaaauuuuaauuagaaaaaagaaacauagucaaagcaugaaguuuaaugaaaaaaguauaccaauuuugaggaaagacaaaauauuugcuacuauguuuuuagccuaauugaaauguguugaaaucugaauuuaugccuacauugagaaugacaaauaauauucaaauuucuuuuguaccuuuagcagccuggaaguuuuucuagcuggucugguaguuuccucauggaugauaacaugucuaauacucuaaauagccuugacgagcacacuagugaguuuuacaguauggaugaaaaucagccugugucugcucagcagaauucacccacaaaguuccuggccguggaggcaaacgcuguguuauccucuuugcagaccaucccagaauuugcagagacucuagaacuuauugaaucuguaaguaaaaaauuguaagauuaucaaaaguucaauuuuaguuauaugauuucaugcucagaaacucaguuuuggacauugaccaguuuuauguuuuguaugccaugcuuaauuuuguucugauauuuugcaguggcuucuaggggaaaaaaguuuaaauuuuucucaaguaugugccuugugaggaauuuuuaaaaauuaaaaacuuaauucauuuuuuauuauauaaguuauacaagugcauuagagaaagcuggaaacuagagaaaacuauaaaaaagaaaauuaaaguccuucauaaacccagaguuaauaauuugauguauuccuuucagucuguguucuauacucagaaaacauuauauuuuuaaacccaaaaauacacuucuguauuauauuuguggauuuuuuuuuguuuuccacccugucaugagcauguuucuguuuccuuuuuuaaacuugauuuuuuuuuuuuuaagauggcaucucacucugucgcccaggcuggaguguaguggugcaaucucaguucacugcaaccugugccuccuggguucaagcgauucuccugccucagccuucugaguagcugggauuacaggugccugccaccacacccagcuaauuuuuauauuuuuaguggagaugggguuucaucauguuggccaggcuggucuugaacuccugaccucaagugauccucccaccucggccucccaaagugcugggauuacaggcaugagccaccaugccuggccuaaauuugaauuuuaggggcuuuguaguauuccaucaaaugaauauaagaaaauauauuuacccaacuauuauuauuggacauuuagguagugucuacuuuuucauuuuuuuaaaaaaaauuuuuuuuuaauuuuuuuauuauuauuauacuuuaaguuuuaggguacaugugcacaauaugcagguuaguuacauauguauacgugugccaugcuggugugcugcacccauuaacucgucauuuagcauuagguauaucuccuaaugcuaucccuccccacuccccccaucccacaacaguccccagagugugauguuccccuuccuguguccauauguucucauuguucaauucccauuuaugagugagaacaugcaguguuugguuuucuguccuugcgauaguuuacugagaaugaugauuuccaauuucauccaugucccuacaaaggacaugaacucauccuuuuuuauggcugcauaguauuccaugguauauaugugccacauuuucuuaauccagucuaucauuguuggacauuuggguugguuccaagucuuugcuauugugaauagugccucaauaaacauaugugugcaugugucuuuauagcagcaugauuuauaguccuuuggguauauacccaguaaugggauggcugggucaaaugguauuucuauucuagaucccugaggaaucgccacacugacuuccgcaauaguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucaagugucuuuuggcugcauaaaugucuucuuuugagaagugucuguugauauccuuugcccacuuuuugauaggguuguuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuugucuuuuguugccauugcuuuugguguuuuagacaugaaguccuuguccaugccuauguccugaaugguaaugccuagguuuucuucucggguuuuuaugguuuuaggucuaacguuuaagucuuuaauccaucuugaauuaauuuuuguauaagguguaaggaagggauccaguuucagcuuucugcauauggcuagccaguuuucccagcaccauuuauuaaauagggaauccuuuccccauugcuuguuuuucucauguuugucaaagaucagauaguuguagauaacgcggcauuauuucugagggcucuguucuguuccauugaucuauaucucuguuuugguaccaguaccaugcuguuuugguuacuguagccuuguaguauaguuugaaaucagguagcaugaugccuccagcuuuguucuuuuggcuuaggauugacuuggugaugugggcucuuuuuugguuccauaugaacuuuaaaguaguuuuuuccaauucugugaagaaagucauugguagcuugauggggauggcacugaaucuauaaauuaccuugggcaguauggccauuuucacgauauugauucuuccuacccaugagcauggaauguucuuccauuuguuuguauccucuuuuauuucauugagcaguaguuuguaguucuccuugaagagguccuucacgucccuuguaagcuggauuccuaaguauuuuauucucuuugaagcaauugugaaugggaguucacucaugauuuggcucucuguuugucuguuauugguguauaagaaugcuugugauuuuuguacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuuccuucuccugccugauugcccuggccagaacuuccaacacuauguugaauaggaguggugagagagggcaucccugucuugugccaguuuucaaagggaaugcuuccaguuuucgcccauucaguaugauauuggcuguggguuugucauagauagcucuuauuauuuugagauacgucccaucaauaccuaauuuauugagaguuuuuagcaugaaggguuguugaauuuugucaaaggccuuuuccgcaucuauugagauaaucaugugguuuuugucuuugguuuuguuuauaugcuggauuacauuuauugauuugcguauauugaaccagccuugcaucccagggaugaagccugcuugaucaugguggauaagcuuagugucuacuuuuucaguacuacagauaacauauaaagcuuugugcaaaaucaugauuaugucuuuagguuaaauugaauuucuggaucaaaguauaucaccauuuuuaacacguuccauacacauuaccaaaugauuaugcagaauuugauggugucuuccugaugugcaguagaaugugaaguuuuaugacgaaauauacuuuuugauaauaacuuaauuuuugauaauaacuuaucauuuguucuuaaaguacuuugacaguaagcuucaacuacugaauuagaugaacuauuauguauuuuggaaucauaggaaagccauaaucuguuccucuuaaauggucuugcuuaaaaaaaauguccaaggaaagcauuuuuacugauaaaaugaguuguuaauuaacucuguggaaaucaucauccuguguucaagagcagauuuaacuagguuacagcauuaacuuuauuaacaguuuaauuuauugcaggauccuguagcauggagugacguuaccaguuuugauauuucugaugcugcugcuucuccuaucaaauccaccccaguuaaauuaaugagaauucagcacaaugaaggagccauggaaugccaauuuaacgucagucuuguacuugaagggaaaaaaaacacuuguaaugguggcaacagugaagcuguuccuuuaacauccccaaauauagccaaguuuagcacuccaccagccauccucagaaagaagagaaaaaugcgagugggucauuccccaggcagcgaacuuagggauggcucauugaacgauggugguaauauggcgcuaaaacauacaccacugaaaacacuaccauuuucuccuucacagguagugguguucauuuuguuuauguuucuaaaugucaaugaguuacauuaaauuagaucuuuaacauccuuacuagcaguugguagcuuugauaacauauaaaaauaauguguuuaaauguauacuugagaauacugaacucugagagaauagaaaguaucucacaaaauguaguagcugcaaauauuuauuuauuuauuuauuuauuuauauuuuggagacagggacucacuuuguugccgagguuggagugcaguggcacaaacacggcucaccgcaaccucaaccaccgaggcucaagugaucuucccgccucagccccccaaguagccuggacuauagaugcgugccaccacaccuagcuaauuuuuguauuuuuuguagagaugggguuuuaccauguugcccaagcuggucuugaacuccugagcucaaguaauccaccugccuuggcucccaaaguguugggauuacaggcgugagccacugcucccgguucuacaugauauuauacuacaguuuuuagagggacauuuucuuuaucuuguagucccauaucuuuauagaacucaucagaaaacaagcccggaaagguaacauugauuugcccaaaguuaucuaaugcaaggcugagacuaagauccgguuuccugacugacuacuguucgauagauauaccugauaaagauuaaaguggccuuaccuauuuagaguaauuuguuuaguuugcccacugagguuuuuccuuuuaauguucuuuggaagaaacuuagauaauugcuuacuguaagaauuuaaugugucaagagguuuccuaaggaugucuagaacuaccuacuuacuuucuccucuuguaauaucccuggacaguagauguuuauguuaggacaguuuccuauugaacacuugcuaugcuccaggcuguuugccaaacgcuuuuuuuuuuuucuuugagauggaguuuugcucuuguugcccaggcuggggugcaauggcaccaucucggcucaccgcaaccuccgccucccggguucaagugauucuccuggcucagccucccgaguagcugggauuacaggcaugugccaccacgcccggcuaauuuuguauuuuuaguaaagacagaguuucuccauguuggucaggcuggucuugaacucccaaccuuaggugaucugcccgccucggccucccaaagugcugggauuacaggcgugagccacugcucccagccuccaaacaaucuucuuauagcaucucaguuaaugcucuuucaaaaggaguuagguggaauaaaauucugaaguugagccacuugucaaaggcaacaguuaguaagagaugaagcugauguuuucugaaaguguuuggcagaggcuacaaaguuuaaggaggaagaagggaguuuaauggucaaacaaacauggagaaugcugggauauuauuggagguauauuuugaggcuggggagauaagcaggaucuggcagaacacagaucucuaaaaauugugcacccaugcuucaggggaugccauuucuguagacuacaaugugaauagucuguucacucccagcccugcucucagaguuaaaaagcacuggagaaagugaaguaggcuugggcauacuagcaguuuucuauucuggaguuuugcaugcuagcaauuuuuguugaagugugaauucuaagguagaaguggcugaaagaugcuuauuucccauggcaaacugcuuggauuuuaucguguaaaagaggguuugauuacuaaucuuaggguaaaauaaauucaaguauucagagccagaagugacagagcuagacuucauucuaguuauaaguagcuuugaagccauuucuauggcuucauaucacuguuucuaaucuuuugacugcaaaaauaaauuaguauuucacaauuguaaauuauauaauuuagaaaauggacucuguuaugccaguuuugacugcuuagagguucuguucuguguucuagauaggcaaauuugccagacagcuguauuucuuaucagcaaagcauuauuauuauauucuaaauuaaaauacucucauagaaaaagccacuuaaggucauuuauuaauaagagcuaaaaaacuuguuuuuucaguuacacacuguuguacaaaacuguuacauuuaacacagcagcuguuuaugguuucuauagaucucuauuugauaauauacuguuuuuuaaauuuuuaguauuuuuuuuguaacuuuugaauauuuguuaaauguuucuugaauuccuauaugugcuaaacacuguucuaagagcuggggagacaaaaaugaacaaaccagacaaaaauuccuacccucauggagcauaauuuccauggaguauaaguguaauauuauucauaagcuuuuuuuaagagguaugaagaaauaauuugaaaaucuuaucaguuuaauauuuguguagggauuuugauguucuagaagucgucuuuaaacucucuucccuuucuaguuuuucaacacauguccugguaaugaacaacuuaauauagaaaauccuucauuuacaucaaccccuauuugugggcagaaagcucucauuacaacuccucuucauaaggaaacaacucccaaagaucaaaaggaaaauguaggguaaguagguauuaaauaauuguguuagagaaaauggggagcacaguguuaaaguagauuagcuuuuugugcauauaaauagcaaguaucauaauuccuauuccuacaggacuuagaauuuuuuuuguuuuguuuuguuuuguuuguuugagauggaauuuugcucucguugcccaggcuggaaugcaauggugagaucucggcucacugcaaccucugccucccggguucaagugauucuccugccucagccacccgaguagcugggauuacaggcaugugccaccaugccugguuaauauuguguauguaguagagaugggguuucacuauguuggccaggcuggucuuggacuucugaccucaggugaucugcccaucucagccucccaaagugcugggauuauaggugugagccacuguggccggccagaauuuuuuuuuuaaaucauaaccuuauguuuucuccuuaggacagugaaaaccaacugaaauauagugucaaacuuugauuucaaucauuucuaguacuuuuucaaacauuucuaguacuuuuuucuauauuaauucuuuuuuucuauuuuaagaugauugauugaaaucagaauuaccauaggugggcauacuuuaaaauagucuuagaauguuuaaaugaagcauauauauauguguaagaaaauuuagcgugugcuuaaauugcuuugcuuucauuaacuuguaugaaaucagaucgugacuauaacauaaauaucuaaaugacuggauagguuuagaacaccuacuauuagaagaucuauacuggguaccacaccaagaacuccuacuccuuuuaagaaugcgcuugcugcucaggagaaaaaauauggaccucuuaaaauugugguauguauauucauuuuauuuuuaauaauuuuccuaauuuuaauaaaacacaaauuaugauuuuuaucacuuugauuuuuaacauuuaaaaaaagauauuuacugaaacagauacaaagcuuuaucuuuugauuuucaagguuuuuuuuuuguuuuuuuuuugagacggagucuuacuuugucgcccaggcuagagugaaguggcgcgaucucagcucacuguaaccuccacccccuggguucaagugauccucaugccucagccuccuuaguagcugguauuacaggugcccgccaccacacccagcuaauuuuuguauuuuuaguagagaugggguuucaccacauuggccagccuggucuugaacuccugaccucaggugauccaccccccucccccccaccucggccucccaaagugcuaggauuacaagcgugagccaccacaccuggccuaauuuucaaguuugaauuuguguucaccuuuuucuuuaacuuguaaauaaacccuugcuuggcuuguuuugaauucuuaacuuuauagcaucuagagaaaacaucaggugucaguggaacucuuuuccuuuuuccuuuuuuuuuuuuuugagacgcagucuugcucugucaccaggauggagugcaguggcucauucuuggcucacugcaaccuccgccuccuggguucaggugauucucccccagccuccugaguagcuuggacuacaggcuugcgccaccacgcccagcuaauuuuuguauuuuuaguagaaaugggguuucaccauguuggccaggauggucucgaucuccugaccucgugauccacccaccuucggccucccaaagugcugggauuacaggagugagccacugcgcccugucggaacacuuuucuuaauacugaaauauacauuuuaguaguuucagucaugguuacauguauuagaauaaaauaauuuuaauauuuugauauacugaagcacuuucaugauaauauuuaggaaacuaaucaggguaccucuuuaggaaacuaauuaggaaaaggcucaguuuccuuuucuaugcaaaggagaucauaaaacacaccccaaauuguuauugugaagcugaaagagaugauguaauuaaaggggcuugucugaguuucaaguacugugugcuugguugcugcuauuauucuaauaauaguauuugugguaguaguucacgaaugaauaggacugggaaguguucuaguuacugugcuuucauauaucuuaccaccuuugaaauaccuuggaacagugaugggcauuuuaggcagauacagauuucugacaaguucuuuagaaauacgauuuuuaaaauauugguaacuuccaggguuuuuuaguuauguucuucuauuuuuagucacuuuuugguuagauucauuaacaaauucuaguuuacuugauuuaauuaauuuucugcccaaaagcauguuacacacgcacaucuucuagucuuuuuuucaaaauacuguguuaaaggguacguaguaggguugaucaagucuuuuugucauuuagcuccauguacugcugugaacaaucauauuuccuuuagagcuuccuagaguuuuuauuuaugcguauacauuaauaaaacaagaguaugaccacacuuuauuauuuuauaacacuuuuuuaauuuaaccaaguaaauguauauauuuaucccauaauuuuuaacguuugcauaauauuccauuguauggaauuaccugauugauuuaggcuguuucaguguuuugcuguuuauuuuaaaaauucaucauuaauucagcaaauauugauugagugccuaauagguuccaggcacuguacuaggcuuuagggauggaaagaauguugaaaaggucaaguaugguuccugccuucauagggucauguagacuaauuggggauuagacaaguaaacaaugauuugaaagcauuuaaaaauucugcagugagucagggucauuuggugaacauauaaguggaauaaaaauuauaauuugauagcugggugugguaguaugcucuuguaguaguccuaggagguuuguuugagccugggaaguggaggcuacagugaguggugaugaagccacugcacuccagccuaaaggacagagugcagcucuguuugaaaaaaaaaaaaaaagacaaaaacaaaaguauauuuguaauagguuucaaauaccuaaaguccuuguccauuuguuuacuagccuucugacauuuuaaauuuaauaccagcagcacucacagcucuuuggauagaauuugaccauugccaaaauagauuauuugcaucagcaauuuaagauaaaaggaaggcaaugauuuauaaauuaaaauuccuagaauaucuauaggcucauacaucucuuugcaguaagcugacuuuucauuucuccugcuccuccuccaguuauuuacugagcaucuacuauaugcuaaccacuuagcuuucuuuuguaucuuacuaugagucaaaugcacuucuuggagauuggcuuuggaauuuuaaucagguauaucuuaaauaucuguugcccuuuuaauaaaccgauucuuuuaauauuuacuauaaauuacucaaaaggcuaaaaacuguagaaauauuaaguuugguaguaucaaaccugaaaaguauuaaaugcaggaguucuuugcuuuugacacauuagaacaauuaagagaauaauucuugcuagugaaugaauuaaucugucuuagcccuauucuaggacauuuguauucuuaaagggagaaaaaccuccagaucuuuuuaagaauacuagacuagaucaagaaaaugugggcuggaugcaguggcucauaccuguaauuccagcacuuugggagaucaagacaggcagaucauuugagcucaggaauucaagaccagccugggcaacauggugaaaccccaucucuacugaaaauacaaaaaaugaacugggcaugguggugugcaccuguggcucuagcuacuugggagacugaagugggaggaucgcuugacccugggagguagagguugcagugagcugauauuauaccacugcacucuagccugggugacagagugagaccccaccucaaaaaaaauuaaggaaaaaaaaaaaaaagaaaaugcgguacguaugcaccauagaauacuaugcagccauaaaaaagaaugaggucauguccuuugcaaggacauggauagagcuggaagccauuauccucagcaaaccaacacagaaacagaaaaccaaauacugcauguucucauuuauaaaugggagcuaaaugaugggaacauguggacguauagagaggaacagcacacacuggggccuuucagagaguggaaggugggaagagagaggaucaggaaaaauaacuaauggguacuaggcuuaauacuugggugaugaaauaaucuuuuuucuuuuuuugagauggaguuucacccuuguugcccaggcuagaguguaguggcgcgaucucggcucacugcaaccucugccuucuaguuucaagcgauucuccugccucagcuucccaaguagcugggauuacaggugcccaccaccacccuggcuaauuuuuguauuuuuaguagagacgggguuucaccauguuagccaggauggucuugaacuccugaccucgugaucugcccgccucggucucccaaagugcugggauuacaggcaugagccacugcgcccggcugggugaugaaauaaccuauacaacaaccccccauguuuacuuauguaacaaacaugcacuuggaccccugaacuuaaaaguuaauuugaaaaaagaauacuuuauguucuuggugaaauaccaucauuaaaaagcucuuugagaccgggggugguggcucacaccugugaucccagcacuuugggaggcugaggugggcaaaucaccuccugaggucaggaguuugagaccagcuuggccaacauggugaaaccccgucucuaguaaaaauacaaaaaauuagccaggcguuguggcagguugugcuagcuacucgguugaucccagcuacucgggaggcugaggcaggagaaucgguugaaccagaggguggggguuguggagguugcagugaacugagauuaugcuacuacacuccagccugggugacagagcaagauuccaucucaauaaauaaauaaguaaauaauaauaauaagcucuuugagaaguauacggaaacacuaacauaauuccuguaugucucagucuagaugagaauacuuuuaacauuuguuuucaucuuaaaaguuuuuguaagugcugugaaaucucauuuauauaugaauaccauucucucuaacuuugcuggcuggggacauaagcugcugguguuuuuuuguuuuuuguuuuguuguuguuguuuuuuuuuuuuuuuugagacggagucuggcucuguugcccaggcuggaguccaguggcgugauuucggcucacugcaacuucugccuccuggguucaagcaauucucaugccucagccucccggggugcacaccaccacccccggcuaauuuuuguguuuuuaguagagaugggguuucaccauguuggccaggaugaucaugaucucuugacuucaugauccacccgccucagccucccaaagugggauuacaggcaugagccaccaugcccagcagcugcugguuauuaagugcugccaguucuuuuauuuaguagagguuuuauuaccuuuucaaguauaucuugguuaugaaagguauaaguuagauauaauuuuuaaauuuuuucuggguuauaaguugugcuuaccuauuugacagaaagcuagaugaauaauauuuugagacuauuucaucacucagcugacacucaagugucuaucucucuguaaccuacccucccacacuacacacacacacacacacacacacacucacucucucugucuucuuggauacugugucagcucuuugcuuaggcuagguauacaaagaugaaaaugaccugaccauugcucucaaguaucucacaaucuuggugguaacaaacguguuaacuaguaauuacauacuauguaauaaguacaauaaaaguagaauaagagcuaguguauucccaauauguucuauauuuccuguuuuuauguaaaaaaaacuugagaaauaacaucuuucuuuucuguuuaauucugaagauccugaccugaagcaggagcuacagugguuuccccaaaaggaagauuuuuguuuaguagccuagaaagaagaaauugcuauucuuuacucaguacuugcaaauguauaauauuguuuugccacaacaugaauuaauuuaauuaauguaucuauaggggcuaggagaaaauuaugacaauaauggacaaguauaaaagauggguuuccuauauauagggagaaaaaggaauugcuauaaaugacuuuuuacaacauuuuaaaaaacaauuuagucccagccacuugcuuucuuggaagaagauauucgggaaguuuuaaaagaagaaacuggaacagaccuauuccucaaagaggaagaugaaccugcuuacaaaagcugcaaacaagagguaaucuucuaguauuauuguuaauaaaagucuuauuguauccaagagacuuugccauaaagcuucuacauaaauuacucauucuagaauaccgcuucugggaagaaagucagaaaaucacuagucuuagauaauugggaaaaagaagaaucaggcacucaacuguugacugaagacauuucagacaugcagguuuguaaaggauuauuauuguuguuauuuuaaaugguugcuuuaaguccuagagguucuuauuucuuacucauuguguagccaguucauuagaaauucauggagaauuuuuaucuuaguaucauuuugccuaauucacagagaaacuauucacuguagagaauauuuuauuuacuuuuuuuuauauuucuuuuguuaugagaggaguuagcugccuuauaucugaugucaaaaaaucguaguucucaagauuuuaaauaucaaaguuuaucuuugguucauuuccaaaauaauauuacuacauuacuagaaauuucaucagagccaaaugcuuucuuggagggaaauaaacagggcuuccauuaccacuuacucaguagucccuccauuugucuccauuuuugaauuaguuauuuuccucuuucuuuuuucucucuuagucagaaaauagauuuacuacauccuuauuaaugauaccauuauuggaaauacaugacaauaggugcaacuugauuccugaaaaacaagauauaaauucaaccaacaaaacauauacacuuacuaaaaagaaaccaaacccuaacacuuccaaaguugucaaauuggaaaagaaucuucagguauggauuuauaaauuucuuuagugauuuuuguuuuuguuuagucaaugaucacuuuggauuuacugaucacaaauuauacuuuuucuuuuaaauucaaaauugauuguaacaguaacuaaacauuuaccauuauuuuaucacucacauuuggguuugagcgacucauucaucagggcacauauaaacuaaacaauugaagcuguaaccaaagacuggucuggugauuuccuaagcacuguaucuuuuuuaaacuaaagauauauaaaucuacuucuggcaccucuucuccuguaacaaauauguauagcccuaauugcuauucugaaaaaggguaagugguuggaagcaguuucagcaugauuuuguugguaccaugguuuccagugaacuuuuuggcucagaaguuguaaaacaaaguccuuuuuuuuuucuguugggauacgaccaguguguaacugcaaaugaagguuggaaaaauuuuuacugcauuaagaguuuaccccagagaauuugagaguucauugaguaggaaauuuucuucuuuaugccacagugacugcagcacuaguauuccugauauugaagcauaccuugaaaacgucuuuggcaauuacauaugaccaccuuacaucuguuuucagccacugcuuucuaagagccauguagcacauucucuuaauccauguaaaaugauuugaguuccuggcguuuaauuaacauagaacuuuuggggaaaguuauuauauagaagaucacaucuauaacauaguaaucuuuaaaauaagggaaggaaaaaaacauaagcuugauuuuuuguuaugaauauauuuccuaauuuguaaauaaagcauucuuggcucauuuuuugacauuacauccucucuuuaaaucuuuugcaaaauuuugaagcaauaaagacuaacauuuauuuccauguuaagacucauuugauuuggggggaauuauuggggacaagacuuuuaaacugccuccauaggccuguaagcaauauagauagcuaaaauaauugacuuuuuaaaaacuugauaaaaaauauuucaguauauauuuuaaaacauuauuauuaaaaaaauacagugccauuguuaaaacauuuuuauaauuauuguuuauaaaauaucuaaucaguuaaaauaacugacuuuaagagucuaauugugauauagauagcuauuuuaauaauuuucaugucacuauuaauauuuccuuucuagucaaauugugaaugggaaacagugguuuaugggaagacagaagaccaacuuauuaugacugaacaagcaagaagauaucugaguacuuacacagcuaccaguaguacuucaagagcucucauacuguaauuguuauuaaaauugaugaaaugccccacucccuuacugcagucucuacuaaauuagguugcagugaaauuuuucucaauuaguuguuuuuaaaguuguaagauagcccuuuuaauacagcaucuuuuuucuauucuauauaguaggcagaaagcuaguaagucacuuaagggguagauaguuucauaguuuauuuuuuaagagaugagauuuuuaaaaauuguuuuuaaagaacaagaugggaaaauaauagaauguucauggauuucuaaaaguaaauucucauauauuuucuucacaagauauauguugcuacucucuugaugcugcaguuuuguuauagauagguguaugaguauauaugauuucugaaauuagucuauguauggaaagcacacaugauuuuaugaaguacuuuugcccaugugcugauuuacuuaggcuaccauuuacaaagaaacacauugaaaaggaauuuaaaggaaggauagaaaguugcacuacuaauuuuuuguuuuuuuuuucagaagcaguaaaauuaacuacaguguuaaauguauuuauuugagcauaguacugaaaacaaaaagcauucaaaaaagaguuuuuucuuuauuaguaaauaguauuuucuuaaucucagaggagcugagaguuuuguugaauguauuguacaguauguaggagcaggagaacuuuguaaauuggaaagaagucuguuuuuauaauuuauuuuuauuuuuaaagcuuaaauguagauauuuauacguauacagggugccuagaagccaauguuguuuccuguuauuacagcuaacacaguaaagaauaauuuugacuuuaaguaugaaacaguaguaaguuauagcugcaaagaauacaauaucuauacuguaugucacaucuaccuaaauguugcacuaugcccuuuaaaucaugcugguuauaaaguaguucuaaaaauguacuaaauaauaauuuaauauuuucuuuuuaaauuauaucggggguggucauauacauuaaucuggugauuuguauauguguuugaaauuuuugcauuuuguuuaaa
